United States Patent 9,353,359 (BACTERIAL ANTI-PHAGE DEFENSE SYSTEMS) - sequence listing, part 2

SEQ ID NO: 2066 - DNA, 3618 bp, Azotobacter vinelandii DJ
atgaatcgcctgctggacttcctggcgcgcgcgctcggcctgatcctcggccggcagttgtgggtcctgctggggctggcggcgctcgtcgcgctgatctggctggtcgggccgctgatcgccatcgacggctaccggccgctgcagagcgaccggctacgcctgggactgatcgcggcgatgctgatggcctggctgatgcgcgtgctgtatcgcacctggcgctcggcgaacctgaacgcgcaactgctcaaccgggtgcgcgagccggcggagggcgccgcgacgacggccgatccgcacctggaggaattgcgcagccgcttcggcgaggccgcggaacggctcaagggcgcccgcttcgccgcgcagggcggcagcggctgggggcgctggctggagcgcatctcgcggcaatacctgtatcaactgccctggtacctgttcatcggcgcgccgggatcgggcaagaccacggccctggtcaactccgggctggatttcccgctcgccgaccagttcggcaaggccgcgatccgtggcgtcggcggcacccgcaattgcgactggtggttcaccaacgaggcggtgttgatcgacaccgccggtcgctacaccctgcaggaaagccatcgcgagcaggaccagaaggaatggctgggcttcgtcgagctgttgaagaagtaccgcgcgcgccagccgatcaacggcgtgatgctcaccgtcagcaccgccgacctgctcagcagcgacgaacaggagcgcacgcagcacgccgtccgactgcgccagcggctgcaggagctgcgcgcccaactgggcatccagttcccggtctatgtgctggtgaccaagatcgacctgctgtccgggttcaccgaatatttcgcccgcttcggccgcgaggagcgcagtcaggtctggggcatgaccttcccgctggaggcggtgcgcgcgccggacttcgacctgcggcgggccttcgccgacgagtaccggctgctgctggagcgcctgtacgccggtctgcccgagcgcctgcagggcgagcaggaccctctccagcgcgagctggcctacctgctgccccaggagttcgccgggctgcaggcggtgctggagcgcttcctggagcaggtgttcgtcgagtcccgcttcgaggccaatgcgctgccgcgcggcgtgtatttcaccagcggcacccaggaaggcacggtgttcgaccgggtgatgggcggcatcaagcgcctgctgcagctcggcggcggcgcgcatctgccacaggtcggcgagccggggcggagtttcttcctgcgccggctgatgcaggaagtgatcttccaggaagccgccctggccgggcgcaacgagcgctggcagcgccgccaggcctggctgcgtcgcgccggccacgcgctggtgggcgtcggcgtgctggcgctgggactggcctggttcaacagctatcgccacaacctgcgccatgtcgaggaggtgctggccagggtgccggcggtggcggagcggatcgccgggatcaaggtggacgaccgggcgccggtcggcgccctgatgccggtgctcgaccaactggcttcgctgcacgccagcagccgcttcgacgtcgacgacccgccgctggatcaccgtttcggcctgttccagggcgacaagctgcgcgccgcggccgacggcgcctatgcccgcgcgctggaggacgtgctgctgccgcacctggcgcgccgcctggaggacggcctgcgccaggcgcggcccgacgatgtggagtacgcctacggcgcgctgaaggcctacctgatgctgtacgaggcgcagcattacgacgccgattacctgcaggcctggctgtcgttcgacatcgagcgcggcctggacgggcggctcgccaacgaccggcgggaggcgctgcgccagcatctggcgcggctgctgggcggtcgcgcggtcagctcgccctatgcccgcgacgacgcgctggtcgcccaggtccgcggtcgcctgctcgggcatggcttcggcgagcgcagctacggcagcctgaagcgcgcgctgcgccacgacgaacgcctgacggatttcaacgtggccgaagtcgtcggcccgcaggccaccctggtgttcctgcgggtcagcggcgccagcctgggcaacggcggcgtgccgggactcttcacctatcgcggttactgggaagtgttcgccccgcgcatcgaagacgacctcgtcgcccgttcccgcgaggagagctgggtgctgggcctgccggagctggaacgcatcgatccgcagaccctggccaagtgggtccgcgaggtcaagcggctgtatttcgacgactacatccgcgaatgggaaggctacctggccgacctgcgcctgcgcagcggcgccgacctggcgcagaacatccagatcgcccgcgccctgtcggcggccgactcgccgctggtgaaactgatgagtgccgcagcgcaggagaccaccctgctgcgcgcgggcgaagacgaccggcgtccggcggccgagcaggccagggaccgggtcggcgccgcgcgcgaggcgctggaaagcctgttcggccggcccgaatcgagcgcggacccacgcccgtccgccaccgagcgtcccgaacgggtggtggacgagcgcttcgccgcgctgcgtcacttcacccggcccggcgagaagggcgagccggcgccgatccagagcgtgcgcgacaccctgaacgagctgtacatccatctgatcgccaccgacacggccctgcgcgacggccagacgccgcccggtgacggggtgctgaacaaggtccgcgcggacgccggccggttgccgctgccgtttcgcaacatgctcaacgaactcgcccgggtatccgacggcaacgtcagccgcgtggtgcaccggcagctcggccagaacgtcgcggcgaacgtcggcgacttctgccggcaggcggtcgacggccgctatccgctggcgcacggctcggcgcgcgacatcagcccgaacgatttcgcgcagctcttcgcgccggccgggctgatggacgagttcttccagaaaaacctcgccggcctggtggatacctcggtgcggccctggcgcttcaagggcgaggccggcggccgggccgcctacctgcaatccttcgagcgcgcggcggtgatccgcgacgtgtatttcgccggcggcgggcgcaccccgtcgatccgcatcgaactcaagccgctgcgcatggacgccggcatcgcgcagatcctcttcgatatcgatggccagaccctgcgctacgcccacgggccgcaggtaccggtccaggtccagtggcccggtccgggcggcggcaaccgggtgcggctggaggccagcgggccggacggtaccagcaaggtcctgctcagcgaaggaccctgggcgctgcaccggctgttcgaccgggccgccctggcgcccggcggggcgccggagcagatgatcgccaccttcgacatcggtggcgccaaggcggtgtttcaggtgaccgccggcggcgtgcgcaaccctttccggctggcgcaactggaatccttctcctgtccgaggcgctcatga

SEQ ID NO: 2067 - DNA, 3636 bp, Variovorax paradoxus S110
atgctgcgcgcgattttccgttttctcgtgagccgcgacctgtgggtctttctcgggctgctggccgttgcgttcctgatctggatcatcggccccgtcattgcggtgggccgctaccggccgttcgaaagcgagttcgtgcgcatcgtggtgatcgcgctgatgttcgcgatctggatcgcgcgcgtgctctaccgcaagtggcgcgagcggcgcctcaatgcgcagctgctcaaccagctgcgcacgccgtcgcccaaggagaaggccgccaagcccgaggatgcgcccgagatcaaggagctgcaaagcggcttcaccgacgccacgtccatcctgaagaacatgcgtttcggcgccgatgccggcggcaagcccgcggggcgcttcgcgctgttcgaccgccagtacctgtaccagctgccctggtacatcttcatcggcgcgccgggctcgggcaagaccaccgcgctggtcaactccgacctcgacttcccactggccgaccagctcggcaaggccgcggtgcgcggcatcggcggcacgcgcaactgcgactggtggttcaccaacgaggcggtgctgatcgacaccgccgggcgctacaccacgcacgagagcaaccgcgagaccgacgagggcgagtggaagggcttcctcgacctgctcaagaagttcaggccgcgccagccgatcaacggtgccatcctcaccatcagcattgccgacctgccgctggccgacgacgcgcagcgcgcgcgccacgcgatggcgctgcgcaagcggctgctcgaactgcgcaacggcctgggcatcaattttccggtgtacgtgctggtcaccaagaccgacctcttggccggcttcaacgagtacttcggcgcgctcggccgcgccgagcgctcgcaggtctggggcttcaccttcccgatcgatgccaaccccgcagacccggccaaggccgacctgcgcgagcgcttccaccaggaatacaagctgctgcaccagcgcctggacgagcgcctgccggaactgctggcggccgagcccgaccagctgcgccgcgcgcaggcctacctgctgccgcagcagttcgcgagcttcgaggacatcctgggcaccttcctggccgacgtgttcaacccctcgaagttcgaagtcgcgccgatgctgcgcggcgtgtacttcaccagcggcacgcaggagggcacggctttcgaccgcgtgatgggcgcgatcaagcgctacctgcaggtcaacgcgccgcccgcgccgccgccgggcccgggcaagagctacttcctcaaggagctgctgcagcaggtgatcttccgcgacgcgggcgtggccggcaccaacctgcgctggtaccggcgcaagcgcgccatcgacctcgcgggctacggcctcatcggcgtgctgctggtggtggtgctgggcgcctgcgtgaacagctggcgcaacaaccgcgactacgtggccgaggtcgacaccaacgccaaggccttcaacaaggccgcggcgcgcggcgaactgccgacggtggtcgattccaacagcgacatcgcgagctcgctgcccgtgctcgaccgcctgcgcgacctgcccaagtcgagccatttcgacatcggcgatccgcccatgggctatcgcttcggcctctaccagggcgagaagctgcaggccgcgaccgacggcgtctaccagcgcgcgctcgaaggcgtgctgctgccgcaggccgcgcagcgcgtggagcaggcgctgcgcgaggcctccaagaccgatgccgaatacagctacgaggcgctcaaggcctacctcatgctgtacgacgcggagcgctacgacgccgactttctccaggcctggctgctcaccgacgtggaccgcaagatcggcgccggcctcacgcgcgagcagcgcaccaacctcgagtcgcacctgaaggcgctgttcgccgaacgcgtggtgacctcgcccttcgccaaggacgaccggctcgtcaccgagacgcgcaaccgcctggccggcgtgccgctggcgcagcgcgcctatgcgcggctgcggcgcatcctgctgcagaccagtccgcccaatgccttcagcatcgcggaggcggcgggggccgagtcggcgctggtgatcaagcgcacgagcggcaagccgctcaccgacggcatcccgacgctgttcacctaccgcggctactgggacatcttcgacaagcgcatggccgagaccacgcttgcgctcgaacaggaagaccgctgggtgctgcagatccgcgcgcccggcatggccgacatcacctcgcgcgagctgctgctgcgcgaggtgcgccggctctacctcaccgactacatccgcgtctgggacgactacctgctcgacgtccggctggccgacagccgctcgctgctgcagagcatccagatgacgcgcgtgctctcgaccagcgagtcgccgatgtcgcgcctcatccgcggcgcggcgcgcgagaccgacctgctgcgcaaccacgacgaagccacgcgcagcctgctcgaccaggcgcagaaccgcgtggccagcacgcgcgagcgcatcgagcagctcatcgggcagcccgacggcagccagcgccgcaacaccgtgccggaccgccccgaatcgctggtggacaaccacttcgcgccgcttcgccgcatggtcaccgcgcccaaggccggcggccaggcgccgatcgacgcgacggccgcgctcatcaacgagctctacaccttcctcaccgccaccgacacggcattgcgcagcggcaacatcccgccatcgagcgacgcggtcaccaaggtgcaggccgaggcgggccgcctgccggtgccgttccagggcatgctgaacgacctctcggccaccgcgtcgtccaaggcggcggcggtgacgcggcagaacatcgggcagaacgcggccgccaccatcggccagttctgcagccaggccattgcggggcgctatccgttctcgcgcggctcgaaccgcgacgtggccgccggcgacttcgcgcagctgttcgcgccgggcggcatgatggacgacttcttccagaagaacctggcctcgcaggtcgacacctccgtcaacccctgggccttcaagaagggcgtggacggcagctcgccggggcgctcggcgtacctcgattcgttccagaaggcgcaggcgatccgcgacgtgttcttctcgggcatggcgggcgggcgcacgccctcgttcaccatcgacatccggcccgaggacatggacgccgccatcagccagttcacgctcgacatcgacggccagacggtgcgctatgcgcacggaccgcaggcgcccagcaccgtcaagtggcccggcccgcgcaacagcaaccaggtgcggctgcaggtgacgaccgccagcggcacgccggccggcggcatcgtcaccgaagggccgtgggcgctgcaccggctgttcgacaaggcctccatttcgtcgggcagcgcgcccgaatcgttcaacgcgaccttcgacctgcaaggcaagaaggtggtgctcgcggtgacggcgaacagcgtctacaacccgctgcgcctgcaccagatgaacggcttttcgtgccccgggaaatcctga

SEQ ID NO: 2068 - DNA, 3600 bp, Variovorax paradoxus S110
atgatcaagaaaatcttcggcttcctgttcagcccgctgctgctgacgctgctggcgctggtcatcgtcgcgctcctgatctggtggatcggcccgctggtgaagatcggcgcgtgggtgccgctcgaaagcgagctcgcacgcgcgctgctgatcggggccatcgtgctcgtcgtggtgctgcgcgcgatctaccgccgctggcgcgcgcgccgtgcgagccagcacctgaccgacggcctcatgaaggcgcccgccgccaaggccgatgcgccggtcaacggcgagcagaagatcctggacacgcgcttcagcgaagccgtggccacgctcaagcagatgcgtctgcatgccgcgggcaagaagcccggctggcgcgactggctctccatttccggcggcagctacctgtacgacctgccttggtacgtgttcatcggcgcgcctggcgcgggcaagaccacggcgctggtcaactcgggcctctcgttcccgctggccgagaagttcggccccggcgcgatccgcggcgtgggtggcacgcgcaactgcgactggtggttcaccgacgaggccgtgctcatcgacaccgccggccgctacaccacgcaggacagccaccagtcggaagacaagagcgcgtgggagggcttcctcggcctgctcaagaaggcgcgtccgcgccggccgctcaacggcgtgttcctcacggtgagcgtggccgacctgctgagccagggcccggagcagcgcacgcagctggccgcgtccatccgcgcgcggctgctcgagctcgatgcgaagctcaccacgcggctgccggtgtatgtgctggtcaccaagagcgacctgctctatggcttcaccgactacttcgacgacctcggcaaggagcagcgcgcgcaggtcttcggcttcacgctggcggccgacgagaacgtgcaggccgacgagaagggcctgtccaccgccttccaccgcgagtttgcgctgctgcacaaccgcgtcaacgacgggctcatcgcacgcatgcagcgcgagaccgacggcacgcggcgcgcggcgatcttcggctttccggcgcagttcggctccatcggctcgatgctgtcggacctgctcgaccaggtgttcaccggctcgcgcttcgcgcagccgccgtgggtgcgcggcgtgtacttcaccagcggcacgcaggaaggcagcccgatcgaccgcgtgatgggcagcctcgcgcgcagcttcggcatcgagcgcgcgatgctcgcgccgcagaagtccagcggccgcagctactttctcactgcgctgctgcgcgaggtggtgttccccgagcagcgcctggccggcgccaacgtgaagctggagcgccgtcgccatgcgctgcgcatggcgggcgtggcggccatgacgctggtcacgctcgcgctgctcgcgggctggggctacagcacgctgcagaacctcaactacctgaagtcggtcgaggcgcgcgtcgagcccgcgcgccagaccctcgcggccctgccttcgcgggtgcagaacctggtcgaggtggcgccggtgctgcagggcctgcgcgacatctggaagacacccgacaaccgccagggcgacgagccgctgtcgatgacgctcggcctctaccagggcgacaagctcgacgccgccgccatgctcacgcaccagcgtgcgctcaacgacgccttcctgccgcagatcgccaagcgcatcgaggaccagctgcgcaccgcgcagaaggacaacctcgaatacacctacgaggcgctcaagagctacctcatgctctaccagcccgagcatttcgatgccgaggcgctcaaggcctggatcacgctcgactgggcgcgcagcctggaccgcggcattcccgaagaccagcgccaggcgctcgaagaccagctcgacgtgctcattgcccagggcccgccacgctcgccgctcaagatggacgagaacctggtgcgcagcgtgcgtgccgtgctcgcgagctatccgctggagcagcgcgtgttcagccgcctgaagcgccagcgcgccaccaaggacattccggccttcagcattgccaccgccgccggcccctcggcgccgctggtgttcgagcgcatcagcggcaagccgctgaccgaaggcgtgccgggcatgttcacctacgacggttatcacaagcgcttccagaatgaagtgacggtgctcaccggcctgctcgcgcaggaagacccgtgggtgctcgggcaggaccgcagcgctgccgaccgcatgcgcgacgtggccgcgctcggcgcgctgaccgaccgcgtgcgccgcctctatcttgcggagtacgtcaaggtctgggaggcgctcctggccgacgtgcggctgatccgcgccagcgggctcgagaagaacatcgaggccgcgcgcattctctcgggcgtgggctcgccgcttgcgaacttcttgcgcgcggtggtgaaggagaccacgctcattccggccgaccagcccaaggacgtggtgagcaaggccaccgccaccgtcgcgagcacccgcaagggcctggaagacctgttcggcggcgaccccaacaaggccgtggccagcggcaagcgcatcgagagcatcgtggacgaccgcttcgagccgctgcgccgcctggtcaccgcggccggaccgaaccagcccgcgccaatcgacgatgcgctcaagctcttcaacgaggtgtatgtgtacctcacggccgtcgacaccgccgtgaaggggcgcacctcgccgccgcccggcgacgtggccggcaagctcaagtccgacgcgggccgcctgcccgagccagtgcgcaccatggtggagaacctgagccagtcgggcgcggcgcaggcccaggtggccgagcgcggcaacctgagccaggacctgcgtcccgtgaccgacttctgcaaccgcgccatcgcgggccgctaccccttcgtgggcagcagcaagcgcgacgtgctgcccgaggacttcggccagatgttcggcgccggcggcctgatggacgagttcttccagaagcggctggccgcgctggtcgacaccagcaccaagccctggcgctacaagcccgtggccgaacgcggcgccgtcaccacgcaggcgctggcgcagttcgagcgggccgcgcgcatcaaggacatcttcttccgcggcggcggccgaggcccgtcgatgcggctggacttcaagccggtggagatggatgcgggcatcacgcaattcatcctcgacgtcgacggccagctcgtgaagtacgcgcacggcccggtggtccccatggccgtgcagtggcccggcccgaagggcagctaccaggtgcgcatccaggtgagcccgccttcggccaccggcagttcgggcgccgcggtcgatgggccatgggcgctgttccgcgcgctcgacgacggccagctcgaagcgggcgatgcgcccgagaagttcttcatcaccttccagatcggcgcgcgcaagacgcgcttcgaagtgacgacgaacagcgtgcagcatccgatccgcttgaaggagctgcgcgagttctcctgtccggaggggctgtga

SEQ ID NO: 2069 - DNA, 1233 bp, Colwellia psychrerythraea 34H
atgtttagaatttcacaattattaaaaacacttcatgacgacatggctgaacttaagcctgttaaagcatcacgtaaaatgaagggtcctgtggttatatggaacctgatccgtcgttgcaacttgcaatgtaagcactgttattcaacctctcttgatatcgactttaaagacgaactatcaactgaacaagttaaaaccacgatagatgatttaaaagttgctcatgtacccgtattaattttgtcaggtggcgagcctttattacgccctgatatctatgaaattactgaatacgctaagcaaaaaggtttttaccttgcactgtctaccaatggcactttaattaatgaagacaacattgaagccattaaagccgcagaatatcaatatgttggtatcagcattgatggcttagaagagttccacgatgaattccgtcgtcaaaaaggcagttttaaaacctcaatgcatgccattaagttatgtaaagatgccggtattaaagtaggtatgcgtttatgtttaacgcgcgaaaacttcaaagacttacctgccatgttgaatttaatggaagaaaatagcgttgataaattctatttatctcaccttaactattcaggccgtggcaaacgcaccgctgaaaatgacgccatgttcaaaatgactaaagacgctatggagcttctttatgaacgcgcttggacacatattaaccaaggcatagaaactgattttgttaccggcaacaatgatgcagatggtccatttttattacaatgggcaagcaaacaatttgctgaagagtatccagaagctattgctaatttaaagcaacgtttaatcaattggggcggtaattctagtggtattaacgtagctaacattgataacaccggcacaattcaccctgatacttactggtggaatcaccctatcggcaatgtaaccactgaaaaattctctgatgtttggcgtgatactcaagacccgttaatgttaggttttagacaaacaccacgcccagtaaaaggacgttgtgcaagttgtgaacacttagctatttgtggtggtaatacgcgaacgcgtgctttcgctcaatcgggtgatgcttgggctgaagatcctggctgttatctagatgacgatgaaattggttttatcccgtcgccatcaaagtttgccgacgagttaactaacacagaaaatccgattcaatttgttgaagtctaa

SEQ ID NO: 2070 - DNA, 1164 bp, Ralstonia eutropha JMP134
atgttccgcctgtcccgattcatggaagcgctgcgcgatggcggtcccgtgcccgcgccgcgcaagccggccggcccggtcgtcatctggaacttgatccggcgctgcaacctcaactgcaagcattgctattcgacctccgccgacaccaacttcaagggcgaactgactacggctgaagcgctggatgtgctcgggcagctcaaggcagcgcatgcccccgcgctgatcctgtccggcggcgagccgctgctgcgcgaggatctgtacacgattgcagcgcgcgcgcgagagatgggcttccacttgtcgctgtcgtcgaacggcacattgctggatgccgcgcacgccgcgcggctagccgagagcggcttcgactatgtcggcgtcagcctcgacggcatgcaggacacacacgaccgcttccgccgcagcggcgatgctttccgccatgcgctcgccggcctgcgcgcggcgcgcagcgctggcctgcgggtaggcgtgcgcatgacgctgaccgaagagaacgcgaacgaactgccggcggtggtggcctttaccgaagcggaaggcatcgacaagttctacctgtcgcacttcaactacgcggggcgcggccgcagccaccgtggcgacgacgcgcgtcacgcggccacgcgcgccgcgcttgactggctgtttgaccacgtctgggagcgcgcgcgccagggccatgccggggacttcgtcaccggcaataacgatgcagacggcgtctacctgctgcactggatcgcgcggcaccagccgcaccggctggccgacatgcgccggcggcttgtgaactggggcggcaatgcgaccggcgttggcgtggccaatatcgacaacctcggcaacgtccaccccgacacgatgtggtggcacgtcacgctcggtaatgtgcgcgagcgcgcgttcggcgatatctgggccgaccgcagcgatccgctcatggcaggcctggcggcatcgccgcgtccgctgcaagggcgctgcgcgaactgcgcgcaggtggatatctgcaacggcaatacgcgtgtgcgcgcggccgcggtgaccggcaatccatgggcgcaagaccccggctgctacctgaccgacgaggaacttgccatgcagctcggtgcggaggtcgccgcatga

SEQ ID NO: 2071 - DNA, 1200 bp, Thiobacillus denitrificans ATCC 25259
atgttccgcatctcccgatacctgcaggagctcgcccagccgaccccgctcggccccgaacgcacgccgcccggcccggtggtgatctggaatctggtgcggcgctgcaacctcacctgcaagcattgctattcgatttccgccgacaaggacttcccgggcgagctcggcaccgacgaggtgttcgcggtgatggacgacctcaagcgcttccgcgtgccggtgctcatcctctccggcggcgagccgctgttgcgccccgacatctacgccatcgcgcagcgcgccaaggacatgggcttctacgtcgggctgtcgtcgaacggcaccctcatcgacgagcacaacatcgagcgcatcgccgcgatcggcttcgactacgtcggggtttcgctcgacggcatcgccgcgacccacgaccgcttccgccgcatggacggcgccttcgacgcctcgctgcgcggcatccgcctgtgccgcgaccgcggcatcaaggtcggcatccgcttcaccctgacccaggacaatgcgcaggacctgcccgcgctgctgcagctgatggaggacgagcggctcgacaagttctacctctcgcacctcaactacgccggccgcggcaacaccaaccgcaagcacgacgtggtgcaccaggccacccgccaggccatggacctcttgttcgacacttgctggcgctaccagcaggccgggctgcacaaggagttcgtcaccggcaacaacgacgccgacggcgtctacctgctgttctggatccgccgccacttccccgcgatggaaggccacatgcgcgccaagctcgcgcagtggggcggcaattccagcggggtcaacatcgccaacatcgacaacctcggcaacgtgcacccggacaccttctggtggaactacagcctcggcaacgtcaaggagcggccgttctcggaaatctggcccgataccagcgatccgctgatggccgggctcaaggccagcccgcgcgcggtcaaggggcgctgcggcgaatgcgcctacttcgacatctgcggcggcaacacccgggtgcgcgcctaccagctcaccggcgacccctggcaggaggaccccgcctgctacctcgacgacgaggagatcggggtcaccacaccgcacgagcggctgaccgtgacgccctatgtgccgctgcggcgggtggcgcgctga

SEQ ID NO: 2072 - DNA, 1164 bp, Pseudomonas aeruginosa UCBPP-PA14
atgctgaggatcagccattacctgcgcagcctcgccgaggacgcgccggcgccgcgccgcgccggcggcaggcgcgccccggtggtgatctggaacctgctgcggcgctgcaacctgacctgcaagcactgttactccacctccgccgacagcgacttccgtggcgagctggagaccgcggaaatccttcgcggcatcgacgacctgcgcgccgccggagtgcgcgtgctgatcctctccggcggcgaaccgctgatgcacccggacctcttcgagatcgccgcccatgcgcgccaggccgggatgttcgtggcgctgtcgagcaacggtacgctgatcgacgaaggcaacatccagcgcgtcgccgaggcccgcttcgactacgtcggcatcagcctcgacggcctgcgcgagacccacgaccgcttccgccagaagcagggcagcttcgacgccgcgctggcggccatgcgcctgtgccgcgaggcggatatccgcgtcggcatgcgcaccaccctgaccgaggagaacgccgcgcaactaccggcactgctcgacctgatgcgcgaactcgacgtgcagaagttctacctctcgcacctcaactacagtggccgcggccgccgcagccgcgccctcgacgcccaccaccggcgcacccgcgaggccctcgcgctgctcttcgaacgggccgacgaggacatccggcaggggcgcgacagcgacttcgtcaccggcaacaacgacgccgacgcgatccttctcctcgactggctcaagcgccgccgcccgcagcaattggcgcgtctctgcgagctgctgctggactggggcggcaacgcctcgggcgagggcatcgccaacatcgacaacaccggcgaggtgcatccggacagctactggtggcaccacagcgtcggcaacatccgccatcagcgcttcgccgacttctggttcgagcgccccgacccgctgctcctgcaactgcgccagcgcccgcgaccggtggtcgggcgctgcagccaatgccgctggctggacatctgcaacggcaacacccgcacccgcgcctgggccggcggagaactctggggcgaagaccccggctgctacctcagcgatcaggaaatcggcctcgagcgcatcgcgctgcacgccgtctaa

SEQ ID NO: 2073 - DNA, 1224 bp, Paracoccus denitrificans PD1222
atgttccgcctgacccaatatatgcagcagcttctggacccctcgccgccgcgccgccggacacggccgggtacggtccgcccggtggtgatctggaacctgacgcgcagctgcaacctgaaatgccgccattgctataccgtctcggccgaccggccgtttccgggcgagctgacgcatgagcaggccatggccgtgctgcgcgacctgtcggatttccgtatcccggccctgatcctgtcggggggcgagccgatgtcgcgcttcgacttctgggaactggccgaggaggcgcggaggctcgatttccgccacctgtcgctgtccaccaacggcaccaggatcaatgcccagaacgtggaccggctggccgggctgggcttcgactatgtcggcatctcgctggatgggatcgacgcggtgaacgactggttccgcggcgtcgagggtgccttcgaccaggcgctggccggcgtgcgggcctgcaaggcgcaaggcgtcaaggtcggcctgcgctttaccatcaccgagggcaacgcccatcacctgcccgccatgctggacctgtgccgcgacgagggcgtggacaagttctatctgtcgcatctggtctatgccggccgcggcgacaagcaccggggcgaggataccgaacatgcccgcacccgccgcgccatggagctgctgatcgcccgcgcctgggaggcggtggagcgggccgaaccgctggaggtcgtgaccggcaacaacgatgccgatgcggtctatttcctgcgctgggccgagacgcgctttccgccggcagccgtcgcccatctgcgcgcgcatctggaggcgtggggcggcaactcctcgggcctgggcgtcggcaatatcgacccgcagggcaaggtccatcccgacacctactggtcggactacacgctgggctcggtcaaggagcggccgttctcggcgatctggaccggggacgacccgatcctggccacgctgcgcacccggccgcggccgctgaaggggcgctgcggcgcctgcgcctatcaggcggtctgcggcggcaatacccgcatccgggcgctgcaactgaccggcgatccatgggccgaggatccggcctgctatctctcgggctccgagatcggcgcagaaggtgctgacctggaccgccttgccgtcacgcctttccggggaaaaagccatgatccggcccaccgctttctttag

SEQ ID NO: 2074 - DNA, 1221 bp, Acidovorax sp. JS42
atgtttcgcatcagccagtacctgcgtgaactcgcccaggcccaagccaccggaacctaccccacttcgcgcgaacggcacgcgcgcggccccgtggtcatctggaacctgatccggcgctgcaacctcacctgcaagcactgctacgcgctctcggccgaccacgactacgctggagagctgtcgttgcaagaggtgtacaccgtcatggacgacctcaaggccttcggcgtgcctgcgctcatcctctcgggcggtgagccactgctgcgccccgacctcttcgagatcgcggcgcgcgcgcgtgacctgggcttctataccggcctttcgaccaacggcacgctgatcgacgcgcccatggccgcgcgcatcgcgggcgcaggcttcgactacgtgggcatcagcctggatggcctgaagcccacgcacgacaagttccgccgtctggacggtgcgttcgaccgcagcctggccgccatccgccacctggccacgcacaacgtcaaggtgggcctgcgcttcaccatgacagcgctgaatgcacacgatctgcccgcgctgttgcagctcatgaaggacgagggcgccaacaagttctatttctcgcacctgaactacgcggggcgtggcaacatccaccgcgacaaggacgcgcaccaccaggccacacgccaggccatggacctgctgttcaaccacgcctgggccgatgcccaggccggcagcctggacgactacgtgagcggcaacaacgatgccgacggcccctatttgctgcaatgggcgcgcgagcacctgccgcaatgggaagacgccttgcgccagcgcctggtggcctggggcggcaatgccagcggccagatggtggccaatatcgacaacctgggccatgtgcaccccgacaccatgtggtggcaccacgacctgggcagcgtgcgcgaacggcccttctcgcagatctggaacgacaccagcgacccgctcatggcggggctcaagcagcacccgcgccctgtccagggccgctgcgccggttgccagtacctcacgatctgcaatggcaacacccgcgtgcgcgcacagcagctcacgggcaacccctggttcgaggaccccggctgctacctcaccgatgccgaagtgggcgcatccagcacgcccttcgaatcccctgccaagcatgagcgccgtcgcacgatcgagattgcccatgcgtaa

SEQ ID NO: 2075 - DNA, 1215 bp, Marinobacter aquaeolei VT8
atgagagagaaaactatgtttcgcatgacccgctacatcaagagcctgatgaatccggcaccggtgcgcccggtccccaaacccagcggcccggtggtgatctggaacctgattcgccgctgcaacctcacctgcaaacactgctattcgatttcagcggacatcgacttcaaaggcgaactcaccacccaggaagtctacaaggtaatggacgacctcaaagccttcggcgtgccggtactcatcctctccggcggcgaaccgctgatgcgcccggacatctttgatatttctcaccgggccaaagccatgggcttttatgtgggcttgtccacaaacggcaccctgattaccgaagacaacatcagcaaaatcgccgaagtgggctacgactacgtaggcatcagtatcgacggtctggaagccacccacgacgaattccgccagaaaaaaggcgccttcaaagagtccatgcacgccgtagccctgtgcaagcaagctggcatcaaggtgggcctgcgtttcaccctgacccaggataactacccggaactgccggccatgctggagatgctggacgagcaccagatcgacaagttctacctgtcgcacctgaactactccggccgcggtggtcgcaacaagaagcgggatgcctggtacgacatgacccgcgacgccatgaacctgctgttcaaccactgccacgacgaactcaggcgcggtatcgagcgggagtacgtcaccggcaacaacgatgctgacggcccgttcctgattgagtgggccaaagagcattacccggaccaggtcgatgccctcacccagcggctgaccaactggggcggcaactcctccggcgtcaatatctccaacatcgacaacctgggcgtggtgcacccggacaccttctggtgggatcacaacctgggcaacgtgcgggaaaccccgttctcgaagatctggtcggaaaccaccgacccgctgatgcagggcttccgccagcatccgcgcccggtgaaagggcgctgcgcggactgcaagtatctgaacatctgtaacggcaacacccgggtacgggcttacaacgtgtctggcgacttctgggaggaagatccgggctgctatctcaccaacgaggaaatcggggtggttgataccacaccccgacgggtcgccgctccggtgatcgaaatcccggttcacaatctttaa

SEQ ID NO: 2076 - DNA, 1197 bp, Methanoculleus marisnigri JR1
atgaaccggatcacgagatacatccacgcgaccggcacggtcagcgaggtaatccggcaccgtgcggccgaaaagagaccgagcggcatgctcgcgttctccgaactccgccggccggtcgtcttctggaacatcacgaaccggtgcaacctcctctgctcccactgctacatccgggcagggccggggcgggggcgggaggacgaactgacgacggaggaggggctcgctcttatcgacgaccttgcagagatgcgggttccccttctgctcttctccggcggcgagccgctcgtccgggaggacttctgggaactcgccgggcacgcgaaggagagtggcctcaccaccgccctgagcaccaacggcacgctgatcacgccggccgttgcacggcggctccgcgacgcgggggtggagtacgcaggggtctcgctcgacggggcgaccgccgagacgcatgacggtatgcgaaacgtcccggggagctttgataaggctgtctcagcgctcgataactgcagatccgccgggctgaagtgcggcgtccgggtgacggcgacgcgggagaactacgccgagatctgcgccctcatcgacctctccctggacaccggggcggaacggttctgcgtctactggctggtcccgagcggccggggaggggaggggtatgacgcccggcaacttcgattccaggagattgccggcctccttgacctgctcatcgagaaggcacgcgaggtagacccggcggccatggagttcctcacggtcgacgcaccccaggacaccgtataccttcttaagaggctggagaaggacgatccttccgcatacgagagtatgtgcacccttcttgcacacgccggcgtcgggtgcagcgcgggagaccgcatcgcaaacatcgatccctccggtgccgtctacccctgccagttcgcccagatggacagactcaaggtcgggagcatccgggagaaaccgttcagcaccatctggaacgacccggagaaccggatcctcgccgacttccggagaaagaaggatctggtcgggggctcctgcgggcgatgctcctaccgcgaccgttgcggcggcgggtgcaggatccgggcgtttgccgataccggcgacctctgggcggaagaaccgctctgccccgtccgccgcgaggaaccccgggacggggcgtga

SEQ ID NO: 2077 - DNA, 1164 bp, Pseudomonas aeruginosa PA7
atgctgaggatcagccattacctgcgcagcctcgccggggacgcgccggcgccgcgccgcgccggcggcaggcgcgccccggtggtgatctggaacctgctgcggcgctgcaacctgacctgcaagcactgttattccacctccgccgacagcgacttccgtggcgagctggagaccgcggaaatccttcgcggcatcgacgacctgcgcaccgccggggtgcgcgtgctgatcctctccggcggcgaaccgctgatgcacccggacctcttcgagatcgccgcccatgcgcgccaggccgggatgttcgtggcgctgtcgagcaacggcacgctgatcgacgagggcaacatccagcgcgtcgccgaggcccgcttcgactacgtcggcatcagcctcgacggcctgcgcgagacccacgaccgcttccgccagaagcagggcagcttcgacgccgcgctggcggccatgcgcctgtgccgcgaggcggacatccgcgtcggcatgcgcaccaccctgaccgaggagaacgccacgcaactgccggcgctgctcgacctgatgcgcgaactcgacgtgcagaagttctatctctcgcacctcaactacagtggccgcggccgccgcagccgcgccctcgacgcccatcaccggcgcacccgcgaggccctcgcgctgctcttcgaacgggccgacgaggacatccggcaaggtcgcgacagcgacttcgtcaccggcaacaacgacgccgacgcgatccttctcctcgactgggtcaggcgccgccgcccgcagcgactggcgcgtctctgcgagctgctgctggactggggcggcaacgcctcgggcgagggcatcgccaacatcgacaacaccggcgaggtgcacccggacagctactggtggcaccacagcgtcggcaacatccgccgccagcgcttcgccgacttctggttcgagcaccccgacccgctgctcctgcaactgcgccagcatccgcgtccggtgggcgggcgctgcacccagtgccgctggctggacatctgcaacggcaacacccgcacccgtgcctgggccagcggcgacctctggggcgaagaccccggctgctacctcagcgatcaggaaatcggcctcgagcgcatcgcgctgcatgccgtctaa

SEQ ID NO: 2078 - DNA, 1176 bp, Candidatus Methanoregula boonei 6A8
atgaaccggatcacccagtgcctgcacgggaagggaacggtgagtgccgtgatgaaacaccggcatggcgatgtcccggcccggtacctcgcattttccgggatgagaagacctgttgttttctggaacctcaccgaccgctgcaatctttcctgcacgcactgctacagccgctcggccccggacagcccgacacagggagaactgtcgacaaatgaagcgctcgcgttcatcgacgatctcgctgcggccggcatcccgcttgtcatctttaccggcggggagccgctggtccgtcccgatatctggcagctggcagggcactgccgggataaggggatcaagaccgcgctcagcacgaacggtacgctcatcaccgatgaagtggcagcaaagatcaaggcaagcgggatcgagtacgcggggatctcgcttgacggtgcaactgccgcgacccatgaccggttcaggaacacgccgggagcgtttgcccgggccaccgccgcctttgcccggtgcaaaaaggccggggtccggtgcggcgtgcgggtaacgctgacaaaagagaaccttgccgaactcggatcccttgtgcagctctcgcaggatctaggggcatcgcggttctgcctgtactggctggtgccctgcgggcgggggagcgatgcttattatcggctccagctgggcgcagaggaggtcacgcaggcgcttacgctcctgtaccacacggcgcaggaaatcccaccggaccagatggaatttctcacggtcgatgccccgcaggactgcatccacctgatccactccatggagcgcgacaactcaccggaccttgccgaggccaaggaactcctgtcttcgctcaacgggggatgcagcgccggcgaccgggtggcaaacgtggatccacgcgggaacgtgtacccctgccagtttgcccggtcgccggagtttcttgtgggaaatatccgggaccggccgttttctcttctctggaacgatgagaaaaatccggtgcttgcccggttccgcacccggcctgccgtagttggcgggaagtgcggctcgtgcacgtacctttccctctgcggtggcggatgccgggtccgggcccgggctcttatgggagacgttacggccgaggacccgttctgctctgtgaacggtccttaa

SEQ ID NO: 2079 - DNA, 1215 bp, Dinoroseobacter shibae DFL 12
atgttccggctgagccattatctcgaccagctctatcatccgaccccgccgcgtatcgccaggggcacgccaaagccggtcgtgatctggaacctgacgcggcgctgcaatctcaagtgcaagcattgctacacggtctcggcggatgtggatttcccgggcgagctgacggcggcccaggcccgcgaaacgctggaggatatcggacgcttcaaggtgcccgcgctgatcctgtccgggggcgagcccttgctgcgcgatgacctcttcgcgctggccaaacgcgcgcgggcgttgacccgcgtgctggccctgtccaccaacggtaccggcgtgatcgggtccaaggccgaccgcgtggcggagatcgggttcgactatgtcggcatctcgatcgacgggatcggcgccaccaacgacgctttccgcggcgtgatcggtgcctatgaacaggcgctggccggcgtgcgttcgtgcaagcggcgcgggatcaaggtgggcctgcgcttcaccatcaccgaacagaatgagagccagctgcccgagcttctgaagctctgcgatgacgagggggtggacaagttctacctgtcgcacctggtctatgccgggcgcggcaacaagaaccggggcgaggatgccgaccatgcccgcacccgccgcgccatggacctgctgatcgcacgcgcgctggaaagtgccgagggcaggggccatccgctggaaatcgtgaccggcaacaacgatgccgacgcggtctatttcctgaactgggcaaaagccaatttccccgccgcgcaagtggcccatctgcgcaagcacctggaggcctggggcggaaatgcctcgggcgtgggggttgccaatatcgacacccagggcgacgtgcaccctgacacctactggtccgaatacaccgtcggcagtgtcaagcagaccccgttttccgagctctggaccgggcccgacccgatgctggccgagctgcgccgccgtccgcggccgctaaagggccggtgcggagcctgtgcccaccaggcggtctgcggcggcaacacgcgcattcgcgcgcttcagctgaccggcgacccctgggccgaagaccctgcctgctatctcaccgcggccgaaaccggcactgcaacggatatcgaccgcctgaccgtcagacctttcatcggagaccgacatgaccccaagccggcttttgtctag

SEQ ID NO: 2080 - DNA, 1257 bp, Leptothrix cholodnii SP 6
atgttccgcatcagccaatacatgcgcgaactcgcgcaagcccatcgcggcggtgtgtacccggccccccgccgcgcagcggccgggggctccatgacgggtccggtcgtgatctggaacctgatccggcgctgcaacctgacgtgccagcactgctacgcgctgtcggccgatcacgaatacagcggcgagctgtcgggcgccgaggtcggcacggtgatggacgacctcaaggcattccacgtgccggtgctgatcctctcgggcggcgagccactgatgcggccggacatcttcgagatcgccgcacgcgccaaggcgatgcgcttctacatcggcctgtcgaccaacggcacgctgatcgacgagccgatggccgaccgggtggccgcagccggcttcgactacgtcggcatcagcctggacggcctgcgcgaaacacacgacaagttccgccgcctcgacggtgccttcgaccgcagcctggccgccgtgcggctgctgcacgcacgcggcgtcaaggtcggcctgcgtttcacgatgacggcgatgaacgcgcacgacctgccggcgctgctgcagctgatgcgcgacgagcaggtcgacaagttctacttctcgcacctcaactacgccggccgcggcaacatccaccgcggccgcgatgcccagttcgccgccacccgcgaggcgatggacctgctgttcgagaccgcctggcaggctgcgctggaaggtcgggacgaggagtacgtgaccggcaacaacgacgccgacgggccgtacctgctgcagtgggtggccgagcacctgccgcatctgagcccgctggtgcacgagtcgctgcgccagcggctggtggcctggggcggcaattccagcggcgtgaacgtggccaacatcgacaacctcggcaacgtgcaccccgacaccatgtggtggcaccacacgctgggcaacgtgcgcgagcggccgttctcggccatctgggccgacacctccgacccgctgatggcgggactgaaggccaggcggcggccggtcggcgggcgctgcggcggctgcgcgcacttcgccatctgcggcggcaacacccgcgtgcgcgcccagcagctcaccggcaacgcctgggccgaagacccgggctgctacctgagcgacgcggaaatcggcgtgagcggcaacggcgagcgggtcaaggtgacggcgttcagtggtggacgcaagagggtcggggtaccggtggtggcggggtga

SEQ ID NO: 2081 - DNA, 1209 bp, Thauera sp. MZ1T
atgttccgcatctcccaattcatccgcgagctcgaccaccccacgcctgccggcccccgccgcaacccgccaggtccggtggtgatctggaacctgatccggcgctgcaacctcacctgcgagcactgctactcgatctcggcggacaaggatttccccggcgagctgaacacacaggaagtcttcaaggtcatggacgacctcaaggacgcacgcgtgccggtgctgatcctgtccggtggcgagccgctgctgcgccccgacatcttcgacatcgcccgccgcgccaagggtatgggcttctacgtcggcctgtcgtccaacggcaccctgatcgacgaatccaacattgatgcgatcgacgagatcggcttcgactacgtcggcgtcagcctcgacggcatcggcgccacgcacgaccacttccgccgcaagcagggcgccttcgaggcctcgatgcacggcatccgcctgtgccgcgagcgcggcatcaaggtcggcgtgcgctacacgatgaccgagggcaacgcccacgacctgcccgcgctgttgaagctggtcgaggacgaggccatcgacaagttctacttctcgcacctgaactacgccgggcgcggcaacaagaaccgcgccggcgacgcccgccaccgcaccacccgcgaggccatggagctgcttttcgagacctgtctcgacctgcaccggcgtggcatcgacaaggacttcgtcaccggcaacaacgatgccgacggccccttcctgctgcactgggtgcagcgccgcttccccgacaaggccgcccacatcgaggccaggctgcgccagtggggcggcaacgccagcggggtgaacgtcgccaacatcgacaacctgggcatcgtgcacccggacaccatgtggtggcacgtgccgcttggcaacgtgcgccagcgcgccttcggcgagatctggaacgacctgtcgaacccgctgctcgccggcctcaagcagcatccgcgcaagctggaggggcgctgcggcgcgtgcaagtacctggagatctgcaacggcagctcgcgcgtgcgcgcggagcaggtcaccggcaacccgtgggcggaggacccggcctgctacctctacgacgaggagatcggcgtgaatccggcagactacggcgccgagcgcgtcgtcacgacgccctggacccgcatcgacaaggtttccgcatga

SEQ ID NO: 2082 - DNA, 1221 bp, Diaphorobacter TPSY uid29975
atgtttcgcatcagccagtacctgcgtgaactcgcccaggcccaagccaccggaacctaccccacttcgcgcgaacggcacgcgcgcggccccgtggtcatctggaacctgatccggcgctgcaacctcacctgcaagcactgctacgcgctctcggccgaccacgactacgctggagagctgtcgttgcaagaggtgtacaccgtcatggacgacctcaaggccttcggcgtgcctgcgctcatcctctcgggcggcgagccactgctgcgccccgacctcttcgagatcgcggcgcgcgcgcgtgacctgggcttctacaccggcctttcgaccaacggcacgctgatcgacgcgcccatggccgcgcgcatcgctggcgcaggcttcgactacgtgggcatcagcctggatggcctgaagcccacgcacgacaagttccgccgtctggacggtgcgttcgaccgcagcctggccgccatccgccacctggccacgcacaacgtcaaggtgggcctgcgcttcaccatgacagcgctgaatgcacacgatctgcccgcactgctgcagctcatgaaggacgagggcgccaacaagttctacttctcgcacctgaactacgcggggcgtggcaacatccaccgcgacaaggacgcgcaccaccaggccacacgccaggccatggacctgctgttcaaccacgcctgggccgatgcccaggccggcagcctggacgactacgtgagcggcaacaacgatgccgacggcccctatttactgcaatgggcgcgcgagcacctgccgcaatgggaagacgccttgcgccagcgcctggtggcctggggcggcaatgccagcggccagatggtggccaatatcgacaatctgggccatgtgcaccccgacaccatgtggtggcaccacgacctgggcagcgtgcgcgaacgccccttctcgcagatctggaacgacatcagcgacccgctcatggcggggctcaagcagcacccgcgccctgtccagggccgctgcgccggttgccagtacctcacgatctgcaatggcaacacccgcgtgcgcgcacagcagctcacgggcaacccctggttcgaggaccccggctgctacctcaccgatgccgaagtgggcgcatccagcacgcccttcgaatcccctgccaagcatgagcgccgtcgcacgatcgagattgcccatgcgtaa

SEQ ID NO: 2083 - DNA, 1200 bp, Candidatus Methanosphaerula palustris E1 9c
atgaatcgtattacccagtgcatgcatggtcggggaacggtcagcgatgtgatgcggcaccgccacaaaccacagaccacggtgcccagtacctatcttgcattctccgggatgtaccgaccggtgatcttctggaaccttacggatcgctgcaacctgagctgtaatcattgttacaaccagtctggcccggaacgcacgactgaaggagaacttacgaccgctgaagcgctgaaggtcatcgatgatctcgcggatatgggtgtcccgctcatcctgttcactggtggggagccccttatgcgggcggatatctgggatctggcacagcatgccaggaatcgtggccttaaaatggcccttagtaccaatggaacgctgatcactcccgacattgcccgcaggattaaggagagcgggattgagtatgccggcatctcgctcgacggggccagggcagagactcatgaccgtttccggaattcacccggtgcatttgagcagacactcgcagcgttcgctgcctgtaaggaggccgggctccggtgcggggtacgggtcacgcttacaaaggagaactgccgggaacttgaagcgcttgtcgatctcgccatctcgctgggagcttcccgtttctgcctgtactggctcgttcctacgggtcggggaatcgattcctatacccagttgcagctggaccgggacgaggtgatcgaagccctcagcctcctctacctgaaagcaaaagagaccgaccccgcaaccatggagttcctcacggtcgatgccccgcaggactgtatccacctgctcgcttccatggagaaggatcagtcagaggatcttgttgatgcccgcgaactgctggaatctttaaagggcgggtgcagcgccggtacccgcgtggcaaatattgatgcacagggaaacgtgtacccctgccagttcgcccgctcaccggaatttctcgtagggagtgtccgtaatctgccattcagcaggatatgggctgaccctgccaatcccgttctcgctaggttcagggaaaaacaggctcggttcgggggtcggtgcgagacatgcaattatcgggatctctgcggtggcggctgccgggtccgggcttatgcagtgaacgagaattttctagcagaagatcccttctgttttgtcgagaaggtcttcccaaaacgacaatga

SEQ ID NO: 2084 - DNA, 852 bp, Jannaschia CCS1
atgggcgacttggccgattttgaaaaactgagcgcgttggaaaagcgcctgtcgcaggcgctggaccggatatcaaccgggatcaaggcgcgcgacgaggcaaaaggcgctgaggcggaggccgaggcccgcgccacggaagccacggaacgtgtcacggcgctggaggcgcggctgagcgagacgcaggacgcgttgagtgaggcgcaaagcgatgtggcgtccgcgcgcgaagaagcggatgccgcccgggcggaggccgatacggcgcgggcgcaggctgcggcgaccccggccgaggatacgcaagagctggccgatctgaagacgcgcctggaggcggccgaggcacaggtgaccgagacgaccgcgtccctggatgcggcgcgggccgagttggacaaggccaaagccgcgccggtttcggatgcagagcccgaggatatggagaaggccctggccgtgatgggccgccgggtcgagcgggcgcgggcggaacggaaccaggcgcgcaccgcctgtgacgcggccaccgatgcgctggatgagttgaaagaggccaccggcgccagcgtcgacgaccgcatcctggccctgcgccgccagttgcgcctgatgcgcacccgggccgaggatctggcggcccaggtctccctgctgcaaagcggggccagcgtggacgcgtcgcttctggatcagggcctgctggccgaggtggagacgctgcgccaattgcgggacacggatgcggcggaactggaccggatcgtgcaggacatgcaggccgggctggagatgaccgggccgggggctgctggcccggacctaacggagggtggccaaaatgcctga

SEQ ID NO: 2085 - DNA, 921 bp, Ruegeria sp. TM1040
atggagcagttagaagaactacagggccgcatccagaccgcgctgcatcgtatctatggcggcgtcgccgcgctggagcaaaagcatgccaatcgtccggtgccgacactggaagagctggatatgcaaaagcatgcggagcttctggccgatctcgaagacgagaagatggccaatgcgcagctgatcgaacggctgcgcctgctgcatggccggctcgaggacatggaaaagaaagtggctgccgtggatggcgcacaagatctgattgcgctgcatgcggaactggagctgctgcgcaacgaggccggaaactccgtcgaaacggaggcactgaaagccgaggtcgcgcgcttgaagcaggatcttgaggccgcacgcaatcaggccgcaagcgagcgtgaaaagctcgaagatgacctgagcgaagccacagcccagaatgaacagctgcaagcgcagctctcggctctgccggagagccctgccgacaccgagatgacgtctgacgtgaagggcgatgcacatgccgacagcgccgagctcgaagcgctgcgtgcagaagtcgccgaattgcgtgcgcgtgcggaagccgccgaaagcgccgctgtctcgcaggatgtggagcctgctgacgagggcgtcagcgccgagcttgatctgcgtctgagcgcccttgatggcgaattgcagggcctgcgggccagcaacgaccagttgcgccagtccaatgcggccctgcgtgcggccaatgccgaaggggttgcggatcctgcgctcatcaactctggccttgaggccgagctggaggggctgaaggccgcccgcgccaccgatcaggccgaggtcaacgcggtgctggcccgattggagccgctccttgccacagcccccaacctgcctgaaggagaagaagcctga

SEQ ID NO: 2086 - DNA, 459 bp, Rhodobacter sphaeroides 2 4 1
atggtggaactcgagcgccgcctcacggccgctctggaacggatcggcgccgggatcgatgcgatcccggtgatgcccgcggaaaatccgcttcaggccgagctcgacgaggagcggatggtcaatgcgcagctctccgaacggctgaagtccgtgaaggagcgcgagggcgtgaagatcgcccagctcgaggagcaggtcgaggcgctgacgcggcagctcgacgctcagggcatggagcttcagcgcatgaagaagacgacgggccagctgcgcgaggcgctgcggagcctgcgcgaggcgacggccgaaggcgtggcggattccgagctcgtcaaccgctcgatggtggtcgaactcgaggcgctgcgcgctgcgcgcgcgacggaagccgccgaggtggaggaggtcctctcggcgctggaacccctgatctcggagggccgcacggatgcctga

SEQ ID NO: 2087 - DNA, 636 bp, Paracoccus denitrificans PD1222
atgagagaagacctgaacctcagcgaaaagcggctgatcgcggcgctggaccggatcgaccaattcctggaccgcgtggcccaggcgcgccatgccccgccgccggcatcctcggccgaggcagaggcggtgcaagtgcggctgcacgaggccgaggccgagaatcggcgtctttcgcaagagcttgccgccctgcaccagcgccaggccaccacgctttccgactgcgaggcgcggctggccgaggcgcatcagcgcctggtcgcggtcgggcaggaagccgcgcagctgtctgccgcgaacgaggccctggccgaggccaaccgtgccttcgtcgcggcgcaaggcgagggcgcgtcgcaggacgatatccgccgcgcgctggaggccgagatcgaatcgctgcgcgccgcccgtgccgccgaggtcgcgcagatgggcgagatcgtcgacgcgctggaccgcatgatagacggcccggcgcccccggcccccgccgatgcgccgcccgccatggtcgagaccccggcgccgccggaagccgcgacccttgccggcgaggcgcgggaggacggcccgcccgaggcggcggagcttgccggggacggcgccactctggacggggaaaggggctga

SEQ ID NO: 2088 - DNA, 468 bp, Rhodobacter sphaeroides ATCC 17029
atgcaggagatggtggaactcgagcgccgcctcacggccgctctggaacggatcggcgccgggatcgacgcgatcccggtgatgcccgcggaaaatccgcttcaggccgagctcgacgaggagcggatggtcaatgcgcagctctccgaacggctgaaggccgtgaaggagcgcgagggcgtgaagatcgcccagcttgaggagcaggtcgaggcgctgacgcggcagctcgacgctcagggcatggagcttcagcgcatgaagaagacgaccggccagctgcgcgaggcgctgcggagcctgcgcgaggcgacggccgaaggcgtggcggattccgagctcgtcaaccgctcgatggtggtcgaactcgaggcgctgcgcgcggcgcgcgcgacggaagccgccgaggtggaggaggtcctctcggcgctggaacccctgatctcggagggccgcacggatgcctga

SEQ ID NO: 2089 - DNA, 468 bp, Rhodobacter sphaeroides ATCC 17025
atgcaggagatggtggaactcgagcggcggctcacggccgccctggaacggataggagcggggatcgacgcgatccccgtcatgccggcggagaacccgttgcaggccgaactcgacgaggagcggatggtcaatgcccagctcaccgagcggctgaaggccgtgaaggagcgcgagggggccaggatcggccagctcgaggagcaggtcgaggcgctgacgcggcagctcgacgtgcaggggctggagcttcagcggatgaagaagacgacgggacagttgcgcgaggcgctgcgcagcctgcgcgaggccaccgccgagggcgtggccgacccgcacctgctcaaccgctcgatggtggtcgagctcgagtcgctgcgcgcggcccgcgccaccgaggccgccgaggtggacgaggtgctctcggcgctgcaacccctgatcgcggagggccgctcggatgcctga

SEQ ID NO: 2090 - DNA, 429 bp, Dinoroseobacter shibae DFL 12
atgagcgaaatccctcaactggagcagcgcatcgccgcggccctggaacgcattcgggccgggctcgataccctgccgggcgccgagattgcagagaccgccgcgcgggccgacaccctggccgcccgcgtcagcgcgctggaggcggaggtgtccgagaagggcgcgctggaagccgaggtctctgccctgcgcgacggactggccagggccgagcaggagcggaccgagatgctcgacacgatgcagaagctgcaaaccgtgaacgcggatctgcgcctcgctgcggccgagggcgtaaccgacccggaagcgatcaacgccgcgcttgtggccgacctcgaggcgttgcaaaaggtccgcgcggccgatctgcgcgatatagacgccattctgagcgagttggcgccgctggcgaaggaggcctga

SEQ ID NO: 2091 - DNA, 912 bp, Thermobifida fusca YX
atgaccgactctcccacgacagcggacaccgcgcgcatcctcgccgaattcgaccggcatctgcgcgtggaacgcggctgttcgccacacacggtgcgcgcctatctcaccgacgtgcgcagcctgctggactatctcgcggacacgggcgcaggcggcctggaggacctcgatctggcaacgctccgcggctggctagggacactccacgacgcgggggcgagccgggccacgatggcgcggcgcaccgccgcggcacgggtcttcaccgcctacctgcaccgcagtggacggctcgccaccgacccagggctgcggctggccacgccgcggcggcaccgccgcctgcccgccgtcctcgacgaggaccaagccgcccgcgtgtgcgcagccgcccgtgacggggaggaatcaccgctcgtgctgcgccgcagcgccgtggtggaagtcctctacagcactgcgatccgggttgcggaactgtgcgggctggaccttgacgacgtggactgggaacggcacaccctgcgggtgctcggcaaaggcggccgggaacgagtggtgcccatcggggttcccgcgctcgacgctgtcgaccggtggctgcgggacggccgcccccagtgggcgaccgcgcacagcggtcgcgccctttttctgggggcccgcggcggcaggctgggggagcgcaccgcccgccgcgacgtctacgccgccaccgcggcggtggcgcgcaccggtccgcacgggctgcggcacagcgccgccacccatctgctcaacgggggtgctgacctgcgcagcgtgcaggagatcctcggccatgcgtcgctggcgagcacccagatctacacgcacgtctctatcgggcggctggccagcgtctaccagcaggcccatccgcgggcgtga

SEQ ID NO: 2092 - DNA, 1158 bp, Frankia CcI3
atgtccccgggtgcagtgtcacggacgccgcggcgtcttgacgagaaccatcgatgttgccacggtcgtctcatggtcctgcgaggcgagagcgccgaggagcccgccgacggtcggcttctgccgcggcagcgctcccgagcgacgtgtggatcagacgcccggccagtcgagatcgtcgagacacccgagtccgactgggacacggcggtcgcgggttttctccgccacctcatcgcggagctggcccgatctcctgagaccgtgcgtgcctacgccgccgacctcgctaacctgcgcgctcatgcggagcggatgggctgttcggtcctcgccgacctcgatctggcgcttttgcggagctggctcgcttcgatgcgcgccgccggggcggcgccggcaagcctggcccggcgcgcctcgatggcccgggtcttctcttcctatgcggcgcgccatggcttcctcgacaccgacgtcgccgcacggctcgtgggtaaccgtacggtcagaagggtgcctgaggtgctcaccgccgcggccgcgcgtcagctccttgagaacccttcgcctgatgtgtcgcccccgggcacgtcgcagccgtccgggctgccggactcgacggcagactccgagcgggtcgtacggcgggcggtggagctgcgggacgcactcgttctcgagcttctgtatggcagcggaatccgggtgtccgagctgtgcggtcttgacctggggcacattgatgacgaccgaaggttgctgcgggtcctcggtaagggcggcaaggaacgcagcgtgccgttcggtgtgccggcggtggccgccctacggtcctggagatcaacgggacggccgcggctgatgaccgctcgtagcgggcgtgcgctgctcctcggcctgcgcggaggtcgcctcgatccgcgcacggtacggcggattctgacgacgagggtggcggccggtgtcgctccggccggcctgactccgcatggtctgcggcattcggcggcgacgcacatgctggaaggcggggccgatctgcgctccgtccaggaatttctcggccatgcgagtctcgcgaccacgcagatctacacccatgtgacaccggaacggttgcgcgcggccttcgagcaggctcacccccgagcctga

SEQ ID NO: 2093 - DNA, 939 bp, Nocardioides JS614
gtgagcgaggaggagcagtcggcgcggcttcccgaggcgatggcccgggcgctcggcgactacgagcgtcacctcgccgccgagcgggacctgtccgagcacacggtgcgtgcgtacatcggggatgtggccgggctcctggagcatgccagccggctcggccagaccgagcccggcgacctcgacctgcggaccctgcggagctggctggccaagcagcagaccatgggccgctcccggaccaccctcgcccgtcgggctaccgcagcgcgggtgttcaccgcctggctggctcgcaccggccgcactccgctggacgccggcgcgagcctcggtgcgcccaaggcgcaccggacgctgccaccggtgctgcgcaccgacgaagcggccgacctggtccgcgcggcggtcgagcacgccgacgacggcagcccggtcggtctgcgcgacgtggcgatgctcgagctgctctacgcgaccggcatccgggtgggagagctcgtcggcctcgacatcgacgacctggaccgcgagcgcaacgtggtccgggtgctcggcaagggccgcaaggagcggaccgttccgttcgggcggcccgccgcccgcgccgtggacttctggctcaagcacggccggccgctgctcgcggtcgaggggagcggcgccgcgctgttcctcggcgcccgcggccgccgcatcgaccagcgcgcggtccgcacggtcgtgcaccggcgcatcgcggaggtgccgggcgcgcccgacatcggcccgcacgggttgcggcacaccgccgccacgcacctgctcgagggcggcgccgacctgcgctcggtgcaggagctgctcggccacgcctcgcttgcgaccacccagatctacacccacgtcagcaccgagcggctgcggcgggcctaccagcaggcacaccccagagcctga

SEQ ID NO: 2094 - DNA, 960 bp, Mycobacterium vanbaalenii PYR-1
gtggtctgccacggtaggggagtgcagaccggcgggcaggagcgcagcgacccgggaatcgggtcttgcctcgaggagttcgatgagtacctcgcgctcgaacgtggccgttccgagcacacccggcgggcctatctgggtgatgtgcgggcgctgttcgacttcctcgccgaacgtcgccccggcaccggactgcgcggtctgaccctgccggtgcttcggtcctggctggccgcgcaggcgacggccggtgccgcccgctcgacgctggcccgccgcacctctgcggtgaagaccttcaccgcgtgggcggtgcgccggggcctgatgaccgaggatccggcggcccggctgcaggtgcccaaggcccgccgcaccctcccctcggtgctccgtcaggaccaggcccgcgaggccatggatgccgcgaaatcaggtgcgcagcagggggatccgctggccctgcgggaccggctgattgtggagatgctctacgccaccggcatccgcgtcagcgagctgtgcgggctggacatcgacgacgtcgacactgcgcgccggctgttgcgggtgctgggcaaaggcaacaagcagaggacggtgccgtacggcgatcccgcgcacgccgccctgaccgcgtggctgtccgacggcaggcccgcgctggtcaccgctggttcgggtgcggcgctgctgctcggcgctcgcggcggccggctggaccccaggcaggcgcgcaccgtcgtgcaccagacgatggccgccgtcagcggcgcccccgatatcgggccgcacggcctgcggcacagcgccgcgacccacctgctcgagggtggagccgatctgcgggtggtgcaggagctgctcggccattcgtcgctggccaccacccagctctacacccacgtcaccgtggcgcggctccgagccgtgcacgaccaggcccacccccgcgcctga

SEQ ID NO: 2095 - DNA, 903 bp, Mycobacterium gilvum PYR-GCK
atggacacggtgctcgaggagttcgatcggtacctggagctggaacgcggccggtcggagcacacccggcgcgcctacctgggcgatctgcggtcgctgttcgcctttctcgacgagcgcagtcccggcaccgggctgggcggcctgacgctaccgatgctcaggtcgtggctggcagcccatgctgcggcgggcaccgcccggtcgacgctggcacgccgcacctcctcggtgaagacgttcactgcatgggcggtgcgccgcggcctgatcggtgacgatcccgcgagccggctccaggtgccgaaagcgcggcgtacccttccgtccgtcctgcgtcaggaccaggcgcgcgatgcgctggaggcagcggaatccggtgcgcagcaaggtgatccactcgcagtgcgcgatcgtctggtggtcgagatgctctacgccaccggcatccgtgtcagcgagctgtgcgggctcgacgtcgacgacgtcgacacttcgcgccggctgctgagggtgctcggcaagggcaacaaacagcggacggtcccgtacggcgaaccggcccacgcggcgctgacggcctggctgcacgaaggccggccggcgctggccaccgcggattccggtcccgcgctgctgctcggtgcgcgcgggaaacgactcgacccgaggcaggcccgcaccgtcgtccatcagacggtgtccgccgtgggcggcgcacccgacatcggtccccacggtctgcggcacagcgccgcgacgcatctgctcgaaggcggggccgacctgcgcgtcgtgcaggaactgctgggccattccagcctcgccaccacccagctctacacgcacgtcaccgtcgcgcggttacgcgccgtgcacgaccaggcccacccccgggcgtag

SEQ ID NO: 2096 - DNA, 1035 bp, Frankia EAN1pec
atggggacgggtggcgatcccgcggccacggcccgcggtggccgtggtgacagcgctggtggcggcaacggcggccgcgctggcgcaggtcctggtgacggtgatagaggcagtggcggcgacggctgggcgggtgccgtcgaggctttcgtgcgccatctggtcgccgaacgggatcgttcgccggaaaccgtccgggcctatcgcgccgatctcgcgggcctacgtgcgcacgccgccgcggccggccgtacggatctcctggacctggatctcgccgtgctccgcgggtggctggccggcatgcgttccgccggagcggcaccagccaccatcgcccgccgtgcgtccctcgccagggtgttctccgccttcgccgcgcggcggggattcctccccgatgacgtcggggcgcggctggcgaccacccgggcgccgcggcggatcccccaggtactcaccgcggcacaggcggaccggctgctggagacacggcctcggggcgatcgtgcgcaggacccgcgcgacgtcgcgctgaacctgcgcgacgatctggtcctggagatcctctacggcagcgcggtgcgggtctccgagctgtgccggctcgacatcggtgacgtcgaccacgagcggcgcctcctgcgcgtgcacggcaagggcggccgccagcgcagtgtgccgttcagcgtgcccgcggcgggcgcgctcgacgtctggctcaccaggggccggccctacctcgcgacgcgcgtcgaggcggcgctgctgctcggtgcccgtggcggccggctcgacccgcgttccgtgcgccggctcgtccaggcgcgcggcgccgccgcgggggttcccaccggtctgacgccgcacggcctgcgccacggcgcggccacccacatggtcgaaggcggcgcggacctgcgctccgtgcaggaactgctgggccacgccagcctgtcgaccacgcagatctacacccacgtcaccccggagcggctgcgcgccgccttcgaccaggcccatccgcgggcctga

SEQ ID NO: 2097 - DNA, 1143 bp, Beutenbergia cavernae DSM 12333
atgctgtccgagttatgtgccaacgtagcgcacaactcatacattcccgtacgacttaaggagggtgcgtggcaccgacacgtcgggttcgcctcggagtggcgtcgcgggacgcgagcggcggcagggcacggtgggtcggtggccgctgaccatcctcgcgactcggcggcgccgagggcgtcgcaccatccgccgtcgcgcccgggcgacgcggcgctcgtcgagcggtacgcgctgcacctcgaggcgcagcgcgggctctccgctcacacggtgcgcgcctacacctccgacgtcgccgacctgctggcggagcttccgccgacgggcgacgagccgaacggcgccgacctgacgcggctcgatctcgtggctctgcgtcgctggctcgcgcggcaggcgcgcgccggcctcgcccgctccaccctggcgcggcggagcgcgtcggcgcggacgttcaccgcgtgggcgcaccgcgcaggtctgctcgcggaggacgtcggtgcacgcctgcggagccctcgggcggacgtggtcgtccccgtggtgctcaccgaggcggacgccgccaccgtgctcgacggcgtgagggccgacgacggcggcgtcggcgcggacgacgacgagggcgagaggtccgccctcgcccttcgcgacagcgcgatgctcgagctcctgtacggcgcggccctgcgcgtgtccgagctcgccggcctggacaccggcgacgtcgacctgcgcgagcggctcgtccgcgtgctcggcaagggtgcgaaggaacgcgtcgtcccgttcgggctgccggcggcgcgcgcgatcgaggcgtggatcagcgtgcgtccggagctcgccgggccgcggagcgggcgggcgctgttcctcggcgcacgcggcggccggatcgatccacgcgtcgtccgcgacgtcgtccaccgggcgacggcgcgggcgggggtgcgggacctcgcaccgcacgggctgcggcactctgctgccacgcatctgctcgccggaggttccgacctgcgctccgtgcaggagatcctcggccacgcctcgctcgcgaccacgcagcgctacacccacgtcacgcccgagcgcctgcgcgccgcgttccgtcaggctcacccgcgcgcctga

SEQ ID NO: 2098 - DNA, 999 bp, Brachybacterium faecium DSM 4810
atgagcaccgagcgggagcacgccgatgacgcggtcctcgacgccttcgccgaccatctgcacctcgaacggggcagatccgagcacaccgtgcgcgcctatcggcgcgaggcggccgggctgctcgcgcatctgcgcaccgtcgagcggatcacgctgcccgagctcgatgtgaccgcgctgcgctcctggctctccgcccgcgccgagaccggagcgagcgcgagcacgctggcacgctccgcagcctcggtgcgcaccttcaccacctggctcgcctccaccggacggatcccgcacgacgtcggcggtcgcctgagagcaccgcgccgcggacgccacctgccgacggtgctcaccggcgaccaggcaggcgagctgctcgacgggctcgacggctccgcgcgggacgactccgccgcaccgccccgcgagatcgccgccgcgccccgcgccgagcaggacccgcgagaccgggcggtgctgctgcgcgacgccgccgtcctcgagctgctctactcctcgggcctgcgcgtctccgagctggtcgccctcgaccgctcgaggatcgaccggcagcacggcaccgtgcgggtgcgcggcaagggggacagggagcggatcgtcccggtgggcctcccggcgctggaggctctccagcgctgggagagcgagggccggcccgtgctgctcgcggccgcgacccccgggacaccccccggcgacgccctgttcctcggcgtgcgcgggggccgcctcggcgaccgggccgtgcgcaccctggtggaccgtcacgtggcggaggccgggatcagccgccacgtcaccccgcacaccctgcgccacagcgccgccacccacctcgtggagggcggcgccgacctgcgcagcgtgcaggacttcctgggccactcctccctcgccaccacgcagatctacacgcacgtgagcgcggaacggctgcgccgcaccgtcgaccaggcccacccccgcgcctga

SEQ ID NO: 2099 - DNA, 1011 bp, Kytococcus sedentarius DSM 20547
atgagcgccacgggtctgttgcgggaggtcgagggctttgccgaccacctgctcctcgagcgtgggaggtcgccccacaccgtgcgggcgtacaccgcggacctgaccgctctcgccgagcacctggaggcagccggggccaccgagtggcgccaggtgaccctgagcgacctgcgctccttcgccgcccgtcgtgcggccgccggcctggcgcggtcgaccctggcgcgggggacggcctcccagcgcaccttcttcgggtggatggtggccaccgaacggctggtggtcgacccctccgcccgtctggtgtcgcctcgcgtcgagaagcgcctgcccgccgtactgcgggcggaacaggcggcccagctggtcgagggtggggggacccgacccgagccgagggcgacgggtggtgcaggggaccccgggggcgacacccagaccgacaccgacaccgacaccgacgcggcaccgggaaccgaggccgacccggtctccctcgccaccgacctgcgcgaccgggccgtgctcgagctgctctacgccaccggcatccgggtgggggagctggtgtccctggacacgggcgccgtctccctgcaggaccacacggtgcgcgtctggggcaagggcagcaaggaacgggtggtgcccttcggcgtgccggcgctccgtgccctggaggagtgggtgcaccaggggcgcccggagctgctgggcgctcgcagcggcgaggccctgttcctgggggtgcggggtggacgcatcgacccccgggaggtgcggcgggtggtgcaccgcgcggcccagcgggtggagggagcagccgacatcgggccgcacggcctgcggcactccgcggcgacccacatggtcgacgccggggccgacatccgctcggtgcaggagctgctgggccacgccagcctggccaccacgcaggtgtacacgcacgtctcggtcgagcggctccgcgaggccttcgaccggtcacacccgcgggcctga

SEQ ID NO: 2100 - DNA, 1011 bp, Nakamurella multipartita DSM 44233
gtggtgcgcacctcgaccgccgagctccgggacgggttgcccgcgccgttggtccgcgatctcgagcgctaccggacgttcctgtcggccgaacgcaaccggtcgcccgccaccgtcaccgcctacctggccgacctggtctcgctgctggaccacctgggccggatgaccggggaccggccggcggagctgaccgacctcaccctgccggtgctgcgcagctggctggcccggcagcggaccaccggcgccgcccgcgcgacgctggcccggcgggccgccgcggcccgctcgttctgcgcctgggcccatcgcaccggccggctgccgcaggacgtcggcgcccggctggccgcgccgcgggcggacaagacgctgccggcggtgctgcgcgccgatcaggcccaccagatgctcgacgctccggcggtctccgccccggaccagtcgccggacaccggcaccggcaccggcactggcactggcaccagcgccgtcgagcaggccatggcccggcgcgaccaggcgatcctggaactgctctacgcctccgggatccgggtgtccgagctgaccgggctgaacctggacgcgatcgatcggcaccgacgggtcatccgggtgctgggcaagggcaacaagcagcggaccgtgccattcgggctgcccgccgaccgggccctgggggactggctggatcgggggcgaccggtgctggccgacgacgagtcgggcgccgcggtgttcctgggccggcggggccggcggatcgacccgcgggcggtgcgcaccctcgtgcaccggcgcaccgccgccgtcgacggggctccggagatcgccccgcacggcctgcggcacaccgcggccacccacctgctggagggcggcgcggacctgcggaccgtgcaggagctgctcggccacgccagcctggccaccacgcagatctacacccacgtgtccaccgagcggctggccgcgatctaccggcaggctcatccgcgggcgtga

SEQ ID NO: 2101 - DNA, 579 bp, Streptococcus agalactiae 2603
atggaagtaaaaactgcaatagaatggatgcacacttttaaccaaaaaattcaatccaacaaggactatttatccgaactagatactccaataggtgatggcgaccatggtggcaatatggcgcgtggtatgactgctgttattgaaaaccttgataacaatgaatttagtagtgctgccgatgttttcaaaaccgtgtccatgcaacttttaagcaaagtaggcggagcatctggaccactctatggttctgcatttatgggaattacaaaagctgaacagagtaaaagtaccatttcagaggcacttggcgcaggacttgaaatgattcaaaaacgtggtaaagctgaacttaatgaaaaaacaatggttgatgtttggcacggtgttattgaagcgattgaaaaaaatgaattgactgaagaccgtatcgattccttagtagatgctacaaaagggatgaaagcaacaaaaggacgcgcttcttatgttggagaacgctcagtaggacacattgatccaggatcattttcttcaggattattatttaaagcattactagaagttggaggtgtctaa

SEQ ID NO: 2102 - DNA, 597 bp, Listeria monocytogenes 4b F2365
atgacttatgataaagattgggcgttacgctggttaaatgacttcggcgaacgcgtacaagaaaacaaacaattattaagtgatctcgaccaagcgattggtgatggagaccacggtatcaatatggctcgcggactcggcgaactcaaaaaagctttcacagaaaaagaacccgctgatttaaaagatgtatttaaaaccgctgggatgacgatggtcagcaaggtcggcggcgcatctggaccactttatggaacagcctttttaaacatgagtaaagcggtagattcagaaacaattgacgcggaaggcttaaccaaagtgcttgaagcaggacttgaagggattgaaaaacgcggtaaatcccatgctggcgagaaaacaatgattgatgtttgggaaccggttgtaaatgcgcttcatcaggaagatttaacagatgatgttgttgatgccgctttacaaaaaacaaaagatttaaaagctactaaaggtcgcgcgagttatcttggtgagcggtcaattggtcaccttgaccctggcgcttactcttctgccctgctatttcacgcaatgcttcaaacggaggtgagctaa

SEQ ID NO: 2103 - DNA, 585 bp, Staphylococcus aureus COL
atgaaagtgaatgatatgaaagcacgtttattaaatttagaagaaacgtttaaaaaacatgaatctgaattaactgaattagatcgagcaattggtgatggtgaccacggggttaacatggttcgtgggtttagtagtcttaaagacaaacttgatgatagctcaatgcaatcattgttcaaatcaactggtatggcattgatgtcaaatgttgggggtgcatcaggaccactgtatggctttagctttgttaaaatgtctgcagtcaccaaagatgatatggataatcaagatttcattacactaattcaggcatttgccgaagcggttgaatcacgtggtaaagttactttaaatgaaaagacaatgtatgatgtagtagcgcgagcagcagagaagcttaaaaatggtgaaactttaacattcaatgatttacagcaattagcagataatacaaaagatatggtagcaacgaaaggtagagctgcatattttggagaagaatcaaaaggttatattgatccaggtgctcaaagtatggtttatattttaaacgctttgattggagatgaagataatgcctaa

SEQ ID NO: 2104 - DNA, 576 bp, Staphylococcus epidermidis RP62A
atgaatgtagcagatatcaaagcacgcttattagatttagaaaatacttttaaagaaaaagaaagtgaactgactgatttagacagagctatcggtgatggagatcatggtgtaaatatggtcagaggtttcgaacacttaaaagaaaaaatagatgatcaaagtatgcaagcgctatttaaatcaacaggtatgacattaatgtctaacgtaggtggtgcttctggaccattatacggatttggttttatcaaaatggcgagtgcagtgaatgatgaaattgatcatgataatcttaaagaggtacttaaagcgtttgctgatggcattcaacaacgtggtaaagtcgaattaaatgaaaaaacgatgtatgatgttatcgaacgtgcgagagaagctgttgaaaaaaatgaaacagtagatctagataaactacaatcatttgctaatgaaaccaaagatatggtagctactaaaggccgtgcatcatattttaacgaagcttcaaaaggttatattgatcctggtgcacaaagtagtgtttatattcttaatgcaattataggaggagagtaa

SEQ ID NO: 2105 - DNA, 627 bp, Mycoplasma capricolum ATCC 27343
atgagtttaaatgtagataatgttaaagaagtgttagtaaaaatagctgaagttgttaatgaaaataaagaagaactttcacaattagatgcagctattggtgatggtgatcatggtcataatatgtctagaggatttttaaaagttgttgaagaattaaaaaataattcatatgatgacataggaagtatttttaaaaaagtgggaatggtgcttgtttcaaatgttggtggtgcttctggcccattatatggaactgcatttttaaaagcagcgacttttgttaataataaaaaagaaattgatataaatgatttttctgtttgcttacaacaagcagttgatggtattaagattcgtggaaaagcgaatgttggtgataaaacaatgttagatgttttacaacctgttagtgatttaataaaagatttgataaatcaaaaatatttagcaaaagaaattttaaataaagcagttgaattagcttttcaaaaagttgagtttactaaagaaattgttgctaaaaaaggtagagctagttatttaggacaaagaagcattgggtataaagatcctggtgcctattctagttatttgatattaaaatgtattagtgaaaatatttaa

SEQ ID NO: 2106 - DNA, 627 bp, Rubrobacter xylanophilus DSM 9941
gtggacgctacggagaagacgcttgaggcggtgcgcgcgatggccgccgcgatggaggagcgccgcgtcgagctgacccagctcgacgcggccatcggcgacggggaccacggcaccaacatgcaccggggctttcgggccgcgctggagcgcctgcaggcctctccccccggcaccccttcggaggtcctgaaggcggtctcgatggcgctggtgagcagggtgggcggcgcggcggggccgctctacgggacggcttttctcagggcctcctcggcgctctccggccgggaggagccctccgcggccgacgtcgccgctgcgctcgaggcggcgctcgccggcgtgaagcagcggggcagggccgaggtcggggacaagaccatggtcgacgccctggagcccgccgtgcgggcggcgaggcaggccgagggcaagggggtcgcggcgatgctccgcgcggccgcggaggccgccggggagggggccgaggccaccgtcccgctcaccgccagaaagggccgggcgagctacctcggggcgcgcgcggccggccacaaggaccccggcgccgcctccaccgcctacctgctcgcggccgccgcgcgcgccgtggagggctcttga

SEQ ID NO: 2107 - DNA, 585 bp, Staphylococcus aureus JH9
atgaaagtgaatgatatgaaagcacgtttattaaatttagaagaaacgtttaaaaaacatgaatctgaattaactgaattagatcgagcaattggtgatggtgaccacggggttaacatggttcgtgggtttagtagtcttaaagacaaacttgatgatagctcaatgcaatcattgttcaaatcgactggtatggcattgatgtcaaatgttgggggtgcatcaggaccactgtatggctttagctttgttaaaatgtctgcagtcaccaaagatgatatggataatcaagatttcattacactaattcaggcatttgccgaagcggttgaatcacgtggtaaagttactttaaatgaaaagacaatgtatgatgtagtagcgcgagcagcagagaagcttgaaaatggtgaaactttaacattcaatgatttacagcaattagcagataatacaaaagatatggtagcaacgaaaggtagagctgcatattttggagaagaatcaaaaggttatattgatccaggtgctcaaagtatggtttatattttaaacgctttgattggagatgaagataatgcctaa

SEQ ID NO: 2108 - DNA, 585 bp, Staphylococcus aureus JH1; identical to SEQ ID NO: 2107

SEQ ID NO: 2109 - DNA, 639 bp, Thermoanaerobacter sp. X514
atggttatcacaaaaaatgatgtcctaaaaattgtggacaaaattgtagaggttataaaagaaaataaagagtaccttacagagttggatgctgctattggtgatgcggaccacggaataaatttagatagaggatttgatgccgtaaagcaaaaattgaccacattgcctgaaactactgatatagggacaatattaagaactataggcatgactcttgtatctacggtgggaggagcttctggtcctttatatggtacagcttttatgagggctggacaagtagttcagggtaaaaatgaactttctgaagaggatatagttaaaatctttgaagctgctttagatggcatcaaacaaagaggaaaagccgaagcaggagacaagactatgatagattctattgaacctgcatataaagctttaaaagagagtttagagaacaacattgcattacctgaagcattaaatagagcagctaatgctgcaaaagagggaatggaatacactaagaatatttctgcaagaaaaggaagagcaagttacttaggagaaagaagtattggacacttagatccaggggcaacatcagcatatttgatgataaagtctttttctgatgttgtcaatttatcatga

SEQ ID NO: 2110 - DNA, 759 bp, Halorubrum lacusprofundi ATCC 49239
atgagcgggaacgaatcggacggagacgggggcgtgtcggacgaccacggggtcgccgtcgtcgcggcagtcgaggcgatcgcggaacgcatcgaggcggagcgcgactacctgacggagctggactccgccatcggcgacgcggaccacggcggcaacatggcgcgagggtgggccgcggcgaccgaggccgcgcgcgacctcgacgatccggaccccgagacggtctgtaagacggtcggcaagacgctcatggccgaggtcggcggggcgtcgggccccctgttcggcgggtcgctcgtgttcgcgagcgccgagctcgacgacgggctcaccgccgagagcgcggtcgcgttcgccgagacctacttaaccaaggtcgaggaacgcggcgacgctcgggtgggcgatcagacgatagtcgacgcgctcacgccgacggtccacacgttcaagaaatcgatcgagacggacgacctcccgccgctcgaagcgctggcgaaggcggtcgacgcggccgagcgcggcgtcgcgttcacggtcccgatccgggcccggaagggccgcgcctcctacctcggctggcggtcggtcggccaccaggaccccggcgcgacgagcgtgctgtacatcctcgaggagctgctcgcgacggccgccgacgccctcgacgctgagatccccgacgtcgacgcgacctcgccgacgattccggacgaggcgaccgaggacgacagcgcgacgacggaggacgactga

SEQ ID NO: 2111 - DNA, 630 bp, Acidimicrobium ferrooxidans DSM 10331
gtgagcgagcccggttcgctcgcctggtggcacgacgtctggcgctgtttcgcggcgtcggtgcgcgaccagcgcacctggctggacgatctcgacgctgcgatcggcgatggtgaccacggtacgaacctgaaccgaggtctcgagcgcgccctcggggccctcgagacctcgcagacgccgcgagcggggctgaggagtgttgggatggcactgctcggcacggtcggcggggcatcaggcgcgctgtggggctttggctggaccaaggcctcggcggcagccggcgacgggaccggcgccccaacgcccgacgaggtcgtggccacgctgtcgctattccgggacgcggtgctcgagcgtggccacgccgagctcggcgacaagaccatggtggatgtcctcgtgccggcgctggcgtcgctcgctgccgagctcgggactcagcgctccttcgccgaggcagccgctaccgccgcgtccgtggcctcggagcgtgccgagtcgaccatccccctcgtggcgcgcaagggccgcgcgtcgtatctcggggagcggagcgcaggtcacgaagaccccggtgcggcctcgatggctctgttcttcgcatgccttggcgaggtgagctga

SEQ ID NO: 2112 - DNA, 627 bp, Actinosynnema mirum DSM 43827
atggggtgcggggcgcgcgaggtcgccggggccgtccgggcgctggccgacgtggtggtggcgcaccggaacgagctggtgcggctggaccgggagatcggcgacggcgaccacggggagaacctgagccgggggttcctggcggcggcggagaaggtcgcgctggccgagcccacgacgccgggggcggtgctgaagctggtcgccacgacgctgatctccaccgtgggcggggcggccggaccgctgtacgggacggcgctgctgcgggccgcgaccgccctcggcgaggtcgccgagctgtccggggacgacgtcgcgctcgcgctgcgggcggcgctggacggggtcgtggcgcggggcaaggcgcaggtcggggacaagacgatggtggacgcgctgagcccggccgcggcggcagccgccgggctcggcggggccggggtgggcgaggtgctcgccgccgccgctgccgccgccgagggcggggcgcgggcgaccgtgccgctggtggcgcgcaaggggcgggcctcgtacctgggggagcggtccgccgggcacatggaccccggcgcgcggtcgaccgcgctgctgctgggggcgctggctcgggtggccgccgggtga

SEQ ID NO: 2113 - DNA, 615 bp, Geobacillus WCH70
atggcgtttggcgtggaacaggcaaaacgatggatgaacatcgcaaacgatcacattcaacaacaaaaacaatatttaacggagctcgatcaagcaatcggcgatggcgaccatggattaaatatggcgcggggatttcaagaagtagttgaaaaaatcagttctaccaattacgaagatctcggttcgcttttcaaagatgtaagcatgacgctaattgcaaaagtcggaggagcgtcgggaccgttatacggcactgcttttttgaaaatgtcgcttgcgctcgcgggaaaaaaggaagcggatgataaagagctgatcgcagcgttagaagcggcgctagacggaatcaaagcgcgcggaaaagcaagcgttggcgaaaaaacgatggttgatgtgtgggagccggtcatagagttgttgcgggagaagggaagcatgcgagcgaaagaagcagcgcttctcgcaaaagaaaaaatggaacatacaaaagaactcgaggcgaaaaaagggcgcgccgcttatttgggatcacgttcggttggccacatcgatccaggttcggcttcttcgtattttttgtttgccgctttagcggaagtgctcgagggataa

SEQ ID NO: 2114 - DNA, 615 bp, Rhizobium leguminosarum bv  trifolii WSM1325
gtgcaggcggaaccggtgcttgtggcaggattgatcgaggtgtgccgcgcgacgatcgcggcaaacagcgatcacctctgcgcgctcgatcgcgccatcggcgatggtgatcacggaaccaacatgcggcgcggctgtgaggcagtgagcgccgaaggcgaaagcctgtccagcctgcccttccccgacgccatggaaaagatcggcctgacgctggtgatgaatgtcggcggtgccgccgggccactctacggcacgctgctgatggagatcggccgcgagcttcgcaaaagcaacgagaaagccgatttttccctcgtgctgaaacaggcaatcgacgccgtcgcaaggcgcgggcgggcgcatgccggcgacaagacgctgctcgacgtgctctatcccgtgcatgccgcgctggagaagcggtctccactcggtgacgtcgcccgcaaggccgaacgttctgccagccgcacggctgacatgaaggcgatgcgcgggcgcgcggcctatctcggcgaccgctcgatcggccatgtcgatcccggcgcgtcgagctgcgcgctgctgaccacggcgatctgccgctatctcggggagcatcgtccgcaatga

SEQ ID NO: 2115 - DNA, 648 bp, Chloroflexus aggregans DSM 9485
atgccaattactgtcgaacacgtcacgcactttctcaccgcagcagcagcgttaatccatgagcggcgcgatgagttaaccgcgcttgacgccgcgattggcgatgccgatcacggggcaaacctcgaccgtgggtttaccgctgtgatggcacgtctgccgagtgtggccgataaagatatcggtactgtgctgaagaccaccgggatgacaattgtttctaccgtgggtggcgcctcagggccattgtatggcacggcttttgtccgggcagggatggcgttggccgatcggcatgagctaagtaccgaggaggtactactcgccctcgaagcagcacttgatgggattgtagcgcgtggtaaagcgcagcgtggtgaaaagacgatggttgatgcgcttgctccggcaatcgaggcgctgcgggccgcgttagctgccggtgagccgctgggtcgggcgttgcaggcggctgcggatgcggctgagggcggcgcgaaagcaactatccctatgcttgccctgaaggggcgggcgtcgtatctcggtgaacgcagtatcggtcatcaggatccgggagcaacttcgacagcgtatctgctccgtgcgctggcgatgacgtgtagccgtgttgaggagggcgcatga

SEQ ID NO: 2116 - DNA, 600 bp, Anaerococcus prevotii DSM 20548
atgaatatagataagttaaaagttttatttacagaaatatcagatgaaataatagcaaatgaagaatacctaaccgatctggataggagcataggagatgcagaccatggttacaatatggccaagggatttaaggctataaaagctgatctagataaggaatattcaagcctcaaggattttttcaataagattgctatgaatctcttatctaaggtaggaggagcgagtggtcccctctacggatcatttttcatgagctttgctaaagcactcgatggcaaggaagatttgactagagatgaactaaaccaggccttcgacgaaggagttgctgctgtcaaaaaaagaggaaaggcccaagttggtgataaaactatggtagatgtcctagagccagtttctaacgcccttaaggaaggaaaggaccttgatgatgtagtaaaaatcgctgaagagaaaatgacctacaccaaagaaatcaaggccctaaagggaagagcttcctacgtaggggaaagatctatcggtcacatcgacccaggtgcctatagctcttatttaataatcaaaaaagccttcggaggatgtcatgattaa

SEQ ID NO: 2117 - DNA, 657 bp, Nakamurella multipartita DSM 44233
atgagtgaggccgaccggaccagctgtgacgcggccggggtggtggcggggatccgcgccgtcgccgcgaccatcgccgagcacaaggtggaactgacccggctggaccgggacatcggcgatggcgaccacggcgagaacatggcccgcgggttcaccgcggtcctggccaagctggacgccggcgagccggacaccccctcggccgtgctcaaactggtggcctcgacgctcatctcgaccgtcggcggggcggccggaccgctctacgggaccgcgttcctgcgggcctcgaccgcggtcaaggaggccacgacgctggacccgcaggcgatcgtcaccgcgctgaccgccggccgggacggcgtcgtcgcccggggcaaggccgagctggaggacaagacgatggtcgacgcgctcaccccggcggtgaacgcggcccgcgcggcggccgacgccggcggcgacgtcgccgcggtgctccgggcggcggccaacgacgcggccatgggggccgcggcgaccatcccgctgcaggcccgcaagggtcgggccagctacctgggcgcgcgttcgatcgggcatcaggacccgggggcgaccagcaccgcatacctgctcgaggcgctggccgcggtcgcggagaaggcgccgtga

SEQ ID NO: 2118 - DNA, 675 bp, Ralstonia solanacearum
atggcaatcgctgactggccggcccacgagcggccgcgtgaaaaactgctcacccaaggtcccgccgcgctgtccgacgcggaattgctggcgatcttcctgcgcgtcggcatgccgggcaagagtgcggtcgatctcgcccgcgagctgctggcccacttcggctcgctcgggcgcctgtgtcatgcgtcgcggcgggagttctccgccatccacggcatggggccggccaagtacgcccagttgcacgcgctgctggaggtggcgcggcgcgcgctcaaggaagaaatcgcgtacggccagaccctcgaatccccgcagagcgtcaaggatttcctgcggctcacgctcggccaccgcccgcaggaagtgttcgcctgcctgttcctggacgtgcggcaccggctcatcgcctgggaagagctgttccagggaacgctgaccgaagcccgcgtctacccgcgcgagatcgccaagcgggccctgcaccacaacgcctcggcgctgatcctgtcgcacaaccacccgaccggccatgtcgagcccagcgaatcggacctggtgctcacccgtgagctgtgccgggcactcgcgctgctcgacgtgagagtcctggaccacatgatcgtcggccgcgccgaggtctacagcttcctggagcacggcaaaatgtag

SEQ ID NO: 2119 - DNA, 717 bp, Acidovorax sp. JS42
atgcccctcaaagacctgccgctggatgcccagccccgcgaaaagctgctcgcacgcggccccgctgcactgtccgacgccgagctgctggccatcctgctgcgcacgggcctggcgggcaagggcgtgctgcagctggcccaggagctgctggatgatcccgtgcgcgactccgccacgggccgcagcgctggcggcggctttggcggcattgccgggctgctgcacgccagcagccaggacctgcagcgcatcaagggcctgggccccgccaagcgcgccgagctgatggccgtgctggaactcgcgcgccgcgccctggcccagcagctgcgcgagcgcgaggtattcgactccccgcaggccgtccaacactacctgcaactgcacctggcggggcgcacgcacgaggtgttcgccgtgctgttcctggacagcggcaaccgcctgatcgccatggaagagctgttccggggcacgctcacgcaaacctcggtctacccccgtgaagtggtgctgcgcgccctgcaccaccatgccgccgccgtggtgctggcgcacaaccaccccagcggcagcgtgcagcccagccgcgccgacgaggcgctgacccagaccttgaaggccgcactggcgctggtggacgtgcgcgtgctcgaccatgtgatcgtggcgccaggcgcggccctgtccatggccgagcaagggctggtgtga

SEQ ID NO: 2120 - DNA, 675 bp, Polaromonas naphthalenivorans CJ2
atgctcatcaaagacctgcccgcagacgcccgtccgcgcgagaaactgctggcccgtggccctgcggcgctcagcgatgccgaattgctggcgctgctgctgcgcaccggcctgcccggcaagaatgcgctgcagatgggccaggaactgctcgataactttggcggcgtggccgggctgctgcacaccggagccgaagcgctcaaatccatcaagggactcggccctgccaagcgcgccgaaatcgtcgccgtgctggaactggcgcgccgcgccctggccgaggagctgaaggaaaaggcgctgttcaccacgccgcaagcggtgcgcgactacctgcagctgcagctgggcagccggccgcacgagatttttgccgtgctgttcctggacagccagcaccggctgatcgcgctggaggagctgtttcgcggcacgctgacgcagaccagcgtgtacccgcgcgaggtggtgatccgggcgctggcgctgaatgcggccagcgtggtgctggcgcacaaccacccgagcggcgcggcgcagccctcgcgcgccgacgaaatgctgacccagaccctgaaaaccgcactggcgctggtcgatgtgcgggtgctcgaccatttcgtggtgaccgcctccctggcggtgtcgatggccgagatgggactggtttag

SEQ ID NO: 2121 - DNA, 714 bp, Verminephrobacter eiseniae EF01-2
atggccctcaaagacctgcccgccgatgcccagccgcgtgagaaactgctggcgcgcggccccgccacactggccgatgccgaactgctggccatcttgctgcgcaccggcatcatgggcaaaggcgtgttgcagatggcgcaggaattgttggatccccccggggtagacgccgccaccggacaacccaccggcggctttggcggcattgccgggttgctgcacgccagcgccgccgatctggagcgcatcaagggcctgggcccggccaagcgcgccgaactggtggcggtgctggaactggcccgccgcgcgctggcccagcaactgcgcgaatgcgcggttttcgacactcccgatgccgtcaagcactacctgcagctacaactggcagccaagggccacgaggtgtttgccgtgctgttcctggacaaccagaaccgcctgctggcgatggaagaattgtttcgcggcacgctcacgcagaccagcgtgtacccgcgcgaagtggtgctgcacgcgctgcaccaccgggccgccgccgtggtgctggcgcacaaccaccccagcggcagcgtacagccgagccgcgccgacgaagcgctcacgcagaccctcaagagcacgctggcgctggtggatgtgcgcgtgctcgaccatgtgatcgtggcgccgggccaggcgctgtcgatggcagaaatgggcttgctgtga

SEQ ID NO: 2122 - DNA, 669 bp, Methylibium petroleiphilum PM1
gtgaaagaccttcccgccgacctccgaccccgcgaaaagctgctcgcccgcggcccggcggcgctggccgacgcagaactgctggcgctgctgctgcgcaccgggctcaagggccagggcgtgctgcagctcgcgcaggcgctgctcgatcgtttcggcggactctccggactgctggcaaccgacacagccgagctcggcagcgtgaaggggctggggccggccaagcgggccgagctggcagcagtgctggagatcgcccgccgcagcctggcctcgcggctggcgcagaccccggtgttcgactcgccgcaggccgtgaaggactacctgcagctccagttggccagcaagccgcacgaggtgtttgccgtgctgttcctcgacacgcagcaccggctgctggccttcgaggagctgttccgcggcacgctgaatcaagcgagcgtgtacccgcgcgaagtggtcaagcgcgcgctggcgctcaacgccgcggcggcgatcctggcccacaaccacccgtccggcgtggccgagccctcgcgtgccgacgaggccctgacacaggcgctgaaggccgcgctggcgctggtcgacgtgcgggtgctcgatcacttcgtggtggcacggggcagcgtggtgtcgttcgccgagcgggggctgctgtga

SEQ ID NO: 2123 - DNA, 720 bp, Polynucleobacter necessarius asymbioticus QLW P1DMWA 1
gtgattgtatctaggccgacaccgaatctgcactcctcgataccaaattggcccaaaagcgagcagccaagggagaagctgcgaatccatggcgcccgagccctcactgatgctgaattgctcgcaatttttttacgcgttggcgttaaaggaaagagtgccgtaaccctggcaaaagatctgctgcattactttggcagccttcctcgccttttagccagcactccagaggaatttattcgcattcatggcatgggcctttcgaaatggtctcaaatacaggctgcctatgagcttgttaaaagaagcttggaagagggtcttgctcaaaacagtattttctcctcgcccggacatgtcaaagagtaccttcaaagcaaaattggccgccttccccatgaagtctttttatgcctataccttgaccccagactgcatctgattgagtgtcaggagctctttaggggctcaatcacccaaacagccgtatacccacgagaaattctcaaagaagccctatctagaaatgccagcgccctgatcgtggctcataaccaccctagcggcaacccattacctagtcaggctgaccaagatctcactcaaacactactcaaagccttgcaatgggttgatatttcacttttagatcactgcattgtgagtagcagtggttttttctctttttctgaatcaggccttatgaatcatgatgattga

SEQ ID NO: 2124 - DNA, 681 bp, Delftia acidovorans SPH-1
atggctctcaaagacctgcctgcccaggcccagccgcgcgaaaagctcgcggcgcgcggcccctcggcgctttccgatatcgaactgctggccatcgtgctgcgcaccggcatggccggcaagggcgtgctgcagctggcccaggaactgctgcagctgcccggccgggccggcctgtccgggctgctgcaggccgggcacgccgacctgaaggccatcaaggggctggggccttccaagtgcgcgcaactcctggccgtgctcgaactggcgcgccgcgccatggccgagcaactgcgcgagcgcccggccctggcctcgcccgaggccgtggcgcgctacctgcagctgcacctggcggcgcgccagcatgaggtgttcgccgtgctcttcctggacggccagcaccggctgatcgcactggaagaaatgttccggggtacgctcacgcgcaccagcgtctacccccgggaggtggttctgcgcgccctgcaccaccatgcgggcgccgtcatcctggcccacaaccatcccagcggacaggtccaggccagcgccgccgacaaggcggtcacgcagaacctgcaggccgccttgcgcctggtggacatccaggtgctggaccatgtgatcgtggcgcccggtgcctcgctgtccatggcgggccaggggatgctgtag

SEQ ID NO: 2125 - DNA, 669 bp, Leptothrix cholodnii SP 6
atgaaggacttgccagcggccatgcgcccgcgcgaaaaactcctggccctggggccggcagccctggccgacgccgaactgctggcgctgctgttgcgcaccggcctcaagggcacgggggtgttgcagctcgccggccagttgctggcgcagttcggcggcatcggcgggctgctgcaggccgacccggccggcctgaagaccgtcaagggactgggcccggccaaacgctccgaactgcaggccgtgctcgaactggcgcgccgcgcgatcgtctcgcagctggcgcagcggccggtcttcgacagcccgcaggcggtgcgcgactacctgcgcctgcagctcggccggctcgatcacgaggtgttcgcggtgctgttcctggacgcccagcatcgcctgatcgcctacgagccgctgtttcgcggcacgctgacgcagaccagcgtctacccgcgcgaggtgctcaagcgcgcgctggcgctcaacgcggcggcgctgatcctggcgcacaaccacccgtcgggcgtggccgagccgtcgcgcgccgacgagttcctgacccagagcctgaagaccgcgctggcgctgatcgacgtgcgggtgctcgaccatttcgtggtcggccgcgagagcgtggtgtcgtttgccgagcgggggctgctgtga

SEQ ID NO: 2126 - DNA, 717 bp, Diaphorobacter TPSY uid29975
atgcccctcaaagacctgccgctggatgcccagccccgcgaaaagctgctcgcacgcggccccgctgcactgtccgacgccgaactgctggccatcctgctgcgcacgggcctggcgggcaagggcgtgctgcagctggcccaggagctgctggatgatcccgtgcgcgaccccgccacgggccgcagcgccggcggcggctttggcggcattgccgggctgctgcacgccagcagccaggacctgcagcgcatcaagggcctgggccccgccaagcgcgccgagctgatggccgtgctggaactcgcccgccgcgccatggcccagcagctgcgcgagcgcgaggtgttcgactcgccgcaggccgtccagcactacctgcagctgcacctggcggggcgcacgcacgaggtgttcgccgtgctgttcctggacagcggcaaccgcctgatcgccatggaagagctgttccggggcacgctcacgcagacctcggtctaccctcgtgaagtggtgctgcgcgccctgcaccaccatgccgccgccgtggtgctggcgcacaaccaccccagcggcagcgtgcagcccagccgcgccgacgaggcgctgacccagaccttgaaggccgcgctggcgctggtggacgtgcgcgtgctcgaccatgtgatcgtggcgccaggcgcggccctgtccatggccgagcaagggctggtgtga

SEQ ID NO: 2127 - DNA, 678 bp, Variovorax paradoxus S110
atggcattcaaggatctccccgcccacgcccgcccgcgcgaaaagctcatcgcgcggggagccgccgcgctggccgacgccgagctgctggcgttgctgctgcgcaccggcgtggcgggaaaaaacgtgctccagctcgcgcaggagctgctcgaccacttcggcggcctttcgggcctgctgcagacgagcgccgaggacctgaaggtgatcaagggcatgggcggcgacgccaagcgcgccgagctcatcgccgtgctcgaactggcgcgccgcgccatggccgagcgcctgaaggagcgcacggtgttcgactcgcccggcaccgtcaagcagtacctgcagctgcacatcggatcgcgcccctacgaggtgttcgcggtgctgtttctcgatgcgcagcaccggctgatcgtgctggaggagctgtttcgcggaacactcacccagaccagcgtctacccgcgcgaagtggtcacgcgtgcgctgcaccaccaggccgcggccgtggtgctgtcgcacaaccatccgagcggcagcatcgagccctcgcgggccgacgagtcgctcacgcagacgctcagggccgcgctttcgctgatcgacgtgcgcgtgctcgaccatgtgatcgtcagtgccggccagagctattcgatggccgagaaagggctgctctga

SEQ ID NO: 2128 - DNA, 525 bp, Chlorobium luteolum DSM 273
atgggcatggtagacactccgggcgaacgccgcggcacgaaggcgaagggtcatcagcggaagcgtatcgggtttcgtctcgacatgaccccgatggtggatgtggcgttcctgctcctcaccttcttcatgctgacgaccacgttttcgaaatccaacaccatggagatcaacatcccgcctgaacagggcgaggtgaaagtagccggatccaacatactgacgctccgcataccgggagacggcatggcctactgttccctcggggaccttgccccccggcgcattccgctctatgagcccggagataaaggcagaaaggcactcagcggagatatgcgcagtctgcttcgccagcagtccctttcgaacagcaagctggtgatcgttgtcaagatcggccagaaagccaaatacaagcagcttgtcgacataatcgacgaactgaacatgatgaaaattgaccggttcagtcttgacgattacaccccccaggacgatctggagataaagaaatccgtatag

SEQ ID NO: 2129 - DNA, 540 bp, Chlorobium chlorochromatii CaD3
atggcactgcacggagaagagcaacgccccactagccccacccgcttacctaagcgccatcccgctcgtcgaggctaccatctcgatatgacgccgatggtggatgtagcatttctactcctcaccttttttatgcttgccactacctttactcccttttatagtatggaactgtcgcagccgcaaaagcagcgccgccttgccgtacaagccgaagaggtgcttaccatgcaggttgcaaacaatggaattgtacactaccgccttggcagcaacgcccttagttccatgccactctatcaagaaaccgcaaccacgcaagagccttcggcaacgccaatgctcaatccagctctgcaccacttcctacgctccctgaaagccgagcaacccaacatcacggtagtgctcagcatgaacaatcaagcacgttatcgcgatctcgtggctgttgttgatctattgaatagcttgcaaattacccgctttagccttggagagatagatggagaggaaaaacaaaaagcaggtgtgaaatga

SEQ ID NO: 2130 - DNA, 528 bp, Cytophaga hutchinsonii ATCC 33406
atggctgaaattaacacaggcggcggcggcggtaaggatggtaaaaaaagatccaaaaaaatgtctacgaaagtagatatgacaccgatggtggatttggctttccttttaattactttcttcatgttggctaccactttaacaaagcaacagaaatttgatttcggggttcctccggatgtaacaaatccggaagatcaaccggaattgaaagccagtaatgcaatcacactgatcttaggaaaagatgatgctatatactggtatacaatgaatcaggatggcagcactgattttcacgaaacagatttctctgatgacggaatccgtgcaacactgatcgaacgtaagaaagccgttggtgcagacttaaacgttgtgatcaaaccgatgaaagattcgaaatacaaaaatttaattgatattattgatgagttagccatactgggtattggtaaaaaagctttggttgaagcaactcccgatgatattaaattggttcaggcagaaaacgcttcagtaaattaa

SEQ ID NO: 2131 - DNA, 525 bp, Chlorobium phaeobacteroides DSM 266
atgggaatggttgattctcccaatgaacgccgggctaaaaaaggcagaaagcggattcgcaagaggatcggttttcatctcgatatgacccctatggtggatgtagcgtttttattgctgaccttcttcatgctgacgactacttttgcgaagtccaatactatggagatcagcatgccgcctgagatggaggaggtgaagatcgctgaagcaaatgtcatgacgttgagaatttcaggagaaggcatggcttattgttcgctcggtaatgaggcgcctcgccggctttcgttgtatgagagtggtgacgccagcaggtttgccttgagtgctgaactgcggcagatcttgaaacagcagaccacagccaataaaaagctggttattgtgttgaaaatcagtgaaaaagcaaagtataagtatctggttgatgttattgatgagttgaatcttatgaagattgaccggttcagtcttgatgattttactgatcaggatgaacttgaaatcaaaagggcggtttag

SEQ ID NO: 2132 - DNA, 555 bp, Flavobacterium johnsoniae UW101
atggctgaattaaataccggcgacggtggtggcggaaaaggtggcaaggtaagaagcaaaaagcaaagttctaaagtcgatttaacggctatggtggatttggcattcttattgatcacattctttatgctaaccacatcgttgtcaaaacctcaatcgatggatttgtcattgccagataaagatcctaaaaacgatgaaaaacctgttaaggttgatgagaatcgtactatgacagtgatgttaggtgaaaataataaactgacttattatatgggattattggagtctcctattgcaggaccaaaagatatctcatacggtaaagatggtatccgtagagaattgcttaaaagaaaaaaatctgttttggaatactctgctggtttagggaaacctaaaaacggaattattgttattattaagccaacaaaaaaatcaacttaccgtaatttagttgatatgctggatgaaatggcaattactggagtagatacttatgcaattgttcctgaatttacaccagaggagactaaattgatagataaaaaataa

SEQ ID NO: 2133 - DNA, 525 bp, Chlorobium limicola DSM 245
atgggaatggtagactctccgaacggtaaccgatccgctaaaaaaggaaaaaagcggcagaaaaggatcggttttcatcttgatatgacgcctatggtcgacgttgcatttctgctgttgacctttttcatgctgaccacaacgtttgccaaatcaaataccatggaaatcaaccttcctcccgataccggagaggtgaaggtttccgagaccaatgtcatgattgtccggcttgccggtgacggtatggcttactgttcactgggcgaacagataccacgccgcatcgctctgtatgattcaggagacgcaaaccggcttgccctgagcggagagttgcgttcacttctcaggaaagagagttcatcgaataaaaaaatggtgattgttgtcaaaatcagcgaaaaggcgaaatacaggaatcttgtagacctgatcgatgaactgaacctgatgaagattgaccgtttcagtctcgatgactataccgatcaggatgaagctgaaattaaaagggctgtttaa

SEQ ID NO: 2134 - DNA, 549 bp, Chlorobium phaeobacteroides BS1
atgggcatggttgattcaccaaatggccgggattccggccgcaaggcaaaacgcaggagaaaacgtcttgggtttcatatcgacatgacacctatggtggacgtggcgtttcttctgttgacctttttcatgctgaccacaacgttctccagggccaataccatggagatcaatattcctccggagaattctgaggtgaagatcgcagaaaccaacgtgatgactttcaggatcgccagggacggttatgcgttctggtcgatcggagaaggaacgccaaggaaaatgcgtctctacgatgagagtgacgcaatgacgctgagcagcgaagttcgccaggtgcttgttcagcagacgaaggcgaacagtaaacttgtgattgtggtcaagatcagtgatcaggcaaaatacaagtatcttgtcgatcttatcgatgagttcaatatgatgaatatcgatcgtttcagcctggatgactttaccgatgccgatgccaaagctatcggtatccttgcgtcaggcattacggaagtcccggatctgaactga

SEQ ID NO: 2135 - DNA, 525 bp, Pelodictyon phaeoclathratiforme BU 1
atgggtattgttgactctccaaatggacgccggagcaataaaaaagggagaaagcactcaaaaaggatcggctttcatctcgatatgacaccgatggttgatgtcgcatttcttctgctcaccttttttatgctgacaacgaccttttcaaaagccaacacgatggagatcaatattccaccggacaaggctgaggtaaaggttgtcgagtcgaacgttatgacactcaggattgccgataacgttatggcctattgttcactgggcgatgaagcgccccgcaggattccactgtacgatcccctcgatacccaccagttggcattgagcggggagctgcgtcagcttctcaggcagcagacagcggcgaatacgaaactggtcattgtggtcaagatcagtgaaaaggcaaagtataaacacctggtcgatattattgacgagctgaacctcatgaaaatcgaccggttcagtctcgatgactatacggagcaggatgcagtcgaaatacagagggctatttaa

SEQ ID NO: 2136 - DNA, 567 bp, Prosthecochloris aestuarii DSM 271
atgggactggttgattctcctaatgatcgcagatcttcacgtaaaggcaaccgtcagagtaaacgtctcggttttcatattgatatgacgccgatggtggatgtggcgttcctgctgctgacgttcttcatgctgacaacgaccttcggcaagcccaataccatggagatcaatattccgccagagagcggagaggtcaagattgccgaaaacaacgttatgacattccgtatcgttgaagacggttatgcatactggtcgatcggtgatcagactccgacccggatcagcctgtacgacgaaggccgtgaacgcggagcaatgtcgctcggaaaggagcttcgtctcatgctccgtcagcagaccgccttgaacgctaagttggtaattattgtcaaaatcagcgacagggccaagtacaagtaccttgtcgatcttattgatgagttcaatcttcttcagatcgaccgtttcagtctcgatgattttaccgatgatgacgccagtgccgtgggtatggttgcttcaaccggcagtaacgtcgggcgtgatgcggcaatgaactga

SEQ ID NO: 2137 - DNA, 540 bp, Pedobacter heparinus DSM 2366
atggcagaattagatacctccggcggggggggcaaaaaaggcaaaaaggtaagaagtaagaaagccaataccaaagtggatttaaccgcgatggtggatttggccttcttgttgattacattctttatgctaactacctccctgtcgaaaccaattgcaatggatattgcaaaacctgataaagatgacaattctcaggaacgtaacgagttacgtgcatcggaaaccatgactattttgttgggtaaaaacaataaagtagcctggtatatgggtgaagcaggtaaatcggtgcctaatattgagagtttcgctgatatcagaaaatcaatattagataataagaaaaaagtagcagatgctaccggcggaagacagatcattatggtgatcaagcctacttcgggagctacttataagaactttgttgatattatggacgagttggcgatcactaagatcaagacagcgcctgcaattgacgacgagaacattactgatgctgaaaaagatttcatgaagaaagctggaattttataa

SEQ ID NO: 2138 - DNA, 582 bp, Dyadobacter fermentans DSM 18053
atggcagcaatagaagaatccggtggtggtgggcacggtaaaggtgatggtaaggtccggggtaagaaaatgtccacccgtgtggacatgactccgatggtggacctgggatttttgcttattacttttttcatgcttgcgacaacaatgtctaaaccgacatccatgtcgctcgcggtgcctgacaaaaccgaagatcaggaaaaaccgaccgaacctttgaaagcatcgaaagtattgaccctgtttatgggcgataacgacgatgtgtattatctggacggtatcgctgctgatgatgataaagcgaaaactgaactgaaaacgacccgctacgggcacgatctcagaaccgtgatcttcgcgtctcaaaagcgtatcaatgcagctaatccaaaggacaaagacggtaatgaagcgtttgtggtggtaattaagcctacggaagtatctacctataaaaacatggtagacgtgctggatgaaatggcgatcaccaagaccaaacgttatgcactcgtggacaacctgaccgactcggagaaggaagttctcggtgacaaaatcaaacctaaaaattag

SEQ ID NO: 2139 - DNA, 594 bp, Chitinophaga pinensis DSM 2588
atggcagaaatggataccagcagtagtggtgggaaaggtaaacaccagggtacgaaatccaagaagcagtctacacgcgtagacatgactccaatggtggatctcggctttctgctaatcactttcttcatgttgactacgactatgagcaagcccaaaacaatggacttgatcatgccgaaagatactaaggatgagaaagagcagaacaaggtaaaagaaagtactgcactcactatactgcttggaaaaaaagatcgcgtatactactacgaaggtctggcacaggatccgaatgcttcggcaaatcctgaatttttcaaagcaactacgtttgctaatactggcggcatcagagatgtaattatcaaaaagcgtgatgaggttgctcaattaaggaactcaaagggagagcctgaagatgtagtgattatcattaaagctgataatgatgctacatacaaggacttcgttgacattctggacgaaatggccattaaccgcattcaacgttatgctacagttgacatcagcgatcaggataaaacctggatccagcagacggaaacagctaacggcggtggctccaagtaa

SEQ ID NO: 2140 - DNA, 2598 bp, Ruegeria sp. TM1040
atgacagataaccagagcgcgacggctcaagaagaccgttcgcttgaggattttgtagccgatagcgacactggcggtcgcttgccgcaggatgcgttgggacgtaatgcgctgtggtatctaccacttgtctggtcgctgtatcagctttggatcgcctcaccgctgccctttatcctcggggttggcgtgtggaatgacacccagacccgggccattcaccttggttttgcggtgcttctggccttcatcgcgtttcccggactgaaatcgagccctagacaccacattccgattccaacctggatcattggtgccgttggtgcgctctgtgcctcctatctgttttatgcctactccggcgtcgctgcgcgctctggtgcgcccaaccagaccgatgtgatcgtctccatcgtggggctggtgctgctgctggaggccgcacgccgcagccttggtttcccgttgatgggtgttgcgctgttcttcctcgcctatgtcttttttggctcttcgccatggttgccggaagtggtgcaatggaagggcgcctcgatcaacaaagccatgagccatatgtggctaaccactgagggcgtttttggtgtcgctctgggcgtatcctcgggttttgtgtttctttttgtgctcttcggcgcacttcttaatcaagccggggcagggaactactttctgaaactggcctttgcggccctcgggcacctgcgcggcggccccgccaaagcagctgtgatcggctcggccgccaccggtcttatttcgggttcgtccatcgccaatgtggtcacaaccgggaccttcaccattccgctgatgaagcgcgtgggctttcccgccaccaaggcaggcgcgatcgaagtctcttcgtcaatcaacggcgttctgacgccgcccgtgatgggcgcggtggccttcctgatgaccgagtatgtcggcattccttatgtggaagtggtcaaaactgcgatcatcccggcagcgatttcctatatcgcgctgatctacatcgtgcaccttgaagcgctgaaaatgggcatgaagggctcgagccggatgcatccggtcaagttcttcctcggtgcaatcttcaccatctcgatctcgatcctgatcgggggcggcaccctctggctctgcggtgttctcgtgaacgcgctggagagcattgcaggtggcgcaaccacatggctgatcgtcgtgatcatggcggtgctctatgttctggcgctgaaggtggctgccgcacaagaggatctggagatcagcatcgagtcgatgcaaaacctgcctcccacgcgcgagatctttaaaaccggcattcattatatcatgccgatcctgctgctgatgtatcttctgatgatcgaacggaaatcgccggggctgtcggccttctggtcgtccgtcgcaatgcttgtgatcctcgcgacgcagaacccgatcaaggcgatgttccgaggtcaagacactgcaattgctgatttcaaacaaggcattgcggacatctttgaaggcctgatcatcggtgcgcgcaacatgattggcctggcctgcgccatgggtgttgccgggatcatcgtgggcgccgtgacccttacggggattgggcaggtgatggcggaattcgtagaattcctctcgggtggcagcgtcatgctgatgctgatatttgtcgcgctcatctccattgttctgggcatgggtctgccaacaaccgccaactatatcgtggtgagttcgctgatggccggcgttgtggtcgaacttggcgcgcaaaacggcctgatcgtgccgctggttgctgtccatatgttcgtcttctacttcgggatcatggcggatgtgacgccacccgtgggccttgcaagctttgcagctgcggcaatctccaagggtgatccgctgcgcaccggctttcaggcgtttttctactcgatccgcaccgcgctgttgccgttcctctttatcttcaacacagatcttctgctgattgatgtgggaccgatccaggccatctttgtctttatcgtcgcgatgattgcgatgctgctgtttgcggcctcgacaatgaactatttcatcgtgaaatcaaagatttgggaaagtgtcttgttgctcctggtggcctttaccttgttcaggcccgggttcttcctcgatcagttgcaacccgcctttgaaacccgaccgggctctgcggtctacgagatggccgaagcggtcgaagatggcggaacgctgcgtgtgcgtctggtgggcgaaagccttgaaggcgatatggtcgatgcccgtttcctgttgccgcttggcgaaaagggcgcggatgggcagacccgtctctatgatggcgctgggattgagttccgcgatgaggatggcaagatctacgtcgacaacctgaactttggcggtccggcagagcagcttggcatcgatttcgactgggaactggtcgagatggaggttgaggctgatcgtctgccgaaagaagtcttctatctgccggcgttcttgatccttggtttcgtggtcttcctgcaaatgggccggaagcgcaaagaagaaggagtagcctga

SEQ ID NO: 2141 - DNA, 2676 bp, Mesorhizobium BNC1
atggccgaaaaaacgaaaaacgtgacgggagaacaagctccactttccgcagacgatctgcaggatcttgtcgcctcaactgataccggtgctcgggagccctccggtatcgcaggctatatcattgccggcgtggcgctctgctggtcgctgtttcaactctatatcgcttcgccggtgccgttctctctttcctcgctgacgggtctgcccctcgttttcaacgatacgcagatacgctcggtgcacctcgcttttggccttctgcttgcgttcctggcctatcctgccttttcgagcagcccgcgcgatcgcatccctgtgatcgactggatcctggcgatagcggctgcattctgtgctctttacatctttatcttctatcgcgagctttccggcaggccgggcgcatccatcacccgtgatttggtggccgccgggatcggcatggtcctgcttctggaagcaacacgacgcgcgttaggtccccccctcatggtggtggccattatcttcctggcctatgtcttcttcggttcttcaaccgttgttccggatgtcctgagatggggcggcgcctcgttttcgcgcgccatggaccagatgtggctcacgaccggcggcgttttcggcgttgccatcggggtctcggcctcgtttgtcttcctttttgtgctgttcggctcgatgttggacaaggccggggcaggcaacttcttcatcaaactcgccttcgcatttctcggtcatttgcgcggcggtccggcgaaggcttcggtcctttcctcattgatgaccggaatgatttccggctcgtccatcgcgaatgtggtcacgaccggcaccttcaccattcctctcatgcgccgtatcggctattccgccgagaaggccggcgcgatcgaggtggcaagctcggtcaacgggcagataatgccgccggtcatgggcgcggccgctttcttgatggtcgaatatgtcggcatcccctattcggaggtcgtccggcacgccatccttccggcactcatcacctatatatcgctgctttacatcgtgcatctggaagcggtgaagaaggacatgccggtgctgcagcgccgccagagcggcccgttcttcatgtctctggtgcgctcccttatcgtcttcctgtccttcgttctcgtcctgatcggcacctactggctggtcaagctggtaaggatggctctgccgggactttcgacggagatcttgatcttccttctgctgggggcgtatgtggccgcgctttggttcgcggccaaggtacccgaccttgaactggacgatcccaacgcaccggtggtgaagattcccagcgccctggaggttgccaaaaccggcttccacttccttttgccgctcttcgtacttgtctggatgttgctggtggagcaccgctcgccggggctttcggccttctacgcggtcctgctgctgattgtgatcatgctcacccagaagccgttgaaggcgtggttccgccggttgcagacgccggaaatccgtgccgctgctctggaaggctggtacgatctcggcaatggtatgatcctcggcgcgcgcaacatgatcggcatcgcctgcgcgaccgccgcggcgggcatcgtcgtcggcaccgtcacgctcacgggcgtcggccaggtcatggcccagttcgtcgagctgctttcgggcggcaacatctatctcatcctcatcttcaccgccatcatcagcctgatcctgggcatggggttgccgacgacggcgaactatatcgtcgtctccaccttgatggcgccggtgatcgtgaaccttggcgccgcgaacggctatctcatcccgctgatcgcggcccacatgttcgtcttctatttcggcctgatggctgatgtgacgccgcccgttgggcttgcttccttcgccgcatccgccatttcaagggccgacccgctgcgcaccggcgttcaggcgttcttctacgagatgcgcaccgcgctcttgccgttcgtctttgtattcaatcaggaactcctgttgatggacgtgacgctgctgggcgcgatcttcgtgtttatgaagtctacaattgcgatgctgctctttgccgccgcgacgcaaggctttttcatgaccaagtcgcgcctatgggaatcggcagcgcttctgctcgttaccgccgcgctcctccggccgggcttctttctcgatttcgtgcagccgccctatgagcaaatcgagccacagcggcttttcgaggtcgtggagcagcttccgtctgattcagaggtgcgtgtgctgatcaggggcccgagctttgaagatcctgaccagacattggagcgcacgatggccttcaatctcggagaggcagggcaggatgggcagatgcgtttcgaggaggcgacagacctgccggcgcgcattgaaagcggctcggtcattcttgatgagcccctggacctgaacagcctgtccggccgcaccctgtccaatatggacttctatgctgatgagccggtgcaggtcgtggctttcgaagtgcccgcggaacgcatgccgagggaggtcttctatatacccgccgtgtttatactgggactggtcatgttcctgcagcgccggcgcggcggtacgctcgccggcaatcctgtcccgcaacccgcctga

SEQ ID NO: 2142 - DNA, 2634 bp, Rhodobacter sphaeroides 2 4 1
atgacagacgagacccagccgaagagccgcagcttcaccgacgaggagcttcaggatctcgtcgcgagcaccgacagcggcggacgaaatccctccaaccgcaccgtcgcgatcctgatcgcggcgacggcgttcctgtggtcgctgttccagctctggatcgcgcagccgcagctctggttcggccagtatctgcccgtgctgaactcgtcgcagacccggcccatccacctgaccttcgcgatcctgctggccttcctcgcctatccggcgctgaagagttcgccgcgcgaccgggtgccgatcctcgactgggtgctggccctcgcgggggcgggctgcgccttctatgtcttcctctattcgcgcgagctggccgcgaccgcgcgcgcaggcctgccgacccagacccagatcgtggtgggcgcggtggggatcgtgctcctcctcgaggcctcgcgccgcgcgctcgggcccgcgctgaccgtggtgggggcgatcttcctgctctacgcctgggtcgggcagggctggctcattcccgacatcatcgcccattcgggcctctccttcacctcgatcgtgaatgcccagtggctcgacaccaacggcgtgttcggcattccgctcggcgtctcgacggccttcgtcttcctcttcgtcctgttcggggcgctgctcgacaaggcgggagccggcaactacttcatccagctggccttcgcgggtctgggcgcgctgcgcggcggacctgccaaggccgccgtcgtgggctcggccatgacgggcctcatctccggctcctccatcgccaacgtggtgacgacgggcaccttcaccatccccctgatgaagcgggtgggcttctcgtcggaaaaggcgggcgcggtcgaggtggcctcgtcggtcaacgggcagatcatgccgccggtgatgggcgccgccgccttcctgatggtcgagttcgtgggcatctcctacgtcgaggtcatcaagcacgccttcatcccggcggtgatctcctacatcgcactggtctatatcgtgcatctcgaggcgctgaagcaggacatgcccgcgctcggaccggcggccaacctcgggcgcatgttcgcgaagatcgctgtgggcttcgtggtgacgggcgcagccttcaccggcctcgtctgggcgatccaggcgctgcgcggggctgcacccgggatctcggactggatcgtgatggccgtgctgggcctggcctatgtgctgatggtgcgcgtctcggcgcgccggcccgatctcgcgctcgacgatccgaacgcgcgccagatccggctccccgcggtggccgaggtcttccccaccggcctgcattacctgctgccgatcctcgtcctcgtctggttcctgatgatcgagatgcagtcgcccggaaagtcggccttctatgccgtggcggtgatgatcttcatcatcgtgactcagcggccgctgaaggctttgttccgcggcgaggatgtggggcaggccttcggcgcgggcttcggcgacctgatcgagggcatgatcgcgggcgcgcgcaacatgatcggcatcggcgtcgccacggcggcggcgggcatcatcgtggcgaccgtgaccaagaccccgatcggcaccgaactggccggcctcgtcgagatgctctcgggcggcaacctcttcatcatgctgctgctcgtggggctcttctcgctgatcctcgggatggggctgcccacgacggccaactacatcgtggtctcctcgctgatggcctcggtcgtggtctcgctcggcgcgcaggaggggctgatcgtgccgctgatcgcggcgcatctcttcgtcttctacttcggcatcatggccgacgtgaccccgcccgtgggcctcgcgagcttcgccgccgcagccgtctcggggggcgatccgatccgcaccgggatcaccgccttcttctattcgctgcggacggcggcgctgcccttcctcttcatctacaacccgacgctgatcctctatggcgtcgatctggggacatgggcgggcatccttcaggccgtgggcgtcttcgcggtggcgacggtggcgatgctcctctttgccgccgcgacccagggctacttcctcgcgccctcgcggctgtgggagcgcgcggcgctccttctcgtggccttcacgctcttcgtgccgggcttctggctcgaccggatcctgccgcgcttcgaggaacgcccgccgaccgagcttgcccaggccttcgatgcggccgaacccggcgagacggtgcgcttcgtggtgcagggcccggacttcgccaccggtcggcccacgcggctgacgatggtccacacggtcgaagccgaggcgccggccacgggacgggcggaggcggccgggcttctcctgctgcccgaagaggggcggctctacatggacgagccgatgttcggcaccgactaccagcagaagctgcagggcttcgacttctacggcaccgaacgggtcgaggtctcgtcgctgcaaagccccgcgcaccggccgccgaagcagctcttctacattccggcgctgctgcttctggggctcgtcatcgcgcttcagcggcgacggcagaccaagcccgccttctga

SEQ ID NO: 2143 - DNA, 2613 bp, Rhodobacter sphaeroides ATCC 17029
atgacagacgagacccagccgaagagccgcagcttcaccgacgaggagcttcaggatctcgtcgcgagcaccgacagcggcggacgaaatccctccaaccgcaccgtcgcgatcctgatcgcggcgacggcgttcctgtggtcgctgttccagctctggatcgcgcagccgcagctctggttcggccagtatctgcccgtgctgaactcgtcgcagacccggcccatccacctgaccttcgcgatcctgctggccttcctcgcctatccggcgctgaagagctcgccgcgcgaccgggtgccgatcctcgactgggtgctggccctcgcgggggcgggctgcgccttctacgtcttcctctattcgcgcgagctggccgcgaccgcgcgcgcaggcctgccgacccagacccagatcgtggtgggcgcggtggggatcgtgctcctcctcgaggcctcgcgccgcgcgctcgggcccgcgctgaccgtggtgggggcgatcttcctgctctacgcctgggtggggcagggctggctcattcccgacatcatcgcccattcgggcctctccttcacctcgatcatcaacgcccagtggctcgacaccaacggcgtgttcggcattccgctcggcgtctcgacggccttcgtcttcctcttcgtcctgttcggggcgctgctcgacaaggcgggagccggcaactacttcatccagctggccttcgcgggtctcggcgcgctgcgcggcggacctgccaaggctgccgtcgtgggctcggccatgaccggcctcatctccggctcctccatcgccaacgtggtgacgacggggaccttcaccatccccctgatgaagcgggtgggcttctcgtcggagaaggcgggcgcggtcgaggtggcctcgtcggtcaacgggcagatcatgccgccggtgatgggggccgccgccttcctgatggtcgagttcgtgggcatctcctacgtcgaggtcatcaagcacgccttcatcccggcggtgatctcctacatcgcactggtctatatcgtgcatctcgaggcgctgaagcaggacatgcccgcgctcggaccggcggccaacctcgggcgcatgttcgcgaagatcgcggtgggcttcgtggtgacgggcgcagccttcaccggcctcgtctgggcgatccaggcgctgcgcggggctgcacccgggatctcggactggatcgtgatggccgtgctgggcctggcctatgtgctgatggtgcgtgtctcggcccgccggcccgatctcgcgctcgacgatccgaacgcgcgccagatccggctccccgcggtggccgaggtcttcccgaccggcctgcattacctgctgccgatcctcgtcctcgtctggttcctgatgatcgagatgcagtcgcccggcaagtcggccttctacgccgtggcggtcatgatcttcatcatcgtgacccagcggccgctgaaggctttgttccgcggcgaggatgtggggcaggccttcggcgcgggcttcggcgacctgatcgagggcatgatcgcgggcgcgcgcaacatgatcggcatcggcgtcgccaccgcggcggcgggcatcatcgtggcgaccgtgaccaagaccccgatcggcaccgaactggccggcctcgtcgagatgctctcgggcggcaacctcttcatcatgctgctgctcgtggggctcttctcgctgatcctcgggatggggctgcccacgacggccaactacatcgtggtctcctcgctgatggcctcggtcgtggtctcgctcggcgcgcaggaggggctgatcgtgccgctgatcgcggcgcatctcttcgtcttctacttcggcatcatggccgacgtgaccccgcccgtgggcctcgcgagcttcgctgccgcggccgtctcgggaggggatccgatccgcaccgggatcaccgccttcttctattcgctgcggacggcggcgctgcccttcctcttcatctacaacccgacgctgatcctctatggcgtcgatctggggacatgggcgggcatcctgcaggccgtgggcgtcttcgcggtggcgacggtggcgatgctcctctttgccgccgcgacccagggctacttcctcgcgccctcgcggctgtgggagagcgcggcgctccttctcgtggccttcacgctcttcgtgccgggcttctggctcgaccggatcctgccgcgcttcgaggaacgcccgccgaccgagcttgcccaggccttcgatgcggccgaacccggcgagacggtgcgcttcgtggtgcagggcccggacttcgccaccggtcggcccacgcggctgacgatggtccacacggtcgaagccgaggcgccggccacgggacgggcggaggcggccgggcttcgacttctacggcaccgaacgggtcgaggtctcgtcgctgcaaagccccgcgcaccggccgccgaagcagctcttctacattccggcgctgctgcttctggggctcgtcatcgcgcttcagcgacgacggcagaccaagcccgccttctgagcgcgcaccaaggaggagaccatggccagaaccatcctgctgcccatcgatctgggtaa

SEQ ID NO: 2144 - DNA, 2636 bp, Rhodobacter sphaeroides ATCC 17025
atgaccgacgagagccagaagaagagtggccgcagcttcaccgacgaggagcttcaggatctcgtcgcgagcaccgacagcggaggccgaaatccctcgaaccggatcgtggcgatcctcattgccaccaccgcattcctgtggtcgctgttccagctctggatcgcgcaaccgcaactctggttcgggcagtatctgccggtgctgaactcgtcccagacccggccggttcatctcgcctttgcgatgctgctggccttcctcgcctatcccgcgctcaagtcttcaccccgagacagggtgcccatcctcgactgggtgctggccatcgcgggggcgggctgcgccttctatgtgttcctcttctcccgcgaactggcggcgacggcgcgggcgggtctgcccacccagacgcagatcttcgtgggcgccgtcgggatcgtgctcttgctcgaggcgtcacgtcgggcactcgggcccgccctgacgatcgtgggggcggtctttctcctctacgcctggatggggcaggggtggctcatccccgacatcatcgcccactccggcctgtccttcacctccattgtcaatgcgcaatggctcgacacgaacggcgtcttcgggatcccgctgggtgtctcgacggccttcgtcttcctcttcgtgctcttcggcgcgctgctcgacaaggcaggtgccggcaactacttcatccagctcgccttcgcgggcctcggcgcgctccggggcggcccggcaaaggccgccgtcgtgggctcggccatgaccggcctcatctccggctcgtcgatcgccaatgtggtgaccacgggcaccttcaccattccgctgatgaagcgcgtgggcttctcgtccgagaaggcgggcgcggtcgaggtcgcctcgtcggtcaatggccagatcatgccgccggtcatgggggcagcggccttcctgatggtcgagttcgtcggcatctcctacgtcgaggtgatcaagcacgccttcattccggcggtgatctcctacatcgcgctggtctatatcgtgcatctcgaggcgctgaagctggacatgccggccctcggtccggcggttaacctcgggcggatgtttgccaagatcgccgccggcttcgtggtgaccggcctcgccttcacgggcctcgtctgggccatccaggccctgcgcggcgcagcgcccggcatctcggactggctggtgctggcggtgctcggtctggcctatgtgctcatggtgcgcacctcggcccgccggcccgatctggctctcgatgatccgaacgcgcgccagatccggctgccgagcgtggccgaggtctttccgaccgggctgcactacctgctgcgatcctcgtcctcgtctggttcctgatgatcgagatgcagtcgcccggcaagtcggccttctacgccgtggccgtcatgctcttcatcatcgtgacccagcggcccctcaaggcgctgtttcggggcgaggatgcggggcaggcgcttcgggcggggttcggcgacctgatcgaggggatgatcgccggggcgcgcaacatgatcggcatcggtgtggctaccgccgcggccggcatcatcgtggcgaccgtcaccaagaccccgatcggaaccgagctggccggcctcgtcgagatgctctcgggtggccatctcttcatcatgctcctgctcgtgggcctgttctcgctggtcctcggcatgggcctgcccacgacggccaactacatcgtcgtctcctcgctgatggcctccgtcgtcgtgacgctgggcgcgcaggaggggctcatcgtgccgctcatcgcggcgcacctgttcgtgttctacttcgggatcatggccgacgtgaccccgcccgtcggcctcgcgagctttgccgccgcggccgtctcgggcggcgatccgatcaagaccggcttcaccgccttcttctactcgatgcggacggcggcgctgccgttcctcttcatctacaatcccacgctcatcctctacggtgtcgatctcggaacatgggccggactgctgcaggccgcggggatcttcgtcgtggccacgatcgccatgctgctcttcgcggcggcgacgcagggctatttcctcgctccctcgcgcctgtgggagagcgcggcgctcctcctcgtggccttcaccctcttcgtgcccggcttctggctcgaccggatcatgccccgcttcgaggagcgccctccgaccgaactggcgcaggccttcgatgccgccgagccgggcgagacggtgcgtttcgtggtctccggccccgacttcaccaccggccggccaacgcgcctgacggtggtccacacgatcgcggaagaggcaccggaaacgggccgtgccgaggccgcgggcctgtttctgctgcccgaggacggccggctcttcatggacgagccgatgttcggcaccgactaccagcagcggctgcagggcttcgacttctacggggccgaacgggtcgaggtgaccacgcttcagagtccggccgaccggccgccgaagcagctcttctacattccggcgctgctgcttctgggtctcgtcgtggccctccagcggcggcggcagaccaagcccgcgttctga

SEQ ID NO: 2145 - DNA, 2565 bp, Vibrio cholerae O395
atgacgcagacaacaacaccgtcgcaagatgtgcaagagatggtggcgcaagcagacactggcgctcgagcccccaaagggcttccggggcgtgtgctttggtttgttccgctctgttggtcacttttccaactttggtacgcttcaccactcccctttatcttcgacttcggcgtactcaatgatacgcaagctcgctccattcacttaacgtttgccgtttttctcgccttcacggcctatccggcaatgaaaggttcgccgcgcgatcgtattcctttaaccgactggcttttagcactcgcgggcagcttttccgctgcttatatctatctattttacgccgagctcgcaggacgctcaggcgcacccactcagtttgatgtgatcgcctctgtggtcggcatggtattactcctcgaagcgacacgccgggcattaggcccaccactgatgatggtggccgcgctctttttactttacaccttcgctggcccttacatgcccgatgtgattgcccacaaaggggcgagcctaaataaggcgatgtcacacttgtggctcaccaccgaaggggtatttggtgtcgcacttggggtatctacctcattcgtgttcctgttcgtgctttttggtgccatgctggagcgggctggcgcgggcgcttacttcatcaaagtggctttctcgatgcttgggcacatgcgtggtggtccagccaaagcggccgtggtagcgtcaggcctttccggattggtttctggctcttcaatcgccaacgtggtcaccacgggaactttcaccattcctttaatgaaacgtgtcggctttcccggcaccaaagcgggtgcagtggaagtagccgcctccaccaacggccaactaaccccaccgattatgggcgcagcagcttttttaatggtggaatatgtcgggatttcctatgttgaagtgatcaaagcggcgatcctacccgcactgatttcttatatcgcactgatttatatcgttcaccttgaagcgtgtaaggcgggcatgagtggtttacctcgtcgtcatcaatcgacggtggctcaaaagctgctctcatttaccgccacgattcttggtttatgcgtgataagtgccgtggtttattacggtatcggctggactaaagaagcctttggcgacgcagcaacgcccatcctcactgtggtgttattggccgcttatgttggcttagtgaaaatatccgccccctacgccaaagagggtttagggattgatgagaatttgcagtacgtccccgatgtcgccccgacgttaaaatccggcctgcactacttgctgccgattgtggtattggtgtggtgtttgacggttgagcgattctcgcccggcttatcggccttctgggccagcgtgtttatgattttcatcctactcacgcaacgtccactgatggctctctttaatcgcacgggttcactgggtgatgcggcgaaagagggcgtgactgaccttttggaaagcttagtctcaggtgcccgcaatatgatcggtattggggtcgcgaccgctgccgctggcacagtcgtgggggtagttaccctgactgggattggtttagtgatgaccgactttgtcgagtttatctctggcggtaacttgatgctgatgctgattttcactgccgtgatcagcttaattctgggtatgggcttaccaacgaccgccaactacatcgtggtttccaccttgatggctccagtcattgtcactctaggcgctgagcatggcttaatcatcccactgattgcggtgcatctgttcgtattctatttcggtattttggccgatgatacgcctccggtcggacttgccgcatttgccgcggcggcgatcgccaaatccgacccgatccgcaccggtatccaaggctttgcctacgatatccgcaccgcgattttgcctttcatgtttgtgtttaatacccagttgctgctgatgggtattgatagctggtggcacttaatgctgaccatactctcttccatcaccgccatgttgctgttctcggcggcaacccaagggtggtggttaaccaaaaccaaatggtgggaagtcgtcgcgctactggtgctgaccttcaccttcttccgccccggtttttggtgggacatggtttatcccgcgcaagtcatgtatgccggcactaagttagagcagattgtcgagcaagctcccgttggacaaccgatccagatgatcgtcgcgggagagaatcttaaaggcgaatacacctctaaaaccgtgcaactgccgtttgaagatcgcgctgtcagcgctcaagagcggatcgcctcaatgggcttaactctgcttaatgataaaaaccgcatgctagtagaaatggttgagtttggcagcccagccgaagcagcgggcatcgatttcgattgggaaattcgctcagtggtggtcgatagcgatcgaccaatgaaagagtgggtattcttgcctgcgattttgctgaccttactgctggcttggaaccaaaaaagacggataaaaaaggcgtaa

SEQ ID NO: 2146 - DNA, 2784 bp, Vibrio harveyi ATCC BAA-1116
atgcaatctgccgatttctttcagaagtcgcgctcacacctaaaaaaagaaaccgcacatttcctttgcccacaaatcaatgggttacagatttgtagcgattcactcgaaagcaaacttcgctctattcactacactgttatagcgaagcggggttctcgatacacaatacagacaggaccatcaataataaggaaaaagtacatggcgacgaacaacactccgtcacaagatgtgcaagaaatggtggctcaggcagacacaggtgcgcgtagcccaatgggcttgcaaggtagaatcttatggttcgtaccactgtgctggtcgctatttcaattatggtatgcctctccgctaccatttatttttaattttggcgtactcaacgatactgaagcgcgagcaattcatttaacttttgccactttcctcgctttcactgcttatccagcaatgaagaactctccgcgtgaccatatcccattaatcgactgggcattggcattagcggggagctttgctgcagcttatatttatattttctataccgaactggccgggcgctctggtgcaccgacaaccgttgatatcgtagtctcagtaacgggaatggctctattgcttgaagcaacgcgtcgtgcactgggtccaccgttgatggtcgttgccgcagtatttctgacctacacctttgccggtccatatatgccagatgttattgctcataaaggtgcaagcttaaacaaagcaatgtcacacttatggctaaccacagagggtgtatttggtgttgcacttggcgtatcgacttcgtttgtattcttgttcgtacttttcggtgcaatgctagaacgcgcgggcgcaggtgcttacttcattaaagtagccttctcactgcttggtcacatgaagggcggtcctgcaaaagcggctgtcgttgcatccggcctatctggtctggtttcgggctcatccatcgcaaacgtagtaaccacaggtacatttacgattccgctgatgaagcgagtaggcttcccgggaacaaaggcaggtgcggttgaagttgctgcgtcgacgaatggccagctaacgccgcctatcatgggcgctgcggccttcctaatggttgaatatgttggtatctcttacgttgaggtaatcaaagcagccctacttcctgcacttatttcctacatcgctctgatttacatcgttcaccttgaagcatgtaaagcaggcatgaccggccttcctcgtcgccacaacccaaccatgctacaaagcctattgtcatttactggcactatccttggcttgtgcgtcatcagcgccttggtttactacggtgtgggttggactaaagacgtatttggcgatgctgcaacaaccatcgtaaccatcgccctactaattgcttacgtcggtctggtgaagatttcagcgaatcacgtgaaagacggcgcaattgaaattgatgcagaactcacagaggttccagatccaggcccaacgattaaatctggtctgcactatctgctaccaatcgttgtgctggtttggtgtttgactgtagaacgcttctcaccgggtctgtcagcattctgggcaaccgtgttcatgatctttatcttgctaacgcagcgcccactgattgctttgctatcaaaacaaggtgacttggttgagcagaccaaagacggttttgttgatctcgcagagagtttggtatctggtgcgcgcaacatgatcggtatcggcgtggcaaccgctgcagcaggtacggtagttggtgtggtcaccttgactggtatcggcttggttatgacagacttcgtcgagttcatctctggcggtagcatcatccttatgttgctgtttacggcagtaatcagcttgatcctgggtatgggtctgccaacgacggcaaactatatcgtggtatcaacgctaatggcaccggttatcgtaactctgggtgcggctcatggcctgatcatcccactgattgcggtgcacttatttgtgttctatttcggtatccttgcagatgatacgcctcctgtaggtttagctgcctttgccgctgccgcaattgctaagtcagatccaattcgtacgggtattcaaggctttacctacgatattcgaaccgcaattctgccattcatgttcgtcttcaacactcaactcttattgatgggcattgattcatggtggcatctagcgttaaccgtgatctcttccattattgcgatgttgatcttctccgcggcaacacaaggttggtggttcactcgtaacaagtggtgggaaacgatcctactattagtattaaccttctcgttcttccgccctggtttttggtgggacatgctctacccagcgaaagttctttcccctggtgttgagatagctcaaatcacagaagggttaaatgtaggagaatccatagagttacgtgtcgctggagaaaaccttgaaggtgactacgttgaaaaaacggtacgtcttccgttcgaagataaagcggtaaccgctgaagaacgactttcttcaatgggcctaatgctgaccgagaacgacggtaaaatgatcgtagacatggttgaatttggcagcccggcagaatcttcaggaatcgacttcgattgggagatcaaatgggtagttcaagatgctgaacgaccaatgaaagaatgggtatttgtgccttgtttgatgattttgctggtacttgccctgaaccaaaaacgtcgtgctcgtaaggaacagctgagcgcataa

SEQ ID NO: 2147 - DNA, 2580 bp, Aliivibrio salmonicida LFI1238
atgacgcagtcgtctaatacgtcacaagatgtgcaagaaatggtggcccaatcagatactggtgctcgttcacctgaaggattatctggccgaattttatggtttgttccactatgttggtctttattccaactttggtatgcctcccctttaccgtttattttcaatttcggcatactgaatgatactgaagctcgatcagtgcatttagccttcgccatctttttagcttttactgcttaccctgcacttaaaaactcaccaagagatcgtattcccgttatcgattggatacttgcttttgctggtagtttttctgccgcttatatctatattttttatactcagctcgcagaacgctcaggggcgccaacaacaccagatatcatcgcctcagttgttggtatggtcttattattagaagcaactcgacgcgctttaggccctccattaatggtcgtggctgccgtcttcttgctttacacttttgctggcccacacatgcctgatgttatcgcgcataaaggagccagtttaaataaagccatgtcacatttatggctaaccactgagggagtctttggtgttgccttaggtgtctcaacctcttttgtttttttatttgtactctttggtgccatgctagaaaaagccggagcgggtgcttacttcattaaagtcgccttttctctgctaggtcatatgaaaggaggcccagcaaaagccgccgttgtggcttcaggtttatcaggcctagtttctggctcatcgattgcaaacgtcgtaacaacaggtacttttaccattccattaatgaaacgagtcggtttctctggtgaaaaagccggtgccgtcgaagttgccgcctctaccaatgggcagttaacgccaccaatcatgggtgcagccgcctttttaatggttgaatatgttggtatttcttatgttgaggttatcaaagccgctttattgcctgctttaatttcttatattgctcttctttatattgttcatcttgaagcctgtaaagcaggtatgaaaggcttacctcgccgccatacaccaaccttagttcatagcctattatcctttactggtacgattcttggcctttgtgtgcttagtgctgctgtttattatggtatcggttggactaaagatgtctttggtgacgccgcaacccctattgttaccgtcgcactgctactttcttatgtcggattaactagcatctccgctaaataccaagaacatgcgatgatggcgattgacgaagaactaactgaagtacccgatccaggaccaaccatcaagtccggtcttcatttcttattaccgattgtcgttctcgtttggtgtttaacggttgaacgcttctcgccgggtttgtctgctttctgggcatccgtgtttatgatattcattctcctgactcaacgcccattaattggtttctttactaaagaaggcacacttgttaatcaagtaaaacaaggggttgatgatctgctcgaaagcttagtgtctggtgccagaaacatgattggtatcggcgttgcaacggcggcggcaggtattgttgttggtgtggttaccttaacgggcattggtcttgttatgacggattttgttgaatttatctcgggtggcagcattattcttatgttgttatttaccgcggtaatcagcttaattttaggcatggggctaccaacgacagcaaactacattgtcgtatcaaccttaatggcacccgttatcgtaacgctaggagccgctcacggattaattattccattaatagcagtgcatttatttgtgttctattttggtattttagccgatgacacgccccccgtgggtctcgccgcttttgccgctgctgccatagcaaaatcggatccaatccgtactggtatccaagggttcacttacgatattcgtaccgctatattgcctttcatgtttgtctttaatacccaattactattaatgggcattgattcttggtggcatttagcattaaccattatttcctccatcatcgcaatgttaactttttccgctgcgacacaaggttggtggtttacgaaaacaaaatggtgggaagttgttttactattactcataactttctcactattccgtcctggtttttggtgggatcaaatctatccagccaaagattattaccaaggtattgagatcgctcaacttgcagaagagttaaatgtgggacaatcactcaccttagaagtctctggagaaaatctagaaggtaatatcgtaagtaaaacggtacgtttaccttttgacgatcgagcggtaactggtgaagaacgcgtaagctctatggggctaatgctgtctaaagtcgataataaaatgatcgtcgacatggtcgaattcggcagtccagcggaagcttcaggaatagattttgattgggaaataacgaatgtggttcttgatgcagagcgtccactaaaagaatgggtatttattccaactcttcttctactgtttgcactgggctttaatcagcgtcgccgagcgaaaaaggaaaacttggccgcataa

SEQ ID NO: 2148 - DNA, 2214 bp, Desulfomicrobium baculatum DSM 4028
atggcagaacacgaaacacccaaacaagacaacgccgcccccggccaagagtcttccgccagcatgaaacaggcagccgaagaccttgtggccatggtcgaagcaggcgcgcgggaaccctcgaattttttcgcctccggcgtgatcacgtttttgtgcctgtgctggtcctgcttccagctctacctggcctaccagcccctggactcgcatatcgcccgggcctggcatctgggttttgcggtgtgcctggccttcctggcctatcctgcctacaagcagcataccccgcccatgtgggtaaaatggaccagaaaagtcatccccaatttcgccaggcgctccatacgtacctacattccctactatgacatgatccttgcggcgctggccacggccggtgcgctgtacatctggtgggattacgaccagctcatcaaccgccagggcctgcccaacaccatggacatctggatgggcatcatcctgatcgcgctgctgcttgaggccgccaggcgctccctcgggcccgccctgaccatccttggcggcatcttcatgggctacactgttttcggcccctacctgcccgaagtgctgcgtcatcgcggcgtgccgctcgatttcatcatcagcgacatgtatctgaccaccaccggcatattcggcgtgccgctcggcgtgtcgacggatttcgtctttcttttcgtcctcttcggcgccctgctcgaccgtgcgggcggaggaaaatatttcatcgacgtggccttctcggcgctgggcacctttcgcggcggtccggccaaagccgcggtcctggcctcgggcctgaccggcctggtctcgggctcgtccatcgccaacacggtgaccaccggcaccttcaccatcccgctgatgaaaaaggtgggctttccggcctacaaggccgcggccgtagaagtggcggcctccaccaacgggcagctcatgcctccggtcatgggcgcggcggccttcatcatggccgaaatcatcggcatcccctatctcgatgtcgtccgtgcagccttcctgcccgcgatcatttcctatctggccctgttctgggtcgtgcacgtcgaatccatgaagatgggcatcaaggccatcccgcgcagccagcttccgcccttcttcaagaccttggtgcggggctgtcacttcatcatcccgctggcggtactgatctttttcctggtgatcgtgcgtcgctcacccgtgacctcggcgcttctggccatcgagagcctgaccgtgatcatgctggtgcagcgtccgatcatcgcatttttgaccatgggcgcccatcgccgcgccggtaccctggacccggccgtagacaccaaacggttcatcgccgccgctgcctggcagggcctcgtcgacatctggaacggcctgatcatgggcgcgcgcaacatgatctccgtgggcgtggccactgccacggccggaatcatcgtcggcgtggtgaccatcaccggccttgtcggccgtttcatcaccctcatcgacaccatctccatgggcaacgtggtcctgatgctcatcttcacggccataaccagcctgatcctaggcatgggcatgccgaccacggccaattacatcatcatggccaccctgaccgcgccggtcatcgtgcaactcggggccgacgcagggcttgtctttcccctcgtcgcggcccacctgttcgtcttctatttcggcattctcgccgacgacacgcctccggtggggctcgccgcctacgcgggggcggccatcgcgcgctccgacccgattaaaaccggtgtgcagggtttcgcctatgacctgcgcaccgcgatcctgcccttcatcttcctcttcaacaccgatctcttgatgatttcgggcgtgacaagcacaggagacatcatctggctggacgactacctgcacatcgcctggatcttcttttccggaacgatcgccatgttcgcattcgcctcggcgatccagggctggctggtcaaaagctgcagctgggtcgagcgccttgccctgctggccatttgcgccacgaccttccgtccgggcgcctttgcgccgtacctgcccttcgaccgactgggaatgcagattctgggagtttgcgttttcttccttttggtcgcttggcaaatgtcgcaaaaaaagactaagaaaaagaaaaaagtcaccacctaa

SEQ ID NO: 2149 - DNA, 636 bp, Brucella suis 1330
atggctcacataccggacggccttctttcccttcccgtggtcgttggcggcggcgttgccgccgctgccgccgtggcggtggcgcttggccgcctggaggaagaacgtattccacagaccgccattctggccgccatgttcttcgtcgcctcgctttttgcggtgccggttggcccctccagcgtccatcttctcctgtcgggcttgatgggcctcaccatagggctcgcgacatttcccgccgtcatggtcgggctattgttgcaggcgctccttttcggctttggcggcctcaccacccttggcgtcaacacaatcaacatcgcgctgccgggcgttgttttcggctggcttttcctgcctttcgtgcgccgcctgccgccattttcagcaggcgtggtgggcttcatctgcgccgcgctttcagtcgcagggacgggttgcggcgtcatgctcgcattggtgctatcttcctcggatttcgtaccttcggtcaagatcatcggcataacctatctgccgctcatggtcggtgaaggtctgattaccggctttgccatcgccttcctgaagcgtgtgcgcccggaaatattcgccagccagccgcccctcgcccagaggaaccacacacaatga

SEQ ID NO: 2150 - DNA, 615 bp, Desulfovibrio desulfuricans G20
atgcacatatcggaaggggtactttcggcaccggttttgctgtgcggtgccgccgtggcggcggcgggcatcgcggcgggactgcgcaggatggactatgaccgcctgatgaccgtggcgctgctttcggccgctttttttgtgggatcgcttatccatataccggtgggaccggccagcgcacatcttattcttaacgggctgctgggcgcagtgctcggttgggcggcctttccggccatattcaccgcactgctgctgcaggccgtgctttttcagtacggcgggctgaccattctgggcgtgaacacggcaaccatggcttctgccgcggtgctgtgcttctatcttttttctccgcttatgcgcaggcaggggcgctggcggctgctgggcggtttttgctgcggggcgtgcggcgtgctgtttgcagggctgttcacagcggcaagtcttgcgttttctgatgaaggcttccgccatgctgccggcatgattctggtggcgcatattcccgtcatggtggtggaaggcatcatcaccgctcttactgtttcgtttctggcccgcgcgcggcctgaagtgctgcatatgaatgccggaaaacagcgttga

SEQ ID NO: 2151 - DNA, 636 bp, Rhodopseudomonas palustris BisB18
atggcccacattcccgacggcgttctctccctcccggtgctcgccgtcggtgccgctgtggcggctgcgggttgtgcttacgggctgaagcggctggatgccgagcgcatcccgcaggtcgcggtgctgtcggcggtgttcttcgtcgcctcgctggtgcatttcccggtcggcccctcgagcgtccatttgatcctcaacggactggtcggcgtggcgctcggttgggcggcatttccggcgattctgatcgcgctattgctacaggccgtgatgttcggtttcggtggcttggtggtgctcggcgtcaacgtgatgaacatggcggtccccgcggtgctgtgcggcttgctgttcgacgccgtgcgcgcccatgccggcgagcgctgggcggtgccggccgccggagccgccggcgtgttgggcgtgctgttgaccgcattgtcagtggcgctggtgctggcgctgagcggacgcgaattcgtcccggccgccaagctggtgctggtcgcccacgtcccggtgatgatcatcgaaggattcttcaccgccgccgccatcggtctgctgctgcgcgtcaaaccggaattcctggatcgcacgcccgcctgccttgccgaggagatcgcgtcatga

SEQ ID NO: 2152 - DNA, 627 bp, Rhodopseudomonas palustris BisB18
atgcacatcgttgacggagcactctccatgccggtcctggtggccggatccgcgctcgccgttgcggggatcggcatcggcgtccgccagatgccgatcgataagattccggcagccggcgtgctgagcgcgacgttcttcgtcgcctcgttggtgcatgtcccgatcggaccatcgagtgtccacctgatcgtcaacggtctggccgggctggtgctcggctgggctgcctttccggcgctgttcgtcgcgctgttgctgcaggcggtgttcttcggtttcggcggcctcacggtgctgggggtgaacaccgtcgatatcgctctgccggcggtgatcgtctactacgtctgccggcccggcatcgtccacgcgcagccagcggtggcggcgatctggggcgcgatcggcggcgcgctggcgatcgctctgacgaccgtctgtgtcggcatcgcgctggctttctccggcgacgagttcgtgcccgccgcgaagcttgtcttcatcgctcatatcccggtcatggcgatcgaggccgtgctcaccgcggccgccgtctatctcgtccgccgggtcaaaccggagctcttcaacgccttcgccgcgcctgtgctcaagggagcgtga

SEQ ID NO: 2153 - DNA, 636 bp, Rhodospirillum rubrum ATCC 11170
atgcatatcgccgaggggatcgtcccgctctccgtggcggcgccgctgacggtcgtcgccgtcgccggcgtcgccaagggcctgcgcgccatcgatgccgagcgtctgccgacctgtggcctgttttcggcggtgttcttcgtcgccagtctgatccatgtgccgctgggaccgacaagcacccatctcgtgctcagcgggctgatcggcctgatgttgggttgggcggcctttccggccattctggtcggactggccctgcaggcggtgttcttcggcttcggcggccttctggtgcttggcgtcaacaccctgaccatggccgccccggcggtgctggcctgggcgctcttccgggggttggccgatcggctggcgccgtcgcgggcgccggtgctggcggcgatctgcggcgggctggcggtgctggtttccgccctgctggtcgccggagttttggccctgtccgatcaggccttcctgccggcggccgggttggtggtgctgggcaatctgccggtgatcggcctggaatcgctgattaccggcgccgccgtcgccctgctccaccgtgtccgtcccgagatgcttccgcgacagggaggtcgcccatggtcgggatccttcgtctcctga

SEQ ID NO: 2154 - DNA, 618 bp, Rhodobacter sphaeroides 2 4 1
atgcacatccccgacggcatcctgacgctgcccgtccttgcggcgggcggtgcgctggcggtagtcggcgtgggcctaggtctccgcgggctggacgaccgggggatcccgcgggtggcgctcctgtcggcggttttcttcgcggcctcgctcgtgtcggtgccggtggggccgtcgagcgtgcatctgcttttgtccggattgatggggctggtgctgggcctcgggatcttcccggcggttctggtggcgctggccctgcaggcggtgctgttcggcttcggcgggctcacgacgctcggcgtcaacacggtgaacatcgccctgccgggcgcggcggcgggactcctgctcggcccgctcgtgcggcggcagacctctcccttagtcgcgggcgtgctcgccggggtaggctcggccctctgcatcttcgcctccggcggcggcgtggcgctgacgctctggctctcgtcgtcggatttcgtgccggtggcgcgggtgctgctcgtgacctgcctgccgctcgcgctggtcgaggcggccgtggcgggcatggtcgtggccttcctgatgcgcgtcgagccgcggatgctgcagccgtccgccggaggggcctga

SEQ ID NO: 2155 - DNA, 618 bp, Rhodobacter sphaeroides ATCC 17029
atgcacatccccgacggcatcctgacgctgcccgtccttgcggccggcggcgcgctggcggcggccggcgtgggcctcggcctccgcgggctggacgaccgggggatcccgcgggtggcgctcctgtcggcggtcttcttcgcggcctcgctcgtgtcggtgccggtgggtccgtcgagcgtgcatctgcttttgtccggattgatggggctggtgctgggcctcgggatcttcccggcggttctggtggcgctggccctgcaggcggtgctgttcggcttcggcgggctcacgacgctcggcgtcaacacggtcaacatcgccctgccgggcgcggtggcgggacttctgctcggcccgctcgtgcggcggcagacctctcccttagtcgcggccctattcgccggggcaggctcggccctctgcatcttcgcctccggcggcggcgtggcgctgacgctctggctctcctcgtcggatttcgtgccggtggcgcgggtgctgctcgtgacgtgcctgccgctcgcgctggtcgaggcggccgtggcgggtatggtggtggctttcctcctgcgcgtcgagccgcggatgctccagccgtccgccggaggggcctga

SEQ ID NO: 2156 - DNA, 612 bp, Rhodobacter sphaeroides ATCC 17025
atgcacatcgtcgatggcgcgctttcggggcctgtggtgatcggcggcgcggtgctggccgcggccggcatcgcgcagggcctgcgtcacctgccggtcgagaagatccccacagcaggcgtgctgtcggcgaccttcttcgtcgcctctctggtgcatgttccgatcgggccttcgtccgtccacctgatcctgaacgggctcgcggggctggtgctcggctgggccgcgtttccggcgctcttcgtgggcctgctgctgcaggcggtcttcttcggcttcggcggcgtgacggtgctgggggtgaacaccttcgacatcgcggccccggccgtcctggtggggatcctctgccgcaggggacttgccgggccgccggcggtcgcggcgatctggggcgcggtgggcggtgcgctcgccgtcgctctgacgacgctctgcgttggcgtggcgctggcgctctcgggcgaggagttcatcccggcggccaagctcgtcttcctcgcgcatatcccggtcatggcggtcgaggcggtcatcaccgccgccgcggtctcgctggtccggcaggtcaagcccgaactcttctcggtcatggaggccgcaagatga

SEQ ID NO: 2157 - DNA, 636 bp, Brucella ovis; identical to SEQ ID NO: 2149

SEQ ID NO: 2158 - DNA, 606 bp, Shewanella sediminis HAW-EB3
atgcatatagctgacggagtattagcaacgccggtattagtggccggaatcgccatgaccttagccggaacgacactggggttaaaaaaactcgatgatgacaaaattccttttgcggccgtactctcggcttgcttctttgtcgcatcacttattcatttgccccttgggccttcgagtgtgcacttgatattcaatgggttaatcggactgttattaggctggctggcttttcctgtcatgctgatcgccctgatactgcaggcgatgtttttcggttttggaggcattgtcgtacttggggttaattgcctgaatatcgccttgccggcggtaatggttggtgctctgttaaggccaatgagacatcatatccctgctcagttactgggttttttggccggtagtggggcggtattattaaccggcattatggtgtcgtcatctctttatctctctggagaggcatttagtaaaacggcaaacgtcgtattttggggcaatcttccactgtctttactggaaggcgtgatatccggttttattatcgtactcattaatcaggttaagcctgaaattctcaagggagtccactccaatgtataa

SEQ ID NO: 2159 - DNA, 594 bp, Candidatus Desulfococcus oleovorans Hxd3
gtgcatatttctgaaggtattttatcgtggccggtgctggccgggtgcggggccgtggccctggccggcactgccgtgggaatccggaaactggaccctgaaaagattccccgcaccggcatgctgtcggcggcctttttcgtggcatcgctgatccatgtgccgctggggccttccagtgttcacctgatattaaatggcatggtcggtctgatcctggggtggagtgcctttcccgccatctttgtcgccattctgctgcaggcggtgctgtttcagtacgggggcatcaccacgctgggggtcaacacgatgatcatggcggttccggcgctgttgagctattatcttttccgtccctttgccggaagaggagattctctggtgtttgccggcgcctttttgtgcggcatggttgcggtgctgaccggcgggtttctggccgcggtggtgctgatctggtccgaggagcggttccttgaagtggccctgctgattgttaccgctcatctgccggttatggtggcggaaggcctgatcacagggtttgcggttctttttttgaaaaaggtcaagccggacctgcttgaataa

SEQ ID NO: 2160 - DNA, 624 bp, Desulfovibrio desulfuricans ATCC 27774
atgcacatagctgaaggagttctgtctccccctgttctggttacaggctacgcgcttgccgctgccggcacggccatgggccttcgcaggctggattacgacaggctgatgactgtagccattctggctgcggtcttttttgtcggctctcttatccatgtgcccatcggtccttccagcgcccaccttatcctgaacggccttctgggagtactgctggggtgggcggtctttcccgccattctgtcagctctggccctgcaggccctgctttttcaatacggggggctggtggtccttggggtcaacagctttaccatggccttttccggccttgtggcctggtatatctttcgcgggcttacgcacctctggcccggcacacgggggttgcgggccgcggctttttgcggcggagccgtgggagtgctgggggccggcctcttgacggctctggctctcgccttcagcgatgaaggttttcttacggccgccaggctcatttttttggcccacttgcccatcatgctgattgaagggcttatcaccatgttcactgtgggctttatagccagggtgcgcccggaaatgctgcaactcacaacgcaaaaaagcgcaacctga

SEQ ID NO: 2161 - DNA, 627 bp, Desulfomicrobium baculatum DSM 4028
gtgcacatttccgaaggggttctttctccagccattctgggccttggcgcggtcctgaccgtcggcggcacggccctgggcctgcaccgcctcgattacgaccgtctcatgaccgtggccatcctggccgcggcctttttcgtcggctcgctcatccatattcccatcggcccctccagcgcccacctgatcttaaacggcctcctcggcgtcatcctcggctgggcagcctttccggccatcctggtggcgctcatgctgcaagcagtgctctttcagtacggaggtttcacggtgctgggggtgaatgccttcaacatggccttcccggccgtgctgtgtttcctgctcttgcgcccgctgctgtcccgtcccggcccgatgcggacaatgggcgcgttttgctgcggggccctgtccgtggccggcgcaggtctgctcacggccctgtccctggcctatacgaacgaaggtttcctgcaggccgcaaggcttctcttcctggcccatgttccggtcatgatcgtcgaaggaatcgtgaccacgctgaccgtatcctttctgtccagggtccggcccgaactcctgcgtttcgcatcacgctccaaaggaggaatccgtgcgtag

SEQ ID NO: 2162 - DNA, 615 bp, Desulfohalobium retbaense DSM 5692
atgcatatcgctgaaggagtgctttctgctcccgtactgctcgtcggagcggttgccgccgcagggcttacgggtgtgggggtgaagaaaacggaccaggaccgtattcctgtcgtggctgtcatggccgcggctttttttattgcctcgcttgtccatatcccgctcggcccggccagtgtgcatctcatcctgaacgggcttatgggggctttattgggatgggcctgtgtcccagctttgttggtgggactcggcctccaggcggttttgttccagttcggcgggttgacggtcctgggagtgaacacggtgatcatggccgctcctgcgcttggtttgggactcgtcttgcgtcccgtcattcaaggccgaggggtcgtggctgtcgcggcgtcgttttgcgtcggcatgggcggtgtcatcggtgccggttgtgttgcggccctggctctctacgcctcgggtgaagagtttttgagtgcggcgcaactgttagtcgcggcccatttgccggtggctctcctggaaggaggggtgacagcgattgtcgttggatccttgaaacggatacgcccggagatatttgctgcaacttcggagagtggagtatag

SEQ ID NO: 2163 - DNA, 339 bp, Methanosarcina barkeri fusaro
atgtctgacaaaccatcaaagaaaccttcggaggacgagtcgcctctggcccgacaggttgggacaaaagccgaacgcaaactcagggcacaacgtcatgtaaacaggactatctggcttggtttaggcatgatgggactcataggctggtcggtagcagttccaactttaattggtactgcaattggtctctggttagataagcactatccagaaagcttttcctggacactcacgatgctgattattggcctttttatcggctgcttgaatgcatggcactggttagctaaggagcgtaaggaaatgcaagaggaacaggaggattacaatgaatga

SEQ ID NO: 2164 - DNA, 369 bp, Pelobacter carbinolicus
atgaccgaagataaagacaaaccccgacgctccggacaacaatcgcgcgaggatctgcgccgtttgctggccgccaagcaggagcgcaaactgcgggccattggacaacgtgaccgcaacgcctggttcggcctcggcatgttcggcctggtcggctggtcggtcgccatcccggccgtggcgcttaccgcccttggcgtatggatagacgcccggcatgccggcccctattcctggacgctgatgctgttggtcattggcgtcggtctcggttgcgtcaatgcctggttctggatcagccgcgagcgcaaggagatcgagacgcagcgccacgaaccgccgaaggaggatttacatgataccgactga

SEQ ID NO: 2165 - DNA, 321 bp, Chlorobium luteolum DSM 273
atgactgaacgtcccgaagagaaagggccgctttcaaaacgggtgggaagcagcgagcagcggaagctgaaggcccggaaacgcaccatccgcaacatctggttcggcttctcgctcttcggcctcatcggctggtcgatcgtcataccgacgctggccggcgtggcgatcggcctgtggatcgacagccgctatccttccgggcgatcatgggcgctgatgctgctcgtcgcagggctggcggtgggatgctggaatgcggtgcgatggatgctcgaggagaaaaaagagatggagagggaggagcgtgatgacgagtga

SEQ ID NO: 2166 - DNA, 492 bp, Nitrosospira multiformis ATCC 25196
atgaaagtgccagcaggattgcggggcaaaagggaagaacgggaaggaaaggagaaaagggaggcggaattcagccgacggataaaggtgaaagcggcgcgcaagctacgggcgagacgggctgggaaccggaataccgaaatggtttgggcagggctgggcatgatcggactagtcggttgggggataagtgtgccgactgttctgggggttgccttgggcatctggctggatcggcggtttccaggggggtattcctggactctcacgctgctgtttgctgggttgctcgtggggtgcctgaatgcttggcgctggatagtgcgggaagagcagctcactcgcaggaaggagagtcaggaagtcgcagcgcaggaaagaggcagcaagtccaaaaatgaaaccagtgacgcaaccagggagatgggcaagcaggatggtgtaaacaaagcgaacagaaaaatcacggaaaatgaacaaggagagggatga

SEQ ID NO: 2167 - DNA, 336 bp, Rhodoferax ferrireducens T118
atgaataacgaaccaaagaaacccccgaaaaaggtgtcggactatgtcgggcaggtcggggtaaaggcggcccgcaagctcaaggcacagcgcaacaccacgccgggcgtctggttcggcttgggcatgatggggcttatcggctggtcggtggtcattccgacgttgctcggggcggcgcttggtctttggctggacgagcgctatccgggaggtcgctcctggacgctggcgctgttggtggcggggcttgcgatcggctgtttcaatgcgtggcattgggtcgccaaggaagacaaggccatgcgggaggagcaggagaatgacgatgaatga

SEQ ID NO: 2168 - DNA, 393 bp, Pseudoalteromonas atlantica T6c
atgaaaagccattccgctaaaccacagcctaacgaaaacaagcacagcgcaaacaacgatgcgccccatctagccaaacaggttgatgcaaaagtggcgttaaagctaaaagcaaaacgtcaaaaaaatgcaggcgtttggtttggcctaggaatgatgggcaccataggctggtcgatagctatccctacgctgattggcgttggaataggcatatggttggataagcaatatgccgatccgcgttcatggacacttgcattactgctcgctggattggcgctggggtgtttcactgcgtgggcgtggatcagcaaagaatacgcggcaatgcacgaggacgcgactatgcaaaaacacgataacaaggaaaatgatcaacatgatgtctaa

SEQ ID NO: 2169 - DNA, 378 bp, Shewanella frigidimarina NCIMB 400
atgaatcataaaccagaggaaaacatcactccggaaaagtcacattccgaaccgccaaagcctgaaaaagataagtccaacaacgacaagtttagccagcaagttgaagacatggcgacacgaaaactgaaggcgcagcgacatatcaataaaaccgtctggaccggttttgggatgatggggcttattggttggtcggtggtaatcccaacggtgcttggtgcagtactcggaatgtggctggataaacactatcctggcgaacattccagaaccttaatgttattgattattgggttatgcctgggttgttttaatgcttggcattgggttgataaagaagataaggaaattcaccgaggtgatgaactcgattga

SEQ ID NO: 2170 - DNA, 384 bp, Psychromonas ingrahamii 37
atgaagcttaaaagtggtaaaaagtcagcgcgaaaagttgaaaataagggtctcaataatgaggaaaagaagtccgattttgtgggtatgattggtcttaaaacagcgcgcaaactgcatgcccggcgcaacagttccccgggaatgtggtttggtctagggatgatagggattataggctggtccgtggtcattcccaccttgctgggagcggcactgggtatctggttagacaatcattatgcagatcagcgctcctggaccttagcgctgttaatcgcagggttaacactaggctgtttcaacgcatggtattgggttgataaagaacagcagaccatgagcaatgaacaggaacaggaaaaaaaagacgagggtgaataa

SEQ ID NO: 2171 - DNA, 336 bp, Polaromonas naphthalenivorans CJ2
atgactgataaaccccggaaaacttcaaaaacagaacccggcctggccgaacaggtcggcgtcaaggctgcgcgcaagctcaaggcgcggcgcaaccccgcgcccggcgtgtggtcgggcctggggctgatgggcatgatcggctggtccgtggccgtgccgaccctgctgggcgcggcgctcggcatctggctggaccggcgctatccgggcgggcgctcctggacgctggccctgctgatggccgggctgatgctgggctgcctgaatgcgtggcattgggtcgcccgcgaagacgcagccatgcgggagaaacctgaacatgacgatgaatga

SEQ ID NO: 2172 - DNA, 381 bp, Marinomonas MWYL1
atgaaagacgatgatgaagacaaaaacgggactaaaacggaccgtaatctagatcgctctctagatcagaaaccgaaaaacaactacagcaagcaagttggctcagttgccgctcgtaagttaaaagcacagcgacacgtgaccaaaactgtctggtctggcttgggcatgatggggttggtcggctggtcgattgctattcctactgtgcttggtgcggcgctaggtatttggttggatagtgcttacccaagtgatcgttcatggacgctggccttgctggtcgttggtctgtgtttgggctgcttcaatgcttggcactgggtgcaaaaagaagacaaagacattcaccaaccggaggacaacgacgatgttaattga

SEQ ID NO: 2173 - DNA, 336 bp, Prosthecochloris aestuarii DSM 271
atgagtgacgatcaaaaaaaacatatccttgaacaaggatcgagcttcggcaaagaggtcggtgcaaaggagtctcgaaaggtgcgtgcccgtaaagagggtcccgccaatgtctggtcaggatttgccatatccggtctggttggatggtccgtcgtcatccctactcttttcggggttatgctcggagtatggattgacagtcgttttcctggttcgtactcatggactctgatgctgcttatggctggacttcttgtcggatgtttcaatgtatggcattgggtttcaagagaaaacagggagatgcagagggaggatagcgatgatgaatga

SEQ ID NO: 2174 - DNA, 333 bp, Desulfomicrobium baculatum DSM 4028
atgagtgaaaaaccggaaatcaaaagcaaggatgaccgcaccacgttcagtcgggaggtcggcgcaaaggcggcgcgcaagctcaaggcgcggcgcaaccccacgccgggcgtctggtttggcctgggcatgatggggcttgtaggctggtcggtggtgattccaacgctgctcggcgcggcgctcggcatctggctggaccatcggcatccgggaagccattcctggaccctggcgctgattgtggccgggctcacggtcggctgttttaacgcctggcattgggtggccaaggaaaacagggaaatgggaaaggaggacaatgatgaatga

SEQ ID NO: 2175 - DNA, 783 bp, Ralstonia eutropha JMP134
atgaacctgcgatggatctgcgtcctcacggccacctgcctcacgctgtacgcgcaggccagcccgctcgcgctccccgatccgcccgatatggcattcgcgccgaccctgggcaagcaggtgccgctcgatctggtcttccgcgacgacgacggtacgccggttcggctgcgcgaactgtcggcgcatcggccggtgattctcgtccccggctactaccattgccccaacctgtgcagcacggtcatggatggcgtgctggaatcgctggcccaggcacatctgccacgcggcgcgtggcgcgtggtcgccttcagcatcgacagcggcgagacagtcgccgtggccgctgcgaagaagcaaagctatggcgcgctggtggccgcttccggcgggaacctgcatatgctgaccggcgataccgcagccgtcggcacgttgatgcaggccatcggcatgcgcgtttcccgcccacccggcgcaagcgagatcgcccatgccgcgggctttgccgtgctgacccccgacggccgcatcgcccaggccttcaacggcgtgcgtttcgatgcatcggccctgcgcaccgccatcgagcgcgcctcggccgggaaggtcggctctccggcgcagcagttgctgatgcgctgcgtccacttcgatccgctgaccggacgctacaccgtgacgatcctcgacggcatccgggccttgttccttggcgcgttcgccgcgctggccggctggtggctgtggcaacaccggcagcggcggcgctcatcatga

SEQ ID NO: 2176 - DNA, 789 bp, Nitrobacter hamburgensis X14
gtgaagccgctattcgccgcccttttcatcatggcaccgttggttcttgcgaccggtgcgcaggccgcgttgacccgcaacgagcttgacggagtgtttctttcgccggcagccgatgcggccgcgccgctcgcgctaaaatttcgcgatattgacgacaggcgcttgaccctgcgcgaggcgatcggcggacggccgagtcttctgctgtttgtggactacaactgccggaccatttgcgggcccgcgctggcgatcgcgtcgggggcgttggcgcagaccggtctcgatcccgcgaagtaccggctcgtcgtgatcggtcttgatccgaaggacagcgctaaagacgctcgcttgatggcccggcagatcggagattccgccgtcgaacgcgtcacaatcctgcttcggggcgatgccggtaacgtgcatcggctcaccgacgccctcggctatcgctatcgatacgatgtcgccgcggatcagttcgcccatcccgccggcgcactggtcatgacagccgatggccgggtttcgagagccctgtcgagccttgcgctcaatccaagggatctgcgtctcgcgctcgtcgaggcgggggcgggacatatcggaacattcgccgaccgcctaactttactctgctacggatttgatgccgcgcatggagtatatgcacccgcgattgcgcgaatgttgaaactcttcgccgcgctcaccgtcatcagtgtccttggtgcgattgcggttctcgaaagacgccggcgcatgagcaaggacattcgctga

SEQ ID NO: 2177 - DNA, 843 bp, Candidatus Koribacter versatilis Ellin345
atggccctcccgctgctcgcagtgagcgcggcgattgcccagccgcctgcggcgttcatggagaaacaaaattcgggccccgcatcgcaagtcgatcctgccagcctcaaggacatcggtatcgaccagcacctcgacacgcagattcctctcgaccttcaattcaaggacgagaacggcaacatcgtgaaactcggcgactacttcaagaagggccgccccgtcatcctcacgatggtctattaccagtgccccatgctgtgcagcgaggtcctgcaagggctcaacagcgctctacagaccatgacgttcagtgcgggcaatcagtttgaagtcatcaccgtcagcatcgatccgcgcgatacgcctgaactcgcgaaagagaagaaggccagcttcctgaaggaatacaaccggcccggggccgaagatggctggcacttcctcaccgtgaacgatccgaaggatgtcgccaagctcgcgaatgtcgtgggttggaagtaccgctgggatcccaagatgcagcagttcattcacgctgccggcatcatgatcgtgaccccgcagggcaagctcgcgcagtactactacggaatcgaatacgcacccaaggatttgcgtctcggcctcgtcgaggcgtcgcaggacaagattggaaacctcgtggacaaagtggttctgtattgctaccactacgatccacacaccggaaaatacggcgctgttgttgcgaatttgttgcgcatcttcggcgccgcaaccgttttgctattagggggctttatcgtgctgatggttcgccgtgactcgcacgctggccgccatgagacaggacaggcctga

SEQ ID NO: 2178 - DNA, 786 bp, Methylobacterium sp. 4-46
gtgacgcgcctcctcctcgccctgctgatcgcgctcgcgccctgcgccgcccgggcgggcctcgccgcctccgagctcgcggcggcgggcctcgcgccgccggccggcgcccgcctgcccctcggcgcccgcgtcacggacgagagcggccgctccctcgccctcggggaggcgctcgggggccgcccggcgctcctcgtcccggtcgacttcacctgccgcaccctgtgcgggccggccttggccgtggtggcgggcgcgctcggcgagacggggctgcggccgggcgccgattaccggctgatcgtgctcggcctcgacccgaaggacggcctcgccgagggccgggcgctcctcggcgcgcaggtggccgatccggccctgcgcgcggcgacggtgctcctgcgcgccgacccggccgccctcgcggacctcacccgctcgctgggctaccgcaccgcctacgatgccgagcacgaccagtacgcccacccgtccgccgccctcgccctgacgctggacggacacctcgcccgcgccctctcgaccctcgccctcgacgggccgagcctgcgcctcgcgctgctggaggccgggcgcggggcgatcgggggcgtcgcggggcggctcgcggtgctgtgctacggcttcgacgcggcgcgggggatctacacgcccgcgatctcgcggctcctcacgctcgccggagcgctgacggtggccgggctgggtctggccctgtggcggctcggccgcggcggcgggccggcccggagggttccgtga

SEQ ID NO: 2179 - DNA, 783 bp, Gluconacetobacter diazotrophicus PAl 5 JGI
atgacgcccggaccgacgatcgggcgcgccatggtggcggcgctggccctggcggtatccacggcggcgtgggcaggtccgatgcaggacctggccttcacccagcgccagggggcgatcgtgccgctcgatgcgcgctttaccgacacggcggggcgcaccctgccgctgggcgcgttcatggacggccatccggcgatcctgtcgatcggctattacacctgccccaatctgtgcgcgctggaacgcgaggacctgctgcacgcgctggatgccggcggcctgaagacgcccgacgattacacgttgatcgtcgtcagcatcgacccggccgaaaccgccgccatggcgcggcaggcccggcaggacgacctggccagccacgccaccccgggcgccgaccggggctggcatttcctggtcgggcaggcggcgtcgatcgcgcgcctgtcccaggcggtggggttccacgcgcggtacgatccggcattgaagcagtatctgcacccgatggggctggtcttcatgacgccggccggcatggtctcgggctacgtgctgggggtcggctaccgccccggcgatgtccggcaggccctggcgtgggcggcggcgggacagcgggccgaggcgtcgccggtcctgctgctgtgcttccattacgatgccgccaccgggcgctacacgctggcggtccgcaagctgctgcggctgggcgcgctgatgacggtactgaccctggccaccctgctgggcatggcccattggcggagggcgcgatga

SEQ ID NO: 2180 - DNA, 1029 bp, Methylobacterium nodulans ORS 2060
atgaggcgcatcctcctcgccctgctgatcgcactccttccggtggccgccccagtgaccgcccaagccggcctgtccgaggccgatctggcgggcgccggcctctcgcccccggccggcgcgcggcttcccctggccttgcgcttcacggaccagaccgggcgcgtcctcgcgctcggtgacgcgctcggcgaacgcccggcgctggtgctgcccgtcgacttcacctgccggaccctgtgcgggcccgcgctcgccgtcgtggcgagcgtgctcgcgcagacgggcctgcggcccggcgccgattaccgcctgatcgtgctcggcctcgacccgaaggacagcctgcaggagggccgagccctccttgacgcccaggtggcggatccggccttgcgggacgccaccacgctcctgcgcggcgaggcggcggcggtcgccggtctcacccgcgcggtcggctaccacaccgcctacgacgccgagcacgaccagttcgcccacccggccgccgtgctggccgtcaccccggacgggcatctctcccgcgcgctctcgacgctcgccctcgacgggcgggacctgcgccttgcgctcctggaagcgggccgggggacgatcggcggtgtcgcgggccggctcgcggtgctgtgctacggcttcgacgcggcgcacgggatctacacgctcgcgatctcgcgactcatgatgatcgccgccgtgctgacggtgctgggggtggcgcttgccttgtggttcctcggccgcaacggcgcagccaccgcttctggagaccacccccctcctcatgctgaagtgctgtgggcgatcttcgatcgcccgaaggctgcctcgaagcaccccaaaccgctggtccgggacaagggtgaccgggaggagcggtcctgggtgcttcgaggctgcggcggagccgcagcacctcagcatgaggagccgagcctttaccatgaccccgcggcgccgaggcgtgacggagggggcggccgcgccgcccgtgaggcctcgtga

SEQ ID NO: 2181 - DNA, 840 bp, Chloroflexus aggregans DSM 9485
atgaaacgctggatctcgctaacgctgcttgggtggctgagtatgttgctcctggcacccgtcaccgtactggcgcaaggaagcaaatcaaatccggctgatggggtggcgtttgagcaacgtatgggagagcaagtacctcttgactccgtctttattgacgagcaggggaatgaagtgcggctcggtcagtttttccgctctgggctgccggttgtgctcgttatgagctactatgaatgcccgatgctttgctcgtttgtgcgcgaaggtgtgttgtcggcgttgcagcaggtaccgctaacggccgggcaggattttcaggtggttaacattagtattgacccgcttgagacaccgatgatggctagtggcgtcaagacactaaccttgcagcgttatgcacgggccggagcggaggatggctggcattttctcaccggtagtgaagagcagatccggcgggtagccgatgcgattggtttcaagtacgtgtacgacgagacgattgaccagtatgcgcatgcggctgggtttgttgtgctgacaccggaagggaagacgtctcgctacttttttgggattgagtttaacgtgtctgatgtgcgattaggtatagtagaagcttcatccggtaaggttggtacgccaatcgatcagttcttgctgctctgttatcaatacaatccgatcaccggtcagtataccccggcgatcatgacaattctccgtattgtcggtatgctcaccgtaatcgggatcatcaccctgatcgtaacgttgagtcgctcgacccccggtggtaatctaccgccgccgcgtgagtcggtgccagcctag

SEQ ID NO: 2182 - DNA, 780 bp, Pelobacter carbinolicus
atgatcgccatgctgccgaacaccaccgaatccgtgcgcgcagcggccctggccgccgcggcaatcattatcagcctcgcgatattggcgtgcgtgccgctgctgctggaccagacttccccggcacaacggcataacctgccccgcaccaaccgcaatatcccgctggtgcccgaaaaaactccggaagaccgtcttttcgagcagcaggaactacccgacccgccggcgccggaaccgatacttaacgctccgcccgtcgagctgccggaggtcgctccgcccgatacccaggccccggcgacgtcatgtccggacatgacggccgcagccctcgcttccctgcccgccgtcgaccttccggtccgggtcgcggtgcccctgcaggggttggcgctacgccccgacccgcagcgtctggccatgaatatcaatccgggcaagctgcacctgcccgccaccgcgcccaccacgggacaccgcttcaatctggacgaggtcgaccgccggccgcagggcatctccaccatgcagcccctctatccctaccaggcccgacgcatggccatcgagggctatgtgacggtgcgttttctggttacccataacggatctgtggatgaactgaccattctcaaagcggagccggagggcgtcttcgaacaagcggtaaaaagcaccttacgccactggcgcttcaaaccgggccagaaaaacggccgaccggtggcgacctgggtcaaaacaagcatcgagttcaagctgcaggacgcttcctag

SEQ ID NO: 2183 - DNA, 660 bp, Desulfovibrio desulfuricans G20
atgatcgtcaggcccatacgacacaccggcagactgattgccggagcggcaggtgccgttttcatggtgggactgctgcatgtgggtatcctgcagcttaaccgtggcggcgagacaacccaccctgaagaaatacacggtgccatccggctggcacagcagacagacgaaccgcctgtccccgaagagcgggcgaaaaccataaaggaaaccccgccgccggaaaaactccccagaacattttcatcgaaacagacttcgcggccgcaacgccccgccatgacgcaggctccgtctttttccgcagagctgcatccgtccgtgaaaggcggcatggtcatgcccgcgctgtccgtggccggagccacctttacccttgccgaagtggatacgccgccgcgggtggtacgcaccgtacccctaaagtacccgcttgtggccaaacgcagcaacattgaaggctatgtgatcgtaaacatgcttgtgactgccgagggcaaccccgagcaactgagcatacaggccgcttctccggcaggtatttttgaagaatctgctcttgaggcagcccggcagtcgcgtttcactcccggaaagctcaacgggcaggctgttgacacatgggttcagcaaccgtttgaatttaaagtgacgcaatga

SEQ ID NO: 2184 - DNA, 783 bp, Chromohalobacter salexigens DSM 3043
atgagggcgatcgcgggagccgcgggcggcgtgctgatggcgctgggcctgttctatctgctggcattgctggtggcgccgccggacgatgcgcgcgagcccatcgagcagccgatgtcggtgtcgcgtgtcgaggcgccaaaggcgcaggcaccggccccccaggcggccgcgcccgatgcgccgacgccaccggccgacacgccgccgccaccgccgccgtcgcccgtgccggcggcgcaaagcgacagtgcgctggcgttgcccgagcccgagcgctcggcaccgcccacgccggaggtgccgcaagagacattgccggagctggaggagatcgaactccagcccgaacccatgccggaaccgcagcccgagccggagccggctcccgagccggaaccgacgccacagccgaccgagtcctcgtcggcgaacgaggcgtcccagggcgagagcgaggccgcctcggcggaccaggccgcggatagcggggagtccagccaggcgccgtcgcaggaagtggggtctccccagcccaccgagcgcgtgccgccggaatacccgtcacgggcgcagcgtcgtggcatcgaggggtacgtcgaagtgcgcttcacgatccagcccgacggccgggtggataccgattccttgcgggtcaccgaggcccagccgcgaaacgtgttcgagcgggcggcactgaaggcgatctccggctggcggttcccgcgtgcggatgccccgcgtgaagcgcgtcagcgtctagaattccgcctcaagaggtag

SEQ ID NO: 2185 - DNA, 750 bp, Campylobacter fetus 82-40
atgaatagttttattggattttttatatctttgttgctgcatgcggggttaattttcggatttattttgctaaacgcgaaagactctgcagatcagatccaaaacgagcaacttttaaaactcactttctcaaatttaaatagtttagaagatataccaaaaccatatgaagaagtttccgaacctattatagaagagaaaaaagaggttgatcaagcgcctcaaaaaaagataatagaaaaaaagatagaacaaatctatactaaaaagataatcaagcatacaaaacccgataaaaaacaagaacaaactcctaaaaaacagattgttcaaaacattgaaacaaagcagatgccaggcatagatccgaatttaaaaagtattactcaaaatagcattgagcaaaaaatatttgatcaaaataccaatcaaaataaaatagaacagcagccaaaaaacaccgtaaacgaaaatatgattataggaacaaaaataagaaatattatagcaaactatgctagaaaaaattaccctaactctgcaaggagaaaaagacaaactggaattgtaaaagtttcgtttatgtataaagctagcggagaagtaactaacgtaaaaatagaccatagctcgacgtatatggttttagatgaagctgttttaactgctatacaaaagacaaaatccaaatttccatctatcaaaaatgatacgaatttccaaattgaagttgagtttagtttaagctga

SEQ ID NO: 2186 - DNA, 852 bp, Psychromonas ingrahamii 37
atgaaaataattagctcttatttcccttttcttattatcagccttgttttctatggttttatttttctttatcttgatcaacccaagcgcattacaacactgccgctaaattccggcgagcaatcggttcaagtccagtttatttcccaacctaacaaaggacagaatccagcagaagataaactagcagcaccaaccgagcagaaaatagtagaggcgaaatcctacgttacagaagaagaagtcgtagaaagagcaaaagttaagtcaaaaaaagtaataaaatacagtgcaaaaagcttaatactttctgaatcagaaattaaattaagaaagcaggcattgctggaaagctttgcaacagccggtaccgataatgtggcgaagttaaaagcagagatttttctcgagcaacttgcaacggagaaaatattaaccaacgaaacagagcaactgagcaaaacaaaagaccaagcctcttcaccacaaacgagcaacggtccagcaaagaaggcggttataaaaaaatccccctcagaaaacagctcatcactggccagtagcacaaaaaatcaaggcgtattgcaggaagccattgtcgtttccggtcgcaaacctgtctacccgcaacgcgccattttgcgtaaccagcaaggccgagtagtcataaaattaaccatcaccaaaaaaggtctgcccaaaaaccctaaaatactaacttctagcggattcccccttttggatgatgcggtgctggcttttgttgaccaggaattatttatgcccgcgctgcaaggcgaagatcaagtgatgtcagagcaacttttcgcttttcgttttgagcttaattag

SEQ ID NO: 2187 - DNA, 741 bp, Anaeromyxobacter sp. Fw109-5
gtgacctcacctccctccgacggctcgccgcgggcgcgcacgctcgcggcgatggcggtggcctcgctcgccatccacgccggcggcttcgcctgggcggcgcggctggaggcgcgccccgccgcgaggcccgcgccggtggtggtcgagttcgaggccgcccccccgccccccgccccggtcgtgccccgtcctcccgcggcgccgccggcgccgcgccgcgtggcgatctcgaggctgcccccgccgcccgcggacccgcccccaccgcctccgccgaacgagccgccaccgcccgccgcccccgcggcgcgcgcggtcccgcgcgtcggcgtgtcgctctcgtcgaccaccaccggcggcgccttcgcggtgggcgtcgggaacacgctccacggcagggcgtccgagatcgccgccgatccggaggcggtgaggccctactccgccccgcggacctcgcccgcccggctctccgcgcagccgcgcctgctcgagcggccggagatcccgtaccccgcggacgcgcggcgggacgggctcgaggggcaggtcgtgctgctcctgcggatcgacgcggagggccgcgtcgccgcggcgcgcctgctctccgcgccgggccccgccctgggggaggccgcccgcgccgccgcgctccgcttccgcttctcgcctcccctgctcgagggcgaggccgtcgagaccgagatccgcttcacctacaccttcgtcctggagtga

SEQ ID NO: 2188 - DNA, 687 bp, Candidatus Desulfococcus oleovorans Hxd3
atgaaagccacccctgtgattcatgccgggaattttcagaaaggccgggattgggccgctgccgccggccttgcgctgctgatcaacctgctgctgtttgcggccctgccggcggtgaaactgccgccggcgccggctgcagaaccttaccgtcagcccggtccggtcacggtcacccggctgcgcccctcccgccccctcccggcaccggcccctttggtaaagccttcagtgcctgaaaaaaaaccggaagctacggcgcccgccaggtccgttcctgccgtgaaaaaagttcctgccgtgtcaccggaaccggttgaaacgacccggccggattccggcgctgaaaccacacctgaagccccgccggtgcctgccgggccacaggtgtttgatgccatggacctggacagccctcttgtgcctgtattccgaaagcccccggtttatccggcccatgccaaacggcggaacatccaggggtgggtgacggtctcctttctggtggacgcaaaaggccgggtaacggatgtgactgtgacagaatccgatcctgaatcgatttttgacgacagcgtgattcagtgcgtgagtggatggcggtttaaacccggcaccattgccggccggccggtggtcacaaaggtcaccaccaccatccggtttgagctgaaagcagacgaatga

SEQ ID NO: 2189 - DNA, 735 bp, Anaeromyxobacter sp. K
gtgaccgcggggcaagcgcccgggctccgcggcccgctcgccggcgccgccgcggcctcgctcctgctgcacgcggcgatcctcgccgcggcgctgcgcctcccgccgaggcctcgcgagcggcccgcgccggtggtggtggacctcgaggccgcgccgccgccggccccgccgcccgccccggagccgccgcccgccgcgccgcctccgccgcgccgggtcgccgccgcggcgctcccgccgccgcggcccatcccggcgccgcccgcgcccgcgccgccgccgcccccggacgcgcccgccccctcgcccgcgccggcccgcgcgccgcgcgtgggcatctcgctctcgtccaccgccaccgcgggcggcttcgcggtgggcaccggcgacacgctcgcgggccgccctcgggaggtcgccgacgcgccggagccggcccggccgctccccgccgcgccgcggccctcggcgcagccgcggctcgtggcgcgaccggaggtgccttacccgcccgacgcccgccgcgccgggctggagggccgggtggtgctgctcctgcgcgtcgatcgggagggccgcgtggccgcggcgcgcgtgctctccgagccgggcggcgggctcggcgcggcggcccgcgcggccgcgctcggcttccgcttccagccggcgctgctcgagggcgagccggtcgagaccgagatccgcttcacctacaccttcgtcctggagtga

SEQ ID NO: 2190 - DNA, 732 bp, Anaeromyxobacter dehalogenans 2CP 1
gtgaccgcggggcaagcgcccagggtccgcggcccgctcgccggcgccgccgcggcctcgctcctgctgcacgcggcgatcctcgccgcggcgctgcgcctcccccagaggccccgcgagcggcccgcgccggtggtggtggacctcgaggccgcgccgccgccggccccgccgcccgccccggagccgcccgcccctccacctccgccgcgccgggtcgccgccgcggcgctcccaccgccgcgcccgatcccggcgccgcccgcgccggcgccgccgccgcccccggacgcgcccgcaccctcgcccgcgccggcccgcgcgccgcgcgtgggcatctcgctctcgtccaccaccaccgcgggcggcttcgcggtgggcaccggcgagacgctcgcgggccgccctcgcgaggtcgccgacgcgccggagccggcccggccgctccccgccgcgccgcggccctcggcgcagccgcggctggtggcgcgaccggagatgccctacccgcccgacgcccgccgcgccggtctggagggccgggtggtgctgctcctgcgcgtcgatcgggaggggcgcgtggccgcggcgcgcgtgctctcggagccgggcggcgggctcggcgcggcggcccgcgcggccgcgctcggcttccgcttccagccggcgctgctcgagggcgagccggtcgagaccgagatccgcttcacctacaccttcgtcctggagtga

SEQ ID NO: 2191 - DNA, 714 bp, Desulfohalobium retbaense DSM 5692
atgagcggttgggcgcgccgcaccgggcttgtccttttggctctggcggtcaatgccctgttgttcgggactattccctacttgactcaggtccaggatcaacgtttacgctcccggcaacaccacgacccaccccaggtccaccaccaggtcacgctcgagcccgagccggccgatccagctccggacgcctcgtcaaagccccaggagactccctccccagctgcggccccatcaccagcgccccagatgcctgaggccgcgccttcgccccggccccagacgcagtcctcgccccgtattcagcgtcctgcgctggacttgcccgctccgcaatgggaaccgtcagcaatcacgctccccaagccgtctccttccgaaaggggccccaaatcgccgggttccgggtcacctctcgaggcccctgccctggaccggcagccgcgcctggtcagccatctccggcctgtctatccctataaggcccgtcgccaggggctaaacggcacggttgttgtcgaggtgctcgtctccgccaagggccgagtcgccaaggccagggtggtccgggcgactcccgagaacgtttttgaagacagcgccctgaaggcggtgcggcaatggcggtttgccccggcaacagccaacggaaaaccggtacgggccagagtccgcatcccgatccgtttttcactggaaaaccagaacccttga

SEQ ID NO: 2192 - DNA, 3321 bp, Nitrosococcus oceani ATCC 19707
atggacgaatatagagtactaaaaaccgttaattttgactggaccatgcaattacaaagcgtatggcgcaactcgccgctacacgtaccgggtctccatgaaaacctgcgaaccgagcttatggaaaccttgaaagagaggatgggaagccaggatcaaaatcccctcgggcaaatcattacgggcccagcaggtgccgggaaaacccatctccttagcgccatacgccaggaggttgccgccctcccggcctggtttgtattggtggatatgaccgatatcaaggatttctgggaaacagtgctactgggatatctcaactccctgcagcaagcaacttcaggaaaccgaccccaatttcaaagcctcctaaaacacctcctaaacccggacgtaaaaccccaaaaccctttttcttccttttatcgaactccgtctcggtcgagaaaatccccactccaatggctgacggcgctgttagcgggcaaaaaagcccagcgccaggaagctgctcctgctacgccccggcaaatcgcggaatatggggacaaggaactcgcccaagtcatccggcagactatcaaccgcctgagcacgcaatacccggaggagatccgggcccatcaagacgccctccgcgctttgatgctgctcaattctaacgatctcgagcgcgccaacgtaggctacagttggctccaaggcatggctattgacgaaactgatcggcatctcttcggctttttatggccccagcggcagccttctgaaatcgtaaagtccttgtcctggctaatgagccggtatgcacctaccctgctggctttcgatcaattagatgccattatgagccaacaccatatcactactgccagctctggcgaaggggagcggatgacgggggagcagcgcgcttcccaagccatcatcgaagggattgcggacggctttatggccgtccgggatacggtctatcgcaccgccaccatcttagcttgcctggaaggaagttgggaaatattgcgaaaggggagtctgaaatcggcgaccgatcggtttgcttccccccagcccctaccgcccattaataatgccacgctcgcagaggaaatcatcgcccttcgcctcgctcatgcttaccatgcccacggctttacgcccccctatcccagctggcctttccaaccacaagtctttgccagcgcggccacgctcttaccccgggaattgttaaaacggtgcgaggagcatcggcttcaatgtttaagcaagggcgaggtcatagagctagcctgtttcgaatcgccaccagaagccaccgagaccttagctaccatccgcccagatcccgggcttgaccacgcttaccaggaactctgccgccaggcccccatacaggaactgctatccgaggaagcagaagatgaagtactggggatgctgataccggccctatgccgctgtctcctgcgggaaaccccactgccgaaaagcaggcggggagtggtggataccgaattcccaggcgataaaaactaccgcgctcttcatgcccggctccggatcatcgactccagccaagagaatcgagaacaacattactgctttcgtgctttgcaaaaaacccacgccaccgcctatcaaaaccgtcttaacggagcccttactgcttccgggattgactccaagctgcctttcagaaggcttatcatcgtccgcaccacccctctgcccttgggcaaggttacccgggaaatcactgacaaatttctccaggcaaagggtaaattcgccgcgcctaacgaacaagatctaagaaccatgtgggcgctccataagcttgagcaacaaaacttgcctggctttgaagcatggcttcgcgagcgccaccccgcaactcaactccaatggcttcaggaaacaaaaattaccgaatgccttgctgctgatgcattccctctggaaaataacctgcctttaaatgcaaaagagaacacggatatctgggccaaactcccggccccaaaacggcacaattataaggccaccactccctcctatccgtcggccctgccggtagggaaaattctgtccaaccctgccgaaaagataactatccccttgccccttctcacacaatatactggaatattggcggggagtggttcgggcaagacggtgctcttgaaaagatgggtggaagaagccgcattgctaggtatcccctccatcgtgatagaccgtaccaatacgctggtgtctttaggggaacagtggcccgccccccccacctcctggactcccgaagatcaggaaaaggcggaacattatcatgccaacaacgaggtgattatctggacccccggacaagcagatggtaatcccttgcaattagagccattgcccgatctcgcttcgctcctggagcagccggaaaaattccagcaagctcttgaaatggcccaatccaccctgaaagaaatcgtagcccccggcaaatccgcccattcagactataaaatggacgttctcactgcggcgctaaaactctttgctatccaaaaggggaaaaccctgccggatcttatcgccattctctcccacctaccggcggaaatcagtaccagtatctccagcgccgctcgcctggggagcgaaatggcccagcgtctgcaagcggagatacaaaacaatcgcttgttctatccggaaagccctttcctcgatcctggctgcctctttaaaggaacttcagcaaataggagcaggatatccatcatcaacctggccggtttacctgaccttaaaacccagcagcagtttcttaatcagttagccataaccctgctaggctggataaaacagcattccgcctctccttccatgccagtacagggttttttgatactggacgaggccgaggattttatccctgccgaacaatccaccccctgcaaagacaacttgctaaagcttgcggaatacgcccctaccggcggtctcggattagttttctctacccaaaaccccaaaaatattgccccccctatcatttctgactgcttcacccagtttgctgggaaagctagcgcaccggccatcatcgaagccatacgggagcagtttaaaatacgcggtggcgaggaggacgacatccccgtcctggaagctggtcatttttacctccatacagaggggatgccagccccggtaaaagtggcgataccctggtgcctctcctaccatcccccccaccctccggagaaggccgaggtcctaaaacgagccgccgcctctcgcctccaggcccaaaatccataa

SEQ ID NO: 2193 - DNA, 3216 bp, Rhodopseudomonas palustris BisB18
atgagcagtcaagaagcggtgagcgacctcgaagcgtttcgcgcggtcgatttcaactggacccgccagctcaagggcatctggcgtgatcaaccctatcacgcgccgctgcatcaggacgtgctcgacgagctgatgggctacctgctcagcaacacccgggacgcggagccggacaacgagccgcttgggcgcgtcgtgatcggatcggccggtctcggcaagactcatctgatcggggaactgcggcgccgggtctgggaagaagacgcagtgttcatcctgctggacttcgtcgggatcaaggatttctggtcgtcggtggcgctcggatttctcaattccctgcaagtgcgcatcgacgagcggcgcacgcaatacgacaggttgatccacaagctcgccaccttgctcgaactgcagtcgcaactggccgacatcgccgtccgtttgcggggacggccgcgggagttgatggcggaactcgtgaagacatttctcggagcgctcgcccgccgcgatcgcgccatgacccagcagcacggcgacgtggtgcgcgccttcgttctgctgatctccgaggatctggaatgcggaagcatcgcgcacgcttggctgcaagggatggatctcgacgctgagcagcttcgcgatctcggatttgtggtcgtcaagaaatcgccgatcgatatcgtgcgcggcatttcctggctgttgagcctggtcgggccgaccttgattgcggtcgatcagatcgacgccatcatcagcgaagccaatgccgagcggcatcgcggcaatggcgctgcggcgtcggagcagacccaggagacgcaatcgatcatcgaggcgctggcacatgggctgatggatctgcatgacgtcaaacgtcgcgccatcaccgtcgtttcatgtctggaagcgtcgtgggaggtgctcagatcgcaggcgaccgtggcggtgacggaccgttactaccggccgaatgttctctatgcactgactcagccgcagttggcgcgggcgttggtgagcgctcggctggcccagggatatgccgccagcggttataccccgcccgacgaaacctatcccttcgcgccggagacgttcgagacggcggtcggtttcacgccgcggcagctattgaaggcgtgcgatgagcatcgtcagcgctgcctcgccgagggcagggtcatcctctgcaagtccttcgatgccgcgcaaccgccgcctccgcggccaactcggaacggatacgacgaggctttcggccacgaactccgcgctgcttcgaccgccggtttactcgacctctccaacgaggatccactgcgcgatctgctcgccgatgtcttgcagatctacaccgcgcatctgcaacttcccgatgatgtcgacgtggtttcgcagccggatccggatcagcgccggccgtccttgcacggccggctgagcttcgtgttccggagcgagggcgaccgcgagcagcactactgcttccgcgttctggcgcataccaacgccatcgcgttccagggacggctacgggccgcgatgaccgcatcgggcgtcgatcgcgcgttgaagtttcgccacctgttcatcctgcgcgccggcgcggcgccgggcggcgccaagaccgcacaactggtcgaaaaattcctgcaggccggcggccagttcatcgcgccgaccgagcaggatctgcgcgccttcgtggcgttgcgggcgatggcgcagcgcaatgccgacggcttcgaggcttggttgcgcgcgcgcaagccgttgttcgacaccgcgctgttcaaggccgcgggtctggcgccgccgccgttcctggcgggcccgcagcccgatccggcaaagcccagcggctcgtcgccggttcctccaccggccccgcctgcgccgtcgctggtttcgacggcacctcgctccgcgccgtctcccgtcgcgcccgccgcgagcaagccagtcgatcgcgatattccggttggacaccgttacgagcgcgggaccgctggcgccgcggcgatgctgcccgcggatctgctgccgcgtcacaccgcaattctggccggcgcaggatcgggcaagaccgtgctgcttcgccgcatcgtcgaggaagccgccctgttggggattccggcgatcgtgctcgataccaacaacgatctggcgcggctcggcgatcaatggccggcgccgcccgagggcaggagcgccgacgacgccgccaaggccgccaactatcaacgcgacgtcgaggtggtgatctggaccccgggcttcaacgccggccggccgatgtcgctggcgctattgccggacttcgccgcgttgaaggatgacgagggggagcgcgatctggcgatcgaaatggcacgggcgacgctgtcgccctatatcggcggcggcaagggcgccagcgccaagctcaaggaaggcgtgctggccgacgcgttgcgcagcttcgcccacgccggcggcggcgacctcgagcggctgatcgagctgttggccgaactgcccgatgatacgagccggatcgacgacgcagccaagctcgcggccgcgatcgccaaccagctgcgcgccgcgatcgcgaccaatcccttgctgcaatcccgcggcaccccgctcgatccgcaagtgttgttcggcaccgatgccggcaagacccggatctcggtgatcaatttctccggccttgccagcgacgaggcgcggcaggctttcgtcaatcagctgcagatgtcgctgttctcctggatcaagcgcaatccgagcccgaccgggcggctctatgtgctcgacgaggcgcagaacttcgcgccgtcgcagcgcaccacgccgtgcaaggaaagcacgctgtcgctggcggcgcaggcccgcaaatatggcctcggcatgatcctggcgacccagacgccaacggggatcgaccacaagatcatctcgaactgcaccacgcatttttatgggcggatgagttcgccgaccacgatcgaggcgaccaagggcctgatggcggccaagggcggcagcggcgaggacatcggaaaattgtcgcgcggcgagttctatttctccaccgaaggcctgccgcggccggtccggattcgcacgccgatctgtctgacctggcacccggcgaatccgctcaccgccgaacaggtcgtgaccaaggcccgtgccgcggtgccgaactga

SEQ ID NO: 2194 - DNA, 3132 bp, Mycobacterium vanbaalenii PYR-1
atggacacggtgcagcgcgaggcgttggcctcgctgaggctgacgtgggcgcccacctccgacgacctgtggcggccccagggggccacccacgtcaccgggctcaacgaacacgccgtcgacgacgtgatggacgcgttcggcgacgcgctggccgacccggcgtccaccccgctgggtgtggtgatccgcggccccgccggatcgggcaagacgcatctgctcggccagatccgcgaacgcgtgcaggacggcggcgggttcttcttcgtcgtcgaacttctcgacgccgccagcttctgggaatcggtgcgcagcggcatgctggagagcctcggccgtcccggcgcgaaccgcgagacgcagctgaaggacctgctgtgggaactggcgtcgctcgcgcacgtgtcacgcgccgaccgtcgcgcgatcatcggtgacgacgacctcgaccccgaaacgctgtaccgcttcatcaaagcgctctcatcggcggcgaaagagactgtgcggcaatgccatcaagtgctgcgtgcgctggtgttgctcggctccaacgacttcgtcgcccacgacatcggtgagggcttcctggagggcaccgaggagttcaccgtcgaggagcgcgggccgtgggggctgcggtcggcaccggcgtcggcgcaggagtgcgtgcgcgacctgtcgcgcctggtggcgctggccgggccgtcggtgctcgccgtcgaccagatcgacacgctgatcgcccagtcggtggccgccaccgggcagtcgaccggtgacggcggcatcgtgctcgagcaggtggcgcacgggctgatggcgctgcggcagaccatgcggcgcaccgtgacggcggtcgcgtgcctgcccgcggtgtgggagcacatccgcgaccaggccggcgcggccgtcgccgaccggttccgggtgaccggcgtgctgaccccgctgcccagcgccgacatcggccgcgcgatcctggagcgtcgcttcgcggccagttacgccgcgacgggcttcaccccgctatacccgagttggccgctggcgcccgaggcgttcgaggaggcgccgtcctacacgccgcgccagctgctgatccgcgccgacacccacgtgcgggaatgcctcaagcacggcacggtcgtcgagctcacacatctgcgcgccgacgcccagccgacatgggaaacgcagtcgccgaacgggaatgcgccggtgtccggtgcgctggaccggcggttcgccgaataccggcggcgtgcggtgccggaggcggcgctggcccacgacggcgaagacaccacgatgcccgaactgctctccgcggcgctgacggcgtggatcgccgagcgcgacggcgagcagacgttcgtctgcgacccgccgcccggcgcgcacgtggtgctgcacgcccggctgcgcgaaagcctggactccgccaccgacgacgaacggcactgggcgttccgggccgtcgcggccaccaacgccaccgccgcgctcagccggatccgaaaggccgtcacggcagcgggtttcggcgcgggaagcgatcggcgcagtctgttcctgctgcgcaactccccgtggccgagcggacccaagaccgccgcggtgatcgacgagttcctggccgccggcggacgggtgctgccgttgtccgacgacgacgtgcgcaccatgaccgcgttgcgcgacctgatccgcgacgacgaccccgaccttcccggctggctgcgggcgcgccgccctgcccacgggttgacgctgctggccgaggcgctgggtgacggcccggccgagccggtggcggtcgtgcccgaggatgggccggaggccgccctgcccgtggacgagccggaatccgtcgtggaccacgactatgaggtgcccgacaccgagctcccgctgggcctggatgtgcacaccgaagaaccggtgaccgtggggctttcggcgctgcgcaaacacgtcgcgatcttcgccggctccgggtcgggcaagacggtgctgatccgccggctcgtcgaggagtgcgcgctgcgcggtgtctcgtcgatcgtgctggaccccaacaacgacctgtcccggctgggcaccgggtggccgcagccgccggacgggtggcgccgctccgacggtgcgcgcgccgacgactacctgcgccacaccgaggtgacgatctggacgccgcgccgcaccaacgggcgaccgctggcgttccagccgctgcccgacttcgccagcgtcgtcgccgactacgacgagttcaccgacgcagtcgagtcggcctgcgcggcgctggagccgcaggcgctgatcaccgggaagacacagaaggccacccggtcccgcgccgtactccgggaagcgttgcagcactacggcagaacgccgtcgccgacgctggacggcttcgtccggctgctggccgacctgcccgaggacgtcagcaacatggccggtgcgcacgccatcgccggtgatctctcgcagaacctgcgggcggcgatggtcaacgacccgctgttcggcggtgccggaacacccgtcgacccgggtgtgctgctgaccccgtccgacggctaccgcgcccgggtgtcggtgatcagcatgatcggcctgccgtccgacgagcagcggcagagcttcgtcaaccagctgcagatggcgctgttcgcctggatcaaacgcaacccggccggcgagcgtcccctcggcgggcttctggtgatggacgaagcccagaatttcgctcccgcacggggtttcaccgcgtgcacgcgcagcacgctggcgctgtcgtcgcaggcccgtaagtacgggctcggcctggtcttcgccacccaggcgcccaagtcgctgaacaacaacatcccgggcaacgcggccacccagttctacggcctgctcaacgcgcccgcccagatcgaggcggcccgcgagatggcgcgcgccaagggcggtctcgtcgacgacatcagcaggctgcgcgcaggcaacttctacgtggccgccgagggggaggcgttccaccggatcgtcgcgccgtggtgcctgtcgtatcacccgtcgagcccaccctcggccgaagacgtgctcgagttggcgatttcggtgtag

SEQ ID NO: 2195 - DNA, 3096 bp, Mycobacterium gilvum PYR-GCK
atggacacactgcagcgcgaggcactggcctcgctgaggctgacgtgggcgccgacgtcggacgacctgtggcgcccgcaggccgcgacccacgtcaccgggctcaacgagcacgctgtcgacgacgtcatggacgcgttcggcgacgcgctgcgcgacgaggcctcctccccgatgggggtggtgatccggggatcggccgggtccggcaagacccatttgctcggtcaggtccgcgagcgcgtccaggccggcgggggctactttttcgtcgtcgaactcctcgatgcggccagtttctggcagtcggtgcgcagcggtgtgctggagagcctcggccggccgggcacgcagcgggagacccagctcaaagatctgctgtgggagctgtcgtcgctcgcgcacgtgtcgcgggccgaccggcgcgcgatcatcggcgacgacgacctggacgccgagacgctgtaccggttcatcaaggcgttgtccggcgtggcgaaagagactgtgcggcaatgccatcaggtgctgcgcgcactggtgctgctcgcctccaacgacttcatcgcccacgacatcggcgaggggttcctgcagggcagcgacgagttcagcatcgccgaacgcgggccgtgggggctgcgctcggcgccggagtcggcgcagatgtgcgtccgcgacatcgtgcggctggtcgcgctcgccggaccggcggtgctcgcggtggaccagatcgacacgctgctggcgcaatcgctggcgggcaccgatggcgacggcgtgctcgaacaggtcgcccacgggctgatggcgctgcgccagacgacgcggcgcaccgtgcccgtggtcgcatgccttcccgcggtgtgggagcacatccaggaccgggccgcggccagcgttgccgaccggttccgcgtcacgggcatgctgacaccactgcccagcgcagacatcggccgcgcgatcctggagcggcgattcgcggccagttaccgcgccgtcgggttcgacccgccgtacccgagctggccgctggcgccgtccgctttcgaggaagcaccgtcctacacgccgcggcagttgctgatccgcgccgacacccacgtccgggagtgcctcaaacggggcgaggtcgtcgagctggcacacctgcgcgccgatgcgcagcccgactgggacacggtttccaccaacgggagtggcgcggtgtcgaccgcactggaccgccggttcgccgagtaccggcggcgcgccgtgcccgcggcggccgtggcgcacgacggcgaggacgtcacggtgcccgagctgctgtcggccgcgctgacggcgtggatcgccgagcgggacggagaagcgacgttcgtctgcgatccgccacccggaacccatgtgatgctgcacgcgcgactgcgcgagacgctggacagcgcgaccgacgacgagcggcactgggcgttccgggcggtcgcggggaccaatgccagcgccgtgctgagccgggtgcggaaagcgttgaccgccagtggtttcggatccggtggtgatcgcaggaggctgtttctgctacggaactcgccgtggccgagcgggaagaagacgaccgaggagattgagctgttccactcggccggcgggcgcacgctcccgctgtcggacgacgacatccggacgatgaccgcgctgcgggacctgttcgccgacgacgaccccgagcttgcggcgtggctgcgggcgcgccgcccggcccacgggctgacgctgctgcgcgaggcgctcggcggcgactcggagtctgccgaacccgcggcgcccgagccggaacccgatcccgaggacgaggtcgtcgccgactacgacgtcccagccgacgagatcccgctcggattggatcttcaggacgaaaagccggtgacagtgcagctttcggcgttgcgcaaacacgtcgccatcttcgccgggtccgggtcgggcaagacggtgctgattcgccgactggtcgaggagtgcgcgctgcgcggcgtctcgtccatcgtgctcgacccgaacaacgacctgtcgcggctcggcaccgcatggccgcagaccccggccgggtggcgccgcggcgacgacgcacgcgccgacgactatctgaccaacaccgaggtcacggtctggactccgcggcgcaccaacggcagaccgctggcgttcgccccgctgcccgacttcgccggtgtgctcgacgatcccgacgagttcaccgaagcggtggaggccgcctgctcggcgctggaaccgcaggcgctgatcaccggcaagacgcagaaggccacccggtcgcgcgccgtcctgcgggaagcgttgcagcactacggaaaaacggagtcgccgacgctgggcgggttcatcagactgcttgccgacctgcccgaggacgtcagcgacatcgccggggcgcacgcgatcgccggggacctgtcgcagaacctgcgcgcggcgatggtcaacgacccgatgttcggcggcgcgggaacccccgtcgaccccggagtgctgttgaccccgtccgacggataccgggcccgggtgtcggtgatcagcatgatcggcttgccgtcggatgaccagcggcagagcttcgtcaaccagctgcagatggcactgttcgcctggatcaagcgcaatcccgccggcgaccggccgctgggcggtctcctggtgatggacgaggcccagaacttcgctccggcacggggattcaccgcgtgtacgcgcagcacgctggctctgtcgtcgcaggcccgtaagtacgggctcggtctggtgttcgccacccaggcgcccaagggactgaacctgaacatcccgggcaacgccgcgacccagttctacggactgctcaacgcgcccgcccagatcgagaccgcacgcgagatggcccgtgccaaaggcggtctggtggatgacatcagccgactgcgtgccggcaacttctacgtcgcgaccgagggcgaatcgttccaccgcatcgtcgcgccgtggtgtctgtcccatcaccccgccagcccgccgtcggccgaagaggtgctgaacctggcgacttcggtgtag

SEQ ID NO: 2196 - DNA, 3435 bp, Frankia EAN1pec
atgagcgccgaactggaggcgctcgccgccatcaagctggattgggtacacgggctcgaggacgtctggcgcgactcgccggtgcacgtcgacggcgtccacgtcgagccgcgccggcgcattctcgcggctctggaccggctcggcgagcggaagccgccaggcatcgtcgtccagggtcaggccggtgcggggaagacacacctgctcggctgggtacgtcagcaggtcgaacggcggggcggttacttcttcctgatcggcccggtgagtggggacgcgttcgccgagagcgtcgtctcggcgatgctcaccggcctcttccggaccgtcgacggcgaggcggagatccggcgcttccttctggcgctgtgcgcgcagttccgcgtgccggcggagctgacctccgcggtcgtcggggaccagcctctggagccgactcatctcaaggacctcgtggtcgcgttcttcgaccacgaccgggcgctggctcgcgaatgccagcacaccctgcgcgccctggtcctgtacagctcggacgactatgacgcccaagcggtcggcgagacctatctgcggtcgatggacgagcaggagcccggcgaacgggcccgccgcggcatgcaggcgcggacccgcccgccgatggacatcgcccgcgatctgtcccggctgctcgcgctgaccggaccgagcgtcatcgcggttgatcaggtcgatggagtcgtcgccgagctcacggcacgcgacgaggcagcggacagcggcctgggcggcttcggcgggtcgggtgcggtgcggctgaacatgctggcggacggcctgctcgtcctgcacgagcgcatggaacggacgctgtgcctgctcgcctgtctgccggtcagctggattcagttccgtgaacgagcggtggcctccatgcgtgaccggttctcggcgatcatgccactcaaccggctggacgacccggagatcacggccaggatcatcgaacgccggttccaggaggacttcgaccgcatcggcttcgccccgcactatccgacctggccggtagcccggtcagccttcgaccgcgcgccccagtacaccccgcgcgagctgttgcagcgcatcgaccggcatatccaggagtgcttgtccacgggcgtcgtccgtgaactgttcgacttcgccgccgcggacgagaatgacatcgtcgatgttcaggacaacggtgaccacgacatcaccgacatcaccgttagcacgaatttcaccgatggcaccgacctggacggcgagcgcctggatcggctggatcggctggggcgcgaggaccggagcggcggtggacgcggccgagcggctgacgaggtcggcgcgaccagtcctgaggtgctcagcgcgctcgacgcccagttcgccgagctacgagcaggcgcgccgcgcgtcgcggcagtcaacgaggacatcctggtgcccgtgctgctgaccgccggactgtccgcgtggatcatcgagaacggcggggcgcacgactacagcctcgaaccgatgccgagcacacgcccagcgctgcacgcccggctgacacgcactgtcgacgccgacaccggcgagcagctgcactggtgcttccgggcaatcacagccagccacggcaacgcgattctgccgcgtatcaccgcggcctgcaccgccgccgccatggtcgccggcaacccgcggcgacggctgttcctgctacggaacgatccgtggagtccagggaagaaggtgcagcaggccctggccgcgttcagcgccgccggcggccgtaccctgcggttgcacgcgggcgacctggacactttcatggcgttgcggaccctgctcgaccagcggccagccgggctgcgcgcgtggctggcctcccggcgccccgccagcggcacctggcttctgcgggaggcactcggcgacgcggccggcaccgacccgaccggctccgccgccctggcgccccgcgcccccaccatgacgcccggtcccggccgcctgggcagcgctggtgaccctgaccctgaccctgattttgactttggccctgaggccgagcccggccccgaatcaccgccacaggtcgcgccggggccacgctccgcggcacccgccggtgttgttcgttcgtcattcgcttcggcggacgacctgggtggcggtgtcgcggccccgtccgcgctcacgctcggcacggcggtacggggagacgcgccggcccggatcgatctggccgtgctgcgccgccatgtcacgatcttcgccggatcgggctcgggcaagacggtgctgatccgccggctggtcgaggagtgcgcgcttcgcggggtgtcctcgatcgtgcttgatccgaacaacgacctggcccgcctcggtgacgcctggccaagcccgccggccggctggagagacggcgacgcccagttcgccgccgagtacctggccgccacggacgtggtgatctggacgccgcgtcgcgacggcgggcggtcgctgaccttccagccgctgccggacttcgccgggctgcgcgacgacccggacgagttcgaggcggcgatcgacgcggccgtcgcgacgctggccgtccgagcgaacgtcaccgggaacgcgaaccgagccagcctcggacgggcagttctgaccgcggcgctacgccatttcgcccgcggtaaccggactggtctgaccgcgttcatcgagctgctggccgaactgccggacggggtggccgacgacctcgacccggcggggaaacgctctgtcgagctggcgcagacgctacgagcggcgatggtcaacgatccgttgttcggcggaaagggcgagccggtcgaccctgggacgctgcttgtccccgcgccggggcagcgtgcccgagtttcggtgatcagcctcgtggggctgcaacatgatgagcagcgccagagcttcgtcaaccagctccagctcgccctgttctcctgggtgaagcgcaatccggccggaaatcggcccctcggcgggttgttcgtcatggacgaggcgcagacgttcgccccgtccggcccgtccaccgcctgcaccacgagcaccctggcgctcgcctcgcaggcccgcaagtacggccttgggctggtcttcgccacccaggcgccgaagaacctgcacaacggaatccccggcaacgccaccacacagatgtttggccggctcaatgccccggtccagatcgaagcggcccggatgatggcccgcgcctgcggcggcgacgccccggacatcggccggctcgccgtcggcgagttctacgccacgagcgagaccctgccattcatgaagatccgcacaccgatgtgcctgagccaccatccgccttcgccgctgaccgccgaggaggtcatcacccgcgcccgcccggacttgaccgcatga

SEQ ID NO: 2197 - DNA, 3231 bp, Methylobacterium sp. 4-46
atgaccgacgccctcgacgccctgcgcagggtcgatttcgactgggtgaacaccctcgacagcgtctggatcgacgccggggcggctcccgggccgaacagcgcccaggccgccgggatcgtgcgcgagttcgtgcggcgcgcccgcgcgcccgaggacaagctcaagggcgcgatcctcgtcggccagtccgggatcgggaagacgcacctcgtcggcgagatgcgccgggagatctggcgggcgggcggctggttcgtgctcctcgacgtgctcgggctcgccgatttctggcgcagcacggccctgagctacctcaccgccctcctccaccggatgccggacgggcgccggcaatgcgaggcggtgctggccggggtggcccggcgcttcaacgtcgagcagcaggtcgagcaggccttcgccacgccggacattgacgcgcgccgcgtcgtcgacctcctggtgcgggcgctgacgcagatcgacatggcgcgggccctccggcaccaggacgtgttccgggctctctgcctcttgcgggcgagcgatgtcggcgtcgtcggcctcgcccatgcgtggctgcaggggcacgacgccgacgaggaggcgcgccgggccctcggcttccgcagcgccccgccgccgccggcggagctcgtggcggggatgtcctgggtgatgagcctcgcgggcccgaccctggtggccgtcgaccagatcgacggggtcgtcagcccggcgagcgccgccctcggggaggatttcgagccggggccgaacctcgccgccgtgctcaccgcggggctgctcgaactgcacgacgtccgccaccggggccagaccgtggtcacctgcctggtcgattcctgggagcgcatccgggagaacggcctcaggtcggggaccgagcgcttcgagccgccggtcgcgctgctgggcatgaacgaccgcagggcggcgagcgcgctcgtggtcgaccggctggggcgcgcctacgcggaggccggcttcaccccgcccttcccgacctggcccttcggcgaggtcgcgatcgccgaggccgccgcctccggcatgatgccgcgcacgctgctgatgcgctgcgacgcgcatcgccgcgcctgcctggagcgggggaccgtcacggtctgcgagagcctgatcgccgaggcgccgccgcgcgacccgggcgcgccgcgggcgcccttcgacctcgcggcggccgcgcgggcggccgacatcgccggcctcctcgacggcgaggacgacgcgatcggcccgctcctgcgcgacgccttcgacctctacgccctgcaggcgccgccgcacgagcgggtcgagatcgtcaaccggggcgaccccgaccagcggatcccgcccctgcacggccggctgaccttcatcttccgggacgacaacgaccgcgagcgccacatctgctaccggggcctgacgcagcgccacgccatcgcgttccaggcgcggctgcgggcggcgctcaccgcctcgggcatccgcacgcgcctgcatcaccgcgaactcgtcctggtgcggcgcggcccgccgcccggcggcgccaagacgcagcagctcttcgacgtcttcacccgggcgggcgggcggctgatcgaccccgccgacgcggatctgcgcctcctggtcgccctgcagactctgcgggcgcgggcggtggccgagggccgcctcgccgagttcgaggcctggatgcgggccgcgcggcccctcgacgggctcggcttcttccgcgccgcgggcctcggcgaggcggccgcgctcgcccccccgcccgccgagggcgcgaccaggatcccgccccgccggcacgcggcgggccgccccgcgccggacgcgccgccgttcgatcccggcccgacctcgcgcatctcggcggaggggattgcgccggaggcgaaggtcgcgccggagccgcgccgggagacgcctcctggaccccgtgcggaggcgatcccggaccgcatcccgctcggccgtcgcacgacgccggaggccgagcccgtggacctcgcgaccgcgctgctgcgccggcacacggcgatcatcgcgggttcggggtcgggcaagaccgtgctgttgcgccgcatcgtcgaggaggcggcgctcgccggcctcccggccatcgtggtcgacccgaacaacgacctctcgcggctcggcgatccctggccggagccgcccgtcggcttcacggcgcaggacgaggcccgggcgggccgctaccgggcgcaggtcgaggtggtggtctggacgcccggcctgcgggccggcaacccgctcttcgtgcccgcgatgcccgacttctccggcctcggcggcgacgcggacgagcgcgaccaggccgtcgagatggcggtcgagacgctcgcgccgctcgcggtggcgggcggccgccgggagctgcagcggggcgtgctggccgacgcgctgcgcttcttcgccgggcggggcggcggcgacctgccggacttcacggccctgctctccgacctgccggacgggatcagcctgatcggcgacgcgggccggctcgccgccggcatggccaaccagctccacgccgccgtggcgacgaacccgctgctgcgggccgaggggccggtgatcgacccggcgctgctgttcttcggccgggacccggcccgcacccggatctcggtcgtcaacctgtcgggcctcgcctccgaggcggcgcgcgaggacttcgtgaaccgcctgcagatgacgctgttcggctggatcaagcggcacccgtcgccccgcgggctgctctacgtgatggacgaggcgcagaccttcctgcccgcccagcgccagccgccgagcctcggcagcggcatcaagctcgccgcgcaggggcgcaagtacgggctcgggatgatcctcgccacgcaggcgccgcggggcatccacaatcagatcgtgtcgaactgcaccacgcagttcctcggccgccaagcgagtccggccacgatcgcggcggcgcacgacatcctctccgccaagggcggcggggcgggcgacatcggcaagctcaaggccggggaattctacttctcgaccgagggatcgggccgccccgcgaagctgcgcacgccctactgcctcagccaccacccggcgaacccgccgacccccgaggaggtgacggtgcgggcgcaccgcgccgcgcaggtgctggcgggcgggtga

SEQ ID NO: 2198 - DNA, 3303 bp, Actinosynnema mirum DSM 43827
gtgacgctcgtcggaccgggcctggacgacgagcggcgcaacgccctgcaggccgtgcacttcaactcggcggtcgcgcccgacgacatctggagcccgctggcgcaccacgtgcccgagctgcacgggccggtcgccgcggagctggcgcgggccgtggcgtccgccgcgcgcaagccgcgctccacgccgatcggggtggtgctgcgcggggagcgcggggtcgggaagacgcacctgctgggctggttgcggcaggaggcgcgggcgcgcggcgggtggttcttcctgctcaagctgctggacgacaggtcgttctgggcgggcgcggtgcacggggcgatcagcgggctcaaccgcgagggcgaccagctcggcgcgatgctggacgcgctggccaaggcgaccgggcacaccgacgagtcgcggttgcggctgcgcggcacgatcccgatcagccgggagtacctggacgagctggtggagcgggtgcgcgagctggacccgcaggtggcgctggagtgccaggacacgctgcgggcgctggtgctgtaccgggcgcgggggcggccgagcgaggtcgggcaccggttcctggcgctggaggacggcggcatcgacgaggcggaccgggcggagtggggcttccacctgcggtcgcggtccgcgcagctggtgctgggggacctgtcgcggatcttcgcgctgaccgggccggtggtgatggcggtcgaccagatcgactcggtgatcacccagcagcccggctcgtcggggctggtggaccggctcgcggacgggctgatgcggctgcgcgaggagacccggcggacggtgctggtcgtggcgtgcctgccccggtcgtgggagctgctgtcggagcacgcggtgaactcggcggcgagccggttcgcggtgctggacctgcgcaccgcgatgccgagcgcgggcgtggcggaggcgatcgtgcagcggcacctgggggcgctgtacgcggaggaggggttcgcgccgccgcacccgacgtggccggtggcgcgggtggcgttcggcggggcggaggtggcgcactcgacgccgaggcggttgctccagcgggtcgaggagcacgtgcggtggtgcctggcgcgcgacgtcgaggcggagctgcgggacttcgcggacggcccggcggaggtggcggcccccgaggtggacgcgggcgggttggcggagctggacgagcggttcgcccgcgcgtgcgaggcggcggacgtgacgtccccgctggacccggcgcgcgaggacgagctggtgccggggctgctgtcggcggcgctgcgctgctacgcggtggagcacggcggcgacctcgtgctcgacccgccgccgggccgcaagcccgcgctgcacgcccggttgcggctgacgctggacgaggccagcgaggacgaggtgtggtggtcgttccgggcgatcgcgcacggccacagcacggcggtgctggcgcggctgcggtcggcgtgcctggaggcgggcgtgttcggcgggaccggcaagcgccgcctggtggtgctgcgcggcacgccgttctcgggcggcccgcagacggcgcgggcggtgggcgagctggtcgcggcgggcggcgaggtcctgccgctgacgccggaggacctgcgggtgttctcggcgctgcgcgaactcgtcggccaggcgcccgccgggttgctggcctggctggccgcgcgcacgcccgcgagccggaccccgctgctgcgccgggtgctgccgccggtgggggacgcgggctcgcaagccccgcagcgcccgtcggcccacgacgagccggtgtggccggaacgcgagtacgaggagcaggtctgcgcactgcccgcaccaccaccacaacacgcccccgaaccgtcctggcccgaacgcggctggccggcggccgagccgtcccgcctggcgggaagcctgttcgacccggaatcccgctggcccgccacccccgcccctgtccccacccccaccctgatcccggccccggccccggcccccgccccggccccggtggtcgcacccacctcaccgccctccgccgacgccacgatcaccctgggcgcggacgcgacgaccggtcgcccgttcaccctccccctcgttctgctgcgcaagcacgtggccgtgttcgcgggcaccggttccgggaagaccgtgctgctgcgccgcctggtggaggaggccgcgctgcacggcgtgtcctcggtcctcctggacaccaacaacgacctggcccgcctaggcgacgcctggccgtccccgcccgagggctgggcccccggtgacgccgaccgcgcccgccgctacctcgacggcacggacgtcgtggtgtggacgccgggccgcgagtccggaaggccgctggtgctggacccgctgccggacttcggcgcggtgcggggcgatccggacgagttccggggcgcggtcgacgcggccgtggcgggcctgctgcccaagctcgccctgtccggtcgcaggctggtgcacggcagggcggtgctgaccgaggccctgaccgcgttcgccggtcgcggcgggcgcgacgtggcggacttcgtggcgttcctgcacgacctgccggagggcgcgagcacgatgcgcgacgccacccgcctggcccccgagctggccgacggcctgcacgccgcgatcatcaccgacccgctgttcggcggctcgggccgccgcctggaccccggcgagctgctgcgaccggctccgggcacgcgggcgcgggtgtcggtgatcagctgcgtggggctgccgacggacggccagcgccaggcgttcgcgcaccagctgcagcaggccctgttcgcgtgggtgcgccgcaacccagccggtgaccgcccgctgggcggcctgctggtcctcgacgaggcccagaccttcgcgccgtcgcgcggcgaggtggtgtcgagcgcgagcacccggctgctggcggcgcaggccaggaagtacggcctgggcgtggtcttcgcgacccaggccccgaagggcctgcacaactcggtcaccggcaacaccgcgacccagttcttcggcaggctgaacgcctccgcgcaggtgcagacggccgtcgaactggcagcggcccgcggcggccgggtggacgacgtgtcaaggctgggcgcgggccgcttctacggcgcgacggagggcaccggcttcacgaagctgcgcctgccgatgtgcctgagccaccacccgcaaggcgcgctgaccgagggcgaggtgctggcgagggcacgcgcctga

SEQ ID NO: 2199 - DNA, 921 bp, Nitrobacter winogradskyi Nb-255
atgaactggggctgggtgacatcactcgatcaattctggcgctctcctgcattcccgatgtggctgacgctcgcgggtgcggttttcttcgcgttcatcgtgttcctgacgctcatccgtgccgaaaagtcggtcgccaacggcgtcttgaccatcatcacgttgctcgcgatcggagttgcggcggcggttgcgcttcgcaccttcgaggcggatggcagccgctcactggattcgaagaaccagagcgtacggaccaacatcgcgataccggcgttgtcctgcattgacgggctggccggagaggtggtcgagagcgcttgcgagaaggcgctgttcgggacgcccgacgcggtggcggccgccgtgtcctacgtcgcttccgaaatcaacaggttacgatcgttcggcgccgccgctgcggacggcagcattgtagcgccggaattggaggtactgcgacggacgatcgaacgcgaccgctatggtctggtcgcccatgtgctggtcgcgcgcgaccattgccagccgtcggactgtgctgctttccagtcgctgactgatcacggtcggatcgcggcgaacatgaaagagcagctctatgagaacctggtggtgcgttacgcgtcatcctggaacgcgcccgcggtagcgcaggccgctgcacccggtacgccgcctgttccggcgctcgcgtcggagccgaccggcaatccgacgaccatggactttccgacggctgaatccattccgccggtcagcatcatgacgcccgagccggcggctgccccgccggcgtcatcctcggccgccgcgcaggccgtcccgaaaccgcgccccgccgcgaggaagccgcatgcgccgaagccgcacgcgcccccgcccgtccgcctggcgcccccaccgacaccacagaactga

SEQ ID NO: 2200 - DNA, 1038 bp, Rhodopseudomonas palustris HaA2
atggagtgggcctcatggtcggcggcagccgaccgcattctgcattcgccgaatttgccgatctgggccgcgatggccgctgcggctgttttcgtcctgattctcgtcatcgcgctggtgcgggccgacagatcggtggcgaatgccgtgctcggcgtcatcacgctgctcgccgtgggcgttgccggcctcgcatcttggcggctgttcgtcgacagcgcgggtccggtggtgcgcaacgcggacgcggggcgggccatcaacaccatgccggcgctggcctgcgtcgacgacctcgccggcgatgccgtgcaggccgcatgcgaacgcgcgctgttctcgtcgcccgagacggtggcggcggcggtgtcctatgcgtcggcgcgaatggcgcaactgacggcgcagggcgatgtcgcttcggccagcaagcggatgacgcccgaactcgaccggctgcggcgttcgatcgagcgtgaccgctacggcctgatcgcctatgtgctgacggcgcaggatcgttgcgtgcctgatcagtgcgccgccttccagtcgctcaccgatcacagccggatcgcggccaacatgaacgaacacgtctacgagaccaccgtcacccgggcagcgcccgcgtggggcgcgggaagtgggccgctcgcagcggccgctccggtgcctggcggcgtgctcggcgtcgccgaggcgccgagcggcaagccggtcaatatcgatttcgcgacctcgtcctcgattccgccgatctcgatcatgaacgagccggcgccggccgcgccgaagcctgccgcgacggccgccggcaatgccgccggtcacgcggcgccgtcggccgccgccaagcggccgcccgcagccccgagcgcccaggctccggccaacggccaggcagccgccgccggcgggcaggctccggcgaatgcccaggctgcggtcaggcgaccgccgccgccgccgaaaccgaagccgccggtggcggcgccggtccagcttgcgcccgcggaggcaaatccggataactga

SEQ ID NO: 2201 - DNA, 924 bp, Rhodopseudomonas palustris BisB18
atgaattgggcttgggcaaattcgatcgatcagctgtggcgccagccgagctttccgatctggctgacgatcgcagccgccggatgtttcgcgatcattctgttcgtgacgctgctgcgggcccagaaatcggtggccaacgccgcgctcgcggtgatcgccctgctggcgatcgggaccgcggcggcgaccaccatccgcggcttcggccccggcgaaggctcctcacggccggcgaatgcaccggagaccgccaacgcggcgttgccggctctggcctgcctcgacgaactggccggcgaagcggtgctggccgggtgtgagaagcagttgttcggctcgcccgataccatcgcggccgccgtcggcgccaccgcgagccggatcgcacggctgaccgcaatgggcgacgtcgccgcggccaacaaggtcatgactccggatttggagcgcttgcggcgctcgctcgaacgcgaccgctatggtctggtcgcctatgtgctgatggcccgcgatcgctgccaggccaacgagtgcgcagcctatacatcgctgaccgaccacaatcagatcgccgccaacatggatgagcgggtctatgagggcctggtgctgcgttacgcggcggcctggaacgcgccggcgaactctcccgcgctggccgcgctgccgccgtcgctgccgaccggcaaaccgaccaccgcggacttccccacctcggcgtcgatcccgccggtgaccatcatgacgccggagccgtcagcctcggcgcgtccggcggcgcctgccgccaatgcccaggctttggcgcgcccgccgcagccggcggcaaagaagccgccggcgccgaaaccgcgcgcgacggccccggttcagttggcaccgacgcagcccgcacctgccgctgagggcgccacagagtag

SEQ ID NO: 2202 - DNA, 1044 bp, Rhodopseudomonas palustris BisB5
atggagtgggcttcgtggtcggctgcagccgaccgaattttacattcgccgaatttgccgatctgggccgcgatcgccgcgtcggccgtttttgcgctgattctcgtcatcgccttgctgcgggccgacaagtcggtcgcgaatggcgtgcttggcatcgtcacgctgctggcggtcggggtggccggcttcgcatcgtggcgtgtgttcgtcgacggcgcgggcagtggcctgcgcggcgttgacgccgcccgggcgatcagcccgatgccggcgctggcctgtgtcgacgatctcgccggcgacgccgtgcaggcggcctgcgaacgcgcgctgttcggctcgcccgagacggtcgccgcggcggtgtcctacgcctcagcaaggctggcgcagttgacctcgctcggcgacgtcgcttcggcgaacaagcggatgaccccggacatggaacggctgcgccgctcgatcgagcgcgaccgctatggtctgatcgcctatgtgctgaccgcgcaggatcgctgtgtgcccgatcgatgcgccgcgtttcaatcgctgaccgatcccagccggatcgctgccaacatgaacgagcacgtctacgagacggcggtgacgcgcgctgcgccgtcctggggagccgggagcggcccgctcgccgctgccgcgccgggcggcgtcatgggcattgtcgaggcgccgagtggcaggccgaccaacgccgattttccgacctcgtcctcgattcctccgatttcgatcatggccgagcccccgccggcgccgaagtcgagcgccacagccggaacgccgtcgccgaggccggccgcaacagccgccggagcggcgggcggcaacgcggccgctcacaactcgccgtcggccgccgcgaaacgcgctccggcgccagcgccggcttcggcggacgcgcaggctcccgccaacgcgcaagccgccgtcaggcgtcccccgccgaagccgaaaccgcctgtggccgcagcgccggtccagcttgcgccggaggaggcaagttcggataactga

SEQ ID NO: 2203 - DNA, 942 bp, Nitrobacter hamburgensis X14
atgaactgggcgtgggtgacatcacacgatcaactctggcattcgccgacatttccgatgtggctgacgctgctggtagcgatattcttcgcgatcattgtgctcctgacgctggttcgcgctgaaaagtcggccgcgaacggcgtcttgaccattatcgcgctgctcgcgatcggagttgcgggggccgtcaccattcgcggattcggcccggatggcggcgaggcgttcgggtcgaaacatctgtccgccccggtcaacgtcgcaatgcctgcgttgtcctgcgtcgacggccttgccggcgacgtggtcgaggtcgcctgcgagaaggcattgttcggcaaaccggatgcggcggcggccgccgtctcctacgtcgcttcggaaatcagccgattgaggtcgttcggcgatgtcgccgccgccaacggcgtcatatcgccggagttgcaggcgctgcggcgggcgatcgagcgcgatcgttatggcctggtcgcccatgtgctggtcgcccgcgatcactgccagccatcggactgtgccgccttccaatcgctgaccgaccatagccaggtcgcggcgaacatggaggagcgggtctacgagaagctggtgatgcgctacgcgccatcctggagcgagcctgcggcaacggctgacgccgcgatgcccggcacgccgacgtcggcgctcgtgtcggagccgacgggccatccgacaacgatggactttccgacggccgcatccatcccgccggttaacatcatgacgcccgagccgccgacaggcgcggcgtcaccgccaccgccgacttcggcggccgcgcagacggttcctaagccgcgtccggctgcggccaggaagccgcatgcacccaagccgcacccggcagagcccgtccgcctcacgccggcaccgtcgtcagcgggagcacagaactaa

SEQ ID NO: 2204 - DNA, 933 bp, Bradyrhizobium BTAi1
atgtggctcaccgtggccgcggcgggcttcttcgccctgatcgtgctggcgaccctgctcagggccgagaagtcggttgccaatggcgcgctcacggtcatcaccttgctggccgtcggcatcgcggtggcgtcgatgatgcgaagccaggatcagggcgcgcggggcggcagcgatcccgcttcgaccgcctccgtcagctttgcgccgccgggtctcgcttgcgtggatgatctggccggtgatctggtcttgtccaattgcgagaagaacctgttcggatcgccggagatgacggccgccgccgtcagctatgccgcggcgatgctgagccgcctcgcgcaggcgggcgacctcgcgagcgccaacaaggtgatgaccgcggaactgctcgcgctgcgccgggcggtggagcgcgaccgctatggcctgatggcctatgtgctgctgacccgcgaccgctgtacgccgaccgattgcgtgatgttccgggcggtcggcgatcgccagcaactcgtcaacaacatggaaggccggacttatgaagggctggtgacgcgctacgcctcgcaatggaatgcgccggccgcccaaaccgcccaatcggccgccgcggggacctttgcgggcttggcgccgaccgcgccgaccggcaagccgaccaatgcggagttccccagctcggccaacacgcctgcggtcagcatcatgaaccccgagcccacggcctcgacgcgctcggtcgcgcccgcgccggcggctccgaagccgcccacccagcttgctcctgcaccggcaccgccgccgaccgttgctgccagccatgcccaggcgcccgccgcggccaagaaggcagcacccaagccgaagcccgccgctaccgctccgcaggctgcgccggaggctgcggagcctgctgcgaacaatgaataa

SEQ ID NO: 2205 - DNA, 1017 bp, Xanthobacter autotrophicus Py2
atgcagtgggtcgatcagcttctgggcgtgctgaacgcgagctttgccgttcccggctgggtcgccgtcgctgcggctgtggccggcgttgtcttcgtggtgctgctgttcgcgcgctccgagccgaacgaccatccggtgaccattctggtgctgctcggcatgctggccggtggcctcgccgttggtggcgcggtggtgcgcgccatcaccggcaccgctgcgggcgggcaggcgcaggcgctggagcagcgcgccgccaccctcgattccgccgcggcacagaccccggcgctcggctgcctcacggccgatacaagccttgccgtcgcgtgcgaggcggtgctgttcgagcggccggattcggtctccgccgcgcgcgggctggtgcgtgagcgcatcgccttggtggaggacgccaccgacatcctgcgcaaggccgacgtgccgggcttgtccgcccgcgtcatgacctggcgccggccgctggagctggacccgttcggcttcaccgcggcggtgctggcggaggaattcggctgcaccccctcgttctgcccgccggcggtcgtgctgggggacagcacccgcgtggtcgccaacatgaccgagggccgctaccagtcgctggtcgccaaatatgcccccatctgggagcgcaacgcccgcaaccgcggcactctcaatcctgccccgccggtgcgcaccggaccgttcggcttcgccgtcgttccccacgacaacgggacgggcggttcaggaacgccccaggatcgcacgcctcaggagcgcccgccggtggccaacctgccggtggaggacgcgcctgcccctcccgcgcccgccgcaaccccggccagcccgaccccgcttcccccgtcgcggccgtcgcgcccggctgcagcgcctgccgccgccccgcctgctgcccgtcccgccaccccgccccgtccgcgcccgcaggcggcgcccgccgcaccggcgccggatgccgtcgagccggctggcgacgaatag

SEQ ID NO: 2206 - DNA, 1041 bp, Rhodopseudomonas palustris TIE 1
atggattcggctgcttggtcggcttggttcgaccagattctgcattcaccaaattttccgatgtgggccaccgtctcggttgcggcattcgtggcgctgctggtgctgatcacgttgctgcgggccgacaagtcggtcgccaacggcgcgctggtggcgatcacgatcggtgccatcggactggcgggctattcggcatttcgcggcttcggcagctcggggagctcgcaggcttcgggagaggctcgcgatccgatcgccaaggcgatgccggcattggcctgcgtcgacgaccttgccggcgacatggttctggcagcctgcgagaaggcgctgttcagttcgcctgaaaccgtcgcggccgccgtatcctatgcgtcggcccggctggcgcggctgaccgcactcggtgacgccgctgccgcggacaagcagatgacgccggagctgacccggttgcgccgcgcgatcgagcgcgaccgctatggcctgatcgcctatgtgctgtcgtcgcaggatcgctgccagccgaccgactgcgcggcgttccggtcgctgaccgattccagccggatcgcagcgaatatcggcgaccatctctacgagaccaccttgacccgttacgcgccgagctggggcggcctgctgatgaccgcgggcgcaggtccggtaccggcctccgccgctggggctacgctccccgtgccgggcacgccggcgctcgccggcgtcaccgaggcgcccagcggcaagccgacggatatcgacttcccgacgtcggcctcaattccgcccgtcagcatcatgacggagcccacgccggccaagccggcggcagctgctgccaccaacgccaagagcgccccggcggccaagaaaccaccggcgcctccggccgcggcccaggcgtcggccacacacaatgctgccggtgcggctgccgccaatccgccgcccgccaagaggccgcccgctccaccgaaaccgaagccgcctgcgccggtccagcttgcgccggaagaggctcccgcggaaaactga

SEQ ID NO: 2207 - DNA, 1227 bp, Nitrobacter winogradskyi Nb-255
atggctatcaatcactttgattcgccgaccggccacatcgcggacaatgtcgccggcttcgcccgcacgctgcgcgcttgtggtcttccggtgggtcccggcgcggtcatcgacgcgctgaaggctttgcgtctgatcgacatcggcaatcgcgcggacgtcttcagcacgcttcaggcgatttttatgacgcgccacgaccatgcgccgatattcgcccaggcctttgatcttttcttctgcatcgcggaggaagggaaaaacatgctggatccggtccagccgctggaccaggccaggaagccgccgccgtcggcgtcccggcgtgttcttgaggcattgtcgcgacctgcgatcacgagcgagcgcgaggcgccgcagggacaggagatgcggccttcagtctccgatctggaggtgctgcaaaagaaggatttcgcgcagatgagcgcagccgaactggcccaagtcacgcagatcatcgcgaacatgaagctgccgcaagccagactgcacacacgacgtatccggcccgatccacgagggtcgcggctggatttgcgccgcacgctgcgtggcgggctgcacaccgggggcgagattgtcgatattcatcgccttgggaggatcgacaagccggctccgatcgtagccctgctcgatatctccggctcgatgagcgagtatacccgcctgttcctgcatttcctccatggcatcacaaaccggcgcgggcgcgtttcggtctttctgttcggaacgcggttgacgaatgtcacgcgcgcgttgcgggcgcgcgatcccgacgaggcgctggccgcctgttcctcggtggtggaggattgggcggggggaacgcggatcgcgacctcgctccacgatttcaacaagctgtggagcaggcgcgtgctcgggcaaggcgccgtcgtcctgatgatcactgacgggctggagcgggaggccggctccgaactggcgttcgagatggatcggctgcaccgatcctgccgccgattgatctggctgaacccgctattgcgctatgatggctttgaacccagggcgcgaggcattaagatgatgctgccgcacgttgacgaatttcgcccggtgcataatctgtcatccatcgagggactcattgccgcgctttcccaagcaccgggacgacatggtcgcggcgccgcccgcggcttgaacgaggggcattatgctcgatcgcgatga

SEQ ID NO: 2208 - DNA, 1218 bp, Rhodopseudomonas palustris HaA2
atgcagcgtaacccgatgaccgcgatggatcacctcaacccgccgaccggcaagatggccgacaacatcgtcggcttcgcccgcgcgctgcgcgcggccggcctgccggtcgggccgggcgcggtgatcgatgcgctggaggcgttgcagctcatcgacatcggcaaccgcgccgatctctacgccacgctggaggcgatcttcgtcaagcgtcgcgagcacgcgctgattttcgcgcaggcgttcgcactgttcttccgcgccgccgaagaatggcagcacatgctggattcgatcccgctgcccgatcacgccaagaagaagccgccgcccgcctcgcgccgcgtgcaggaagcgatggcgccgtccaccacgcgcgatttccccgccgccgaagagcaggaagtgcgactcgcggtgtccgacaaggagatcctgcagaagaaggacttcgcccagatgagcgcggcggagatcgccgaggtgacgcggtcgatcgcgcggatgcgcctgccgcaggcggaattgcgcacccgccgcgtccgcccggacaagcgcggcctcaagctcgatctgcgccgcacgctgcgcgcgtcgctccgcaccggtggcgacatcgtcgatattcgcaagctcgggctgatcgacaagccggcgccgatcgtggcgctcctggatatctccggctcgatgagcgagtacacgcggctgttcctgcatttcctccacgccatcaccgacgaccgcaagcgcgtctcgaccttcctgttcggcacgcggctgaccaacgtcacccgcgcgctgcgggcgcgcgatccggatgaggcgctggcgagctgcacctcgtcggtcgaggactgggccggcgggacgcggatcgcgacctcgctgcacggcttcaacaagctgtgggcgcgccgcgtgctcgggcagggcgcgatcgtgctgctgatttcggacgggctcgagcgcgaggcggactccaagctggcgttcgagatggaccggttgcatcgctcctgccggcggctgatctggctcaatcctctgctgcggttcggcggcttcgaaccgcgcgcgcagggcattaaaatgatgctgccgcacgttgacgaattccgcccggtgcataacttgacctcgatgcaggggctgatcgaggcgctgtcgtcggcgccgccgccgcaccatttcagcgcgatccgctccgccgcctga

SEQ ID NO: 2209 - DNA, 1203 bp, Rhodopseudomonas palustris BisB18
atgaccgacatcgatcacctcaatccgcccaccggcaagatggccgacaacatcgtcggcttcgcccgcgcgctacgcgccgccgggctgccggtcgggccgggcgcggtgatcgacgccttgaacgcgctgcagctgatcgaggtcggccatcgcggtgatttctacgccacgctgcaggcgatcttcgtcaagcgccatgagcattcattagtgttcgcgcaggccttcgcgctgttcttccgtgccgccgaggattggaagcacatgctggattccatcccgctgccggaccacgccaagaaaaagccgaagccggcggcgcgccgggtgcaagacgcgctggcgcagccgaccagccacgaggtgccgcaagcgcaggagcaggaattgcggttatcggtgtccgacaaggaaatcctgcagaagaaagacttcgcgcagatgagcgccgcggagatcgcgcaggtgacccgggcgatcgcgcagatgaaattgccgcaggccgaattgcgcacgcggcgtcacgcgccggatccgcatggcttgcggctcgatttgcgccgaacgctgcgcggcagcttgcgcaccggcggcgatatcgtcgacatccgcaagctcggccgcatcgacaagccgtcgccgatcgtggcgctgctcgatatctccggctcgatgagcgaatatacgcgtctattcctgcatttcctgcacgccatcaccgacgcccgcaagcgcgtctcggtgttcctgttcggcaccaggctcaccaacgttacccgcgcgctgcgcgagcgcgatcccgacgaggcgctggcgaattgttcgtcggcggtggaagattgggccggcggcacgcggatttcggcgtcgctgcacgtcttcaacaagcaatgggcccgccgcgtgctggggcagggcgccatcgtgttgctgatttccgatgggctggagcgtgaggccgatgccaagctgtcgttcgagatggatcggctgcatcgctcctgccggcggctgatctggctcaacccgctgctgcggttcggcggcttcgaggccaaggcgcagggcatcaaaatgatgctgccgcacgttgacgaattccgcccggtgcataatctgacctcgatgcaggcgctgatcgccgcgctgtcggcgccgccgccggtgcatcaccgcgcgctgatccggtccgcggcctga

SEQ ID NO: 2210 - DNA, 1245 bp, Rhodopseudomonas palustris BisB5
ttgttgctcattctttgctcgataactttgagcgagttcgacatgcccacaatcgatcacctcaatccgcccaccggcatgatggccgacaacgtcgtcggctttgcccgcgcgctgcgcgccgccgggttgccggtcgggcccggcgcggtgatcgatgcgctgaacgcgctgcaactgatcgagatcggcaatcgcgacgatctctacgcgacgttggaggcgatcttcgtcaagcgtcgcgagcacgcgctgatcttcgcgcaggccttcgcgctgttcttccgcgccgcggaggagtggcagcacatgctggattcgatcccgctgccggatcacgccaggaagaagccgccgccggcctcgcgccgggtgcaggaagcgatggcgccgtcgacgacccgggacttcccttccgccgaggagcaggaaatccggctcgcggtgtcggacaaggagatcctgcagaagaaggacttcgcgcagatgagcgctgcggagatcgccgaggtcactcgctcgatcgcgcggatgcggctgccgcaggcggaattgcgcacgcgccgcgtccggccggacaagcgcggtctcaagctcgatctgcgccgcacgctgcgcgcttcgctccggaccggcggcgacatcgtcgatatccgcaggctcggcctgatcgacaagccggcgccgatcgtggcgctgctcgatatctccggctcgatgagcgaatacacgcggctgttcctgcacttcctccacgccatcaccgacgatcgcaagcgggtctcgaccttcctgttcggcacgcggctgaccaacgtcacccgcgcgctgcgggcgcgcgatcccgacgaggcgctggcgagttgcacgtcgtcggtcgaggactgggccggcggcacgcggatcgcgacctcgctgcatgtcttcaacaaggcgtgggcgcgccgcgtgctggggcagggtgcgatcgtgctgctgatttccgacgggctggagcgcgaggccgatagcaagctcgccttcgagatggaccggctgcatcgctcctgccggcggctgatctggctcaacccgctgctgcgcttcggcggtttcgagccgcgcgcgcagggcatcaaaatgatgctaccccacgttgacgaattccgcccggtgcataatctgacctcgatgcagggattgatcgaggcgctgtcctccgcgccgccgccgcaccatttcagtgcgatccgctcggccgcataa

SEQ ID NO: 2211 - DNA, 1233 bp, Nitrobacter hamburgensis X14
atggccatcaatcatctcgacccgccgaccgggcggatcgcggacaacgtcatcggctttgcgcgcgcgctgcgcgccgccggccttccggttggcccgggcgccgtcatcgccgcgctgaatgctctgcacctgatcgacattggcaaccgcgccgacgtcttcaccacgcttgaatcgattttcgtgacgcgccacgaccatgggctgatcttcgcccaggccttcgatctgttcttccgcgccgcggggcaatggaaaaacgtactggattcggtgccgctgccggaccaggcaaagaagccgccgtcgcccgcgtcgcggcgcgttgacgaggcgctgtcgcagccggcgatcaccagtgagagcgaggcgtcgcaggagcaggagacccggctttccgtctccgaccgcgaggtgctgcaggagagggactttgcccagatgagcgcggccgagatcgcagaggtcacgcaggtcatcgcgacaatgaaactgccgcaggctgagttgcgcacgcggcgcacccggccagatcatcgggggctgcggctcgatctgcgccggacgctgcgcggcagcctgcgcaccggcggcgagatcgtcgatattcatcgcctcggcctgatcgacaagccggctccgatcgtggcgctgctggatatctccggctcgatgagcgaatatacccgcttgttcctgcatttcctccatgccatcaccgatgcgcgcaagcgcgtctcggtctttctgttcgggacgcgtttgaccaatgtcacccgcgcgctgcgggcgcgggatccggacgaggcgctggccgcctgttcatccgtggtcgaggactgggccggcgggacgcggatcgcgacctcgctgcacaacttcaacaagctgtggggccggcgcgtgctcgcgcagggcgccattgtgctgctgatcaccgacgggctggagcatgaggccgactcgaaactgacgttcgagatggatcgcctgcaccgatcctgtcgccggctgatctggcttaacccgcttttgcgctatgacggctttgaaccaaaggcgcaaggcattaaaatgatgctgccgcacgttgacgaatttcgtccggtgcataatttgtcatctatcaaggggctgatcgccgcgctgtctccggcgttggcaccgtatcgccgtgatccctccgccccgcagcttgaattgagtggccgccatgctcgatcgcgatga

SEQ ID NO: 2212 - DNA, 1143 bp, Rubrobacter xylanophilus DSM 9941
gtggttgaggaggaacccgccccccggatgctggaggcggcggtcgccttcgggcgcgtgctgcgcggcgcggggctcgcggtgggcaccgaccggctcgtgggcttcgcccgggcgctcgaggagctggacgccgggcgccgggaggacgtctactgggccgggaggatcacgctgacctcccgcccggaggacatcgaggtctacgaccgggccttcgaggccttctgggagcggggcgaggaggcccccccgccgccgcgagggggggccgagctccgcatccccgagcccgaggactccgtgatgccggccaaggagtccgtcgaggctgacgagcggggcgaggaggcggtcgggctgcgctacagcccggtagaggtgctgcgcaaaaaggacttcgccctctactcccccgaggagttcgccgagctgcagcggatgctctccgacctgcggctctccggggccctccggcgcacccgccggctggagcccgcgcggcggggccggcacgacccccgccgcaccatgcgcggggccatgcgcaccggcggggagaccgtcaggcaccgcttccggcgggccaaggaccagccgcgcagggtggtgctcctgtgcgacgtgtcgggctccatgtctccctacagccgggcgctgctgcgctttctgcacgccggggtcataagcggggcgcgcctcgaggccttctccgtggggacccggctcaccaggatcacgcgggagctctccacccgcgaccccgaccgggccctgcggcaggcggccggggccgtgcgggacctctcgggggggacccgtctcggggacgcgctcaaggagttcgtggaccgctgggggcagcgcgggatggcccgcggggccgtggtggtcatcctctccgacggctgggaccggggcgacgtggcgttgctcgccgagcagatgcggcgcataaggcggctggcctaccgtgtgatctgggtgaaccccctcaaggcctcccccgggtaccggccgctcgccgcggggatggccgccgccctgccctacgtggacgtctttctctccgggcacaacttcgagtccctggaggagctggcccgcgccgtcgccgaggcggcgggagacggccggcggtaa

SEQ ID NO: 2213 - DNA, 1257 bp, Mesorhizobium BNC1
atggccggaaacggcgtagaaaagcacgcgacggccgccgatccggaagggcgcattgccgacaatatcgtctatttcgcccgcgctctccgtaaagcagggctaagggtcgggccggcggcggttaccgacgccattcaggccgtgctcgttgctggcatcggcacgcgcgaggatttttactggacgctccattccgtgctcgtcacaaggcatgaggaccatgcggtcttcgacgaagccttccgcctgttctggcgctcacgcgagctgatcgagaagatgctcgccatgctttcgcctctggcgccggtcccgcttaaaaaggaaaagccgagggctggcgagacgcgcgccggtcatgccctgctcagcccggaccgggaagagcgccgggaggcgcagccggagctggaaatagacgccaggcttaccttctcttcccgcgagctgctgcgcggcaaggatttcgcgcagatgacggcggaggagctagccgaggcgcggaaggccgtttcctcgctcgtcatgccgcacgacctcgtcgccacgcgccggcatcggcccgatccgcggggacggcgtatcgacccgcggtcgatgatgcggcttggcctgcgcacgggcggagacctgattttgccgcgttataaatcgccccgccgcgtgcaccctcctttggtggtgcttgccgatatctccggttccatgagccagtacacacgcgtcttcctgcacttcctgcatgcgctgaccgagagccgcaggcgcgtgacgagcttcgtcttcgggacgcggcttaccaatctcacacgccagcttcgctatcgcgatcccgacgaagcgcttgcccattgcgctgccgccgttcaagactggtcaggtggcacgcgcatcggcgaggcgatcggctcctttaatcgtctttggtcgcgccgcgtcctggggcagggggcggtggtgctgcttatcaccgacggactggagcgcgacgacgtggaagcactcgcacgcgagatggagcgcctacacaagtcctgccgcaggcttatctggctcaatccgcttttgcgcttcgatggattcgagcccagggcgcgcggcatgcgggccatgctgccttatgtggacgagttgcggcccgtgcattcgctggatgcactctcggatctctgtgaagcgctctcggccgtgccccgcagccgcgcaaggccgtcagctcttcttgaagggcttggcaagcgcccgcccgcgtga

SEQ ID NO: 2214 - DNA, 1212 bp, Acidiphilium cryptum JF-5
atgagcgcctccgatacgggacggctcgcgccgaatgtgatgcatttcgcgcgcctgctccggcgtgccggcctgcctgtcggccccggcgaggtcatcgccgccgccgaggcgctcacccatgtcgacatcaccgaccggcgggtgatgcgagcggcgctgcaggcggtgatgctgcgccggcacgagcacgcgctgctgttcgaccaggccttctcggtcttctggcgcaaccccgacgccgccaaattcgcccagatgctggcagcgatggatggccgcgccccgcgcgaggaaaaggccgccgccggcgcccgccgccttgccgaggcgatgcaggcggccaagtcgcgcgagcaggaaccccgccccgacgaacgccgcgaggtcgacgcgctgctctccgcctctggccaggaacgcctcgaatccctcgatttcgaggcgatgagcgccgaggagatcgccgccgccaaggccgagatcgcccgcctcaccctcccgctcgacgaacggcgcacccgccgcttccgcctcgccgcccgcggctgccgggtcgatctcaagcgcaccctgcgcgattcgatgcgccattccggcgaggtgttcgacatcgcccgccgcgtgccgctcacccgcccgccgccgctcgtcgtcctgtgcgacatttccggctcgatggcccgctacgcgcagatcctgctgcacttcctccatgccgtcgccaacgagcgcgaccgcgtgaccaccttcctcttcggcacaaggctgaccaacatctcccgccagctcgcccggcgcgacccggaagaggcgttcgagcaggttgccggcgcggtgccggactggtcgggcggcacccgcatcggcgaggcgctcggccagttcaaccggctctgggcccgccgcgtgctggcgcagggcgcggtcgtccttctcgtcaccgacgggctcgaccgcgagggcgccgtcggcctcgccgacaacatggcaaggctgcaccgctcctcgcgccggctgatctggctcaacccgctcttgcgctacgatggcttcgcgccgaaatcgcaaggcgcacgggcgatgctgccctatgtggacgagttccgcccggtgcataacctggccagcctgcgcagcctggtccaagccctgtcgggcgaggcgccgccgcgcctgcaggccgccgccctgtgggagacccgccaatga

SEQ ID NO: 2215 - DNA, 1206 bp, Bradyrhizobium BTAi1
gtgcccaccagcatcaatcacctcgcaccacccaccggcggcattgccgacaacattgcaggctttgcgcgggcgctgcgtgcagcaggtcttccggtcgggccaggcgctgtgatcgatgccatgaccgcgctcgaggtcatcgacatcggcaagcgcgcggacgtcttcaccacgctggaatcgatcttcgtcaagcgccatgagcacgcgctgatcttcgcccaggccttcgacctgttcttccgccccgccgaggagtggaagtcgatgctcgattccgtgccgctgccggatcacgccaagaagaagccgccgccggcgtcgcgccgggtgcaggaggcgatggcccagccgcagatgcatgaggagccgaaggcgcaggagcaggatctgcggctgtcggtgtccgaccgcgaggtgctgcagaagaaggattttgcccagatgagcgcggccgagatcgccgaggtcgcgcgcgcgatcgccaagatgcggctgccgcaggccgagctgaagacgcgccgccacaccacagatccccgcggccaccgcatcgacatgcgcaagaccttgcggcaggcgctgcgcaccgagggcgagatcatcaacttccatcgcctgggacggatcgagaaaccggcgccgatcgtggcgctgctcgatatctccggctcgatgagcgaatacacccgcctgtttctgcatttcctgcacgccatcaccgacgcccgcaagcgcgtgtcggtgttcctgttcggcaccaggctgaccaacgtgacgcgggcgctgcggcagcgcgatccggacgaggcgctggcgagttgctcggccaatgtcgaggactgggccggcggcaccaggatcgccacctcgctgcagaccttcaacaagcaatgggcgcggcgcgtgctcgggcagggcgcgatcgtgctcctgatctctgacgggctcgagcgcgaggccgacagcaagctcgccttcgagatggaccgcctgcaccgctcctgccgccgcctgatctggctcaacccgctgctgcgctattccggcttcgaggccaaggcgcagggcatcaaaaccatgctgccccacgttgacgaattccgccccgtacataacttgacctcgatcgagacgctgatctcggcgctgtcatcgccgctcccgccgcacatcagccgcgtgatccggcccgccgcctga

SEQ ID NO: 2216 - DNA, 1290 bp, Sinorhizobium medicae WSM419
atgaccggcgccaattcgggtgagaccaactcttctgcatcccgcgaaggacagggacggcttgccgacaatatcgtcttcttcgcccgcgcgctgaggcgcgccggattgcggatcggccccgccgccgtcgctgacgcgatcgatgcggtcaggctgatcggaatcggttcccgtggcgaattctatgcggcgctccaatgcaccttcgtcaagcgccatgaagaccaggccgtgttcgacgaagcgttccggctcttctggcgctctccggaccttgtgaacaagatgatcgcgctcatgtcgcccattgccttgcctcgctccggggaggaccggcgtcggcgtgccggcgaagcacgcatgcgtgatgcgctccttgccggtcggcacggtgcacagcagccgagcaaggcgccggaggtcgaggtcgatgcacgctataccgtttcggggcgcgaactcttgcgcaaagcggatttcggccagatgaccgccgaggagatcgccgaggcaagaagggccttgtcctcgatcctgctgccgctggaccggatacgcacgcgccgctatcgcccctcccgccgtccagtgcgaatcgacccgcgcgccaccatgcgcgacgcgatgcggcttggaggggatttcatcctgccgcgatttcgcgagccacgcttcgttcatccgccattggtcgtgcttgccgatatctctggatcgatgagccagtacacaaaaatattcctgcattttctgcacgcgctgacggaacagcggcagcgtgtgcagacgtttcttttcggaacgcggctgacgaatgtcacgaggcagatgcgcaaccgcgaccctgacgaggcgctggacgagtgcattgccgcggtcaaggattggtcgggcggcacgcgtatcggagagacgctgcacgcgttcaatcggcgctggtcgcggcgggtattaggacagggcgcagtcgtgctgctgatgaccgatgggctggagcgcgatgacacagcgggtctggaggctgaactgggccgactgcatcgatcctgccgccggctcgtctggcttaatccgctgctgcgcttcgacggtttcgaggcgcgcgcgagaggcgtgagggccatgttgccacacgttgacgagttccggcctatacacaatctcgaatcggtctccgacctggtgaaatcgctgtccggccagggaggacgcgatgccgacccacggcgtttcctcaaccatggacggcttgccgttgaccgagcgccggcgaatgcgccacagtga

SEQ ID NO: 2217 - DNA, 1212 bp, Parvibaculum lavamentivorans DS-1
atgcccgctcgccctgcggagaatcatggccgcctggcggaaaacatcgtccatttcgcccgcgtgctgcgccgcgccggtctccgcgtcggtccgcgccaggtgctcgatgctgtcgaagccgtcgaggcggcaggcatcggcccccgcgccgacttctactggaccctccatgcgacactcgtgaagcgccacgaggaacgcgagattttcgatcaggcgtttcacgtcttctggcgcgacccgaagctcctcgacaagatgatgtcgctgatgcttcccgagatcgaaacgccgccaggtgcaacggacgaagaaaaaagccgccgcctcgccgaggccctgttcggcgaaacccgtccgcaggcgccggaagagccggatatcgaaatcgaccgcagtgaaaccttctcggccgaggagttgctccggacaaaggatttcgagcagatgtccgccgcggaactggcggaagccaaagccgcgatctcccgtctccacctctcgcatgacgatatccgcacccgccgcacgcgcccctcctcgcgcggccagatgatcgacatgcgagcgaccttgcgtgcgacgctccgctctggcggcgtcattcctctgaaacgccgtacctttcgccgccgccgcccgccgctcgtcatcctctgcgacatctccggctccatgtcggtctacgcgcgcgtcttcctccacttcctgcatgtgctggcgaacggccgcgaccgggtccacatcttcctcttcggcacccgcctcacccatgtcacccgggagctgaaacaccgcgacatagacgaggcgctggcccgcgtcgccgcccgtgtcgaggattgggatggcggcacacgcataggcgagacgctccaccgcttcaatgtcgattgggcccgccgtgttctcggtcagggcgccacggtcctcctcgtgactgacggtctggatcgggatgccggcgaaggcgtcggcccggaaatcgcccgcctccaccgccaggcccgccgcctcatctggctgaacccgcttctgcgctatgagcgtttcgagccgaaatccctcggcatccgcgcgctcctcccccatgtggacgagttccgcccggtccataatctcgcctcgcttgcctctctggtcgaagccctctccgatgcccatatcggcaggaagccggaaaggccgggaaggaaggaagccgcatga

SEQ ID NO: 2218 - DNA, 1218 bp, Rhodopseudomonas palustris TIE 1
atgcagcgtaatccgaccgcgatgatcgaccatctcaatccgccaaccggcaagatggcggacaatgtggtcggctttgcgcgggcgctgcgcgcggcggggctgccggtcggaccgggcgcggtgatcgatgcgctggacgcgctgcagctgatcgagatcggccatcgcgacgatctctacgccacgctggaagcgatcttcgtcaagcgccgcgaacatctgttgatcttcgaccaggcgttcgcgctgttcttccgcgccgccgaggattggcagcacatgctggactcgatcccgctgccggacgccgccaagaaaaagccgccgccggcctcgcgccgggtgcaggaagcgatgtcgccggcggcgacgcgcgacatgccgtcggccgaggagcaggaattgcggctcgccgtctccgacaaggaaatcctgcagaagaaggacttcgcgcagatgagcgcggcggagatcgccgaggtgacccgcgcgatcgaacggatgaggttgccgcaggccgagctgcgcacccggagagtgaggcccgatcgtcgcggcctgaagctcgacctgcgccgcaccttgcgcgcgtcgttgcggaccggcggcgaggtcgtcgatatcaagcggctcggtctgatcgacaagccagcgccgatcgtcgcgctgctcgatatctccgggtcgatgagcgaatacacgcggctgttcctgcacttcctccacgccatcaccgatgaccgcaagcgggtgtcgaccttcctgttcggcacaaggctgaccaacgtcacccgtgcgctgcggcagcgcgatccggacgaagcgctggcgagctgcacctcctcggtcgaggactgggccggcggcacgcggatcgccacctcgctgcacagcttcaacaagctgtgggcgcggcgggtgctcggccaaggtgcgatcgtgctgctgatctccgacgggctggagcgcgagagcgactccaagctggcgttcgagatggaccggctgcatcgctcctgccgccggctgatctggctcaatccgctgctgcgctacgacggtttcgagccgcgcgcccagggcatcaaaatgatgctaccccacgttgacgaattccgcccggtgcataatttgacctcgatgcacacgctgatcgcggcgctgtcgtcggcaccgccgccgcaccatttcagcacgatccgttccgtcgcctga

SEQ ID NO: 2219 - DNA, 1185 bp, Methylobacterium sp. 4-46
atgacgggccggctgccggacaacatcgcccacttcgcccgcgccctgcgcagggccgggctgccggtcgggcccggggacgtcatcgacgcggtcgaggccgtggtggcggcccggattggcagccgcgaggacctctactggacgctccacgccgtcctggtgcgcaagcacgagcattcggtgctgttcgaggaggcgttccgcctgttctggcggcggcgcgacctcatcgaggcgctgatcgcccagatggcgccggtcgcgccggcccgggggcgcgagccgccgaaggccggggccctgcgggtgcgcgaggcgctcgcgcccgacgccccccggccccggccgaagcaggacgaggcggccctgcgcgccaccctcacggtctccgagcgcgaggtgctgaaggccaaggacttcgcccagatgtcgaccgaggaggtggcgcaggcccgccgcctgatcgccgccctggcgctgcccgacgacgccgcccgcacccggcgcttcgccccgacggcgcgcgggcggatcgacccgcggcgcagcttccagcgcaccctgcgcgcccagggaagcatcgacctcgcgttccggtcgccgcgggtgcggccgccgccgatcgtcgccctcgccgacatctcgggatcgatggcggagtactcgcgcctcttcctccacttcctgcacgccctcggcgagcggcgccgggtgcacagcttcgtcttcgcgacgcggctcaccaacatcacccgcgaactcgcccggcgcgacccggacgaggcgctcgtccgggcgagcgcccgggcccgcgactgggaggggggcacccgcatcgccgcggccctgcacgccttcaaccggcactggtcccgccgggtgctcggcgggggcgcggtggtgctgctgttcacggacgggctggagcgcgaggtgacgccggaactgaccttcgagatggaccggctgaagcgctcctgccgccgcctcgtctggctgaacccgctcctgcgcttcgaccgcttcgaggcccgggcggccggcatccgggcgatgctgccccacgtccacgatttccggccgatccacagcctcgcggcgatggaggatctctgccgcgcgctcggcgcagggccggtccgcgccgacgacccgcgcgcttggttgcgccgggccggctga

SEQ ID NO: 2220 - DNA, 1188 bp, Methylobacterium nodulans ORS 2060
atgaccgggcgcctgccggacaacatcgcgtatttcgcccgcgccctgcgcaaggccggcctgccggtcgggcccggcgacgtgatcgatgccgtcgaggccgtgcaggccgccgggatcggcacccgtgaggatttctactggacgctccacgccgtgctggtgcgcaagcatgagcattcggtgctgttcgaggaggcgttccggctgttctggcggcggcgcgacctcatcgagaagctgatcgcccagatggcgccggtcgcccccgaccgcggacgggagccgcccaaggccggggcgttgcgtgtgcgcgaggccctgacccccgccgccgcgccgaagccggcccgcaagcaggacgagacggcgttgcgcgccaccctcaccgtctcggagcgcgaggtgctgaaggcgaaggacttcgcgcagatgtccgccgaggaggtggcgcaggcgcgccggctgatcgcggcgctcacgctccccgacgacgccacccgcacccgccgcttcgccccgcaggcgcgcggccgcatcgatccgcgccgcagcttccagcgcacgatccgcgcctatggggccatcgacctcgccttccgggcgccgcggatgcggccgccgccgatcgtggcgctcgccgacatctcggggtcgatggcggaatattcgcgcctcttcctccacttcctgcacgcgctgagcgagaggcggcgggtgcacagcttcgtcttcgcgacgcggctcaccaacatcacccgcgaactcgcccgccgcgacccggacgaggccctcgcccgggcgagcgcccgcgcccgcgactgggagggcggcacccgcatcgcggaggcactgcacgtcttcaaccggctatggtcgcgccgggtgctcggcggcggggcggtggtgctgctcttcaccgatggtctggagcgggaggtgacgccggagctcaccttcgagatggatcggctcaagcgctcctgtcgccgcctcgtctggctgaacccgctcctgcgcttcgaccggttcgaggcccgcgccgggggcatccgggcgatgctgccccatgtccacgacttccggccgatccacagcctcgcggcgatggaggatctctgccaagcgcttcgcgcagggccgacccgcgcggaggacccgcggacttggttgcgccgggccggctga

SEQ ID NO: 2221 - DNA, 1137 bp, Brucella suis 1330
ttgtcattttccatctctgttgaacgcctgatcgagcgatggcagaacgaaggcctgattgatgcgcaaacggcatcacggctgaatctcgatcttgaaaagcgcaggtctgttttcagcctcggttctgtattggcaacccttggcgggcttctgctgggcgcggcggttatcatgctcgtcgccgccaactggcaggaaatgccccggctgatgcgcataggcgtcatcttcgttctgatctgggcgagctatctgggaggcgcatggcgtcaggcgcggggcgacaaggtttttcccgccgcgctttacgttctaggtgctgcgtcctttggcgcggggattgcgctcgtcggccagatgtatcacatatcgggcgatgttcattccgcagccctctactggacccttggtgttctggcttcggcatttctcctgcgcgcacaggcgctggcggcttttggcgcgggcgtagcctgcttttatctttcgaccttcgttttcgccgatagcaacctttcaggtgccgatatttcttatcgctgggtcgggccgcttttgctgcttgcaggcgttgccgccgcacttttcacgcgctcgcgccatgcggcgcattttctggccctgttctcgatcggctggtgcctgcttctttatgccggacaggaaaacaaaacggttctgttgctcatgatcgtgattggcatagggctgatactggctgacggcctgcgccacgaacaattgcagaagcttacgcgctttgcccatccgctcgccgcttacggattgctgcttgtgcttctttcatttgcaattttgcaactcgacagcgttatcacctatggcggtgtttcggcgggcatcgaccgtgacattctttatagtatgctgatattggccctttcgattggtgcgatcgccatctgcgggcgcgataatggtggattgcgctccatagcttatgcggcattctccattgaggttctttatctggcgtttgaaaccgtgggcaccatgatcggaacctcgggcttctttcttacggcgggcattctggtgctgctgcttgccgcctttgtgcggcgcatggaaagccgctttggccgaaagcaaggtctggaggtgcatccatga

SEQ ID NO: 2222 - DNA, 1005 bp, Brucella ovis
ttggcaacccttggcgggcttctgctgggcgcggcagttatcatgctcgtcgccgccaactggcaggaaatgccccggctgatgcgcataggcgtcatcttcgttctgatctgggcgagctatctgggaggcgcatggcgtcaggcgcggggcgacaaggtttttcccgccgcgctttacgttctgggtgctgcgtcctttggcgcggggattgcgctcgtcggccagatgtatcacatatcgggcgatgttcattctgcagccctctactggacccttggtgttctggcttcggcatttctcctgcgcgcacaggcgctggcggcttttggcgcgggcgtagcctgcttttatctttcgaccttcgttttcgccgatagcaacctttcaggtgccgatatttcttatcgctgggtcgggccgcttttgctgcttgcaggcgttgccgccgcacttttcacgcgctcgcgccatgcggcgcattttctggccctgttctcgatcggctggtgcctgcttctttatgccggacaggaaaacaaaacggttctgttgctcatgatcgtgattggcatagggctgatactggctgacggcctgcgccacgaacaattgcagaagcttacgcgctttgcccatccgctcgccgcttacggattgctgcttgtgcttctttcatttgcaattttgcaactcgacagcgttatcacctatggcggtgtttcggcgggcatcgaccgtgacattctttatagtatgctgatattggccctttcgattggtgcgatcgccatctgcgggcgcgataatggtggattgcgctccatagcttatgcggcattctccattgaggttctttatctggcgtttgaaaccgtgggcaccatgatcggaacctcgggcttctttcttacggcgggcattctggtgctgctgcttgccgcctttgtgcggcgcatggaaagccgctttggccgaaagcaaggtctggaggcgcatccatga

SEQ ID NO: 2223 - DNA, 1131 bp, Ochrobactrum anthropi ATCC 49188
ttgtcattttccatttctgttgaacgcctgatcgagagatggcagcgggacggtctgatcgatgcggaaacagcatcgaaactgaatgccgaccttgaaaagcgcgcttcggtcttcagccttggttccgttctggccacgcttggcgggctgcttcttggcgcagccgttatcatgctggttgccgcgaactggcaggaaatgccgcgcctcatgcgcatcggcctcatattcgttcttatttgggtgagttatctcggtggagcctggcggcagtctcgtggtgacaagctgtttccggctacgctctatattgtgggtgctgcatcgttcggggcagggctggcgcttgtggggcaaatgtatcatttgtccggcgacatccattccgccgcaatctattggtccgtaggcgttctggtttcggcttttcttctgcgcgcgccggtactggcggctttcggcgccggtgtcgcctgcttttatctttcgacctacgtttttgatatgtcgtcctatgatgacgtgacctatcgctggatcggaccgctgcttttgctgttcggcgctgcagcggccttgttcacgcgctcgcgacatgcagcccatctgtgggcaatgttctccattggctgggctttgctcgtctatgcggagcatgagagcaatacggtgctggtgcttatgctggtcgtgggaatcggtctgatactggctgacggttttgcccatgatacggtgcagagactgacccgcttcgctcatccgctcgcggcatacgggctggctctcgcgctgttggcgcttgtcacgcttcagatcaaccagatgttctcctattccagcgttaccgcaaatctggatagggacatattatatagcatcttcatactggcgctcgcgatcggggcgattgctgttgccggtcgaaataatggcggcctgcgttccatcgcctatgccgcattttcgatccaggttctctatctggctttcgagacggttggcaccatgatcggaacatccggcttcttcctgactgcgggcattctcgtgctgctgctggctgcttttgtgcgacgcatggagaaccggttcggaaggaaaagcagcgtggaggcccgcctatga

SEQ ID NO: 2224 - DNA, 1251 bp, Campylobacter curvus 525 92
atgaatccttttaataaagattttctctctggtgagatcgtgaaatggcgtgataaaggcatcatcgacacccagaccgcgcaaaagatagcctctctttacaatataaatttaaacagcacgcatgacactacgagctttatccttaaactagtagcctatcagtttttttcgcttgcgttttttacgcttatcggagctaactgggaggagataccgcgttttggtaggcttttgatcgttcttttcgtgctcgctcttgtaaatttaggcggctttttcacacttaaaaagggcaaagaaaatagcgctacggcgttatttttacttgggaatttctgctacggagcggcgatagccttgatagctcagatctatcatttgggcgaacatatggctgatggcgtgctactttgggcggtgggctcttttgcgctatcctttgccgtaggcagatcgatcctgatcgctcaaagccttgctatagcgcttttttggtttgtcatggagatagaatttggccttgtgatgcatggctttttgatatttgtcgccatcagctgctatgtgctttggcgcgatagctcgaggatactcacagggcttatttttatcagcgttttcgtatatttggtgtttgccatcttgcgagctacgcccgtagagttgctagatagcatatttataataagcatcgtgttttttgcgctatcgtattgtatgttgtgtgtatcggtcgcgcttgtggtggaaaattttggcaaatttcatatcgccgagtatctaaaaacgacgtctatcacttgcggagtcgtggtattgctcgtgtcgatgacgttttatgatcttgacctccttctctttcagacggatatggagtcggtcgtattttataaaacggtgtttggctacgtggcagccgcatttatcgtgatctgtgcgttgatatttgctaaatttaggagatattactcgttgcttctttgcgtggggctatttttgctaccgatcttgatcgaaaatttcagtgattattcaaaggcgatattctcgttcataagcgtgttggtaggcatcgtgctcatcaagcaaaattatctgaattttggccttatagtgatattttgtgtcgctatcgtcagatatatcgatctgataggagactatatcggagctagcttgctatttatggcctttgccgtgactgtgctcgtgatgtctcgaaaaaggagggctaaaaatgaggcttaa

SEQ ID NO: 2225 - DNA, 1296 bp, Parvibaculum lavamentivorans DS-1
atgtggcagcgcatctacttgcagcgcctgaagcacgatctcgatctgtggatcgagcggggctgggtcacaccggcaaacgccgaatccatcctcctctccgcccgcgagcctgccgccacgcggcgcatgcccggcgtcctcgccattctcggcgcggtgctgatcggcttcgccgtcatgagcttcgtcgccgccaactgggcggagatttcaaagctcgccaaactcatcatgatcttcggcgccatgtgggcggcctatatcgccgctttcctcctccagaagcgcgatcatccggctctggcgcaagccgccgtgctgataggcctcggcctttttggcgcaggcatcatgctcatcgcccagatttatcacatcgtcaccgacgatccggcgggcgtgctcgcatggtgcatcgccgccctctccaccgcatggctccttccgtcacgccccgcccttgccctcggcattctacttactgtcgtctggacatatttcgtggtggaaatgcccggcgccgtctcgccgcattggagcttctggctgccctgggccgccgccctcgttttgtcgctgcgtctttcatggtcgcccgggctgcatctctctctgatcgccggcctcatctggcaggcgatgaacgcgcaagccatcgtcgagacctatggcatcgtcgaaacgcaactcgccatcattattctgctggaaatgctggcgatctggctcgccgctgtcttgctctccgagcgcggcccgcgcttcgcttccatcgcggaagcatatgcaatcgcctttgccttcgcgatcttctggattttccagaccgcgccctccgataatgaaatcgcctcctccgccgccggccccttggtgacgggcctcatggccgtggtcgtcgccgggctcgccttcctctgcatcgcaagaagcaagctcgaagcccgccacatcatcggcatcggcgcgctggcggtcctcgctcttctgttccccgtgctgagatcgggcgccggggaaaccattccctggctctatgccgccgccttcctcgtcctcgccgcatggctcgtctcctatggcaccgggcgcggcagccgcttcgccgtcaatttcggcttcgtcgctttcgccgccgaggtcctctacctctattttgaaacgctgggcgatcttctcagcacggcgctcttcttcgccctcggcggcgttctgctcatcgccggcagcatcgtcatggagcgaatgcgccgccgtctggtgaaagccgcgagcgaaggagacgcgccatga

SEQ ID NO: 2226 - DNA, 1263 bp, Campylobacter concisus 13826
atgaatttttacaatagaaattttctagccaaagagctagatcgctggcaaaaagaggatgtgatcgataaggtcaccgctttaaagatagcaaatttatatgatatagatataaacgctcatagcgaaaagactagctttatcttaaagttggttgcctatctctttttcgcgctggcattttttactctggttggagcctactgggaggagataccaaggatggggcgccttgttatcatctttggagtgcttgctcttttaaattttggcggagtttattatctaaaaaagggcaaagataagcttggcacagccacgctctttttgggaaatttctgctacggagcagccatagcgcttatcgctcaaatttataatattagcgatgagccaagcggtggagttttgctctggagcgttggagctatggctctctcttttgctagcaaaaagggtctgctagtggctcaaagccttgtttttgcgacgatctggtttgttttaaagggcacgggcggcgagtttgcttatgaatttatcgtctttatagcccttggcgcctacacgctttataaaagtgactctatttttcttgctaccatgcttttagcggatatatttttctacatcgtttcgctttgcgctaggatcagtgggtttaacgaattttatggctatgatcttatgtttagagcgccgatggctgctactttatcgctctcatacgcgcttttacttgtcgcgctctttagcccgttagctgactttagagataggctagcgcaccttgtaaaaggctttggcaagtatcttggcatcattatcttgatcgtttgcttgatagcttatgcaaatggcgatatctacgagctagaagaagataaattttggtttgcaaaagcatttttttatagcagttttggcaaggtttttgccgtatttggcatcgctagcattgcgctatttttcaaagagaaaaacaaaagtggcctgcttcttggcttgatactctttgcgttgccatttgtctttagcttgggcgttggatatgcaaatatcttcttctcgctagcaaacatcatcgttgcagccgtgcttatcaaaaatggcgagctaacgcttggcctttgtatgatattcttagttgctgtgattagatactttgagctaataggcgattatttgggggctacggcgctatttatcatctttgccttcgtcgtgctcgcagttgccgctaaaaaaggacgtacaaaatga

SEQ ID NO: 2227 - DNA, 1329 bp, Shewanella sediminis HAW-EB3
atgcggttaatccagctgtttaaaaaggagttgtcacacgaagctcgtacctgggtacgtgatgagcttgtgtcggagcagcaggctaattcgatattggcccgctacggcacgagcctcaatgatgacaccgataaaaattccttcggttattacctgctgatgtcattgggagtgttgtttattggtttagcgctgatactgatcgtttcacacaactgggatgagatcccaagaagcatacgtacaggaagtttactgttattaaccttggtgactaacgccgtcggtattaaactatttttatcgaagcgaatacgcgccggcatcatctggttactctttggcggcatgagttatggcgccagcatcatgctcatcgcacagatctatcacctgggagaacacttccctgatggcatattctggtgggcattgggtatattacctttggtggtctttactcagagtcgacttttggcgctgttgtccttgagcttggccagtatctggctagtggtcgaatcgggggaagactttttcccgacgctttatccgatatttatatcagtgacactttggttaaccctgtttcaggctcgctcccgtttactgttcctgtcctgtgttgtgggtttacttgtctggataaatttaggtctggcttggatcatgggcagtggctatcacttcgatcccgtggcagagcaattacccttttctttaggcctggggcttatcataaatggtgttgcatggtggctaatgcgcgctgataagagtgactggcgagagtacggactggtggtacacatctggttactcagggcggccattattaccctgttagtattcagcttcgaaggcgtgtgggaagagtacccgagcgaccagagttggttgtctgtgataagtgttatcttcatcctagtgtcggggatgcttgcatttcggctatctcgcgcaagtggtcgatacgcatctctgccgacgttgatgctgaccggctatctgacgttctcattttatctggtgagcgcgtttagccatatggaatttatctcagccatcgccactaacttgatgctgctcctgatggggatcctcttgatacgaagaggtatcgatcaatccgaaacccactatttctataccggcattgtcgtcctgttactgacggcatttatacgatatttcgatcttataggagattacataggtggagctgttctgtttctcgtcgcggccggtatcttgatggccgcggcaaaatactggaagcatcatgtcacccttatcgctttaaaacagggaggtcatagcgaatga

SEQ ID NO: 2228 - DNA, 1338 bp, Shewanella woodyi ATCC 51908
atgaggctgatcaacctctttaaaaaggaacttgcccatgaagctcgagattgggtgcgcgatgagctagtgtccgatgctcaggcgagtgctattttagcccgctatggtgaatcattagatgaagatcccaataaaaactccttcggttactacctattaatgtcacttggtgcgctgtttttagggttagccttgatccttattgtgtcccataactgggaggagatcccaagagtcatacgcaccacaggcttgctgttattgaccttcagttgtggtgtcattggtagcaaactttttctgtcaggccgagagcaggctggtaaaatctggctgttttttggcgggatcagttacggtaccagtatcatgctggtcgctcaaatatatcacttaggtgaacattttcccgatggtatattctggtgggctgcgggtatcttacctctggtcattttcactcagagtaggctattagccttactctctttcacactagccactatttgggccatggtagaaacaggggaggattttttccccgcactctatcctatatttgcagtggtgactctctggttaaccctgttcaaaaaaacatctcggttactgtttgttggcagcattgcagctctggttacctggtttaatttagcattggcttgggcgatgggtggtgcaggttatttcgaactttttgaagagcagctgccactctctattgcgatcggtatattgcttaacggtctggcttggtggttaatgagatctaaagatcatgattggcaggagtatgggctagtgactcatatctggctgctaagaggatccattattacactgctagttctgagctttgagggagtatggcaagattacccgatggggtttgactggctgtctctgttaggtattaccactttgcttctttttggttgtttatcttggggattatcgagaaaaagtggtttatatgcctcaacgccagctatcttaatgacgttctattttgtcttgtgtttcgccttagtgggagcgttcgataatatggagctgatcaccgcaattgcaacaaacttaatgttagttgttatggggatcctattgatccgcagagggatagatcagacacaaacccactacttttataccggtgtcgttactctcttgttgactgcttttttccgttactttgatcttattggtgactatataggtggggcaattctctttatggtcgcagcagctatcttgatggctgcagctaagtattggaaatatcacctaaagttagttacgaaagtcgatgatacacaagttagggagggcgagtaa

SEQ ID NO: 2229 - DNA, 1353 bp, Methylobacterium sp. 4-46
atgccgttgagctaccgcgaccgcgttctcgccgacatccgcgcctgggccgcccgcggcctcatcgacgccgagcagcagcgcctgctggaggccgagctgcggcgggagccgggcctcgccggcctccaggtcgccctcggcgccgtcgcggccctgctcgtcgccgtcgcggcgatcaccttcgtggcctcgaactgggccgggatgccgcccctctggcgcctcgtcctcctggtggcggcggatgccctcgcggtcgggctcgccgccctcgccaccctccggcatcgccgcagcggggacgtcacgctgcggcgcctcgccgacgccctggccgggctctcggtcgccgtctccgccgccgcgctcgccctgatgggccagaccttccacctgccgccggacctgccgggctacgccgtcaccgtcgcggtcgttgccaccgcgaccgccctcgcactgcgctccggcagcgcgggcggcctcgccgccgcggggctggcgctcgccgcctgggcggatttcctccaggacggcgccgaggccgcgccgggcctgccgcatccggcctggccctgcctcgtcgtgctggcgaccggccagctgtcggggcgcatcccggcacggaccgccgggttcttcctcctgctcctgccgctcgccagcgcggtcgcggtgccggccgcgggcccgcgcatcgatgcgggccggctcgcgctcttcgccctcgcggtcgtcaccgcggcgcaggccgcctcccgcctgccgcgcctcggtccgggggtcgcgcgccggctcgcgcggctcgcgcgggcggccgggggcttcgtgctcctcgccctgctggcgcgggccgcgggcctgctcggcgccgaaccggccgggagcgcgccctcgttcccgcgcctcctcgccggactcgccctggtcgggctcggcctcgcgctgccgcggccgcgcgggacacccgtcccgatcgggcccgcgatcctcgccggggcggcgctggttcccctggcgctcggcgccggtccgccgtcccgcggcgccgcggccgccccggccctggtctggacggtgctgctccccctcctcgccgtggcggtggcggcccggctcgacgggcgccgcgccctcggggccgtcagcctggccgcctgcgccgccatgaccctcggcgtgctgctcctcggcgacgacctgatcggcgtcgccctccacctgctcgccgcgggcgctctcgcggccctcgccctcgcggcgacccgccgcctcggcgcgatgcggccggcccggccgggaaacgggccgagggcggggcccaaggacgagccgagggacgggccatga

SEQ ID NO: 2230 - DNA, 1104 bp, Rhizobium leguminosarum bv  trifolii WSM2304
atgtatcgcggcagattggagcgggatctctccctctgggtgggcaagggcctgctggggcaggaaacggcaggcgcgcttcttgccgaatatgacagccgcccggcaagcttcagcctcgggcgggtgttgatggctctggcggcggtgctgctggcagccgccatcctgctggtcgtcgcctccaactgggaggccatcccgcggcttatccgcgtcggcgttatccttgccctgatctgggtggtgcacctcgccgccgcccggatgctcgcccgcggtgcgtccgcggcggcaagcggcttgctgatcatcggcgcgatgagtttcggcggcgccatttcactggtcggacagatgtatcatctctccggcgacgagcagacggtgatgtatctctggttcgccatcgcgacgatctcggcgatcctgttccgctcgggtgccgtggccgtcgtcgcgggtttcctgtcctgggcgtcctttgccgtctatctcgagaattacgacacacattggatagggttcgatccctggatggcgcccgtcatggcggcgatcgtcatcgggctggtgcggtataccggcgccgagcgggcccgccatctcgcctatctactgctgatcggctggcttgcctggctctatacgctttacgaggagatcgccgtggcgctcgccttcgcgatcggcggcatggccgccttcgtgctgacggcgttgccgacccgctctgttgcctccctggtcaggagcgccggtgcggctccggccttctacagcttcctcgttgccgcgatcggcttcctgctgctgcatatcgaaatcgaggacggctggccgctggtggtgctcggcgtggcgacgcttgccgcctcggtgctggcgatcgccctgcatggcagggacaacggcgcggtgcgttatctcgcttacacaacctttgccgccgagatgctttatctcgcttccgtcactgtcggctcgatcctcggtacctcgagcctcttcctgttttccggtctcgtcgtcgcgctggttgcctggatcgtcatccgtctcgaacggcgcttttcggcgaatgcacagggggagcgcgcatga

SEQ ID NO: 2231 - DNA, 1311 bp, Methylobacterium nodulans ORS 2060
gtgaccgacatgccgttcagctatcgcgagcgcgtcctgcgggacatccggtcctgggcggcccgggggctgatcgacctcgcccagcagcgccgcctggaggaggaggtgcggcgcggctcggatctcgggggccttcaggtggcgctcggcatcgctgccgcgctcctcgtcggcacagccgcgctcgccttcgtggcctcgaactgggcggcgatgccgcccttcgcacggctcctgctgctgatcgcggccgacgcgctggtggtcgggctcgccggcttggcggctttccgccagcgggccagcggcgatccgaccctgcgccacatcgccgatgccctcgcggcgctctcggtcgcggtctcggcggccgcgctcgcgctgatgggccagaccttccacctgcccgcggacctctccggcttcgcgctcacggtggcggtggtcggcacggtgactgccctcgtcgcccgctcgggcggcgcggcggggatcgccgccgcggccctggtggtcacggcctggcccgatctcgacgaattcggaccggcccgcgccgtctcctggcccggctgggcctgcctggggcttctcgccgccgggcagctctccggctggatccccgcccggagcgcgggcttcctcgtcctgctgatcccggtcgcgaccgagatcgcggtggtgggcgacggcgagccgagggtcgatgccggccggctcgtgctcctcgccttcggggtgatcgcgctggcgcaggtcctccggctcgtgccggccctgcccgaccgggtcgcgagccgccttagccgcctcgcaggcgccgcagccgggctgctgctcatcgggctgctgatccgcgccgccggcgtgacgggatggccctccgcgaccgccaccccctcggcaccccgcctgctcctcatggcggtgtggatcgggctcgtcctgctgccgccgcggttgcgtggcgagcccctgccggtcggcctcctgatcctcgcggcggcggcgctcgtcccgttgtgcctcggcggcccggcgccgcccatcctcggcgaggccggctgggcggtctggaccgtgctgctgccgatcctcgcggtcgcggtggcggcccggctcgatcatcggcggaccctctatgccggcagcctcgcggcctgcctggtcatcgccctcgcgctgatgatgctcgccgacaacctgatcggcgtgtcgctccatctcctcgtcgcgggcgctctcgcggcgctcgccgtggcggcgatccgccgtctcccgcgccatgctgccccgagctggccatga

SEQ ID NO: 2232 - DNA, 1113 bp, Agrobacterium vitis S4
atgatgtatcgggcgaaactgaagaaagatcttgatcgctggaccggcatgggcctgatcagcaaacaggccgccgaggcgatgatcgaggatcatgatggccgggcgggcaatttcaatatcggcggcgttttgctcatgctgtcggcagtgctggtctctgccgccatcctgctgcttgtggcggccaattggcaggccattccgcgcctggtgaaggtgtctagcctgattctgctgatctggggctttcatggcggcgctgccttctgcctcgctcaagggcggcaggcgtcgggtcatgcccttctggtgctgggagcagccagtttcggcgcagcactgtcgctggttgggcagctgtatcacctgtcgggtgaccttctcgatctgctttatctgtggatcggtatggcaagcctgtcctgcctattgtttcgctccggtgcgatggcggctttcgttggtgttctggcgctgggcttggcggctgcaacccttgaccagtttgatttctcctggacgctggaggcagtttggacaccgccccttttggctgtgctcgttacaggcttggcacttttcaccggaaacatccgggttcagcatatatccggcctgctgattcttggctggcttgcctggatctatgcgcagatcatgcagccaggccttgccatggcctatgtggctttaggggtggccgcattcgcagcgtcagccttgccgctgctcgcccggtatatgtccgtgcagattgccggttttcatgccttgctgctggcggcaatgggtcttttcatcctcaatattgagtttgatcacggtttgccactggcgctggtggccgtcactgcggttggtatctccattgcggcccttgtgcttcgtgggcgtcacgacggtgtcgtgagggcgctggcttatctgattttcgcaggcgagatcctctatctgtccttcacaacaattgattctctgttggggacatcgggctttttcctgatcgccggtgtgattgtcgctttgctggccctcggcgtcagccagatggaaaagctgctgggtacgcgcaagcgtccgatggcggttgaaggacgggagcggtcatga

SEQ ID NO: 2233 - DNA, 1104 bp, Rhizobium leguminosarum bv  trifolii WSM1325
atgtatcgcggcagattggagcgggatctctcactctgggtgggtaagggcctgctcgggcaggaaacggcaggtgcgctactcgccgaatatgacagccgcccggcaagcttcagcctcggccgggtgctgatggcgctggcagcggtgctgcttgcagctgccatcctgcttgtcgtcgcctccaactgggaggccattccgcgcctcgtgcgcgtgggtggcatccttgccctgatctgggtagtgcatatcgccgccgccaggatgcttgcccgcggtgcgacagcggccgcaggcgggttgctcgtcatcggcgcgatgagtttcggcggcgccatctcgctggtcgggcagatgtatcatctctccggcgacgagcagacggtgatgtatctgtggttcgcgattgcgacgatctcggcgatcctgttccgttcgggcgccgtgaccgtagtcgccggcttcctctcctgggcgtccttcgccgtctatcttgagaataacgacacgcactggatagggttcgccccctggatggcgcccgtcatggcggtgatcgtcatcgggctggtgcggtataccggcgccgagcgggcccgccacctggcctacctgctgctgatcggctggcttgcatggctctatactctttatgaggagatcgccgtggcgcttgcctttgcaatcggcggcatggcggcattcgtgctgacggccttgccccccaggcctattgcctccttggtcagaaccgccggtgcggcgccggccttctacagcttcctcgtcgccgtaatcggcttcctgctgctgcatatcgagatcgaggatggctggcggctggtggtgctcggagtggtgacgcttgccgcttccgtgctggcgatcgtcctgcgtggcagggataatggcgcggtgcgatatctcgcctacgcgacctttgccgcggagatgctctatctcgcctccgtcaccgtcggctcgatcctcggcacgtcgagcctcttcctcttctccggtctcgtggtggcgcttgtcgcttggatggtcatccgtctcgaacggcgtttttcggcgaatgcacagggggagcgcgcatga

SEQ ID NO: 2234 - DNA, 2616 bp, Dehalococcoides ethenogenes 195
ttgtttagcagtgatgaattacgcgaaaattatctgaaattttttgaggagaaggggcataaaaggattgccagctcttccctgataccccacaatgaccccacccttcttttaactaccgccggcatggtgcagtttaaaccctattatctgggggtggccaagccggaaaactcgcgtatgacttcctgccagaagtgtttccgcactaccgatattgaatccgtgggggatgccagccacctgaccatgtttgaaatgctgggcaatttcagtatcggcaattactttaaaaaagaggctattgcctgggcctgggaatatgtgacccaaaggcttaatatacctgccgaaaaactctgggtgacagtttatctggatgatgacgaggctattgccctctggaaggaacagggagtacccgaagggcggatagtccggctgggtgcggctgataacttctggggtccggccggggattcaggcccctgcggcccgtgcagtgaaatccactatgatttcgggcaggaaatgggctgcggcaaggctgattgcaatccctcctgcaagtgcggccgtttttgtgaaatatggaatctggtatttgtccagtttaatcaggataaaagcggcaaacgccagaatctgcctgcccccagcattgacaccgggatggggttggaacgcttgactatcctgatgcagttcaggaaaaacgtatatgaaaccgatatatttgcccccgttatagaaaaagcctgccagctttcgggcaggcagtacgggattgatgccgaaactgataaggctttgcggatagtatccgaacacagccggggcattacttttctgattgcagacggggttatcccggataaggcggggcgggggtatgtgcttcgccgcctgcttcggcgggcagtccttttcgggcgcaggctgggcctggagaaaccctttctggtggacatggccggggctgttattgcccgcatgagcggcatttaccccgaacttaacaaacgccaggcatatgtgctggagatgatagccagtgaggaagcccgtttttcggagacgctggctaccgggcttgagcttctggaagaaatagtccgccagaccaagggcgggcagatttccgggcaggatgcctttaaactatatgacacttacggtttcccggtggagatgaccaccgaaatagccgctgaaaggggcttaagtgtagaccttggcgggtttgaagccgaaatggaagtccagcgtaccaaagcccgttccagccgcaagttcagttttgatgcggcggctactgccgaggcagtcaagaatatgcgccatggggaaaagacctgttttgtgggttacgaacttacccgccagaaatcaactattatggatatcctgaccgaaggcggcagtgtggacagcatagaagagggtgatgaggccagtatagtgctggatgaaagccctttttatgccgagatgggcggacaggtgggtgataccggtgagattataaccggcggcgggcgttttgaagttaaaaatacccttcacctgcctaacggggtttttctgcatcaggggcgggtaataagcggctgcctgaaaatagctgaaaccgccgctgcccatattgacgaagaacgcaggcgggatattgcccgtaatcataccgccacccatatactccagacagccctcagacaggtgctgggtgagcaggttcagcaaaggggttcggtagttacgcctgagcgcctccgctttgatttttcccatttgaaacccatgaccaaagatgaaatccgccgggcagaggaatttgtaaatgacaaaatccgccgcaacctgccggtttatgccgaggaaatgccctaccgccatgccctggaagagggggtaaccgcccttttcggggaaaaatacggtgacagggtgcgggtgcttagggtggggcgtccggctgtttcagccgaactctgcggcggtacccatgtgagtgccagcggcgaaataagcctgtttaaaatagtcagtgaaagcagtgtgggggcaggccttcggcggattgaagccgtaaccgggcgtgaggccgaggcttatattaaccttcagcaggacagtttatccgagctttcgggtatgctggaagctgcgcctgaggaatctccccgtaaactggctgaacttaaagaagagatagatacgcttaagaaaacagtccagaatctggaacgccagatgtcccgcggagaggcggaagagctgctttccaaagctgaagattataaagggattaaactgctggtcagccgcatgacttcggtcaatgcggataccctgcatgaaacggctgatttcctgcgggacaagctgggcagcgggataatagtgctgggtacggttagcgaggacaagccctttttcctgtgcatggtaacgccggaccttattgagaaaggttatcatgccggcaatatagtcaaaaaactttcccagatagccggcggcggcggcggcggcaagccgaatatggctcagggcggcgggcgtgacaaagccaaactggacgaagccctgcaggctgtaaagggaatgctataa

SEQ ID NO: 2235 - DNA, 2670 bp, Thermobifida fusca YX
atgaagtcggcagagatcgctcgccgcttcctcgcattcttcgagaaaaacggacacaccgtggtgccctcggcaagtcttatcgctgaggaccccacactgctgctggtcaacgcgggcatggtgccgttcaagccgtacttcctcggccagcggactccgccctacccgcgcgccaccagcgtgcaaaagtgtgtacgcaccattgacatcgacgaagtcggcaagaccacccgtcacgcctccttcttccagatgctgggcaacttctccttcggcgactacttcaaggagaaggccatcccgctcgcctgggagctgctcaccacctcggtggccgacggtggcttcggcttcgacccggaacgcctgtgggtcaccgtctacctggacgacgacgaagccgcgaccatctggcgggagaaggtaggactgcccgaggagcgcatccagcggcgcggcaaagccgacaacttctggtcgatgggtgtgcccggaccgtgcggaccctgctcggagatctacttcgaccgcggccccgaatacggcgctgaaggcggccccgtagccgacgaggaccgctacctcgaagtgtggaacctcgtgttcatgcagttcgagcggggcgagggcagcggcaaggaggactacccgatcctcggggagctgcccagcaagaacatcgacaccggcatgggcctggagcgcatggccgccatcctccagggtgtcgacaacatctacgagaccgacaccctcggccggatcctgcgccgcgctgcggagctcaccggcaccacctacggggagaacgagcgcgccgacgtgagcctgcgggtcatcgccgaccacgtgcgcaccgccaccatgctggtcgccgacggggtgcggcctggaaacgagaagcgcggctacgtgctgcgccgtatcctgcgtcggtcgatccgcaacctgcgcctgctctccggggacgagtcgttccacatgcacgacctcaccgcggtcgcgatcgacgcgatgggcgaccagtaccccgagctgcgtgccgacgcggacaagatccacagcatcatcgacgcggaagagaagaacttcgcggacacgctgcgggccggcaccacactgttcaaccgggcggtccggcgcacgaaggagaccggcggcaccgtgttctccggcgccgacgcgttccagctgcacgacacctacggtttccccattgacctgacgctggagatggccgccgagcacggcctgaaggtcgatgaagaaaccttccaccagctcatgcagcgccagcgggagaccgccaagcgcgacgcgcaggccaagaagctcggcaacgccgatatcagcgtctacggcaacctgttggagaccggcggccccaccgagttcctcggctacaccgactcggaaagcgaagcccgggtgctcggcatcatcgtcaacggcgagtccaccggggcggcccgcaagggcgaccaggtggaactggtgctcgaccgcacccccttctacgcggaaagcggtggccagctcgctgacaagggcacgatcaccgtggacggccgcggcgtcgtcgacgtcgaggacgtgcagaagcccatccaaggcctgtttgtgcaccgcggcacggtccgcgagggcgaagtcgtcgtcgacgacaccgtgcacgccgcgattgacacgggtcggcgcgcctccgtgtcccgctcgcactcggcgacccacctcatccactctgcgctgcggaacaccctcggcccgtccgcaggccaggcagggtcggagaaccagccgggacggctgcgcttcgacttcacctcggacaaaccgctcgacgctacggaaatcgcccaggtcgaggaggaagtcaacgaggtactcgcccgcaacatcgaggtccagtacctggagaccacccttgacgaggcgctccggatgggcgcgctggccatgttcggggagaagtacggcaaccgggtgcgcgtggtcgacatgaccgagtactcccgcgagctgtgcggcggcacccacgtggcggcgaccgggcagctcggcctggtcaaggtgctcggggaatcctcggtcggctccggggtgcgccgcgtggaagcgctggtcggcttggacgcgctgcgccgcgtctccaccgagtcggcgctggtgggacagctttccgagcagctcaaggcgccgcgcgaggaactgccgcagcgcatcgacagcctggtctctcggctgcgcgccgcggagaaggagatcgagcggctgcgcgccgcccaagtcctccaagccgccggaaagctggcggaaagcgcccgcgaccacggcaacagccgcgtggtgacccaccgggttgaagacggcaccaccgccgacgacatgcgcaagctcgcgttggacgtgcgcggccggctcggtgaggaccggcccgcggtggtggcgatcgccggcgtgcccagcgaccgccccgtcgtggtggtggcgatcaacaaggaagcccaacaggcgggcttgaaggcgggcgagctggtcggcgtggcggcccgtgcactcggcggtggcggcggcggccgtccggacatcgcccagggtggcggcagcgacgtgaccgccatcgacacggcgctgcgcctcgtggaacagagagtggcggggtcgtga

SEQ ID NO: 2236 - DNA, 2646 bp, Frankia CcI3
atggacacggccgagatccgtagccgctttctcaaccacttcgcccggcgcgggcacaccgtcgtcccgagcgcctcactggtggcccaggatccgacgttgctgctggtcaacgccggcatggtgcctttcaagccctattttctcggggatctcccggcgccgtggccgcgggcggccagcgtgcagaaatgtgtccggacggtcgacatcgagaatgtcgggcacaccgcgcggcacgcctccttcttccagatgtgcggcaacttctcgttcggcgactatttcaaggccgaggcgatcccgttcgccttcgagctgctcaccgaagggttcggcttcaaggccgacgacctgtgggcgacggtctacctcgacgacgacgaggccgaggggatctggcgcaagctgctgcccgccgagcgcatccagcgccgcggcaaggaggacaacttctggtcgatgggcgtgcccgggccgtgcgggccgtgcagcgagatctacttcgaccgcggctgcgcctatggccgtgagggcggtccgatcgcggacgaggagcgctacctcgaggtctggaacctcgtcttcatgcagtacgagcggggcgagggcgccgggtacgactatccgatcgagcgtgagttgccggcccgcaacatcgacaccgggatgggcctggagcggatggcgaccatcctccagggtgtcgacaacctctacgagatcgacatctcccggccggtgctcgacgccgccggccggctgaccgggcggcgctacggcgcggaccccgccgatgacgtgcggttgcgagtgatcgccgaccacacccgcaccgccgcgatgctgatctccgacggcgtcgtcccctccaacgaggggcgcggctacgtgctgcgccgcatgctgcgccgggcgatccgtaacgcccggttgctcggtgcccacgagccggtgatgagcgagctgttcgcggtcgtcgggtcggcgatggggacgatctaccccgaactgctcgacaatgccgagacgatcaccggggtcgccgtcgcggaggagcaggcgttcgccgagacgctgcgcaccggtaccacgatcttcgacaccgcggcgcgccaggcccgatccctgggctcgaccacgctgggcggcgaggcggccttcaagctgcacgacacctacggcttcccgatcgacctgacactggagatggccgctgaggcgggcctttccgttgacgaggcgggtttccgccggctgatggaccgccagcggcaggccgcgaaggcggaccgggccgcgcggcggatcggcaacgtcgacctgtccgcgttccggccgatcctggcccgttccggcccgacgaccttcaccgggtacgaggagctcagccggacctccggcgtggtgggcctcgtcggcatcgccgacggcgcggggctggcggcggcgggggaggacaccgaggtcggggtcgtgctcgacgcgacccccttctacgccgagagcggcggccaggagcccgacctcggtcggctgcgtttcgacggcggcgaggtcgaggtgctcgacgtccagcggcccgtgcccgacctggtcctgcaccgggtgcgggtgctcggcggcgagctgcggctcggcgtggaggtgttcgcggaggtggatgccgatcgtcgccgcgcggtgtcccggtcgcacaccgccacccatctcgtgcacaccgcgttccgtcgcgcgctgggcgagggcgcgacccaggccggttcgctgaactccccgggccggctgcggttcgacttccacgccctcggcgcggtgccgccgtcggtgctcgccgacgtcgaggacgagatcaacgaggttgccctgcgtgacctgccggtgcgggctttcgtaaccacgcaggaggaggcccgccggctcggcgcgatggcgctgttcggcgagaagtacggcgacgccgtgcgggtcgtcgacgtgggcgactacgcccgcgagctgtgcggtggcacgcacgtcgcgagctccgcgcagctcggcgcggtgaagctgctgtcggaggcgtcgatctccgcgggcacccgccgagtcgaggggctggtcggcctcgacgccttccgctacctggcgcgcgagcatctcctggtgtcgcagctgtccaccgcgctgaaggcccgtccggatgagctggtggaccgggtcaccgacatcgtcggccggctgcgcgacgccgagcgggagctggaacgactgcgggccgccgcggtactcgccggggccggggcgctggccgagggtgccgaggaggtggctggcgtcgccgtggtcaccgccgaggtgcccgccggcaccgcccccgacgacgtgcggctgctggcgctggacgtgcgtgggcggctggcggggcggcccgccgtcgtcgccgtggccaaggccgacgggtcgtcgatcgtcgtggtgaccgacgacgccgcgcgcggccgggggctgcgcgccggtgacctggtgcggcagtcctgggcgagcctgggtggcaagggtggcggcaagccggacgtggcccagggcggcggggggaacccacagctggtgccggcggtgttcgccaggctgcgggggctggtggccgagcacgcctcgcggtga

SEQ ID NO: 2237 - DNA, 2694 bp, Mycobacterium MCS
gtgcagacacacgagatcaggaagcgcttcctcgatcacttcgtgaaagcgggccacaccgaggtgccgagcgcctcggtgatcctcgacgaccccaacctgctgttcgtcaacgccggcatggtgcagttcgtccccttcttcctgggccagcggaccccgccctaccaacgggccaccagcatccagaagtgcatccgcacgccggacatcgacgaggtcggcatcaccacgcgccacaacaccttcttccagatggccggcaacttctcgttcggcgactacttcaagaagggcgccatcgagttcgcctggacgctgctgaccaaccccgtcgaccagggcggctacgggttcgaccccgagaagctctgggccaccgtctatctcgacgacgacgaggcgatccagctctggcaggaggtggccgggctgccgctggaacgcatccagcgccgcgggatggccgacaactactggtccatgggcatccccgggccctgcggtccgtcctcggagatctacgtcgaccgcggcccggagtacggcatcgagggtggcccggaagccaacgaggaccgctacatcgagatctggaacctcgtgttcatgcagaacgagcgtggcgagggcaccgggaaatccgacttcgagatcctcggcccgctgccgcggaagaacatcgacaccggtatgggcatcgagcgggtggcctgcctgctgcagggtgtggacaacgtctacgaaaccgacctgctgcggccggtcatcgacgccgtcgccgcacgcgccccccgcggttacggcaggggcagccactccgacgacgtccgctaccgcatcatcgccgaccacagccgcaccgcggccatcctgatcggcgacggggtgagtcccggtaacgacggccgcggctacgtgctgcgccggttgctgcgccgggtgatccgctcggcgaaactgctcggcatcgacgacgccgtcgtcggcgacctgatggccaccgtgcgcgacgcgatgggcccctcgtatcccgaactggtcactgatttcgaccggatccagcgcatcgcggtggccgaggagaccgcgttcaaccgcacgctgagttccggatcgcggctgttcgaagaggccgcccagtcgacgaaggccgccggtgccgaccggctctctggccgcgacgcgttcacgctgcacgacacctacggtttcccgatcgaactgaccctcgagatggcggccgaggcggacctcgccgtcgacgaagagggcttccgcagcctgatggccgagcagcggcagcgcgccaaggccgacgccgccgcccgcaaacaggcgcacaccgacctcaccgcctaccgcgaactggtcgacgcccacccgacccagttcaccggattcgacgagctgaccaccgaggcgcgcatcctcgggatcttcgtcgacggccgtcgggtccccgtcgtcgggcacgacaccgccaccgcccagcaccgcatcgaactggtcctcgaccgcagccccttctacgccgaatccggcggccagatcgccgacgaggggaccatcaccggcaccggcgcgtcccagacggccaaggccgcggtgtccgatgtccagaagatcgccaagacgctgtgggtgcaccgcgtcaccgtggagtccggcgaattcgtcgaaggcgacaccgtgacggcggcggtcgatccgcgttggcggcacggcgccacccagggccactccgggacccacatggtgcacgccgcgctgcggcaggtcctcgggcccaacgcggtgcaggccggttcgctcaaccggcccggttatctgcgcttcgacttcaactggcagggtgcgctcaccgacgatcagcgcacgcagatcgaagaggtgaccaacgaggccgtggaggccgacttcgaggtgcacagcttcaccaccgagctcgagaaggccaagtcgatgggcgcgatggcgctgttcggcgaggcctaccccgacgaggtccgggtggtcgagatcggcggaccgttctcgctcgaactgtgcggcgggacgcacgtgcgcagctcggcccagatcgggccggtcaccatcctcggtgaatcctcggtcggatccggcgtccggcgggtcgaggcctacgtcggcctggactcgttccgccacctcgccaaggagcgcgcgctgatggccgggctggcgtcgtcgctgaaggtgccctccgaggaggttcccgcgcgggtggccggtctcgtcgagcgcctcaaggccgcggagaaggagctcgaccggatgcggctcgcgaacgcgcgcgccgcggcggtcaacgctgtcgcgggtgccgagcgggtcggtaaggtccgactcgtggcgcagcggatggccggcggtatgtcggcgggcgatctgcgcacactcgtcggtgacatccgcggcaagctgggcggcgacccggctgtggtcgcgctgatcgccgagggcgacaacgacaccgtgcccttcgtggtggccgtcaacccggccgcccaggatctggggctgcgcgccaacgaactggtcaaacagttcggcgcggcggtgaacggccgtgggggcggcaaagccgatctggcgcagggttccggtaagggggcggcgggcatcgacgcggcattggctgcgttgcgtgccgagatcgacaggagctga

SEQ ID NO: 2238 - DNA, 2649 bp, Rubrobacter xylanophilus DSM 9941
atggagcacatgaagagcgccgagatacgccgcaggttcctggacttcttcgccgagcgggaccacaggatctacccgagctcctccctgatcccgcacgacgaccccaccgtgctcctgaccacggccggggtccagcagttcatcccgtactttctcgggcaggagaagccgccgcatccccgggccgccagcgtccagaagtgcttccggacccaggatctggaggaggtgggcgaccccagccacctcaccttcttcgagatgctcgggaacttctccttcggggactacttcaagaaggaggccatcgggtgggcctgggagttcctcaccgaggggctcggcatcccccccgagcggctctgggtgaccatcttcgagggcgacgagaacgccccggaggacctggaggccaagaggttctggatggaggtgggggtgccggagcacaagatcttcgggctccccaagtccgagaactggtggggccctgcgggcgagaccggcccctgcggcccctgctcggagatctactacgactacggcgaggagttcgggccgggcgatcccctggaggacgcccgctacggccccggaggcgaggagggcgacgcccgcttcctcgaggtgtggaacctggtcttcaaccagtacgagcagctgcgggacgggagcctgcggccgctggagcagaccggcatagacaccgggatggggctcgagcgcatcgcggcggtcatgcagggggcgcgctcggtgtacgagaccgacctctacgccccggtcatcgagcgggcgcgggagtacaccggggtcgcgctcggggacggggaggaaaccgaccgggcgctgcgcatcctcgccgaccacgcccgggggatggccttcctcatcgccgacggggtgcggccgggcaaccagcggcgggagtacgtgctgcggcggatcatccgccgggccacccgcgaggcctacgggcgcttcgggctcgacgccggaaggatagcctccctcgccgagaccgtcgccgactacatgggcggcttctggggcgagctgcgcgaggcgcgggacgagatccggcgggtggtcgagagcgaggccgcccggttcatcgacatctaccactccgggatgcgcctgctggaggcggagatctcccgcctggagggcgggcggttcccgggggaggtggccttcacgctgcacgacacctacggtttcccggtggaggtgacccgggaggtgctcgcggagcgcgggatctcgctggacgaggccggcttccggcgggcgatggagcggcagcgcgagcgggcgcgggaggcgctcgaggggcacgagcgggcggtggccgccttccgcgacagggagatccggagccgcttcgtcggctacgagcgggagcaggcggagaccaggatactcgccatcgagcccgtccccgacgccgagggggagctctacctggtcctcgaggagaacccgttctacgccaccggcggggggcaggtggcggacaccggctggatctcctccgagaaggggcagctggaggtggtcgacgccatccccgccggggactaccaggtcctgcgggcgagggtggagcgcggccgcttcgaggccggggacgaggtggtcgcctccataaaccgcgtgcggcgccagcagatagaggccaaccacaccgcgacccacatcctgcactgggcgctgcgggccgtgctcggcaaggaggtggtgcaggccgggagctacgtcgggcccgaccggctgcgtttcgactaccgctactcggggcgggtgaccgaggaggagctggcccgcgtccaggagctgtgcctgctcaagatcaccgagaaccagcccgtccgctactacaccaccacgctggaggaggcccgcaagctcggggccatcatgctcttcggggagaagtacggggagctggtgcgggtggtggaggtggacggcttctcccgcgagctgtgcggcgggacccacgtgcgcgggacggccgagataggggccttcaagatcacctccaaccggcggcacggcgcggacctctacaggatcgaggtgataaccggccgggaggcgctctactatctcacccgggccgccgagaccgccgagcggctcgccgcggagctgcggctccccggggtcgaggagcttccggaggcggtttcccgcctgcgggaggagctgcagcaggcgcgcgaggagctgcgccagcaggcgctcaagagggggctcgaggaggtcggctcgctggtcgagaacgccgagtccatagacgggacgaaggtggtgaccggccgggttgccgccgcggacgtgagggatctgcgccagatctcggacgacgtccgcaaccgggtgggcgggcccgtggcggtggtgctggcggccgacctggacggcaaggcggtgctggtggcgaacttccacccggaggtctccaagcgcgtgaaggcgggcgacgtggtccgggaggcggccggcatcctcggcggcgggggcgggggcagccccacgatggcgcaggccggcggcgggaacctggaggccatccccgcggccctggagcgggtgcggcagatcctgagccgcgagctctccggccgcgaggcgtga

SEQ ID NO: 2239 - DNA, 2679 bp, Arthrobacter FB24
atgaagtcgcaggagatcaccaagcgctggatcgacttttttgtcagtaagggccacacggcggtgccttccgcatcactggtctccagcgacccctccctgctgttcacggtggccggcatggttccgttcattccgtacctgacggcccgcgaggaggcgccctacaaccgcgccaccagcgtgcagaagtgcatccgcaccggcgacatcgaggaagtcgggaagaccgcccgccacggcacctttttccagatgtgcggcaacttctccttcggcgactacttcaaggaagacgccatcaagttcgcctgggagctcctcaccaccagcgtcgacgacggcggctacggcctgccgcccgagaagctttgggtcaccgtctacgaagaagacgacgaggccgagcagctctggctcaagaacaccggcatgcccgccgagcggatccagcggatgggcaaggcggacaactactggtccaccggccagcccggcccggccggaccctgttccgagatttactacgaccgtggcccttcctacggcgtcgaaggcggccccatcgccgacgagaaccgctacgtcgaaatctggaacctcgtgttcatgcagtaccagatcgacaacgtgcgctcgaaggtggacttcgacatcaccggtgaactgcccaagaagaacatcgacaccggcctgggcatggaacgcctggcaatgatcctgcaggacgtcgaaaacatgtacgagaccgaccaggtccgtcccgtcatcgacaaggccgcggcactgtccggcaaggaatacacctcggccgagtccgccgacgatccccaccacaccgacgatgtccggatgcgcgtagtggcggaccacatccggtccgcactgatgctgatcgccgacggcgtgacgccctccaacgaaggccgcggctacgtactgcgccgcctcatccgccgggccgtgcgctccatgcggctcctgggcgtcgaaaaggcctgcctgcccgatctgctgccggcttcccgtgacgccatgaagggcgtctacccggtggtggagaccgacttcgaccgcatcagccgcatcgcctacgccgaagagaaggcgttcctgcggaccattgcttccggcaccgcacgcctcgaggacgccgtcaaggattccaaggcagccggccagccgctttccggcgccgatgcttttgccctgcatgacacttacggtttcccgatcgacctgacgctggaaatggcggaagaagcgggcctgaaggtcgacgaacccgaattccggaagctgatgcttgagcagcgccagcgcgcccaggcggacgccaagggcaagaagggttcgcacgccgacctcagcgccttccaggagctgctggccgagggggagacggtcttcaccggttacacggagcttgccggcgaatccaaggtccgcggcatcctttccggcggccgcaaggtttcccaggcctccaccggcgaggaaatcgaactggtgctcgccgagaccccgttctacgcggaagccggcggccaggctgccgacaccgggctcattacgggagacggcttcgtcgtcgaagtgctggacgtccagcgccctgtcaagggcctgagcgtgcacaaggcgatcgtccgcgagggcgaaatcggcgcggactcgctcgtgcaggcggcggtggaccgcgagcggaggcactccgcagagcaggcccacaccggcacccacattgtgcatgccgccctgcaccagatcctcggcccggaggcactgcagcgcggttcctacaacaaggccggatacctgcgcttcgacttcgcctggggagagggactcagcgctgccacgcgctctgaaatcgaagaagtctccaaccttgccatccgcaacaacttccaggttgagaccaaagtcatggcattggccgaggccaaggctctcggcgccatggcgctcttcggcgagaactacggcaacgaagtccgggtcgtagagatcgacggcgcatggtcccgcgagctttgcggcggaacccatgtggccaacacctcgctcatcggcagcctgtcactgctgggcgaccagtccgtcggctcgggaaaccgccgcgttgaagccttcgtgggaatggaggctttccggcacctggctgccgagcgggcgctggtcacggagcttacggaaatgctgaaggtgccgtcagggctgctggcggaccgcatcgccaccaccctgaccaagctcaagacggtggaaaaggaactcgagcgcctgcgcaaggagcagctgacggctgccgctgcgcagctggtgggtacggctaaggacgctgccggggtgaaggtcattgcgcacgacgccggacaggtgagcggcgctgacgacctccggggactggcgcttgacctgcgcacacgtcttggctccgaggccgcggcagttgcggttgcgggtgtgagcaacgaccgccccgtgattcttgtcgccaccaacgaggcggcccgtgccgcgggtgtgaaggccggagcactcgtccggctcgcagccgggatcctcggcggcggcggtggcggcaaggacgacgtcgcccagggcggcggcaccgatgccgcgaaggtgccggcggcgctgaccgccgtcgtggacgcaatcacgaggcgataa

SEQ ID NO: 2240 - DNA, 2661 bp, Acidothermus cellulolyticus 11B
atggagtccgcggaaatagcccgtcggtggctggcattcttcgagaaacgcgaccacgtcgtcgtcccgtcgaccccgctggtcgccgacgatcccgaattgctctttgtcgtcgccggcatgcaaccgttcaaaccgtatttccgcggcgacgcacccgccccctggccgcgcgcgaccagcgtgcagaaagtgctgcgcacaccggacattgacgaggtcggcaagacgacccggcacgcgacgttctttcacatgtgcggcaatttctcctttggcgactacttcaaggaaaccgcgattcccctggcctgggaattgctcaccacgccggtcgccgacggcggttacggtttcgcacccgaccgactgtgggtcacggtctacaccgacgatgacgaagccgccgatatttggcaccgggtggtcggtctgccggtcgaccgcatccagcgccgcggcatggcggacaatttctggtcgatgggcgtgccgggtccctgcggtccgtgcagcgaaatctactacgaccgggggccggaattcggcgtcggcggcggccctgtcgccaacgaggaacgctacctcgaggtctggaacctcgttttcatgcaatatgaacgcggcccgggcggcgccaaggacaattacccgattctcggcgaattgccggcgaagaatatcgacaccggaatgggtctggaacggatggcggccattctccagggtgtcgacaacatttatgagatcgacaccacccggccgatcctggacaaggccgctgaactgaccggccagcggtacgggtccgggggccagaacgacgtccggctgcgcatggtcgccgaccatatccgggccatcaccatgctcgtcaacgacggcgtcgtcccgtccaacgaggaacgcgggtacgtgctgcggcggctcatgcgccgggtggtccgcgcgatgcggctgctcggcgcccgggaaccgaccatgcacgagctggtcgccaccgcgattgcggtgttcacgccgcaataccccgaactcagccggaacgccgagcggattttcgcggtcgccgacggcgaggaggcctcgttcttctcgacgctggccgcgggcaccgcacggttcgaggccgcggttcgggaagccggcggcggggtcctctccggggagcaggcgttcgtgctgcacgacacgtacggctttcccatcgatctcaccctggagatggccgccgagcagggcgtgaccgtcgacgaggaggggttccgcgccctcatggccgagcagcggcgacgggccaaggaagatgcggagcggaggaagaccggggccgccgatcgggcggcgtaccgtgcggcggcggagctgctcggccgcccggtggaattcaccggctacaccgaacgcagcggggaagccgtcgtccgcggccttctcgtcgacggggctgcggtgcccgcggcccacgccggccagcgggtcgaggtggtgctggaccgcacgccgttctacgccgaaggcggcggccagctgccggaccacggcgtcctcgagttcgccgccggccggatcgacgtggacgacgtccagcaaccgctgcccgggctcatcgtgcaccgcggccgggtggccgacggtgagatcaccgtgggggagacggtcctcgcccgcatcgacgtcgaccggcgatgggcgatctcccggtcgcacacggcgacccacatggtgcacaaggcgttccgggagttcctcggggacaccgcggcgcaagccgggtcggagaacgcgcccggccggttccggttcgacttcaccaatcccagcgccgtacctccctcggtgctcggggaggtggaggagcgggtcaacgacctcctcctgcacgatctcgaggtcaccgcgcagatcatgcgccagcaggaggccattgccagcggcgcgatcgccatgttcggggagaagtacggcgaccaggtgcgagtgatctcaattggggattggtcgcgggagctctgcggcggcacccacgttccgcacaccggccacctcggcgtcatcaagatcgtcagtgagtcgtcgatcggtgccggagtgcgccggatcgaggcactggtcgggctggacgcctaccggtacctggcccgggaggccgtgttggtctcccagctcgccgaacagctcaaggcacccgcggacgagcttcctgaccggatcgccggcatgctcgcccgactgcgggacgccgagaaggagctggagaaactccggcaggcccggctcctggccgaggcaccgcggcttgccgccgcccgggtggacgtcggcggcctggcggtcgtcgccgcccgggtggacggtgacggggtggacgccgacgggctccggctgctcgccaccgatctccgccagcggcttggcggcagtgcggtcgtcgtcctggccggtgttgcgggcggccggccggtggtcgtcgccgcggtcgggagcgaggcgctcgcccgcggggtcaaggcgggcgagctggtcggcgtcgcggccaagcggttgggcggcggtggcggcggccgcccggacttcgcgcaaggcggcgggacgaatcctgcggcggtggacgacgcggtgtcggccgcgctggacgccgtccgcgcccaggtcgggtga

SEQ ID NO: 2241 - DNA, 2691 bp, Nocardioides JS614
atggacaccgcggagattcgccgacggttcgtggctcacttcgagcacaacaccaccgtcggggcgcacaccccggtgccgtccgcgtcgctgctgctcgacgaccccaacctgttgttcgtcaatgccggcatggtgccgttcaagccgtacttcctcggccaggaggcgccgccgtacccgcgcgccacgagcgtgcagaagtgcgtgcgcacgcccgacatcgaggacgtcggcaagaccacccggcacggcacgttcttcgagatgtgcggcaacttctccttcggcgactacttcaaggagggcgccatcgagctggcctgggacctggtcaccaggcccctcgccgacggcggctggggcctggaggagagcaagctctacccgagcgtctacgaggacgacccggaggcggtggcgctgtggaagaaggtcaccggcctgccggaggagcggatcatccggctcggcaagcgcgagaactactggtcgatgggcgtccccggcccgggtgggccgtgctcggagatcctctacgaccgcggcccggactacggcccggacggtgacttcggacccaagggcgaggaccgctacctcgagatctggaacctcgtcttcatgcaggacgagctgagcgcggtgcggtccaaggaggacttcgacatcgcaggctcgctgccgaagaagaacatcgacaccggcatgggcctggagcgggtcgcgttcctgctgcagggcaaggccaacatgtacgagatcgacgtgatgttcccggtgatccagaaggccgaggagctcaccggccggcgctacggcgccgatcatgacgacgacgtgcggttccgcgtcgtcgccgaccacgtccgcagctcgatgatgctgatcggcgacggcgtcacccccggcaacgaggctcgcggctacgtcctgcgccggctgctgcgccgcgcggtgcgctcgatgcggctgctcggctacgaggacccggcgctgcccgagctgttcccgatcagccgggacaagatgggggagacctacaccgcgctgcaccgcgactgggagcggatctccacggtcgcgtacgccgaggagcacgcgttccgccagaccctgcgctccggcaccacgatcttcgaccaggccaccgccgagctgaagcaggccggtggcagccagctgtcgggcgacaaggcgttcgcactgcacgacacctacggctttccgatcgacctcaccctggagatggcggccgagcaggggctcgcggtcgacgaggtcggcttccggcggctgatgaacgagcagcggcagcgggccaaggacgacgccaaggcgaagaagggccagcatcgcgacgcctcggcgtaccgccaggtcgccgactccctgggccgcccggtcgagttcaccggctacgacgtggtcaccgacgaggcgtccgtgcgcggcctggtcgccgccgggggtgtggtgtcctccgccggcccgggcgacgacgtcgagatcatcctcgaccgcaccccgttctacgccgagggcggcggccagctcgccgaccagggtgtgatcgagctcgacaacggggcccgggtcgaggtccgcgacgtgcagtccccggtcagggggctgatcgtgcaccacgccacggtgctctccggagaggtcagcattggcctcggcgcccatgccctggtcgacgtcgagcggcgacgatcgatctcccggtcccacaccgcgacccacatggtgcacaaggccttccgcgaggcgctcggcgagaccgcgacccaggccgggtcggagaactccccgggccggttccggttcgacttctccgcggtcggggcggtgccggagtcggtgatggccgacgtcgaggcgcgcgtgaacgaggtcgtcctcgacgacctcgcggtgcacgccgaggtgatgagccaggccgacgcggtgaagtccggggcgatggcgctgttcggcgagaagtacggcgaccgggtccgcgtggtctcggtgggcgactgggcgcgcgagctgtgcggcggcacccacgccggcagctccggcaagctgggcgtggtcaagctgctcggcgagtcgtccatcggctcgggtgtgcggcgcgtcgaggccctggtcggcagcgacgcctaccggttcctggcccgcgagcacgtcctggtcgctcagctctccgacacgctcaaggtccggcccgagcagctgcccgagcgggtccacgacctggtcgagaagctccgcgaggcggagaaggagatcgagagggtccgggtcgggcagctgctcgccgcagccggcgagctcgccgcgggcgcggcgaaggtcgggccggtcaacctggtcgcgcaccgggccgacggcgccggtggcggcgacgtccgcacgctggcgctcgacgtccgcggccggctcccgcagggcgagccgggcgtggtcgtggtcatcggagccgtcgacggcaaggtggcggtggtcgcggcgctcaacgacgaggcgcgggcccgcgggctcagcgcgaacgagctggtccgcgccgtcggcccgctcgtcggcggcaagggcggtggcaaggacgacgtcgcgcagggcggcggcaccgacgcctcgcgcatcgacgaggcgatcacgctggtgaccgccgaggtcgggcgggtggccgccggctga

SEQ ID NO: 2242 - DNA, 2694 bp, Mycobacterium KMS; identical to SEQ ID NO: 2237

SEQ ID NO: 2243 - DNA, 2697 bp, Mycobacterium vanbaalenii PYR-1
gtgcagacacacgagatcaggaagcggttccttgatcatttcgtgaaggcgggccacaccgaggtgcccagcgcttcggtgatcctcgacgacccgaacctgttgttcgtcaacgcgggcatggtgcagttcgtcccttacttcctcggccagcgcacgccgccgtgggaccgggccgccagcgtccagaagtgcatccgcaccccggacatcgacgaggtgggcatcaccacacggcacaacacgttcttccagatggccggcaacttcagcttcggcgactacttcaagaagggcgccatcgagttcgcctggacgctgctcaccaacccggtggaagcgggcggatacggtttcgatcccgaacgactctgggccaccgtctatctcgacgacgacgaggccatcggctactggcaggaggtggccggcctgccgctggagcggattcagcgccgcggcatggccgacaactactggtcgatgggcattcccggaccgtgcgggccctcctcggagatctattacgaccgcgggccggagtatgggatcgagggcggccccgaggccaacgaggaccgctacatcgagatctggaatctcgtgttcatgcagaacgagcgcggcgagggcacctcgaaggaggacttcgagatcctggggccgctgccgcgcaagaacatcgacaccggcatgggcgtcgagcgggtggcatgcctgctgcagggcgtcgacaatgtctacgagaccgacctgctgcgcccggcgatcgacctggtggccggcatcgcgccgcgcggctacgggcagggcgtccacgaagacgacgtgcgctaccggatcatcgccgaccacagccggaccgcggcgatcatcatcggcgacggggtcagccccggcaacgagggccgcggctacgtgctgcgccgactgctgcgccgcatcatccgcgccgccaagctgctgggtgtcgacgacccgatcatggccgagctgatggccaccgtccgcgacgcgatgagcccgtcctacccggaactggcagcagatttcgaccgcatccagcgcatcgcggtcgccgaggagaccgcgttcaaccgcacgctggcctccgggtccaagctgttcgacgatgcggcccgtgcgaccaaggcgtcgggcgccgagaagctgtccggccgcgacgcgttcacgctgcacgacacctacggtttcccgatcgagctcaccctcgagatggcggccgaggcggacctgagcgtggacgaggagggcttccgcgccctgatggccgaacagcggcagcgcgccaaggcggatgcggcagcgcgcaagcaggcgcacgccgatctgtcggcctaccgtgaactcgtcgacgccggacccaccgagttcaccggattcgacgaattgagttccgaggcaaggattctcggcatcttcgtggacggcaaaagggtgcccgtggtggcgcataccggccgcgagggtgcccaggagcgcgtggagttgatcctcgaccgcagcccgttctacgccgaatccggcggtcagatcgccgacgagggcacggtcaccggcaccggtgcctccgagacggcgaaggcggcggtcaccgacgtccagaagatcgccaagacactgtgggcgcaccgcatcaacgtggaatccggcgagttcgtcgagggtgacaccgtggtggcggccgtcgatccgcgctggcgtcatggcgccacccagggtcactccggcacccacatggtgcatgccgcgctgcgacaggtgttgggccccaacgctgttcaggcgggttcgctgaaccggccggggtacctgcggttcgacttcaactggcagggcgcgctgaccgatgaccagcgcagccagattgaagaggtcaccaaccaggcggtcgaggccgacttcgaggtgcacagcttcaccaccgagctggacaaggccaaggccatgggcgcgatggcgctgttcggtgagaactaccccgacgaggtccgggtggtcgagatcggcggtccgttctccctggaactgtgcggcggcacccacgtgcgcagctccgcgcagatcggcccggtgacgatcctcggggagtcctcggtcggctcgggcgtgcggcgcgtcgaggcgtacgtcgggctggattcgttccgccacctcgccaaggaacgggcattgatggccggcctggcatcctcgctgaaggtgccgtcggaggaggtgcccgcccgggtcgcgacgctggtggagaagctgcgtgccgcggagaaggaactcgaccgcctgcgtctggccggcgcgcgctcggccgcggtcaacgccgccgccggcgccgagcagatcggcgatgtccggctggtggcgcagcggatggcaggcgggatctccggtgcggacctgcgctcgctggtcggggagatccgcggcaagctcggcagcgatccggcggtggtcgcgctgatcgccgagggcgacaacgactcggtgccgttcgtggtggcggtcaaccccgcggcgcaggatcgcggggtgcgcgccgacgagctggtcaaggtcatgggtgccgcggtcaacggccgcggcgggggtaaggcagatctcgctcagggttccggtaagggggcggcgggtatcgacgcggcgctggcggcgatacgcgcggagatcggccggagctaa

SEQ ID NO: 2244 - DNA, 2694 bp, Mycobacterium JLS
gtgcagacacacgagatcaggaagcgcttcctcgatcacttcgtgaaagcgggccacaccgaggtgccgagcgcctcggtgatcctcgacgaccccaacctgctgttcgtcaacgccggcatggtgcagttcgtccccttcttcctgggccagcggaccccgccctaccaacgggccaccagcatccagaagtgcatccgcacgccggacatcgacgaggtcggcatcaccacgcgccacaacaccttcttccagatggccggcaacttctcgttcggcgactacttcaagaagggcgccatcgagttcgcctggacgctgctgaccaaccccgtcgaccagagcggctacgggttcgaccccgagaagctctgggccaccgtctatctcgacgacgacgaggcgatccagctctggcaggaggtggccgggctgccgctggaacgcatccagcgccgcgggatggccgacaactactggtccatgggcatccccgggccctgcggtccgtcctcggagatctacgtcgaccgcggcccggagtacggcatcgagggtggcccggaagccaacgaggaccgctacatcgagatctggaacctcgtgttcatgcagaacgagcgtggcgagggcaccgggaaatccgacttcgagatcctcggcccgctgccgcggaagaacatcgacaccggtatgggcatcgagcgggtggcctgcctgctgcagggtgtggacaacgtctacgaaaccgacctgctgcggccggtcatcgacgccgtcgccgcacgcgccccccgcggttacggcaggggcagccactccgacgacgtccgctaccgcatcatcgccgaccacagccgcaccgcggccatcctgatcggcgacggggtgagtcccggtaacgacggccgcggctacgtgctgcgccggttgctgcgccgggtgatccgctcggcgaaactgctcggcatcgacgacgccgtcgtcggcgacctgatggccaccgtgcgcgacgcgatgggcccctcgtatcccgaactggtcactgatttcgaccggatccagcgcatcgcggtggccgaggagaccgcgttcaaccgcacgctgagttccggatcgcggctgttcgaagaggccgcccagtcgacgaaggccgccggtgccgaccggctctctggccgcgacgcgttcacgctgcacgacacctacggtttcccgatcgaactgaccctcgagatggcggccgaggcggacctcgccgtcgacgaagagggcttccgcagcctgatggccgagcagcggcagcgcgccaaggccgacgccgccgcccgcaaacaggcgcacaccgacctcaccgcctaccgcgaactggtcgacgcccacccgacccagttcaccggattcgacgagctgaccaccgaggcgcgcatcctcgggatcttcgtcgacggccgtcgggtccccgtcgtcgggcacgacaccgccaccgcccagcaccgcatcgaactggtcctcgaccgcagccccttctacgccgaatccggcggccagatcgccgacgaggggaccatcaccggcaccggcgcgtcccagacggccaaggccgcggtgtccgatgtccagaagatcgccaagacgctgtgggtgcaccgcgtcaccgtggagtccggcgaattcgtcgaaggcgacaccgtgacggcggcggtcgatccgcgttggcggcacggcgccacccagggccactccgggacccacatggtgcacgccgcgctgcggcaggtcctcgggcccaacgcggtgcaggccggttcgctcaaccggcccggttatctgcgcttcgacttcaactggcagggtgcgctcaccgacgatcagcgcacgcagatcgaagaggtgaccaacgaggccgtggaggccgacttcgaggtgcacagcttcaccaccgagctcgagaaggccaagtcgatgggcgcgatggcgctgttcggcgaggcctaccccgacgaggtccgggtggtcgagatcggcggaccgttctcgctcgaactgtgcggcgggacgcacgtgcgcagctcggcccagatcgggccggtcaccatcctcggtgaatcctcggtcggatccggcgtccggcgggtcgaggcctacgtcggcctggactcgttccgccacctcgccaaggagcgcgcgctgatggccgggctggcgtcgtcgctgaaggtgccctccgaggaggttcccgcgcgggtggccggtctcgtcgagcgcctcaaggccgcggagaaggagctcgaccggatgcggctcgcgaacgcgcgcgccgcggcggtcaacgctgtcgcgggtgccgagcgggtcggtaaggtccgactcgtggcgcagcggatggccggcggtatgtcggcgggcgatctgcgcacactcgtcggtgacatccgcggcaagctgggcggcgacccggctgtggtcgcgctgatcgccgagggcgacaacgacaccgtgcccttcgtggtggccgtcaacccggccgcccaggatctggggctgcgcgccaacgaactggtcaaacagttcggcgcggcggtgaacggccgtgggggcggcaaagccgatctggcgcagggttccggtaagggggcggcgggcatcgacgcggcattggctgcgttgcgtgccgagatcgacaggagctga

SEQ ID NO: 2245 - DNA, 2697 bp, Mycobacterium gilvum PYR-GCK
gtgcagacacacgagatcaggaagcggttccttgatcatttcgtgaaggcgggccataccgaggtgcccagcgcttcggtgatcctcgacgatccgaacctgttgttcgtcaacgccggcatggtgcagttcgtcccctacttcctcgggcagcgcaccccgccgtgggatcgggccaccagcgttcagaagtgcatccgcacccccgacatcgacgaggtcgggatcaccacccggcacaacaccttcttccagatggccggcaacttcagcttcggcgactacttcaagaagggcgccatcgagctggcgtggtcgctgctgaccaacccggtctccgaaggcgggtacggcttcgaccccgaaaggctctgggccaccgtttatctggacgacgacgaggccatcgagctgtggcaggaggtcgccgggctgccggccgaacgcatccagcggcgcggaatggccgacaactactggtccatgggcattcccggtccgtgcgggccgtgctcggagatctactacgaccgcggacccgactacggcatcgacggcggacccgaggccaacgaggaccgctacatcgagatctggaatctcgtgttcatgcagaacgagcgcggtgagggcacctcgaaggacgacttcgagatcctcgggccgctgccgcgcaagaacatcgacaccgggatgggcgtcgagcgcatcgcctgcctgctccagggcgtcgacaacgtctacgagaccgacctggtgcgcccggtcatcgacctcgtcgccggaatcgccccgcgcggttacggacagggcaaccacactgacgacgtccgctaccgcatcatcggcgaccacagccgcaccgcggcgatcatcatcggcgacggggtcacccccggcaacgagggccgcggctatgtcctgcggcggctcctgcgccgcatcatccgggcggccaagctgctcggtgtcgagcagccgatcatgggtgagctgatggcgacggtgcgcgacgagatgggtccgtcgtatccggagctggtgacggacttcgagcggatcaaccgcatcgcgattgccgaggagacggcgttcaaccgcaccctcacggctgggtcccggctcttcgaggacgccgcggagaccacccgcaaggccgggtccacggtgctctccggtgacgacgcgttcacgctgcacgacaccttcgggttcccgatcgacctgacgctggagatggccgccgaagcggggctcagcgtcgacgaggaaggcttccgcggcctgatggccgaacagcgccgtcgtgcgaaggccgacgcggcggcccgcaagcaggcgcacaccgacctgtcggcctaccgcgagctcgtcgacgccggccccaccgagttcaccggcttcgatgaattgaccaccgaggcaaggattctcgggatcttcgtcgacggcaggcgcgttccggtggtgtcgcatgtgcagggcggagacgctcccggacgggtcgagctgatcctgaaccgctccccgttctacgccgagtccggcgggcagatcgccgacgagggcaccgtcaccggcaccggggcgtcgcagaccgcgaaggccgccgtcaccgacgtgcagaagatcgcgaaaactctgtgggcgcaccgcatcacggtcgagtccggtgagttcgtcgagggcgacaccatcgtcgcagccgtcgacccacggtggcgccacggtgccacccaggggcattcgggcacccacatggtgcacgcggcgctgcgacaggttttgggccccaacgccgttcaggccggatcgctgaaccggcccggctatctgcggttcgacttcaactggcagggtgcgctgtccgacgatcagcgctcccagatagaagaagtgaccaacgaggccgtcgaggccgactacgaggtgcacaacttcaccaccgaactggagaaggccaagtcgatgggcgcgatggcgctcttcggcgagaactaccccgacgaggtcagggtggtcgagatcggcgggccgttctccatcgagctgtgcggtggcacccacgtgcgaagctcggcccagatcggacccgtcacgatcctcggcgagtcctcggtgggctccggtgtgcggcgggtcgaggcctacgtcggactcgactcgttccgtcacctcgccaaggaacgcgccctgatggcggggctggcgtcgtcgctgaaggtgccctccgacgaggtccccgcccgggtcgagaacctcgtggagcggctgcgggccgccgagaaggaactcgatcggctgcggctggtcaacgcccgagcggcggcggccaacgcggccgcgggcgcggagcagatcggcgggatcaggctcgtcgcgcagcggatggcgggcgggatctcggccggcgatctgaggtctctcgtcggcgacatccgcggcaagctcggcagcgatccggcagtggtcgcgttgatctccgaggcggacgacgacacggtgccgttcgtcgtggcggtcaaccaggcggcgcaggatcgtggcctgcgcgccaacgatctggtgaaggtgctcggggccgcggtcaacggccgcggcgggggtaaggcggacctggcgcaggggtccggcaagggggcggcaggtatcgacgccgcattggcagcgatacgtgcggagatgggccggagttaa

SEQ ID NO: 2246 - DNA, 2679 bp, Salinispora tropica CNB-440
atgaagacggcggagatcaggcggcggtacctcgcgcacttcgaggcgaacggtcacgccgtggtgccgtccgctccgctgcccgccatcagcgacccgaacctgctgtttgtcgccgccggcatgatgcagttcgtcccctacttcctggggcagcagaccgctccctacaagcgggccgtcagcgtgcagaagtgcctccgtacgccggatatcgacgaggtgggcaagaccagccggcacggcacgttcttccagatgaacggcaacttctcgtttggggactacttcaaggacgaggcgatcccgctcgcctgggagctgtccaccaagccggttgacgccgggggactcggactcgacccggatcggatctggccgacggtctacctcgacgacgacgaggcgttccagatctggcgatcggtcggggtgccggcggatcggatcgtgcgtcgcggcaaggctgacaacttctggtcgatgggcattcccgggccgtgcgggccctgctccgagctgttctacgaccgtggccccgagtacggccgggagggcggtccggaggttgacgaggatcggtacctggagttctggaacctcgtcttcatgcagttcgagcggggaccgggcaccggcaaggaggactacccgatcctcggtgacctgccggcgaagaacatcgacaccgggatgggcctggagcggatggcctccatcctccagggcgtggacaacctctacgagatcgacgaggtgcggccgatcctggccaaggccgccgagctgaccggcaaacggtatggcgcgcactccggtcaggtcgccagcgagtcgcacccggatgacgtccggctgcgggtcgtcgccgaccatgtccgcaccgccctgatgttgatcggtgacggggtgatcccgagtaatgaggggcggggctacgtgctgcgccgcatcatgcgccgggcgatccgttcgatccggctgctgggctggcaggaacgggcgatgcccgagctgctgccggtggcccgcgactgcatgtccgcgtcatacccggagctggcgaccgactttggccggatcgccgactacgcgtacgcggaggaggatgcgttcctgtccacgctgcgtgccggcaccacgatcctggacaccgccatcgccgaaacccgtaccgcgggccggcgggcgatctccggtgcgaaggcgtttcagctgcacgacacgtacggcttcccgatcgacctgaccctggagatcgcgagcgagcagggtctacaggtcgacgccgagggtttccgtcggctgatggccgaccagcgggctcgggcgaaggccgacgcgcaggcccgtaagacggggcacgtggacctgtccgcgtaccggacggtgctggacgagggcggcccggtcaccttcaccggctaccaggaggtctcccgcgagtcgacggtgcgggcggtgctcggcgcggccagtccgcacgccgcggcggtggagggcgaaacggtcgagctggtcctcgacaccaccccgttctacgccgagggtggtggccagcagccggacctgggcgtgatcaccgtcggtgggggccaggtggaggtcctcgacgtgcagcagccggtaccggggttgatcgtccaccgggcccgggtgctgcggggtgaggtgcgcgtgggcgagaccggcttcgccgagatcgacactgatcgccgtcgggcgatctcccggtcgcacaccgcgacccacctcgtgcaccagaccatgcgcaacttcctcggtgagtccgccacccaggccggttcgctgaacgcaccggggcggcttcggttcgacttcaacaccccgaccggggtggcaccgagcgtcctgcgggatgtggaacagcaggtcaacgaggcgctcctcgccgacctggaggtgcgtgcgttcgttacctcgctggccgaggcgcggcgtatcggtgcgatggcgctcttcggcgagaagtacggcgagcaggtgcgagtcgtcgaggtcggtgactacgcgcgagagctgtgcggtggtacccacgtgggccgttccggccagctcggcctggtgaagatcctttctgagtcgtcgatcgggtccggggttcgccgggtcgaggcgttggtcgggattgacgcgttcaacttccttgcccgcgagcacctgctcgtcgcccgcctcgccgagctgtaccgggtgccatccgaccaggtcgcggagcgggtggagcagaccgtcacccagctgcgcgacgccgagaaggaactggagaagctccgcgcgcagctggtgctcggcggcgcggccgccctcgctgcccaggcgagcgaggtgcgtggggtggcgtacgtcgggaccgaggcgcccgagggtgcggccggcaacgatgtgcggaccctcgcgcaggagatccggagccggatcgatccggcgcgtcctgcggtggtcgcggtggcggcccgggcgaacggcaaggcttccctggtggtggcggtcaacccagcggcgcgcagtcaggggctgtcagcggcggatctggtcaaggtagccttcgccggccggggtgggggcagccccgagttggcccaggggggcggtctgccggcggcggaggcgccggggttgcttcggaccgtcgagaatgccatcgccggggcgtaa

SEQ ID NO: 2247 - DNA, 2616 bp, Dehalococcoides BAV1
ttgtttagcagtgatgaattacgcgaaaattatctgaaattttttgaggagaaggggcataagcggattgccagttcttccctgataccccacaatgaccccacccttcttttaactaccgccggcatggtgcagttcaagccctattatctgggtgtggccaagcctgaaaatccgcgtatggcctcctgccaaaaatgtttccgcactaccgatattgaatccgtgggcgacgccagccacctgaccatgtttgaaatgctgggcaacttcagcatcggcaactactttaaaaaagaagctattgcctgggcttgggagtatgtaacccaaaggctaaatatacctgccgaaaggctctggataacagtctatctggatgatgacgaggctattgccctctggaaggaacagggagtacccgaaaaccggatagtccggctgggtgcggctgacaacttctggggaccggccggggattcaggtccctgcggcccttgcagtgaaatccactatgatttcgggcaggaaacgggctgcggcaaggcggattgcaacccctcctgcaagtgcggccgtttctgtgaaatatggaatctggtatttgtccagtttaatcaggacaagagcggcaagcgtcaaaatctgcctgcccccagcattgataccggcatggggctggaacgcctgactatactgatgcagtccaagaaaaacgtatacgaaaccgatatatttgccccaattgtggaaaaagcctgcctgctttcgggcaggaaatacgggtgtgatgccgcaactgacagagccctgcggatagtatccgaacacagccggggcattacctttctgattgctgacggggttattccggacaaggcggggcggggctatgtgcttcgccgtctgcttcggcgggcagtccttttcgggcgcaggctgggattggaaaggcccttcttggtggatatggccggggcggttattaaccgtatgagcggcatttatcctgaacttaaaaaacggcaaacctatgtactggagatgatagccagtgaggaagcccgtttttcggaaacgctggctaccggtctggagcttctggaagagatagtccgccagaccaaaggagggcggatttccgggcaggatgcctttaaactgtacgatacttacggctttccggtggagatgactaccgaaatagccgccgaaaagggcttgagtgtagaccttgatggatttgaatccgaaatggaaatccagcgtaccaaagcccgttccagccgtaagttcagctttgatgcggcggctaccgctgaggcagtcaagaatatgcgccatgccgaaaaaacctgttttgtgggatacgaacttgccattcagaaatcaactattaaagatattctgaccgagggcggcacagttgacagtatagaagagggtgacgaggccagcatagtgctggatgaaagccctttttatgccgaaatgggcggacaggtgggcgataccggtgagattataaccgatgcagggcgttttgaggttaaaaataccctccacctgcccaacggggtttttctgcatcaggggcgagtgataaatggctgcctgaagatatctgaagcggctactgcccatataaatgaagaacgccggcgggatattgcccgcaaccataccgctacccatatactccagacggctctcagggaagtgctgggtgagcaggttcagcagaggggttcggtggtaacgcctgaccgcctccgatttgacttttcccatctgaaacccatgagtaaagatgaaatgcggcgggtagaggaatttgtgaatgacaaaatccgccgcaatctgccggtttatgccgaagaaatgccctaccgccacgctctggaggagggtgtaactgccctttttggggaaaaatacggtgacagggtacgggtgctcagggtggggcgtccagcggtttcagctgaactttgcggcggtacccatgtgaccgccagcggtgaaatagccttgttcaagataatgagtgaaagcagtgtgggggcaggtctccggcgtattgaagctgtgaccgggcgggaggctgaggctttcattaatctccagcaggacagtttgtccgaactttcgggcatgctggaatctactgcggaagaatcaccacgcaaactggctgaactgaaagaagaaatagacacgcttaagaaagcagtccaaaatctggaacgccagatgtctcggggtgaggcggaagagctgctttccaaagctgaagattacaaaggggtcaaactgctggtcagccgtatgacctcggtcaatgctgataccctgcgtgagacggctgattttctgcgggataagctgggcagcggggtaatagtgctgggtacggttaccgaagataagccgttcttcctgtgcatggtaacccctgatctgattgccaaaggatatcatgcgggcaatatagtcaaaaaactttcccagatagccggcggcggcggtggcggcaagccgaatatggctcagggcggcgggcgtgacaagtccaaactggacgaagctcttcaggctgtaaagggaatgatataa

SEQ ID NO: 2248 - DNA, 2715 bp, Mycobacterium tuberculosis F11
gtgcagacacacgagatcaggaagcggttcctcgatcatttcgtgaaggcgggccacaccgaggtgcccagcgcctcggtgatcctcgacgaccccaacctgttgttcgtcaacgccgggatggtccagttcgtgcctttcttcttgggacagcgcacgccgccgtacccgacggccaccagcatccagaagtgcatccgtacccccgatatcgacgaggtgggcataaccacccggcacaacacgttttttcagatggccggcaatttcagcttcggcgactatttcaaacgcggggccattgaactggcctgggcactgctgaccaacagcctcgccgccggcggctacggcctggacccggaaagaatctggacgacagtctatttcgacgacgacgaagctgtccggctatggcaggaggttgccgggctgccggcggagcgaatccagcgccgcggcatggccgacaactactggtcgatgggcattcccggaccgtgcgggccgtcatcggagatctattacgaccgcggacccgaattcggtcccgcaggcggtcccatcgtcagcgaagaccgctacctcgaggtctggaacctggtgttcatgcagaacgagcgcggagagggaaccaccaaggaggactaccagatcctcgggccgctgccccgcaagaacatcgacaccggcatgggcgtcgagcggatcgcgctggtgctgcaagacgtgcacaacgtctacgagaccgacctgctcaggccggtcatcgataccgtggccagggtcgccgcgcgtgcctacgacgtcggcaaccacgaagacgacgtgcggtaccgcatcatcgcagaccacagccgcaccgccgcgatcctgatcggtgacggcgtcagccccggcaacgacggtcgcggttatgtgctgcgccggctgctgcgtcgggtgatccgctccgccaagctgctgggcatcgacgctgcgatcgttggcgacctgatggccacggtgcgcaacgcgatgggcccgtcatatcccgaactcgtcgccgacttcgagcggatcagccggatcgcggtcgccgaggagacggcgttcaaccgcacgctggcgtcgggttccaggctgttcgaggaggtggctagctccaccaagaaatccggagccaccgtgctgtccggatcggacgctttcacgttgcatgacacctacgggttcccgatcgagctcacgctggagatggcggccgaaaccggtctgcaggtagacgaaatcgggttccgtgagctgatggccgagcagcgccgccgtgccaaggccgacgccgccgcgcgcaaacacgcgcatgctgacctgagcgcctaccgcgagctggttgacgccggcgccaccgagttcaccggattcgacgagttgcgttcccaggcgcggattctgggcatcttcgtcgacggtaagcgggttccggtggtggcgcacggtgtagccggcggagccggggaagggcagcgtgtcgaacttgtcttagatcgcaccccgctctacgccgaatcgggtgggcagatcgccgatgagggcaccatcagcggaaccggttccagcgaagctgcccgggccgcggttaccgacgtgcagaagatcgccaaaacgctttgggtgcaccgagtcaacgtggaatccggggaattcgtcgagggtgacaccgtaatcgcggcggtggatcccgggtggcgccggggtgccacgcagggccactcgggcacccacatggtgcatgccgcgctgcgacaagtgctggggcccaacgcggttcaggcgggatcgctgaaccggccgggatatttgcgcttcgactttaactggcagggtccgttgaccgacgaccagcgcacccaggtcgaagaggtcaccaacgaggccgtgcaagcggacttcgaggtgcgcacgttcaccgaacagctcgacaaggccaaggcgatgggtgccatcgcgctgttcggcgagagctaccccgacgaagtgcgggtggtggagatgggtggaccgttctcgctggagctatgtggcggcacccatgtgagcaacacggcgcagatcggtcccgtgacgatcctgggcgagtcgtcgatcggctccggggtgcgccgggtggaggcctacgtggggttggattcgtttcgtcacctggccaaggagcgtgcgttgatggccgggttggcctcgtcactgaaggtgccgtccgaagaggtaccggcccgggtggccaatctagtggagcgcctgcgggccgccgagaaggaactcgaacgtgtccggatggccagcgcccgggcagccgccaccaatgccgccgccggggctcagcggatcggtaacgtccgtttggtggcgcagcgaatgtccggcgggatgaccgcggcagacctgcggtcgttgatcggcgacatccgcggcaagctgggtagcgagccggcggtggtggcgctgattgccgagggcgaaagccaaactgtgccgtatgcggtcgcggccaatcccgctgcccaggacctcggaatccgtgccaacgacctggtcaaacaacttgcggtggcggtcgaaggccgcggtggcggtaaggcggacctggcgcagggctcgggaaagaatccgaccggtatcgacgccgcgctcgacgcggtccgctccgagatcgccgtgatagcgcgggtcggttga

SEQ ID NO: 2249 - DNA, 2679 bp, Frankia EAN1pec
gtgccttatcccgacgaccctggacgacgtgaaccgatggacacggccgagatccgccgccgctttctgaaccatttctccgagcggggtcacaccgtggtcccgagtgcgtccctggtggcgcaggacccgaccctgctgctggtgaacgccggcatggttcccttcaagccctacttcctcggggacctgaaggcgccgtggaaccgtgcgaccagcgtgcagaaatgcgtgcggaccgtggacatcgacaacgtcggccgcaccgcccgacacgcctccttcttccagatgtgcgggaacttctccttcggtgactacttcaaggccgaggcgatcccgttcgccttcgagctgatcgtcgacggctacggcttcaaccccgacgacctgtgggccaccgtctacctggacgacgacgaggccgaggcgatttggcgcaccctgctgcccgccgagcgcatccagcggcgcggcaagaaggacaacttctggtcgatgggtgtgcccggcccgtgcggcccgtgcagcgagatctacttcgaccgcggcccggcgtacgggcgcgagggcggcccggaggcggacgaggaccgctacctggagatctggaacctcgtcttcatgcagttcgcgcggggcgagggcagcgagtacggctacgagatcgtcggtgatctgcccgcccgcaacatcgacaccgggatgggcctggagcggatggccaccatcctgcagggtgtcgagaacctgtacgagatcgacatctcccgtccggtgctcgacgcggccggccggctcaccggcacccgctacggcgccgacccggattccgacgtccggctgcgggtcgtcgccgaccacacccggaccgcggcgatgctgatctcggacggggtctcgccgtccaacgagggccgcgggtacgtcctgcggcggatgctgcgccgggcggtgcgtgacgcccggctgctgggcgcccgtgagccggtcatggacgagctgttcggcgtggtccgcgcggcgatgggcccgatctacccggagctcgtcgaccaggccgaggcgatcacggcggtcgcggtcgccgaggagacggctttcctggagacgctgcgcacgggcaccaccctcttcgacaccgcggtcacccaggcccggtccagcgggtcgtcccagctcagcggcgagtcggcgttccggctgcacgacacctacgggttcccgatcgacctgaccatggacatggcggccgacgcgggcctgaccgtggacgaggccggcttccgccggctgatggagcgccagcgccaggcggcgaaggccgaccgggcgtcccgccgcatcggcaacctggacctctccgccttccggccgatcctcgccgcctccggcccgacgacgttcaccggctacaccgagctcgggcgcgagtcgggcatcgtcggcatcgtcggcatcggcgacggcgacagcctgaccgcggccggcgagggggaggaggtcggcatcctgctcgacgcgacccccttctacgccgagagcggtggccaggaggccgacctgggccggatccggttcgacggcggcgaggccgaggtgctcgacgtccagcgcccggtgcccgacctggtcatgcaccgggtgaaggtgctcggtggcgagctgcgtgtcggcgcggacgtgttcgccgaggtggacgtcgagcgccggcgcgcggtgtcgcgctcgcacaccgccacccacctcgtgcacaccgcgttccgccgggcgctcggggagtcggcgacgcaggccgggtcgctgaactcgccgggccggctgcgcttcgacttccacgcgctcggcgcggtgcccgactccgtcctcgccgacgtcgaggacgaggtcaacgagatcgccctgcgtgatctggaggtccgctggtacgtcacctctcaggaggaggcgcgccggctgggcgcgatggcgctgttcggcgagaagtacggcgaccgggtccgtgtcgtggacgtcggggactacgcccgcgagctgtgcggtggtacccatgtggccagctcggcccagcttggcgcgatcaagctgctgtccgagtcgtcgatctcggccgggacgcgccgggtggaggcgctggtcggcatggatgccttccggttcctggcccgcgagcacgtgctcgtctcgcagctctccagcacgctcaaggcccgtccggacgagctcgccgaccgggtcgccgacatcgtcgggcggctgcgagacgcggagaaggagctggagcggctgcgggcacaggcggtgctggccggctcggcggcgctcgccgccggcgccgaggacgtggggggcgtggcgctggtcaccgcgcaggtgcccgcgggcactccggcagacgacgtccgcctgctcgccctggatgtgcgcggccggctcgccggccggccggcggtggtcgcggtcgtcgaggccgccggcgcggcagtcgtcgtggcgaccgacgagaccgcgcggacccgcggcctgcgggccggcgacctggtccggcactcctgggccgcgctcggaggcaagggcggcggcaagcctgacgtcgcccagggcggacgcggtgacgcggacatgatcccgaaggtcttcgcccggctgcgcgagctggtcgccgaccagagcgcgtga

SEQ ID NO: 2250 - DNA, 2679 bp, Salinispora arenicola CNS-205
atgaagacggcggagatcaggcggcggtacctcgcgcacttcgaggcgaacggtcacgccgtggtgccgtccgctccgctgcccgccatcagcgacccgaacctcctgttcgtcgccgccggcatgatgcagttcgtcccctacttcctggggcagcagacggccccctacaagcgggccgtcagcgtgcagaagtgcctccgtacgccggacatcgacgaggtcggcaagaccagccggcacggcacgttcttccagatgaacggcaacttctcgttcggggactacttcaaggacgaggcgatcccgctcgcctgggacctggccaccaagtcggttgacgccgggggtttcgggcttgacccggagcggatctggccgacggtctacctcgacgacgacgaggcgtacgaggtctggcggtcggtcggcgtcccggcggaccggatcgtgcgtcgcggcaaggccgacaacttctggtcgatgggcatccccggcccgtgcggaccctgttccgagctgttctacgatcgcgggcccgagtacggcctggagggcggcccggcggttgacgaggaccgctacctggagttctggaacctcgtcttcatgcagttcgaacggggcccgggcaccggcaaggaggactacccgatcctcggtgacctgccggcgaagaacatcgacaccggcatgggcctggagcgaatggcgtcgatcctccaaggcgtggacaacctctacgagatcgatgaggtacggccgatcctggacagggccgccgagctcaccggtaaacggtacggcgcgcactccggtcacgtcgccagcgagtcgcacccggacgacgtccggctgcgggtcgtcgccgaccacgtccgtaccgccctgatgttgatcggtgacggggtgacgccgagtaacgaggggcggggctacgtgctgcgccgcatcatgcgccgggcgatccgctcgatccggctgctgggctggcaggagcgggcgatgcccgaactgctgccggtggcccgcgactgcatgtccccgtcgtacccggagctggcagcggacttcggccggatcgccgactacgcgtacgcggaggaggacgccttcctgtccacgttgcgggccggtaccacgatcctggacaccgccatcgccgaaagccggacggcgggccgtcgggcgatctccggcgcccaggcgtttcagctgcacgacacgtacggcttcccgatcgacctgaccctggagatcgcgaacgagcagggcatgcaggtcgacgccgagggcttccgccggctgatggctgaccagcgggcccgggcgaaggccgacgcgcaggcgcgcaagacagggcacgtggacctgtccgcgtaccggacggtgctggacgagggtggtccggtcaccttcaccggctaccacgaggtctcccgtgagtcgacggttcgggcggtgctcggcgaggctggcccacgcgcggcggcggtcgagggtgacacggtcgaactggtgctcgacacgaccccgttctatgccgagggtggcggtcagcagccggatctcggcgtgatcacggttggcggcggccaggtcgaggtcctcgacgtgcagcagccggtgccggggctgatcgtccaccgggcccgggtgctgcggggggaggtacgcgcaggcgagaccggcttcgccgagatcgacgccagtcgccgtcgggcaatttcccggtcgcacaccgcaacccacctcgtgcaccagaccatgcgcaattttctcggtgagtccgccacccaggccggttcgctgaacgcaccgggacggctccggttcgacttcaacacgccgaccggagtggcgccgagcgtcctgcgcgacgtcgaacaacaggtcaacgaggcgctcctcgccgacctggaggtgcgtgcgttcgtcacgtcactggccgaggcgcggcgcatcggcgcgatggccctgttcggcgagaagtacggcgagcaggtgcgggtcgtcgaggtcggtgactacgcgcgggagttgtgcggtggcacccacgtcgcccgttccggtcaactcggtctggtgaagatcctttccgagtcgtcgatcggctccggggtccgccgggtcgaggcgttggtcgggatcgacgcgttcaatttcctcgcccgcgagcacctgctcgtcgcccgcctcgccgagctgtaccgggtgccgtcagaccaggtcgccgaccgggtggagcagaccgtcagccagctgcgtgacgcggagaaggagctggagaagctccgcgcgcagctggtgctcggcggcgcggcagcgctcgccgcccaggccacggaggtgcgcggggtggcgtacgtcggtaccgaggcgccggagggtgcaagtggtaacgacgtacgtaccctggcccaggagatccgcggtcggatcgatccggcgcgtcccgcggtggttgcggtggccgcccggtcgaacggcaaggcttcgttggtggtagccgtgaaccaggccgcccgtagtcggggcctgtcggccgcggatctggtcaaggcggccttcgccggccgcggcgggggcagccccgagctggcccaggggggcggactgccggcagcggaggcaccaggtctgcttcgcaccgtcgagaacgcgatcgccggggcgtag

SEQ ID NO: 2251 - DNA, 2682 bp, Bifidobacterium longum DJO10A
atgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctga

SEQ ID NO: 2252 - DNA, 2658 bp, Mycoplasma arthritidis 158L3 1
atgttaagctcaaaacaaattcgacaaatgtgacttgatttttttgcctcgaagaggcatttggtcgttccttcaaaatcgctcatccccgttaacgacccttcacttctatgaattaactccggggttgctactttaaaagattattttagtggtaaaaaaatccctcctgctaagcgtttaacgaactcacaaaaatcaatccgtactaatgacattgaaaacgttggtgtcactgctcgtcaccatactttttttgaaatgttaggtaacttttccattggtgattattttaaaaaagaagcaattaactttggttacgagtttatttttgatgttttaaaattagaaaaagatcgcatttatattacctattttgctgaagacaaagaaacttatgaaacttgaattaagtgtggcattagccctgatcatttaattgccggcacaagagatactaacttttgagatgtcggccaaggtccttgcggccctgatactgaaattttttacgatcgtggtcctaaatatgattctcgtggcattgaacttcttaaagaagatcttgaaaatgaccgttttattgaaatttgaaacattgttttttcccaatacaataatgatggtgaaaataactacagcgaactaatttctaaaaatattgatactggcgctggcctagagagaattgtttctattatgcaagatgcaccaactaattttgacactgacctcttcttgccaattattaaggctattgaaaaactaacttcatataaatacgatattaataactacttcactaaagaagctaaacaagctaaaattaatacttattttaaaattatcgctgatcatatgcgggcttcggtaaatgcaattaatgatggcgttagtccttctaatgtgggaagaggatacattattagaagactaattagaagatcttatcgtgctgggatttcgctaggcattagtgcttcaagttttttatacaaattggttaaggttgttaaagactcactaatctatgaaattgatgaagaaaatgttgctaagataatcaaacaagaagaagagctttttgccaaaactattaaagaaggcgaaaaactactcgaaaatgaaattaaaaaacatggcaccgttactaccgaaattgtgttcaaaatgtttgatacctacggctttcctattgaacttacttctgaaattcttaaagaaaaaaatattgctattaatttagaagaatttaaacaatatttaaaagagcatcaagaaaaatcacggggcagtttagaaagtggcatgaataaagtaattaactcgctagcaacgattccgggttatgttagtgaattcattggttatgactttttaaaaagtgcttcaaagattttgtatttactagatgaccaaaaagcaattgctcatgccaatgatgatgaaattagttacttaattttggataaaacgccattttatgcaacaagtggtggccaaaatcatgatcatggttatttaaaacaaggcaacaacataattgaagttcttgatgtttttaaagacaaatactgaaatcatgtgcataaagttaaaggcagtattgatgcatcacaaccaattgagtgttatgttgatgagcccaaacgattaaattttgctagaaatcactcatcaactcacttaatgtaccacgcgcttagagaaacttatcctaatgaaccaattgaacagctaggatctaacattagttttgatcattttacattcgattttggtctagatcatcgcccaacggtccaagaatgtcgccaaattgagaaaattatgcgctcatacattgcctttagtgctaaaagaaattacattatcactactatcaaaaaagctcaagaaatgggtgcgtgaatgaccattgaagaaagtgaatatcacgatgctaacaaagtaagagtagtagaatttgaaaatattactaaagatgtttgtggtggtacccacgtgccaaattcttcggtgattgaagattttaaaattgtttcagtggactcaaaaggaacagacacatatcgactaagagttgtcacttcatcagctctagttaatgaatatttgaccgatgaaatcaaagaaaaacaaaaattacttagcattttaattaaaaacaatcaagcttttctgccaacatataacattgcctttgaaacgaagattcctgcaaatagcattgaaaaagaagctttactactagcgtatgaaaatattgaagatacaattcgtcaagattataaaaaatttcttaaggctaaacaaaatgaagtagttgatattagtaaatatgaaagcacaaaaattaatggcattgaaacctatatcttttttgaagatgatgttactttaactaaaaaagcttctgttgagttacgtgaaaaataccccgatgctcttgtgctgggactaagcaaactagcagaaaagaattatttctttattgtcgcttcaaaagcttatgatgctcatgcaatttttaaaaaaataactacaaagcttggtggcaaaggtggtggtaatagcatcgttagtcagggctcgcttaattttgatggtgaaaaagcagaaattattagtacaatgggagaagtgattaatgcgtaa

SEQ ID NO: 2253 - DNA, 2721 bp, Ureaplasma urealyticum serovar 10 ATCC 33699
atgttgaaattaagcacgaatgagattagaaaaaagtgaatcgaattttttgagtcaaaagatcatttatttattgaaccaaagtcattaattcccaaaaacgaccctacgctattatgaattaactctggtgtttcaactttaaaagattattttagtggtaaggttaaaccaccacataaacgtttagttaattctcaaaaagctattcgtacaaacgatatttttaatgtgggactaacgagccgtcaccacactttttttgaaatgctagggaatttttcaattggagattattttaaaaaagaagctattgattgagcttatgagtttttaattgatgttttaaaaattgacgtaaaaaaactatgggtaactgtttttgaagatgatcagtttacgtatgatgaatgaattaaattaggaattattaaagaacaaatcattaaatgtaatcgtgatcgtaatttttgagatgtaggtaatggtccttgtggtccatgtacagaaattcattatgatcgaggtgaacattttgatcctaataaagttggttcaaaactaattttagaagatattgaaaatgatcgttatgtagaaatttgaaatattgttttttcacaattcaataatgatggtcataacaattacactgaattattacaaaaaaacattgatacaggagctggtttagaaagaattgcttgtatttcacaagatgtaccaacaaactttgatagtgatgtttttatgcaaattacaaaaagtgttgaacagttttcagaatataaatatgatatgaatgaatactttcatcccaatgttgctcaaaataaaattaatttcgcttataaagtaattgcggatcatatgcgtgcaactgtttttgcgattgcagatggtgcaattccttcaaataaagaacgtggttatattttacgtcgtttgattcgtcgaactatggttttagtgcgtcgtttaaatattaataatcttttatgagttgatgcagttgttaacgccattgcttcaacaatgggtgatttttatacttatttaaaagatgaaaaaacacttgctaaaattaagatgattttaaacaaagaagtacaattgtttgaaaaaactttacaattaggtttaaatatttttgaaagttctatccataatcaagaattagataaagacattacttttaaactagttgatacttatggttttcctatcgaattaattaaggaaatttgtgaacaacgtaatgttaaagttgatttagaagcttttgatgctatgtttaaacatcatcaattagtctcaaaagcaaataaagctaatttgaaagtaatggaatcacaaaacgaatcattaatgcaattagatgtcgattcaacttttcattatgaaatatttaaatgagaaaatgctaagatcattactttatttaatgaggatttcgaattagttgatggtttagatcatgaagatggttatgttgtttttgataacacatgtttttatgcaacatccggcggtcaacaacacgatacaggttatattattaaaaatgaccaacaattttttgttgatgatgtttttaaagcacctaatcgtcaacatgttcatcatgttaaaaatgctagtttatcaatgaatgagtatgttattttacaaattaatgaacaagatcgtaaatcaattacagcaaaccatacagctgaacacttattacattattgcttaaaacaagttttaagtcctgatattaaacaagaaggagctgctaaatatcctcataaagtaacatttgactttacttatcacgcccaaccaacaaaagcacaattagataagttagaaaatgtgttaaatgaaatggtacaaagtaattttgatgtacaagaattacacatggatttagatgaagctaaagctgttggtgctgctgcttattttgaagatgtttataaaaaattaaaaggcaaattacgtgtaattaaaatgggaccttcaattgagttatgtgggggaacacatgcacatcatacatcagaaattgagcgaattaaaattgttgaatgtgcttctaaaggagctggttcttgaagaattactatggtaacaggtcatgataatttagcaaaatacattcacgatttatatgtagaatacttaaatgaaatcaatcacttaaaagctaatttagatattaatgatcataaattaaatgatttatacaatgcttttgcaaattgaaaaaatctatcaattgatgattatgatttattaaatgaaaaatttactgaactaaaacaagcattaattaattttaaaatcgaatttgataaacaaaatgctaaacaagctatcattgatattaagaatacttttaatgcgcaacaaactaataaacgtatacatgtttttaaaaacactgataataaaaatatttttaatgctttaaatgaattaattaatgaaaatcaaaatacattatttattagctttaatttagatgaaaataaaattcaatatttattagcaatcaatgaaaagtttgctactacaaatcaaattaatttaaataaatatattaaagagttaaatactatttctaatggtaaaggcgggggtaaaccatattttgttcaaggtggaacaagtgaacaagaaaaattagatgagttattaactgctatagataaatgagttattaatgcgtaa

SEQ ID NO: 2254 - DNA, 2598 bp, Dictyoglomus turgidum DSM 6724
atgagaagtagtgacataaggaaaaaatttatagattattttgtaagtaaggaccatctacatttgcccagtgcctcattagtgccatccgatgatccaactcttctttttaccactgctggaatggtaccttttaaaccatatttcttaggtcagggcatacctcccaaaaggagaattactactgttcaaaaatgttttcgaaccactgatatagaaagggtaggtataactccaagacatcttacatttttggagatgcttggaaatttttcctttggagactattttaagagggaggcaatcggttttgcatatgaatttttaactaaagaacttggaattcctatatccaaattatggatttcagtttacgaagaagatgatgaggcttatgatatttggaataaagagataggaattcctaaggaaagaattgtaagattaggaaaagaagataatttctggggtcccccaggacccactggaccttgtggtccttgttccgagatttattatgattttggacctaaaagtaaagatgaagaggattgtaagcctggagacccctgtgatagatttatggaaatatggaatttagtatttatggcatattatatggatgaagaaggaaaactttctcctcttcctcagaaaaatattgatacaggtatggggcttgagcgaatcaccacagtggtggaaggggtaagtaatgtttttgaaacggatctatttgttcctattattgaggaaatcaggaagattgtaaaggattcggattctgttacggaaagattaatttctgatcacattagaggaattacgtttttaatgggagacggtgtagtaccgaccaacgaaggcagaggttatgttttaagaagacttataaggaggtcattaaggagggcatataaacatggtatagtgaaacctttcttatacaagttagtccctattgtggttgatataatgaaagatgcttatcctgatttaatagaaaaaaaagattatattcaaaaagtactcataaaggaagaggatcaatttttaaggaccttagagcaaggtctgtccctcttagaagactactttagaaaagctccaagtaaaacggtaggtggggagtttgcttttaaactttatgatacttatggttttcctattgagttaacaaaagagatagcagaggaagaaggattcgtcgtagatgtagacggttttaacaaatatatggaggagcaaagagaaaaagcaagagcctctatggaggcgaagcttgaagaaagttttatttctctttccgatgatgaggtctatcttatgaaatctctccctaaatctgagtttgttggatatgaagttttggaaagtgaaagtaaggtactcttcttcattggaggaaaacatgggaaaaagatttccaatggagaagaagtttactttttaatggataaaacccccttttatcccgaaggaggaggtcaagtctctgatacaggtaaggtttataattcggaagttgaagtaatggttttggaggtcaaaagattaggagaagatttcattattcatagaggaaaggttttaaaaggagagtttgaagaaggccaaatagttagggcagaagttgataaggagaaaagatatcacactatgagacatcataccgcaactcatcttctccatgcagcactaagggaatatttaggtacccatgttatgcagtcgggatccttagtgtctcccgaatttttaagatttgattttacccatcattctcccctaacctatgaagatttaaagataatagaaagaaaagtaaatgaaaatattttagcgaaccataaggtagagaaattctggactaatttagaagaagcaaaaaggatgggagctattgctctgtttacggaaaaataccaaaaaaatgtgagaattattaaaattaataatgtaagtatggaactttgtggtggtactcatgtggattgtactggagaaataggaagtttttacatagtgaaagaagaaggaataggaagtgggataaggagaatttttgctgtctgtgggttaaaggcttgggagtttcaaaagagaagagaagaaattctaaataaaatctctttcgtacttaagtcttctcccgatgagatttatgtgaaactggaaaagttaattgatgaaatgaaagaaaaagaaaagaagataaaagatcttgaagaaagaataattgagaaagagttggaagttttggctaataagattgaaaattggggtgagttttcctttatttgtacttatgtagatatggagaatgaagccataaaaaagcttggcgatcacttaaagagtaaaaatgataatctaattatggttttctttaagccctcagataataagcttttaggaacaattatggtgagcaaaaaagtaaatttgaagggaataactgctaaaaagattgtggaaataattggagaaagatttaatggtaaaggaggaggaaaggataccttagcccagattagtttacctaagactgatatagaggacataaagagagccttaaaagagacacttttgaaatga

SEQ ID NO: 2255 - DNA, 2697 bp, Arthrobacter chlorophenolicus A6
atgaaacagctcatgaaatcgcaggagatcaccaagcgctgggtggacttttttgtcagcaagggccacacggcggttccctccgcatcgctggtgtccagcgacccgtcgctgctgttcactgtggccggcatggtgcctttcattccctacctcacggcccgcgaagaggcgccgtacacccgggccactagcgtccagaagtgcatccgcaccggcgacatcgaggaagtgggcaagaccgcccggcacggcaccttcttccagatgtgcggcaacttttcctttggtgactacttcaaggaagacgccatcaagtacgcctgggagttgctcaccaccagcgttgacgacggcgggtacggcctgccgcccgaactcctgtgggtaacggtctacgaagaagatgacgaagccaaggaactgtggctgaagaacaccggcgttcccgcggagcgcatccagaagatgggcaaggccgacaactactggaacaccggccagcccggcccggccggcccctgctccgagatctactatgaccgtggtcccgcctacggcatcgaaggcggcccgctcgctgacgagacccggtacatcgaaatctggaaccttgtcttcatgcagtaccagatcgacaacgtccgctccaaggacgacttcgacatcgttggtgaactgcccaagaagaacatcgacaccggcctgggcatggagcgcctggcgatgatcctccagggtgtcgagaacatgtacgagaccgaccaggtccgtcccgtcatcgacaaggctgccgaactctccggcaaggagtacacctcggccgaaaccccggatgacccccaccacacggacgatgtccggatgcgtgttgtgggtgaccacatccggtccgccctgatgctgatttccgacggcgtgaccccctcgaacgagggccgcggctacgtcctgcgccgcctcatccgccgcgccgtgcgttccatgcgcctcctcggcgtagagcaggcctgccttccggacctgctgccggcttcgcgcgacgccatgaagggcgtctacccggtcgtcgaaacggacttcgcccggatcagccggattgcgtacgccgaagaaaaagctttcctgcggaccattgcatccggcacggcgaggctcgaggaagcagtcaaggaatcaaaggccgccaacaagcagctgtccggcgaagatgccttcgccctccacgacacctacggtttccccattgacctcacgctcgaaatggccgaggaagccgggctgaaggttgacgaggccgccttccgcagcctgatgcaggaacagcgccagcgtgcccaggccgacgccaagggcaagaagggcggccatgccgacctcagcgccttccaggacatcctggcccagggcgaaacggtcttcaccgggtacaccgagctcgacggcgaatcccgcgtccgcggcctgctcaccggcggccgtccggtccagcaggcagccactggcgatgagatcgaacttgtactctcggaaacgccgttctacgccgaggccggcggccaggcggccgataccggcctcatcaccggcgacggcttcgtggtcgaggtcctggacgtccagcgtcccgtcaagggcctcagcgtgcacaaggcgattgtccgcgaaggcgaaatcggtgctgactcgctggtgcgcgccgccgtcgaccgcgaacggcgccacgccgcagagcaggcgcacacgggcacccacatcgtgcacgccgccctgcaccagatccttggcccggaagccacccagcgcggatccttcaacaaagcgggctacctgcgcttcgacttcgcctggggcgagggcctgagcaccgccacccggtcggaaatcgaagaggtgtcaaacctggccatccgcaacaactacgcggtggaaacaaaggtcatgggcctcgccgaggcaaaggccctgggcgccatggcgctcttcggcgagaactacggcagcgaagtccgcgttgtagagatcgacggcgcgtggtcccgtgagctgtgcggcggaacgcacgtagccaacacctcactgatcggcagcctttccctgctgggcgaacagtccgtagggtccggaaaccgacgcgtggaagccttcgtgggcatggaggccttccggcacctcgcggctgagcgtgcgctggtcactgaactgaccgatctcctgaaggtgccgtccgggcagctggccgaccggatctccgcaacgcttgccaagctcaaggccacggagaaggaactggaccggctccgcaaggaacagctggcagcctcagcagcccagctggtcaacagcgcgaaggacgcggcgggcgttagcctcatcgcccacgacgccggttccgtcagcggcgcagacgacatccgcggcctggcactggacctgcgcaaccggctgggctcggcacccgccgcagtggctgttgcgggcgtggcaaacgaccggccgctggtcctggtggccaccaacgaagctgcccggaacgccggagtgaaggcaggagccctggttcggctggctgccggagtccttggcggcggaggcggcggcaaggacgatgtcgcccagggcggcggcaccgatgcaggcaaggtgggtgccgcgttggcggccatcctggatgccgtcgaacggcgccagtcctga

SEQ ID NO: 2256 - DNA, 2565 bp, Acidimicrobium ferrooxidans DSM 10331
gtggattcgaatgacctgagacgtgcgtttcgggagtacttcgtcgagcgaggacacgttcccgttccctcggcgtcgctcgtgccgcacgatccgacgctgctcttcacggtcgcgggcatggtgccgttcaagccctacttcttgggcgaggaggtcccgccgtatcgtcgggcgaccagcatccaaaagtgcatgcgcgccggtggcaagcacaacgatctcgatcaggtggggaccacggcccgacacctcaccttcttcgagatgctgggcaacttctccttcggcgactacttcaaggagggtgcgattccctacgcgtggggtctcgtcaccgaggtgctcggactcgatccagaccggctctggatcacggtgcacacgagcgacgacgaggcggagcgcatctggatcgaggcctgtggggtccgcccggagcgcatccaacgactcgacgaggacaactggtggcagatgggggagacagggccgtgcggtccgtgctctgagatctactacgacaagggcgagtcctacggcgcgggcggtgggccggcggtcgggtccgacgagcgcttcctcgagatctggaacctcgtgttcatgcagtacgaccgccacccggacggttcgttgacgccgctgccggcaccctgcatcgacaccggtgccgggctcgagcggatcgtgccggtgctccaggggcacgactcggtcttcgagaccgatctcatgtggccgctcatggaggaggcacagtcgctgacgggccgacgctacggcggtcgcttcggtgcggacgccggtggcgacgtcgggctgcggatcatggccgatcacgctcgggcgacgacgttcttgctcgctgacggggtcgtgccgacgaacgaggggcgtgggtacgtgctgcgtcgtatcatccggcgtctcgtggcgcgcgcgcagctgttgggcgcgaagggtccggtcgtcgagccgatggtgcgcatgaccgccgccgtgatgggcgaggcctaccccgaggtggcgcgcgagctcgagacgatcgtgcagcacgcagcgcgcgaggaggagcggttcgcggcgacgctggcgctggggcgcccgctgctcgacgcggccctcgagggcggctcggttcccggcgcgctcgcgttcaagctccacgacacctacggtttgccgatcgagctcacgatggagctggcggccgagcggggggtgagcgtcgatcgtgccggtttcgaggaggccatggccgcacagcgcgagcgggcccgccaggccgggctcggtaccgaggccgtggagcacccggtgagcgccgaggtgctgcgcgagcacggccggagcgagttcacgggctacgaggccaccgaggacgaggggcgcctgctcgcactcgcctccgaaggcgacgtgctcgtcgccgtcctcgatcgaacgcccttctatcccgaaggtggtggccagctcggtgataccggcacgatcgagggggatggctttcgcctcaccatcatcgacaccgaccagcccgtcgcgggggtgatccgccaccacgtcggagcggtcgagggcgagccggtgatcggggcgttggtgcgggccgtcgtcgacgcggagcggcgcgagggtcttcgggtccaccacacggcgacgcacctgctgcactgggcgcttcgcgaggtgctcggtccgcacgtcaagcaacaaggctccctggtcgcaccggatcacctgcgcttcgacttcacgcactggggaccgctcacgcccgacgagatcgaggagatcgagcggcgggtcgcggccgagatcatccgcgactcggtcgtcacggtggagctcatggatcgcgacgaggcgatccgtcgcggtgcggtcgccttcttcggcgatcgctacggcgacgtcgttcgcgtggtgcacgccggtgagtcgtcggtggagctgtgcggtgggacgcacctcgaccgactcggccgcatcggccacctgcgcatcacgtccgagagctcgatcggcgccaacacgcgccgggtcgaagccgtcgtgcagctcgccgccctcgaggtggcacaccgcgatcggcgactcctcgacgagctcgagcggatcgtcccgggcggacgcgatgggatcggcgagcgcgtcgatcgcatcgtcgagcgtgccaagcgcgccgaatccgagctcgcgcgtgagcgcacgcgcaccttggctgagcgcgcccgcgcgctcgccgagacccggggggccgacggactcgtggtggcgcgcgtggacggtcttgaccagcggggggttcgggagctcgcgatgctggttcgtgaccacgagggcgtgctgggcgtcgtgatcgggggcgtcgccaacggcgtggtcgcactcgccgccgcggtgcgcgagggcgctccctggcgtgccgacgagctgctgcgccccgtcgcgcaggcggtcggtgggggcgtcggtcgagccgaggtggtggcggtctccggtgggcgccgtgccgaagcccttgacgcggcgctcgaggcggtgcggacggcttcgtga

SEQ ID NO: 2257 - DNA, 2673 bp, Actinosynnema mirum DSM 43827
gtgcagacacacgagatcatcaagcgcttccgcgagcacttcgagaacgccgggcacgccgtcgtccccagcgcctcgctgctgctggacgacccgaacctgctgttcgtcaacgcgggcatggtgcccttcaagccctacttcctcggtgaggccccgtcgccgcacaagcgcgccaccagcgtgcagaagtgcgtgcgcacgccggacatcgacgaggtcggcaagaccacccgccacctgacgttcttccagatggcgggcaacttctcgttcggcgactacttcaaggaagacgccatccggctcgcctgggacctggtcaccaagtcccaggacgacggcggctacggcttcgaccccgagcgcctgtgggtcaccgtctacctggacgacgacgaggccgccgacctgtggcagaagatcgccggcctgccgccggagcgcatccagcgccgggacgtcgaggacaactactggtccatgggcgtccccggcccgtgcggcccgtgctcggagatctactacgaccgcggccccgagttcggcgccgagggcggcccggtcgtggacgaggaccggtacctggagatctggaacctggtcttcatgcagaacgagcgcggggcgggcggcgccaagcgcgactacccgatcctgggcgagctgccgtccaagaacatcgacaccggcatgggcgtcgagcgggtggcgttcctgctgcagggcgtggacaacgtctacgagaccgacctggtgcgggccgtcatcaccaaggccgaggagctgtccggccgcaagtacggcgacaacccgaccgacgacgtccgcttccgcgtcatcgccgaccacgcccgctccggcgtgctgctcgtcggcgacggcgtcacccccggcaacgaggcccgcggctacgtgctgcgccgcctgctgcgccgcatcgtgcgctcctcgcgcctgctgggcgtgaccgagccggtgctccagacgttcgccgccgtcgtgcgcgacaccatgggcccctcctacccggagctggtcagcgggttcgcccgcatcgagcaggtcctcaaggccgaggaggacacgttcctgcgcacgctggacgcgggctcccggatcttcgagaccgccgccgggaccgtgaagtcgcagggccgcgcgatcctgcccggcgacaaggccttccagctgcacgacacctacggcttcccgatcgacctcaccctggagatggcctccgaggcgggcctgaccgtggacgaggacggcttccgcaagctcatggccgagcagcgcgcccgcgccaaggccgacgcggcgggcaagaagaccggccacggcgaccagacggtgtaccgggagctgctggagctgggcgccaccgagttcaccggctacaccgagctggccagcgaggccgtgctgcgcggcatcgtgtccggcggcaagcgggtgaagtcggcccgcgagggcgacatcgtcgaggtcgtgctcgaccgcacccccctgtacgccgagtccggcggccaggagagcgacgcgggcgtgatcgtctccggcggcgccgagctggaggtcgtcgacgtccagaaggtcgcccgcaagctgtgggtgcaccaggtccgcgtggtctccggcgagatcgccgagggcgagaaggtcgaggcccgcgtcgacgccgagtggcgcgtcggggcccgccaggggcactcgggcacgcacgtcgtgcacgccgccctgcgccaggtgctcggcccgtccgcgctccagtccggctcgtacaacaagcccggctacctgcggctcgacttcgcctggaccggcggcctgtccgagtccacgcgcagcgagatcgaggaggtctcgaacctggcggtccgcaaggacctgccggtgagcgtggtctacaccgacatgggcggcgcccaggagatgggcgcggtcgcgctgttcggcgagacctacgacgagaccgtgcgcgtggtcgagatcggcggccggtggtcgcgcgagctgtgcggtggcacgcacgtcgagcactcctcgcagatcggcccgatcaccgtcatcggcgagtcgtcggtcggctccggggtgcgacggctggaggcctacgtcggcatcgaggcgttcaagtacctggcccgggagcgggcgctggtgcagaacgtggccgccatgctgaaggtgcccgacgccgaggtgcccggccgcgtcgaggcgctggtcgagcggctgcgcgtggccgagaaggagctggagaaggtccgctccgcccagctcgtggcctcggccgggtcgctggtctcgcaggcgctggacgtgcgcggcgtgtccgtgctcgcgctggccctgcccgagggcacctccggcgccgacgtgcgcgcgatcgccagcgaggtgcgcggacggatggccgacaagcccggcgtggtcgcgctgttcgccccggacggcgacaaggtcagcttcgtcgtcgccaccacggcgggcgcccgcgaccttggcctcgccgcgggcaagctggtgcccgccttcgcgcccgccgtcggcggccgtggcggcggcaagcccgacctggcccagggcggtggcaccaacccggcgggcgtgccgcaggccgtggccgccgtgctcgccgaggtggaacgcgcccttgagcagcggtga

SEQ ID NO: 2258 - DNA, 2691 bp, Beutenbergia cavernae DSM 12333
atgcgcaccgccgagatccgacgtcgctacctggactacttcgccgagcgcgaccacacggtcgtgcccagcgcctcgctcatctccgccgacccgtcgatcctgttcacgatcgccggcatggtgccgttcatcccgtacatcgtcgggacggagcaggcaccgtactcgcgtgcggtgagcgtccagaagtgcatccggacgaacgacatcgaagaggtcggccgcactaccaggcacggcacgttcttccagatgaacggcaacttctccttcggggactacttcaaggagggtgccgtcgagttcgcctgggagctgatgacgagctcgcaggacgacggcggattcggcctggaccccgacctgctctgggtcacggtgtgggaggaggacgcggagacggcgcgcgtgctccgggaggtcatcgacttccccgcggagcgggtcgtgccgctgtcgcgtgctgactcgttctgggacaccggccagccgggtcccgccggcccgacggcggagtggcacctggaccggggcgctgaccgcggccccgacggcggaccggccgtcgacacggcgggcgaccgctacgtcgagttctggaacctcgtgttcgacgagttcctccgcggtcccggccccggcaaggactatccgctgctcggcgagctgccgatgaagagcatcgacaccggaatgggtctcgagcgcgtcgcggcgatcctccagggcaaggacaacatctacgagatcgacgaggtgttcggcgtcatcgcccgcgccgaggagctctccggccgccggtacggcgcctcgcgcgaggacgacgtacggatgcgcgtcgtcgccgaccacgtgcgctccgcgatgatgctcgtctcggacggcgtgaagccgtcgaacgagggccgcgggtacgtcctgcgccggctgctgcgccgcagcgtccgggcgatgcgcctcctgggcgtgacggatcccgcgctgcccgagctgctcccggtgtcgaaggacgtcatgaaggcgtcctaccccgagctggaggcggacttcggccggatctccaccatcgtctacgacgaggaggacgcgttccggcgcacgctcacctcgggaacgacgatcctcgacacggccgtgcgccggctcaaggagagcggcggctcccagctgggcggcgagcaggcgttcgcgctgcacgacacgtacggcttcccgatcgacctcacgctcgagatggcggccgagcagggcgtgagcgtcgacgaggaggcgttccggcgcctcatgggggagcaacgcgcccgggcacgggccgacgccctcgccaagcgcagcggccacgccgacacgagcgtgtaccgcgacatcgcgggttccctgcccgcaccggtgagcttcctcggatacaccgacgccgaggcgcgggtggccgtcgtcggcctcctcgtcgacggcgtgcccgccccagcggcgcaggcgcccgccgaggtcgaggtcgtgctcgaccgcacgcccttctacgccgaggcgggcggccagctcgcagaccagggccagatcgtcctcgacgacggcgcggtggtcgaggtcgacgacgtccaggctccgatcaagggcttgtcggtgcaccgcggccggctcgtcgagggcgtgctggggctgggctcgtcgggcgtcgcgtcgatcgacacggcccggcggcgagcgatcgcgcgcgcccacaccgcgacgcacatggtgcacaaggcgatccgcgagcacgtcggtgagagcgccacacaggcgggcagcgagaacgccccgagccggttccggttcgacttccgttcgggttcggcgctgccgagcgcggcgctcgcggagatcaacgcgcgtgtcaacacgctcctcgccgacgatctcgacgtgacggacgaggtcatggctctcgacgacgcgcgggccgcaggtgccatggcgctgttcggggagaagtacggtgaccgtgtgcgcgtcgtgtcgatcggcggggactggtcgaaggagctctgtgccgggacgcacgtggcgagcaccgggcacctcggtctcgtcacgctcctcggcgagtcctcgatcgggtccggcgtgcgccgcgtggacgctctcgtgggcgacggggcgttcggctaccaggccaaggagcacgcgctcgtgggccagctgacgcagctcgtcggggcgcgcggcgaggagctgccggagcgggtgagctccctcatgacccgtctcaaggaggcggagcgcgagatccagtcgttgcggcagggccgtctgctcgccgcggccgcgtcgctcgccgcgtcggcggcactcgtctccggcgcccgcgtcgtgacgcacgacgccggcgaggtcgcctccgtcgacgacgtgcgggcgctcgtcgtcgacctgcgcgaccgactgggcgaggcgcaggccgccgtcgtcgtcgtcggcggagtcgcgaagggccgcgccgtcgtggtcgccgcgacgaacccggccgcgcgcgagtccggcgtccgggcgggcgagctcgtccgcgtcgcggccggcgcgctcggcgggggcggcggcgggcgcgacgacctcgcgcagggtggcgggtcggacccggaccagatcccggcagccctcgagcaggtggtcgcggccgtgggacgcacgttggacgagcggggctga

SEQ ID NO: 2259 - DNA, 2709 bp, Brachybacterium faecium DSM 4810
atgcgcacctccgagatccatcgccgctggctcgccttcttcgcgaagaaggaccacgagatcgtgcccagcgcctccctggtgtcctccgatccctcgatcctcttcacgatcgccgggatggtccccttcatcccgtacatcgtcgggaccgagacggcgccctacccgcgggccgcgagcgtccagaagtgcatccgcaccaacgacatcgagaacgtcggccgcaccacgcgccacggcaccttcttccagatggccgggaacttctccttcggggattacttcaagcagggagcgatcgactactcctgggagttcctcaccacgccccaggaccagggcgggctcggcttcgacccggagcggctgtggttcaccgtgtgggagcaggacgaggagtcctaccggcacgtcaccgaggtgatcggtctggatccgcagcgggtggtgcgcctgccgcgcgaggagatcttctgggacacgggccagcccggcccggcgggcccctgcggcgagtggcacttcgaccgcggccccgagcacggccctgaggccgtgaccggcaccgtgcccgaatggcccggagacgagcaggccgaggatcgctacatcgagatctggaacctcgtcttcgaccagtacctgcgcggtgagggctccggcaaggactacccgctgctcggcgagctcgagcagaagtccatcgatacgggactcggcgtggagcgcgtcgccttcctgctgcagggcaagcagaacatgtacgagatcgaccagatcttcccggtcatcgagaaggcgcaggagctgaccggccgccgctacggcgcggtcgaggaggacgacgtccacctgcggatcatcggcgaccacgtgcgcagcgcgctgatgctggtggccgacggggtgcgcccgggcaacgagggccgcggctacgtgctgcgccgcctgatccgtcgggcggtgcgctccatgcgcctgctcggctacacccagccgtccatgccgcagctgctgccgatctcgcactccctcatggtcgagtcctaccccgagctcgaggccgatttcgcgcggatcagcgagatcgtccacgccgaggaggaggcgttccgccgcaccctcgagaccggcaccacgatcttcgagggcgtggtcggcgcggtgaaggaggagggcggccgggtgcttcccggcgaggacgccttccgcctccacgacacctacggcttcccgatcgacctcaccatggagatggcgagcgaggtgggcctccaggtcgatgccgaggccttccgcagcgcgatgcaggagcagcgcgagcgggcccgggcggacgccgccgcgaagaaggcagggcacaccgacaccgcgctctacagccgcctgctcagccagcgcggcggagaggtgcccttcgtcggctacaccgaggacaccgtcgccaccaccgtcgaatcggtgctggtggacgggcagctggtggacaccgtccacgcacccgcgcaggtcgaggtggtcctcgccacgaccccgttctacgcagaggccggcgggcagctcgccgaccagggacagatctccctcaccggcggcgggctgatcgaggtcgacgacgtgcagaagcccgtgcgcgggctcatcgtccaccgcggccggctcctcgagggggagctcgcccagggcgcctccgcgatcgccaccatcgacgtggcgcgccgcggggcgatcgcccgggcgcacaccgcgacccacatggtccacgagtcgctgcgcgaggagctcggcggcagcgccacccaggccggctccgagaactccccgggccggatgcgcttcgacttccgctacggccaggcggtgccgaagtccgtgctcgagcagatcgaggggcgcgtgaacacgctgctgcaggacgagctgaccgtcaccgatcagcagatgtcgctcgacgaggccaaggccctcggcgcgcaggcgctgttcggcgagaagtacggcgacatcgtgcgcgtggtctcgatcggcggggactggtcacgggagctgtgcggcggcacccacgtcgacagcaccggcgcgatcggcaccgtgcagctcatgggggaggcctcgatcggcagcggcgtgcgccgcgtcgatgcgctggtggggctgtccgcctaccgccaccaggccaaggagcacgcgctggtctcccagctctccgagctgctgaaggtcggcgccgccgaggagctgcccgagcgcgtgcgcgccctgacccagcggatgaaggacatggagaagcagctggcggccctgcgcggccagcagctccaggccgaggccggcaagctcgtggagtccgcgagcgacgtcgccggcgtccgcctcatcgcccatgacgcgggcgaggggatcgccgccggcgacctgcgcaccctcgccctggacctgcgctcccggctgggcgaggacgtgcccgtcacgatcgccgtcgccggccacgacggcggccgggcggcgctcgtcatcgcgaccaacgccacggcgcgggagcgcggcctggcggcgggcacgatgctgcgcggcgccgccgaggcgatgggcgggcgcggcggcggcaagccggacctggcccagggcggcggcggcgagcccgcacgcatccctgcggcgctcaccgcggtgcgcgaggcgatcgcggccgccccgaccgcatga

SEQ ID NO: 2260 - DNA, 2712 bp, Micrococcus luteus NCTC 2665
atgaagtcccaggagatcgcccgccgctggaccgccttcttcgagtccagggggcaccgcgtggtgccgtcggcgtcgctcgtctcgccggatccgtcgctgctgttcacggtggccggcatggtcccgttcatcccgtacttcctgggggagcagaccccgccgagcccgcgcgtcgtctcggtgcagaagtgcatccgcaccgcggacatcgaggaggtcggcaaaaccgtccgccacggcaccttcttccagatgtgcggcaacttctccttcggcgactacttcaaggagacggccatcccgatggcctgggagctgctgacgtcctcggtcgaggacggcggcttcggcctggaccccgagcgcctctgggtcaccgtgtaccgcgaggacgacgaggccgagcgcatctggcgcgaggacgtgggcgtccgtcccgagcgcatccagcgcatgggcaaggacgacaactactggaacaccggccagcccggcccgggcggcccctgctcggagatcttctacgaccgcggccccgcgtacggcgtcgacggcggcccggccgcggacgacacccgctacatcgagatctggaacctcgtgttcatgcagtaccgcctctccgcggtgcgctcgaaggacgacttcgacatcgccggcgagctcgagcacaagaacatcgacaccggtctcggcctcgagcggctcgccatgatcctccagggtgtggagaacatgtacgagacggaccaggtccgccccgtgctcgaccgcgccgcgcagctggccggccgcgcctacacttccaccgaggacccggccgacccgcactacgacgacgacgtccgcctgcgcatggtggccgaccatgtgcgctcggccctgatgctgatcagcgacggcgtgcgtcccggcaacgagggccgcggctacgtgctgcgccgcctcatccgccgcgtcgtccgcgccctgcgcctgatgggcgtcaccgagcccgtgttccccgagctgctgccggtctcccgggacgcgatgaagggcacctacccggtcgtggcggacgagttcgagcgcatctcccggatcgcctacgccgaggagaaggcgttcctgcggaccatcgccgcgggcacggcccgcctcgacgccgcggtgggccaggcccgctcggcgggcggcggcatcgcgggcccggacgcgttcgagctgcacgacacctacggcttcccgatcgagctgacgctggagatcgcggaggaggccggcgtcgccgtggacgaggccgggttccgcgccctcatggccgagcagcgcgaccgcgcccgcgcggacgccaaggccaagaagtccggccacacggacacggccgtgtaccagcgcctgcgcgccgaaggccagacccacttcaccggctacaccgagcacaccaccgagtcggtggtgcgcggcctgctgcagaacggcgaggaggtcccgtccgcgggcgccggcacggagctcgagctcgtcctggacgccacgccgttctacgcggagtccggcggccaggccgcggacaccggcctgatcaccggcgacggcttccgcctcgaggtgctcgacgtgcaggcccccgtgaaggggctttccgtgcacagggtcaaggtcctcgacggcgaggtcgccgccggcgcgcaggccctcggcgcgatcgacctgcagcgccgccttgacggcgagaaggcccactccggcacccacctggtgcacgccgcgctgcaccagatcctcggccccgaggccacccagtccggctccttcaacaaggagggctacctgcgcttcgacttccgctgggccgaggcgctctcggccggggcccgctccgaggtcgaggacgtggtgaacatcgccatccgcgacgaccacaccgtgctcacccaggagatgagcctcgaggaggcgcgcgcactcggcgcgatgagcctgttcggcgagaagtacggcgaccgggtgcgcgtcgtggagatcgacggcgcctggtcccgcgagctgtgcggcggcacccacgtgggccgcaccgcgcagatcggctcgctgaccctgctcggcgagcagtccgtgggctcgggcaaccgccgcgtcgaggccctcgtcggcctggactcgttccgccacctcgccgcggagcgcaccctcgtctccgagctctcggagatgttcaaggccccggccgaggagctcaaggaccgcatcggcgccaccctggaccggctcaaggcggccgagaagcaggtcgcggagctgcgggcccaggcgctgcaggcccaggccggacagctcgccgggcaggcccaggacgtcacgacgtccggtgggacgtcggtgcgggtgctggcccaccacgccggcgacgtggccggggaccagctgcgttccctcgcgctggacctgcgcgcccggatcgagtcggccggcggcaacgcggcgggcacgcccgtgctcgtggccctcacggccgaggccaagggccggcccctcgtggtcgtggcgaccaacgaggccgcccgcgcggccggcctcaaggcgggcgccatggtcaagaccgccaccggcgtgctcggcggcgggggcggaggcaaggacgacgtcgcccagggcggcggccaggacgtcacgcgcgtcggggatgcgctcgacgccgtcgtcgccgcggtgcgcgcggcctga

SEQ ID NO: 2261 - DNA, 2682 bp, Kytococcus sedentarius DSM 20547
atggaaaccgctgagatccgccgccggtggcttgcctacttcgagggcaaggaccacgccgtggtgcccagcgcccccttgatccacgacgacccgaaccttctgttcgtcaacgccgggatggtgcccttcaagccctacctgctggggcagcagaccccgccgtggcagcgtgccaccagcgtgcagaagtgcgtgcgcaccggggacatcgaggaggtcggcaagacctcccgccacggcaccttcttccagatgaatggcaacttctccttcggtgactacttcaaggccggcgccatctccatggcctgggagttcctcaccacgcccgaggccggcgggggcctggggctgcgcaaggacgacctgtgggcgacggtctacaacgacgacgacgaggccttcgacctctggctcgagctcacggacctgcccgccgagcggatcgtgcgccgggacgaggaggacaactactggagcatgggcgtgcccggccccggtggccccagctcggagatcttcctcgaccgcggtgccgagtacggccgtgacggcggaccggcggtggacgaggaccggttcatggagatctggaacctggtcttcatgcagcacgagctctccgcggtgcgttcgaagtccgacttcgacatcgcggggaacctgccccagcagaacatcgacaccggcatggggctcgagcgcatcgcctcggtgctgcagggggtcgacaacctctacgagatcgaccaggtctacccggtgctggaccgcgccgcggagatggctggcgtggagtacggcgcgagctcgggccacatcgcctcggagagccacccgcacgacgtacacctgcgcgtcgtcgccgaccacgtgcgctcgggcctgatgctcatcggcgacggcgtggtgcccggcaacgagggccgcggctacgtgctgcgccgaatgctgcgccgcgcggtgcgctccatgcgcctgctgggcgtcaccgaccccgcgctgccggagctgctgcccatctcccgcgacctgatgggggagtcctaccccgagctggtctcgggctgggaccgcatcagccagatcgcctacgccgaggaggacgccttccgccgcacgctggaggccggcaccaccatcttcgacgtcgccgccggccagaccaaggacgccggccagaaggtcttccccggtgacaaggccttcgccctgcacgacacctacggtttcccgatcgacctgaccctcgagatggccgccgagcaggggctggccgtcgacgaggcgggcttccgcggcctcatgaccgagcagcgggagcgtgcgaaggccgacgcgcgggcgaagaagtccgggcacgcgaacaccgaggtgtggcgcgagctgcggtccctcggcgccacggactggcgggcctacaccgacctggccactgacgggcgcgtcgtcggcctggtgcgtgacggtgagcgggtgggcgggctctcgcagggtgagaccggccaggtggtgctggacaccacgagcttctacgccgagtccggtggccaggtggccgacgccggcatcatcaccctcgacggggcccgcctggaggtcgtcgacgtccagcgccccgtgaagggactggtcgcgcacaccgtgaaggtcgcctccggcgaggtcaccgagggtgccgatgcccgcgccgaggtggaccccacgtggcgcatcgaggccgctcaggcgcactcgggcacccacgtggtgcacgcggcgctgcggcaggtgctgggcccctcggccctgcagtccggttcgtacaacaagcccggttacctgcggctcgacttcgcgtggaacggcgcgctcgatgcggcgacccgcagcgagctggaggaggtcgcgaacctcgcggtgcgcgacgacctgccagtctccgcacactggatgagcctgccggccgcccgtgagtggggcgccctggccctgttcggtgagacctacgacgaggacgtccgcgtcatcgagatcggtggcccctggtcgcgcgagctctgcggtggcacgcacgtgcagcactcctcgcagatcggtgcgcttacgctcaccggtgagtcctcggtgggctccgggtcgcgccggttggaggccttcgtcggcctgaacgccctgcgccacctggccaccgagcgggcgctggtcgccgagctgagcaccatcgccggtgtgcagccgaccgagctgaaggacaaggtctcccagctggtggcccggttgaaggagaccgagcgggagatcaccgccatgaagcgccagcaggcacagggcgccacggccggcctggtcgacgaggccgagcaggtgggtggcatccggctggtcaccaaggagctgcccgaggtggacggtggcgacctgcgcacggtggcgcaggacgtgcggggccggttcggcgacgcagcggccgcagtggcgctggtctccaccgcgggggccaagccggtagttgtggtggccaccacccaggccgcccgtgacgccggggtcaaggccggggcactggtgaaggccgcggccaccgccctcggcggcggtggcggcggcaaggacgacctcgcgcagggcggcgggcaggacaactcccgcgccgccgacgcgctggccgccatccgcgccgcggtcgcgaacgcctga

SEQ ID NO: 2262 - DNA, 2637 bp, Eggerthella lenta DSM 2243
atgaagtacatgaccagcgcggagatccgcgagaagtacctgagctttttcgaggagaagggctgcaagcgctggccctcgtcatcgctcattcccgacgacccgtcgttgttgctgacgagcgccggcatggtgcagttcaagccgtatttcctgcagcagaagcaccttgaagccccctacatcggcacgacgacggtgcagaagtgcgtgcgcacgaacgacatcgacatcatcggcaccacgggccgtcaccagagcttcttcgagatgttgggcaacttcagcttcggcgaatacttcaaggaggagatgtgcgcgtgggcgtacgaattctccaccgaggtgctgggcctgccggccgagcgcctgtacttcaccgtgtatctcgacgacgacgagaccatcgagatctggaagaagctgggcgtgcccgacgaccatatctcgcgcctgggcgaggatgacaacttctggcgtgccgggcctacgggcccctgcggcccctgctcggagatctacttcgatcagggcgaggacttcggctgcggcagccccgactgcgcgcctggttgcgactgcgaccgcttcctggagtactggaacctcgtgttcacccagtacgacggacaggaagacggtacgttcgtgccccttccgaagaagaacatcgacaccggcatgggcctcgagcgcatcgcggccatcctgcagggcgtccagtccaattacgagacggacgtgctgcgcagcctcgtggcggtgggcgagaagctgaccggaacgacgtacggcgaggacgcggccatcgacctatcgctgcgcatcatggccgatcacagccgtgccgtggcattcatgatcgccgacggcatcctgccctccaacgaaggccgcggctatgtgctgcgccgtctgctgcgtcgcgccgtgatgaagggccatctgctgggcctcgacaagccgttcctcaacgattacgtcgacgagatcgtgaacctcatgggtcacgtgtaccctgagatcgtggagaaccgcgagctcacgcggcgcgtcatcctgtccgaggaagagcgcttcggctcaaacctgcgccagggccgcgcgttcctcgacgaggcgctggccgagctcgagggcgaggtgctgccgggcgaccgcgcgttcacgctgcacgatacgtacggcttccccgtggaggtcacgcgagagctgtgcgacgagcgcggcatcgaagttgatatggaaggcttcggccgctgcatggacgagcagcgcgagcgcgctcgcgctgccaatacgaaggacgccgaggcggcctggtccacctatggcggcgtgatgaacgagatcctcgaggccgtgggtcccaccgaattcctcggctatacgaagaacgacgccgaagcgcgcgtgctggcgctcgtgaaagacggcgtgcaggtggatgtgctggaggcgggcgacgagggtcgcgtggtgttggacgctacgcccttctacgctgagaagggcggccagatcggcgacgccggcgtgcttgcgaaggacgatgccatcgtggcggtcctggacacgaaggagcccgagaagggcctgatcgcgcacaccgtgaaggtggagagcggtcgcttgagcgcgggcgatgccgtgcatgccgccatcgacgtgccgcgccgcgagcgtatccgccgcaaccacaccgctacgcacatcctgcattgggcgctgcgcgaggtgctgggcgatcatgtgaagcaagcgggcagctacgtcgccgacagccgtctgcgcttcgacttcacccacttcgaggccatgacggccgaacagatcgccgaggtggagcgcctggcgaaccagaagatcatggagaatcatcccgtgcgcgcctacgagacgtcgctcgcatcggcacgcgaagccggcgtcatggcgctgttcggcgagaagtacggcgagttcgtgcgcgtgctcgacatcgagggcttttcgcaggagctgtgcggcggtacccacgtttcggctacgagcgaaatcggcttcgttaagataacctccgagaccagcgtgggcgcgaacctgcgtcgcatcgaagccgtgaccagcttcgacgcgcttgcgtacatgaatcgcgtggaggctgagctcaaggaggcggccgagtctttgcgcgtgcccctgttcgacgtgagcgagcgcacggcatcgaacatgaagaccttgaaagacctgcagacgaagctgaagcgtgggcgcgaggccgtggccgacgacggcatcaacgccttgctcgagaccgcgcagacgagcgctgcgggctatccggtagtgttcggccgcatgccggaggccgatgcgggtcagatgcgcaatatgtgggatgtgctgcgcgcgcgtctgggccagccgggcgccgcggtgctggccacggagaaagacggcaagcccacgctgttggcggccggcacgccggaggcggtggaggtgggcttcgacgcagacgccgtcatcaaggcgatctcggggaacatcaagggcggcggcggcggaaaggccgccatggcgcaggccggcggcaaagacgcctcgggcatcgacgcggcccttcaggctgcgcgcgacatgctgctgtag

SEQ ID NO: 2263 - DNA, 2670 bp, Catenulispora acidiphila DSM 44928
atggaatccgcggagatccaccgccgctggctcgacttcttccagaagaagggccacacggtcgtcccgtcggcgtcgctcatctcgaacgacccgaccaccctgctcaccatcgcgggcatggccccgttcaagccgtacttcctcggcgagcagcccgcgccctggccgcgcgcgacctcggtccagaagtgcgtgcgcacgctggacatcgaagaggtcggcaagaccacgcggcacggctcgttcttccagatgtgcggcaacttctccttcggcgactacttcaaggagaccgccatcccgatggcgtgggagctgtgcaccacgccggtctccgagggcggcttcggcctggacccggagaagatctgggtcaccgtctacctcgacgacgacgaggcggaggagatctggaagaaggcgggcttcccggccgagcgcatccagcgcctcggcatgaaggagaactactggtcgatgggcgtgcccgggccctgtggcccgtgctcggagctcttctacgaccgcggcccggagttcggcgaggccggcggcccggcggtgaacgacgagcgctacatggagttctggaacctggtcttcatgcagttcgagcgcggcgcgggcggcgacaagggcggcttcccgatcctcggcgagctccccagcaagtccatcgacaccggcctgggcctggagcgcctggcgacgatcctgcagggcgtcaacaacctgtatgagatcgacacctcgcgcgcgatcctggacaaggcggcgtccatcgcgggtgtcacctacggccgggacaccaggaccgacgtctcgctgcgcgtggtcaccgaccacgtgaagaccgcgacgatgatgatcggcgacggcatcacccccggcaacgagggccgcggctacgtgctgcgccgcctgatgcgccgcgcgatccgcaacatgcgcctgctcggcgcgcacggcgcgaccatcaaggacctcgtcgagatcaccataggggcgatgggccaggcctaccccgagctgatcgcggacgcctcgcgcatcgtcgcggtcgcggtcgccgaggagacctccttcctgcagacgctgcgcaccggctcggcgatgttcgagaccgtcgcggacgaggcgaaggcctccggcagcgcggtcttctccggcgaccaggcgttcaagctgcacgacaccttcggcttcccgatcgacctgaccctggagatggcgtccgaggcgggtctgagcgtcgacgaagagggcttccgccgcttgatgaaggagcagcgggaccaggcgaaggcggacgcgcgggcgaagaagaccggccacgcggacatgtcggcgtaccgggagctgctcgacgcggcgggcccgtcggcgttcaccggctaccacgaggtctcctccgagggcctactgaaggcgatgctggtcaacggccaggtcggcagctcggccaagcccggcgacgaggtggagctggtcctggaccgcacccccttctacgcggagggcggcggccagctggccgaccacggtctgatccggctcggcaacggcgcgctggccgaggtcgtggatgtgcaaaagcccgtcggcgacctgatcgcgcaccgggcgatcgtgcgcgacggcgaggttgtgctgggcgccgaggcgtggggcgaggtggacaccgcgcgccgcgcggcgatctcccgcgcgcacaccgcgacgcacatggttcacaaggcgttccgtgagctgctcggcgagaccgcgacccaggcgggttcggagaactcccccggccgcttccgcttcgacttcgcctccccgggcgcggtcccgcactcggtgctggcggacgtcgagcagcgggtcaacgagctgctgatcgacgacctgtcggtcaccgcgcaggtgatgagccagcccgaggccaaggcgatgggcgcgatggcgctgttcggcgagaagtacggcgaccgggtccgcgtggtctcggtcggggagtgggcgcacgagctgtgcggcggcacgcacgtggacaacaccggccgcctcggtctggtgaagctgctgtccgagtcctcgatcggctccggcgtgcgccgcgtcgaggcgctggtgggcaccgacgcgtacaacttcctcgcgcgcgagcacgtcctggtttcgcagctcgcggaggtcgtgaaggcgcgcccggaggaactggtcgagcgggtcggcggcatcatgaccaagctgcgggacgcggagaaggagatctccgcgctcaaggcggggcagctgctgcagatcgcgggctcgctggtggacggcgcgagcgacgtccacggcgtcgcggtggtcacgcaccaggcgcccgacggcgcgtccgcggacgatctgcgcaagctcgtgctggacgtgcgcggccggctcggcacgcgcccggcggtggtcgcggtcgcggccgcggcgggggagcggccggtggtggtcatcgcgaccaacgagggctcgcgcgggcttggtctgaaggcgggcgagctggtgcgctcggcggccaagacgctcggcggcggcggaggcggcaaggacgacgtcgcgcagggcggcggcaccgacgccacggccatcccggcggcgctggagggcgtcggcagggcggtggcggagaaggtggccgcgtag

SEQ ID NO: 2264 - DNA, 2637 bp, Cryptobacterium curtum DSM 15641
atgactaccgcggagattcgcgaacgatatctgcgctattttgaaagcaaaggctgcaagcgtatgccctcgtcgtcgctgattcctgacgatccgagcctgctgctcaccagtgctggcatggtgcagttcaagccgtacttccttcagcagaagcatcttgaggcaccttatattggcactacgaccgcacaaaagtgcgtgcgcaccaacgacattgatcttattggaaccgacggtcgtcacttaagcttttttgaaatgctgggcaattttagtttcggtgcttatttcaaagaagaaatgtgcgcatgggctcttgatttttcccttaacgaactgggtcttcccaaagaaaagctttactttaccgtgtacgaggatgacgacgaaacaatcgagatctggaagaatctcggtattgaggcgtcgcatatctcgaagatgggcgaagaggataacttctggcgtgctggcccgactggtccgtgcggtccgtgttctgaattgtattacgatcaaggaccagaggttgggtgcggtcgtcccgattgcgctcccgggtgtgaatgcgaccgattccttgagtattggaactgcgtatttactcaatatgacgcacaagaagacggcacactgaagccgctgccaaagaagaatattgatacgggcatgggtcttgagcgcatggcagctattctgcagagcgtttcgagcaactttgacaccgatgttctccgtggtcttgttgcagtaggagagcgcctatcagggcgatcctatggtgcgtcggatgcagacgaccgcgccttgcgcgtgatggctgatcattcccgttcgatgacgtttatgattgccgatggcattctgccgtcaaatgaagggcgtggctatgtattgcgtcgactgctgcgtcgcgcggttatgaagggccatctgctgggtattgaaggcgctttccttggttcgtttgtcgatgagatcattcaggttatgggcagcgaatatgctgaactggtcgaaaaccgcgatctcattaagcgtgttgttgcttccgaagaagaacgttttggctcgacgttacgccaagggcgcgcttatttacaagaagcgctcgacggtctttcgggcggtctgctttctggcgaggttgcgtttaccttgcatgatacctatgggttccccttagaagtcacacaggagatatgtgctgaatctggtatcgaggttgacgttgaacagttcaatcacctgatggacgaacagcgttcacgcgcacggcgcgctacccaggacgatgctgaagcagcgtggtctacctacgatggctctatggccgctctgctcgagcaggtgggggctactgtttttaccgggtatgacgaaaacaaatcagcaggtcacgtacgtgcgttactgcgcgatggtgaatcggtttgcaccctttccgctggagaagcgggctgtgtcgtgcttgatcgttcgccgttttatgcggaaatgggtggacaggtggccgacacgggcaccattacatcacccgatggcgcctcgtgcgcgcgtgtgactgacgtgaaagctcccgaatcgggtcttatcgttcattatgttcaggttgaacaaggatcttttaccatcgatgacgaggttattggatctatagacgtggcgcgacgtgagcgcattcggcgcaaccacactgcgactcatattctgcataaagtcctttccgaagtgctgggtaaccacgtgaagcaggctggcagttatgttgctccaaatcgcctgcgcttcgactttactcattttgaagcgattgatcgcgcgacgctcgatgaaatcgaaaacgttgccaatcgcgtaattatggaagcgcatccggtgcatacctacgaaaccacgcttgatgaagcgcgtgaacagggtgtgacggcgctctttggtgaaaaatacggcgaggttgtgcgcgtggtcgatatcgatggattcagtcgcgagttgtgcggcggtacccatgttcggaacacgtctgaaattggatttgtcaagattgtttcagaacagtcgacgggtgcgaacatgcgccgtattgaagcagtaaccagctttgatgcgcttgcttataccgaccgcatgcgcgacgaactgcgacagacagctgccgtgtttggcgtgcccctgtttgatgttaacgaacgcgcagctattgccaccgagcagttaaaaaccttacaggcgcaagccaagcgtgctaagaagattgcggttgctagcgatattcgcacgctggttgataaggctatttcgacttcacgagctggctatccagtgcttatttatcgtttggatggcatggatgcgggctctctgcgcaacacctgggatattgctcgtgctcaccttggggaaacctgtgctgtcgtgttggcaagcgataacgaagggaagccgcttattatggctgccggcaccgatgcagcagttgcagctgggtttgatgctggtgccatcatcaaagaagtagccggtgccatttcgggtggcggcggcggtaaaccatcgatggctcaagcaggcggcaaagatccagcggggctggacgaagcacttgatatagcccgccgaatgttgctttaa

SEQ ID NO: 2265 - DNA, 2667 bp, Saccharomonospora viridis DSM 43017
gtggaaactcacgaaatcaacaagcggttcctggactacttcgaacgacacggccacaccaaggtgcccagtgcgtcgctgatcctggacgatcccacgttgctgttcgtcaacgcgggcatggtccagttcaagccgtacttcctgggcgaggtgccgccgccctatccccgtgccacgagcgtgcagaagtgcgtgcggaccggggacatcgacgaggtcggcaagaccacccgccacaacactttcttccagatggcgggcaacttctcgttcggtgactacttcaagcagggcgccatcgaactggcctgggagttcatcaccacctcgcaggacgaggggggtctgggcctgaacccggaccgcttgtgggccaccgtgtacgaacacgacgccgaagcggccgcactgtggcgtgatgtcgcgggacttccctcggaacgcatccagttccggggcccggacgacaactactgggacatgggtgtgcccggcccgtgtggaccgtgttcggagatctactacgaccggggtccggagtacggtcgcgagggcggtccggtggtggacgaggaccgttacctcgagatctggaacctcgtgttcatgcaggagatgcgtggggagctgagcccgaagcagggccacgcacccatcggcgagctcccgcagaagaacatcgacaccggcatgggtgtcgagcgggtcgcctatttgctgcaaggggtcgagaacgtctacgagaccgacctcgtacgcccggtcatcaccaaggccgaggagttctcgggccgccgctacggcgccgatcacgcggacgacgtacggttccgtgtgatcgccgaccacgcccgctcgggtgtcatgctgatcgccgacggggtcacgcccggcaacgaggcccgcggctatgtcctgcgcaggctgctgcggcgcatcgtgcggtcggtgcggctgctgggcgtgcatgagccggtgttgccggagttcgccgcggtggtgcgggacgcgatggccccctcctacccggagatcgcgcgggacttcgaccgcatcagcgatgtgatgcgcgccgaggaggaggcgttcctcgccacactgaccagcggttcccgcatcttcgacctggccgcccaggagaccaagcgtgccggtggcacgatcctctccggggacaaggcgttccagctgcacgacacctacggcttccccatcgatctgaccttggagatggcggccgagcaggggctgtcggtggacgaagagggtttccgcaccctcatggagcagcagcggcagcgggcgaaggccgacgccgcctcccgcaagaccggccacggcgacttgtcggtctatcgcaagctgctcgaggagcacggcgagaccgaattcctcggctacaccgacctccaggccaccgcgcgtgtcctcgggctgctcgtggacgggaagcccgtccgctcggcgagcgagggcagcgtcgccgagctggtgctcgaccgcaccccgttctacgccgagggcggtgggcagatcgccgacaccggtgtgttgatcggtgagggtgccgagctgaaggtcctcgacgtgcagcggctcgtgccgggactgttcgtgcaccgcgtcgaggtcgtcgcgggtgaggtcggggtggacacccagctcaccgcgtcggtggacggtacgcgccgtgcgtccatcgcccgttcgcactcggccacgcacctcgtccacgcggcggtgcgcggcgcctacggcaaccgtgccgcccaggcgggttccctcaacacccccggtcgcatgcggttcgacttcaccacgccgaagtcggtgtcggacgacgtgctcaccgaggtggaggaggaggtcaacgactacctccagaccgacgtcgaggtgcaggcgtacaccaccaccaaggacagggcccttgaactcggtgcgatcgcgttgttcggcgagaagtacggggacagggtccgtgtggtcgacatgggcgactactcacgcgagttgtgcggtgggacccacgtggagcgcatcggccagctcggtctggtcaagctcgtcagcgactcctcggtcggttccggcgtgcaccgggtggaggcgctcgtgggcaccgacgccctgcgacacgtgcgtaaggagcaacttttggtgtcgcagttggcgagcacactcaaagtgcccgccgatgaggtgccgtcccggatccaggatgtgttgacccggctgcgcaacgcggagaaggagatcgagcagctgcggctgcgcgaggtgttgaactccgcgtcgacgctcgccgaacgggctcgagagatcgccggtgtctccgtcgtcgccgagcgactcgaccaggaggtcgacgccggggcgttgcgcaagctcaccggcgaggtgcgtaatcgactgggatcgcggccgggcgtggtggcgttgttcgcgccctccggtgagggcaaggtgagtttcgtcgtcgccaccaccgccgaggcgcgtgacgccggtctggcggcgggcaagctcgtccccgcgttcgccgaactggtcggtggtcggggtgggggtaagcccgacatggcgcagggcggtggcagcagacccgagggtgtcgagcaggctatcgaggccctccgcgcggcggtcgcggcgaaccggtga

SEQ ID NO: 2266 - DNA, 2688 bp, Jonesia denitrificans DSM 20603
atgcgtaccgctgagattcgccatcgctggctgcagtttttcgaaagtcgcgaccaccacgttgtgccgtcagcgtcgttgatctcacctgacccatctgtccttttcacgatcgcgggtatggttcccttcattccctacatgctgggagaacagaaggcgccgtggccgcgtgcaacgtcggtgcaaaagtgtatccgaaccggtgacatcgatgaggtcggaaagactactcgtcacgggacgttctttcagatgaacgggaacttctccttcggtgactacttcaaacgtgaagcaatcaccttcgcgtgggagttcatcacggggtctgaagaatccgggtgcctgggttttgaccccgaattgatctgggtgactgtctaccacgacgatgacgaggcagcgtcgctgtggcgtgacgttgctgggctacccgaggaacgaatccaacgccgcgggaagaaagataacttctggcacaccggtcaaccgggccctggtgggccgtgctcggagatttacgttgaccgtggtccacagtatggcgccgaaggtggtcctgtcgttgatgaagacaggtatctggaaatctggaacctcgtgtttatgcagtactcgttggagaatgtgacctccaaggagagcttcgacattgtcggtccgctacgccagcacaacattgacaccggtatggggcttgagcgagttgctctcctcaagcagggcgtcaacaacatgtacgaaattgatgaggtgtacccggttattgaggcagcagagaagctgtcagggcgcacctatggtgaaaacaacgatgatgatgtgcggttccgagtggttgcagaccacatccggtcctcactcatgcttattggtgacggcgttcgcccgtcgaacgagggccgtggctacgtgctacgacgcttgttgcgtcgctcgatccgggcgatgcgcctgttgggtgtgacagaacctgcaattcctgctctcatcaccgcgtcgaaagaggcgatgaaagcgtcgtacccctacctggaggagaatttcgccacgatcctcgcgaccgcgtcgaccgaggaggacgtgttccgacggacgctgaaccaggggctcacgatcttggatgctgccgtctcggatgcgaaatcacagggtggttcctctgccgctctcactggtgaacaggcgtttacgctgcatgacacctacgggttccccattgatttgacgttggaagttgccgcggagcaaggcgtcagtgttgacgagacggctttccgttccctgatgcaggaacaacgggaccgggctcgggcggatgctttagcgaagaaacaaggccatggtgacttgggtgtttaccagtccctgcttgcgtcgatggctgctcctgtggagtttttgggttacaccgatgctcaggctcctgcgaaagtgacggcgttgctcgtcgatggtcagcccgtggcgacggtgacagctccagcagacgttgagatcgttctggaccgaactccgttctacgctgaaaagggtggtcagcttgctgatcatgggcgggtgtactccgagcagggggccactgtcgacattgctgatgttcagtcacctgtcagcgggttgtctgtgcatcgtggtgccctggtcgatggcacgttgagtgtcagtgatgcggttgttgctgagatcgatgtggtgcgtcgacgtcagatttcccaggcacatacagctacgcacatgatccataaggcgttgcaggaaaccttgggtgcggactcgactcaggctgggtcagagaactcaccgaaccgaatccggttcgatttccggcagagccaagctgttccgacatctgcactggctgagatcgagggacgcgtcaacgaccagcttcgtgagaacctcgaggtgacagatattgtgacgtcgcttgatgacgcgcgtgccatgggcgcgatggcgttgttcggtgagaagtatggtgaccgggttcgtgttgtgtccattggtggtgactggtctcgcgagttgtgtgcggggacgcatgttccaacctccggtgagttagggattgtcacaatccttggggaagcctcgattggctcaggggtccggcgcgtcgatgctcttgtgggtgcgggtgcttatggtcatcatgctcgtgagcgtgcattggtgtctcagctgtctgggttgctgaatgtgcgttcggaggagcttcctactcgtgttgagtcgctggtgggtaagctgcgtgatgcggagaaggaactcacaactttgcggcaggcacagttgctggcgcgcgctggtgagattgcgagttcagcagcgaccgtgggtgctgttcgtgtcgtgacgtatgacgcgggtgaggttgctactcccgatgcactgcgaaccttggttctcgacgtgcggggccgtttgggtgactctcagggctctgttgtggcggttgctggtgtgtcgaagggccgccctgttgttgtcattgcgactaacgcgtcggctcgcgaggcgggtgtgaaggctggtgctttggtgcgtactgcagctggagtgctaggtggtggcggtggtgggaaagatgacctcgcccagggtggtgggcaaaacccgaccgcgatcaccgaagcccttgctgcggtgtcccgtgatgtagcgtccgttcaaggggcgtag

SEQ ID NO: 2267 - DNA, 2670 bp, Slackia heliotrinireducens DSM 20476
atgcgctatatgacaaccgcggaaattcgcgaaaagtatctgaaattcttcgaggggaaggcctgcaagcgcctgccttcttcctccctcattcccgatgatcccagcctgctgctgaccagcgccggcatggtccaattcaagccctacttcctgcacgtcaaggaattcgatcccgcctacgtgggcgccgctaccgtgcagaagtgcgtgcgcaccaacgacatcgacatcatcggcaccaccggccgtcacctgagcttcttcgagatgctgggcaacttcagcttcggcaagtacttcaagaaggagatgtgcgcctgggcatgggaattctgcctcaacgagctggagcttcccaaggaaaagctgtacttcaccgtgttcgaggacgacgacgagaccattgagatctggaagagcctgggtgtcgaggacagccacatttcccgcctcggcgaggacgacaacttctggcgcgccggccccaccggcccctgcggcccctgctccgaaatctactacgaccagggtcccgaattcggctgcggtgatcccaactgcgcccccggctgcgactgcgaccgcttcctggagttctggaactgcgtgttcacccagtacgacgggcaggaagacggcacgcttgcgccgctgcccaccaagaacatcgatacgggcatgggcctggagcgcatggccgccatcatgcagggtgtccagtccaacttcgacaccgacgtcatccgcggcctcatcgcggtgggcgagcgcctgagcggcaagtcctatgtgggcaaggccaataccgtgggtcacggcagcgagcagggcgatatcgatctgtcgctgcgcatctgcgccgaccacagccgcagcgttgccttcatgatcgccgacggcatcctgccctccaacgaaggccgcggctacgtgctgcgccgtctgctgcgccgcgccgtcatgcacggccgcaagctgggcatcgagggcgcgttcctcaacgagtacgtggcggtcatcgtcgacctcatgggccatgtgtatcctgaaatcgttgagaaccgtgcgctggtggaaagcgtcatcgcctccgaggaaggcgccttcgccaacacgctgcgccagggccaggcctacctggcagaggctctgaagaaccttgaaggcaccacgctttccggcgatgtggccttcaagctgcacgacacctacggcttccccgtggaggtcaccgaggagatttgctccgaaagcggcatttccgtcgaccacgcgcgtttcgaggaatgcatgaacgagcagcgcgagcgcgcccgtgccgccaccaaggacgatgccgaggctgcctggagcacttacggcagcatctacgccgacctgctcaaggagcttggtcccacgaagttcgtgggctacgaaggaaccgattacgaaggcgccaccatcaaggccatcatccgcaacggcgagctcgtcggttcgctgcatcgcggcgaggagggcgagattgtcctcgacaccacgccgttctacgctgagatgggcggcgaggtcggcgacaccggcatgctgcacggtacgttcggcgtgtccgaggtgctggacaccaaggcgcctgagaagggcctggtctgccacagggtccgtgtcatcgagggcgactgccacgcggtggacgagacggtgaacgcttccgtcgacgcccagcgccgcgctctcatcacccgcaaccacacggcaacgcacctgctgcatgccgcgctgcgcgaggttttgggcgaccacgtgaagcagaagggcagctacgtcggtcccgaccgcctgcgtttcgacttcacccacttcgagggcatgacgcccgagcagatcgccgaggtggagcgcgtcgccaacgagaaggtcatgcaggccattcccaccaccatttacgaaacgtccctcaacgccgcccgcgaagccggcgtcacggccctgttcggcgagaagtacggagatacggtccgcgtcgtcgaggccggcgagttctcccgtgagctctgcggcggctgccatgtgtccaacactgccgaaatcggcttcatcaaaatcgtgtccgagggctccagtgccgccaacgtgcgccgcatcgaggctctgaccagcgtcgaggctctgaactacatgaacgccgtcgaggccgagctgaaagaaaccgcagccgagctgcgcgtcccgatgttcgacgtatccgagcgtaccgcttcgaatctggccaccatcaaggattacgagaccaaggccaagaacgccaagaagatggctgccgaaggcaacatcgccgagcatgtcaaggacgtcgtgaacgtgggttatccgctgctcgtcgttcgcatcgacggtctggacaccggcgggttgcgcaacgcttgggatatcatccgtgcccgcatggaaaccccgggtgcctgcatcatcggtaccgtcaacaacgacaagcccatcatcatggcggccggcaccgatgaggccgtggccgccggattcaacgccggtgcggtcattaagaacatcgccggcaacatcaagggcggtggcggcggcaagccgagcatggcccaggccggcggcaaggacgcttccggtctcgatgccgcgctgcaagcagcccgtgacatgctcggggcatag

SEQ ID NO: 2268 - DNA, 2646 bp, Atopobium parvulum DSM 20469
atggctgactataaaacaatgacaacagcagagattcgtgaggacttcctgagcttttttgagagcaaaggttgtaagcgttatccttcttcatctctggtgccttctgacccttcactgctccttgctaacgctggtatgaatcagtttaaggagtattaccagggtatcaagactatgaaggagattggcgctacatcctgccagaagtgtcttcgtactaacgatattgataacattggcgactcccgtcacctttcattctttgaaatgctgggcaacttctcctttggtggttataccaagcgcgatgcatgtacctgggcaatggagtttatttcttctccagagcaccttggtctgccacttgatcgcctgtactttaccgtttttactgatgacgatgaggcaattgagatttggaagtctcttggcataacagaagatcacatcacccgtctgggcgaggaggacaacttctgggcagctggtccaactggtccttgtggtccttgctctgagatttattttgatcaaggccctgagtttgagggagaagcgcctggagatgatggtgaccgctaccttgagttctggaacctcgtcttcactcagtttgaccgtcaggaagatggctctctgcctgagcttcctcatcgcaacatcgataccggcatgggtcttgagcgtattgcagctatcatgcagcatgagggaaccaactacgagggtgacattatgcgtaccctcatctctttgggcgagaaactctctggcaagaagtatcactcaactgacgagattgatcgcagtctgcgtattcttgcagaccactcccgtgcagttacttttatgattggtgacggcattcttcctggtaatgagggcagaagctacattcttcgccgtctgcttcgtcgtgctgtctaccacggtcgtttgttgggtattcagggtacttttatggcggagtacgcgcatgaggttgctgttttgcttggtgcagagtatccagaacttgtcgagaagagcgctcttatcgatggcattttaactgcagaagaggagcgctttggcgctacgcttgacgctggcgagtccaagctcactgctgagcttgagcagcttgaggatggtgcacaactttctggtgaggttgcattcctcctgcacgatacctacggattccccattgatcttactcgtgagattgcagcaaatgcaggtcacgttgttgatatggatgcatttgatgctgcaatgaccgagcagcgcgagcgcgctcgtaagtctgctaaccgcgatgcctggggtaatgctcaaagcatctgggtggcactttctgaccgccttgatgagaccgtttttgacggctacgacaataatgagctttccggtgttcgtgttgttgctcttgttcaggacgggcaggaggttgagtccgccactgttggctccgaggtagaagttgtacttgaccgcacacctttctacgcagagatgggtggtcaggttggtgacactggtaggctcagtggtcctggtctttatgttcacgtcactgataccaagcaccgtgacggcggccttgagtcccacattggtgtagtagaggagggtacgctctctattggtgattctgttaccgcaactattgacgctggtcgtcgtgagcttattcgtcgcaaccacacagcaactcacctccttgatgcagcgcttaagaaggttttgggagaccacgttaaccaagctggttctcttgttgccccagatcgtatgcgttttgactttacgcactttgaggctcttactaaagatgagcttgatcgtattgagggcatggtaaatgcagagatctttgccgctaagcctattgttactaagattatgagcattgaagacgcaaaggcagctggtgctgttgcactctttggcgagaaatacggtgatgtcgtacgtgttgtttctgctggcacagaagacactccattctctcgcgagctttgcggtggtactcatgcacgcaacactgcagaccttggcctcttcaagattatttctgagagctccgttggttctaactcaaggcgtattgaggctgtaacctctatgggcgctattgagtacgttgatgagcgcctggctcagcttgatgaggttgctgcagctctgaaggtccgtccttccgctgttgcagaccgtgttgagcagctgcagcaagatcttcgcgctgctaatcataagcttgaggccgctcttactggagcaggtagcaatcaggtagcagaagcacttaagtctgctgttcagcttaacggttacagctgcgtcatcgctaagcttgaaggtctttctggtaaggagctccgctctgcatgggatggcatacgtgatgcatctgacggtcagcctgttgcttgcgttatcgcatccgcaactgctgacggtaaggtttctctgcttgcaggtgcaactgattctgcagttgcagcgggattctcggcaggagacattgtaaaagagattgcagagtttgttggtggccgcggtggcggcaagccagcgatggcgcaggcaggcggctcaaatgccgctggaattgatgctgcacttgatgctgcaagaacaaagcttggtgcataa

SEQ ID NO: 2269 - DNA, 2676 bp, Nakamurella multipartita DSM 44233
gtgcagacccacgagatccggcgccgtttcctggaccacttcgagcgcgccggccacaccgtcgtgccctcggcgtcgctgatcagccaggacgccaccgtgctgttcaccatcgccgggatggccccgttcaagccttacttcctgggccagagcaccccgccgttcccgcgggcgaccagcgtgcagaagtgcgtgcgcaccggtgacatcgacaacgtcggcgtcaccacccggcacaacaccttcttccagatggccggcaacttctccttcggcgactacttcaaggccggcgccatcgagcacgcctggaccctgctgacctcctcgctggccgacggcggctacggcctggacccggaccggctgtgggtcaccgtgtacgagtccgacgacgaggccgagcggctctggcaggagatcgccggcctgccggccgagcgcatccagcggcgtggcatggccgacaacttctggtcgatgggcgtgcccggcccgtgcggcccgtgctcggagatctactacgaccgcggcccggagtacggcatcgagggcggtccggtcgccgacgaggaccggtacctggaggtctggaatctggtcttcatgcaggacatgcggggcgagtccgacgggtccggtaagggggacttcccgatcctgggcccgctgccccagcagaacatcgacaccgggctgggcgtcgagcggctggcgttcctgctgcagggcgtcgacaacgtctacgagaccgatctgctgcgcccgatcatcgcctcgatggagcagctgtccggcaagaagtacggcggcggcgaccaccaggccgacgtccgcttccgggtcatcgccgaccattcccgcagcggcatgatgctgatcggcgacggggtcacccccggcaacgagggccgcggttacgtgctgcgccggctgctgcgccgggcggtgcgctcggcccggctgctcggcgtcaccgagccggtcatgccgacgctgatgagcatcgtgcgcgacctgatgagcccgtcctacccggagctggccaccgactacgagcggatcgagaaggtcgccgcgacggaggagaaggcgttcctgcgcaccatcgcatccggctccaagctgttcgacgtggccgcggccgacctggccacccagcacgtcaccacgctgcccggggccaccgccttcaccctgcacgacacccagggtttcccgatcgacctgaccctggagatggccgccgaggccggcctgaccgtcgacgtcgccgggttcgagcggctgatgaaggagcagaaggaccgggcccgggccgacgccaaggcccgcaagggcggcttcgccgacctgtccgagtaccggcggctgctggaccagggcgcgaccgagttcaccggctacagcgagctgcagaccgaggcgcgcatccgcggcctgctgcgcgacggggtgccggtgccggcggcgcacgagggtgaggagatcgagctcgtgctcgaccgcaccccgctgtacgccgaatccggcgggcaggactccgacgcgggcaccatcgtcggggcgcacggcgccgccgaggtgctggacgtgcagaaggtggaccgcaagctggtcgtgcaccgggtccggatcaccgacggcgagttcaccaccggtgcgcaggtgctggccaaggtcgacccggaatggcggctcggtgcccggcaggcgcactcgggcacccacgtcgtgcacgccgcgctgcggcaggtgctcgggccggaggcgctgcagtccgggtcctacaacaagcccggctacctgcgcctggacttcgcctgggaccaggcgttgtcggcggccacccgcagcgaactggaagaggtcgccaatcgggccgttcgtcaggacctgccagtgcgcgtgctctacggctcgatgcaggaggcccaggcgatgggcgccatcgcgctgttcggcgagacctacgacgacaccgtgcggatcgtggagatcggcgggccgtggtcggtcgagctgtgcggcggcacgcacgtcgagcactcctcgcagatcggtcccgtcgccatcaccgccgaatcctcggtcggatccggcctgcgccgggtcgaggccgcggtcggcatcgaggccttccaccggctggtcgccgagcgcaccctggtcagccagctggccagcaccctgaaggtgcagccggccgagctgcccgggcgcatcgagaccctgctggacaagctcaagtccgcggagaaggagctggccgggctgcgcgcggccgcgctgggcaacgtcgccggcacgctggctggcggcgcgatcgacgtggccggggtggcgctggtggcggccaccgcgccggagggcaccgcggccggtgacctgcgcacgctggcctccgacgtccgcggccggctcggggaccggcccggggtggtcgccctgttcgcgccggcccacgcgtcggtgccgttcgcggtcgccgtgaaccagggcggcatcgcccgcgggttggctgccggcgagctggcgaaggcggtgctgccgctgatcgagggacggggcggcggcaagaaggacctggcccagggggccgggacccgtccggaccggatcccggaggcgatcgacgccctgcgcgccgccctgctcacggcggccggctga

SEQ ID NO: 2270 - DNA, 765 bp, Brucella suis 1330
atggccctccccctgttcagtgccaaaatgctcctccccgttggaaatccaccatcgcttaaaaccctggcaacggggctcattcttgcctgcggcatagccttgcccgcttcggcaaaggacacgcttcaggttgcccttgcggatcgttcggagtttctgcccctttcccgctcgtccattgaggccaatcggggtaatacgcccgcactcgttcccctgcccgatgcgctgccgcgcgccataccgaaatccgcttccgatggtgcccccgccccacttcatatttcaaaggccattccggaaattcaccgggatttcgacaagctgcccgagcctgtgcgcgcgatgcgcgagcggatgctggaagcggcacggtccggcgacattgaaaggctgcgtcccctcctcggcgttcaggacaaggccacacagcttgcgcttgaagacaacgaagaagatgtcatcgatttcctgaaatcgctttccggcgatgaggacgggcgggaagttctcgccatcatcacggatctgctggataccggctatgtccatctgaatgtgggccagcaaaatgaggtctatgtctggccctatttctacgccatgccgctcgacaagctgacgccgccgcagatcgtggaactgttccagatcgtcaccgctggcgacttcgaggatatgaagaaggcaggcggctatattttctacagtatcggcatcggccctgacggaagctggcgcttcttcaccgccgggcaatag

SEQ ID NO: 2271 - DNA, 735 bp, Mesorhizobium BNC1
atgccgacccctcccccttcctgcagagcttacgcggtggcgctggccctggccgcgcttttctggctgccaggcaaatccctcgcgctgaacgatactttccctgaataccggccagtgcagcaacagcctggaggagcatccgaagggaatcccgaccttctgtccgcgcccacgctttcagaggaatcgggtgaggactccacagtcggcgccgaggaaaggtcgggagatgtagcgcgccccgacaccactcccggcgaggagccaccggaggtgatttacgacctcagccgcctgcccgagccagtgcgccgcatgcggcagctcatcatcgatgcctgcaagagcggtgacattgaaaagctgaggccgcttatcggcagcggcgacagcgccacccaactgctgctgggcaatctcgaaggcgatccgatcgatttcctccgccagatctcaggcgacgaagaaggccaggagatcatggccattctgctggaggtcatggaatccggcttcgtgcatctcaatgccggtgcggagaacgaatactatgtctggccctatttcttcgcctttccgctcgatgagctgtcaccgcagcagaaggtggagcttttcacgctgctgacggcgagcgattatgaagagatgaagaatttcggcgcttacattttttatcgctcggccatcacgccggacgggcgctggctgttcttcgtggctggagactga

SEQ ID NO: 2272 - DNA, 747 bp, Sinorhizobium medicae WSM419
atgaaccggaaccctgcaagccgggccctcccggttggtcttgtcgtgctgctgctggcgagcgcgattgcgaccggcacgcctgcgctggccctcagcgagtttcaaggcgctcctccccccatcggcagcgaacggaacgcagcaccggccgaggaaaccgaagaggcagccccggaagaacggacccctttcgaaattccgatgcccgaccctctcgtcgacagaacggcggtccagctgaaggacgatgagatccccgctccggaggtgctggagcctgtcgaggtgctgacggatgtctcgaagataccggagccggtcgctcgcatgcgcgagttgatcgtcgaggccgcagcttcgggtgacatcgagcggctgcggccgctgctcggcaaggggccgacccagactcaggttaccgggaccgctggggaagaggacccgatcgcggcgctcaaaagtctttcgggcgatcaggacggcatcgaagtcctggcgatcctccttgatctcatgtccacgggcttcgtacttgcggacaagggcacccctgaggaggcctatgtctggccctattttgccgaaaaaccgctctcgtcgttgaccgcgccggaaaaggtcgaccttttccggctcgtgactgccggcgacttcgcgggaatggaggagttcggcagctacaatttctatcgggtcggcatcacgcccgacggccggtggaaattcttcgtcgcaggcgattga

SEQ ID NO: 2273 - DNA, 738 bp, Ochrobactrum anthropi ATCC 49188
atgtcattcccgatcaggaacttcgcctcgccccgagctttattggccgggataatccttgcctgcggcattgccttgcccgcagctgcggcaagctcttttgacctcgcgctggcggaccagtcggacttcctgcaacgccccggcggccgtgcggtgacggatgaaagcgacagctcctcccctattcccctgcctggcgcgcttcctcgcgcaataccaagagtgtcgcccggccatgagcctgccccggcgacatcctccaagcccatgccggaaatccatcgcgatttcgacaagctgcctgagcctgtgaggctgacgcgggagcgtatgctggaagcagcccgttccggtgacatcgagaaattgcgaccgctcctcggcgttgaggacaaggtcacccagctatcattggaagatcacgaggaagatgttatcgatttcctcaaatcgctgtcgggcgacgaagcaggccgtgaagttctggcaatcatcgtcgatctactggatacgggctatgtgcacctgaatgcaggcaaggacgacgaggtgtatgtctggccttatttctacgccatgcccctcgacagactgacaccgccgcagatcgtggagcttttcgaaatcgtcaccgccggtgatttcgaggatatgaagaaagcaggcggctatatcttctacagtatcggcatcgggccggacggtagctggcgctttttcactgcgggcgaatga

SEQ ID NO: 2274 - DNA, 759 bp, Rhizobium leguminosarum bv  trifolii WSM2304
atgcataccggtaaagagaaaatttcgcgaattccgctcgcgccggtgctgcttgcattcagcctcgccgccggcaatattttccttgccccggcagcctacgcgctttccgaactgcacaagatccccggccaggctgccaacgacgcgccggctgcgccgggaagcgctcagggacagagccagccgcagggcgggaccgctcccagcgttcccatggccgatccgctggtcaacagccagaacaatcaaggtgtcgacaagacgccgggcgcccaggatgcttccaagcccgccgaagtaatttacgacatcagcaaggtgcccgagccggttcgcaagatgcgcgagcagatcgtcgaggcggccgcctccggcgatctcgaacgcttgcggccgctgatgggcaccggaaccgagcagactcaggtgactgtcggcgagcccacggaggatccgatcggcacgctgaaggatctttcgggcgatcccgacggagacgagatcctcgccatcatgctcgacatcgtttcgaccggcttcgtgcatgtcggccagggtacggcagacgagatgtatgtctggccctatttcgccgagaaggacctgaaatcgctgacaccgccggagcgcgtcgagctgctgcgcatcgtcaccgccggcgatctttccgatatgcaggaattcggcggctataatttctaccgcctcggcattacgccgcagggcaaatggaaattcttcacggcgggcgactga

SEQ ID NO: 2275 - DNA, 777 bp, Agrobacterium vitis S4
atgcgcaaggcatgccagaccggagcaaaggcgaccggtctcaagaacaatgtaaaaacaatgttggtctgcggctggatggcaagcattgccgttatcgctctgccgggcagcagtttcgctctgtcggaattgcagggcggcgccaaggatgcggcgcagcaggggcagcaaccgcaaaccggccagcagccgggcctgccaaccgacagcacctccgatccgaagagcgcgcccagcgccgaaccacagcaggcaacacccgccgacaaggcgaagggtgcggctgccgaagcggccccgcacacacctgttgaggtgatctacgatatcagcaaagcgcctgaaccggtgcgcaaactgcgcgaaaagctggtggaagccgcagcctccggcgatccggaacggttgcgcgcgcttctggcgggcggcaacgatccgacggcgctggcacttggcaatgacaatggcgacccgatccagacgatcaagagcgtttcaggcgaccccgacgggcttgaagtcttggccatcatgctggacgtgctgtcgaccggcttcgtccatgtcaatgccggcaccccggaggaagcctatgtctggccctatttcgccgaaaagccgctgacaacgctgaccccaccggaaaaggtggaattgctgcggctggtgacagcgggcgattttgaaaacatgctggaagttggcaattacaatttcttccgcatcggcattgcacccgacggcaaatggaaattcttcacggcaggcgattga

SEQ ID NO: 2276 - DNA, 753 bp, Rhizobium leguminosarum bv  trifolii WSM1325
atgcacaccggtaaaaagaaagtttcgcgaatttccctcgcgccggtgctgcttgcgttcagcctcgccgccggcaatgttttccttgcgccggcagcctacgcgctttccgaactgcacaagatccccggccaagcggccaacgagacgccacccgcacagggaagcgctcagggacagagccagccgcagaccactcccggcgttcccatggccgatccgctggtcaacggccagaacaatcagggtgtcgacaagacgccgggcgctcaggacaattccaagcctgccgaggtgatctacgacatcagcaaggtgccagaaccggttcgcaagatgcgcgagcagatcgtcgaggcggccgcctccggcgatctcgagcggctgcggccgctgatgggcactggtgccgaccagacgcaggtgactgtgggcgaaccgaccgacgatccgatcggcacgctgaaggatctgtcgggcgatcctgacggtgacgagatccttgccatcatgctcgacatcgtctcgaccggcttcgtacatgtcggccagggcacagcagacgacatgtatgtctggccctattttgccgagaaggacctgaagacgctgacgccgccggagcgtgttgaactgctgcgcatcgtcactgccggcgatctctccgacatgcaggaattcggcggatataatttctaccgcctcggcattacgcctcagggtaaatggaaattcttcacagcgggcgattga

SEQ ID NO: 2277 - DNA, 1383 bp, Ralstonia eutropha JMP134
atgaccagcgcggtattcctcggctttctcgtcctgtcgctctaccttgccattcgctcgaagaagggccacggcgcacagagcatgcacgacttcttcgttgcatcgcgccagttcggcgccttccttgtgttcttcctcgccgccggcgagatctacagcattggcacgatggtcggctttccgggcggtatctacgccaaggggccgacctatggtgtctggttccttggctacatcctgctcgcgtatccgcttggctattttctcggtccgcgcatctggcgcgcaggcgcaaagttcaatgcgatcacgatggccgatctgttcaagggccactatggcaaccgtacgctcgaactgatcgtggcagggtcatcgatcctgtttctcctgccttggggacaacttcaatttacgggcctggtagcggcgctcaagggcctcggctgggagttctcgccggtctatctcgtgatgatctcggccgcgctcgcgttcacatacatcgccatctccggcgtgcgcgcgtcggcctatatcgccatcctcaaggacatcctgatggtggtggccattgttgccaccggcgtggccgtgggcatgaaggcgggcgtgggagacgtgttccacgtggcgagcgtgcaggtcagcaaccagatgaccgacacgcaactgcgcttctcgatgagcaccatgctgttccaggcgatgggcttctacgtgatgccattcgcggtgcagaacttcttcaccgcgaaaagtgccgacacgattcgccgcacgcagatctacatgccgctgtacatgctgatgtacccgttcctcgtgctggcgtcgtactacgcaatcagccagaacctgcacctcgcgtcgccgaacgaagcgttcttcgcggcggcggtgcgactgctgccgggatggctgctcggtctggtgggggcgggcgcagcgttgtcggggctgctggtgctggctgggatctgcctcgcaatcggtccgatcgtcacgcgcaatctgctgccggggatgccagaaagcaagcagaagcggggcgcgaaggtggtaattgtggtgtatctggtgctgtcgatcggcatgacgctcgccacgcccaacctgatgctcacgctgatcaacaccgcgtattacggcgtgacgcagttcttcccgggcgtgatcgtgattctcttcggtctgcgcgtccggccgctcgccatcggggcgggcatcctgaccggccagatcctggcgatggcgctctatctgcagcaggctgacttcggcggcgtgaacatcggcctcatcgcgctcgccgtcaacgtgctcgtcagcgccttcgtccactacgccccgcgcctcacccgcgtgcaggccgcctga

SEQ ID NO: 2278 - DNA, 1392 bp, Burkholderia 383
atgtcgtctgtggtattcacgggtttcatcctcctgtcgttctgcctcgcgctttactcgcgccgaggcgtaggcaagcagagcgtgcacgatttcttcgtcgcatcgcggcagttcggtgcatttctcgtcttcttcctggcagcgggcgagatttacagcgtcgcgacgatggtcggcttcgcgggcggcatctatgcgaaggggccgacctacgggatctggttcctcggctacattctgctcgcctacccgctcggctattttctcggcccgaagatctgggaagcagggcagcgctacaacgcgattacgcttgcggacctgttcggcggctatttccgaagccgctcgaccgagttcgtcgtcgcgctgtcgtcgatcgtgtttctgctgccgatggctcaactgcagttcacgggcctcgttgccgcgtttcgtggcctgggctggcaattcgagccgctgcacatggtgctgatcgctggtgtgctcgcgtttctatacatcatgatcgccggtatccgttcgtcggcgtacgtcgccgtgttgaaggacatcctgatggtcctggcgatcgtgatcacgggcctggccgtggcgggacacgtcggcgtgacggaggtgttccacgcagcgagcctgcacgtgggcaaccagatgaatgcggaacagctgcggttctcgatgagcacgatcctgctgcaatcgctcggcttccttgcgatgccgttcggtgtgcagattttcttcaccgcgaaaagcgccgacacgatccgacgctcgcagatcgcgatgccgctctatatgctgatgtatccgttcctcgtcatcgccgcgtactacgcaatcagccagaacctgcatctccgctcgccgaacgaagcgttcttcgctgccgcgaatgcgttgctcccgtcgtggatgctcgggctcgtcgcagcggcggcagcgctctccggcctgctcgtgctgaccagcatgtgtctcgcgatcggcccgatcgtgagccgcaacctgctgccgtcgctgccgtcgcaacggcaaacaggggcggcgaagatcgtcattttcgtgtacctcggtgtgtccattgcgatgacgtctgcagcacccacgctgatgcttacgctgatcaacgtcacctattacggcgtcacccagttcttcccgggcctgatcgccgtgctgttctcgctgcgtatccggccggtggcggtgacggcaggcatgctcgttggacaaggtctcgcgttggcgctgtatctcgggaaggttcagctcggcggcatcaacctgggtttgccgtgcctggccgccaacatcgctacggtcgcggcgatccattacctgctgggcgcggccaagccccggacgttggcctcgcaatga

SEQ ID NO: 2279 - DNA, 1395 bp, Burkholderia 383
atgtcaacggtcgtcttcgccgcgctgatcgcgctgtcgctctatctcgccatccgttccggccgcggccgcggcaagcagagcgtgcatgacttcttcgtcgcgtcgcgccagttcggcacggcgctcgtgttcttcctgaccgccggcgagatctacagcatcggcacgatggtcggcttccccggcggcatctacgcgaaagggccgacctacggcgtgtggttcctcggctacatcctgcttgcctacccgatcgggtatttcgtcggcccgaagatctgggaggccggcaagcgccacaacgcgatcacgctgcccgacctgttcaagggccacttccgcagccgcgggctcgagctggtcgttgcgtgcgcatcgatcctgttcctgatcccgtgggggcagctgcagttcaccgggctcgtcgcggcgctcaagggactcggctggcacgtcgagccgctgtacctgatcctcgtgtgcgcggcgctcgcattcacctatatcgcgatctccggcgtgcgcgcgtcggcgtacatcgcgatcctgaaggacatcctgatgctgctcgcgatcgtcgtgacgggcgtggccgtcgcgtggcaggtgggcggcgtgcatccggtgttcgacgcggcgagccggcaagtcagcaacacgatgagcggatcgcagctccgcttctcgatgagcacgatgctgttccagtcgctcggcttctacctgatgccgtttgccgcgcagaatttcttcaccgcacgcgggccgaacgcaatccggcgcacgcaggtcgtgatgccgctgtacatgctgatgtatccgttcctcgtgatcgcgtcgtactacgcgatcaccgcgaacctgaagctggcatcgccgaacgacgcgttcttcgccgccgtcacgcacttgctgccgggctggctgatcggcctcgtcgcggccggcgccgcgctgtcggggctgctcgtgctggccggcatctgcctcgcgatcgggccgatcgtcacgcgcaacctgatgccgaacctgcccgagtcgcgccagaagcgtgcggcgaaatacgtgatcgtcggctacctgctgctgtcgatcgcaacgacgatgctcacgccgaacctgatgctcacgctgatcaacaccacgtactacggcgtcacgcagttcctgccgggcgtgctgatcctgctcgcggggcgccaggtgcggcccgtcgcggtgggcgccgggatgatctgcggccaggtgctcgcgatgatcttctacgtgttccatgtcgacttcggtggcatcaacctcggcctcgtgtgcctcgtcgtcaacgtgctcgtcgtcgcggccgtgcatgcgatgctgcacggccgccccgtgaagcaatacgccgtatcctga

SEQ ID NO: 2280 - DNA, 1386 bp, Cupriavidus metallidurans CH34 uid250
atgtccacagcggttttcctcggcttcatcgtcctgtcgctgtacctggccctgcgttcgcgcaagggaacggggtcgcaaagcgctcatgacttcttcgtcgcgtcccggcagttcggcgcgttcctcgtgttcttcctggcggctggcgagatctacagcgtggccacgatggtgggcttcgccggcggtatctacgcgaaggggccgacctacggcatctggttcctgggctacatcctgctggcctatccgctcggctacttcctggcgccgaagatctgggaggccggccagcgcttcaatgccatcacactggcggacctgttcaagggccacttcgacaaccgcgccgtggagttcgtagtcgcgctgtcgtcgatcctgttcctgctgccgatggcacagctccagttcactggcctgatcgccgcgttccgggggctgggctggagcttccagccgctccatctggtcctgatcgcggcggtgctcgccttcacgtacatcgccatttccggcgtgcgttcgtcggcctacgtggcggtgctcaaggacgtgctgatggtggtggcgatcgtggtgacgggcctggcggttgcgggcgaagttggcgtagcgaaggtcttccacgtggcgagcgagcacgtcagcaaccggatgaacgacgagcagctacgtttctcgatgagcacgatattgttccagtcgcttggcttctacatgatgccgatctcggtgcagttcatctacaccgcgaaaagcgcagatacgatccgccgcacgcaggtggccatgccgctgtacatgctgatgtatccgttcctggtactggcgtcgtactacgcgctgacgcgcagcgacacacttgcaacggcgaacgaggccttcttcgtggcggccacccacctgctgccctcctggctactgggcctggtggcggcggccgcggcgctgtcgggcctgctggtgctgacgggcatgtgtctggcgatcggtcccatcgtcacgcgcaacctgctgccgcacctgccagagtccaggcagaaggcaggtgcaaagggggtgatcgtcgtgtacctgatcgtgtcaatcctgatgacgctgatggcgccgaacctgatgctcacgctgatcaacaccacgtactacggcgtgacgcagttcctgccagggatgatcgtcatcctgttctcgctacgtgtcaggccaagcgcggtggtgctgggcatcctgaccggccagttgatggcggtcgtgctgtatctcgagaaggtggatctgggtggcatcaacctgggactgccctgcctcgcggcgaacgtcgtggtgatggtggtgctgaacctgctccgtaccccgaaggggcttcaggcgacggcgtag

SEQ ID NO: 2281 - DNA, 1383 bp, Delftia acidovorans SPH-1
atgaccaccgcagtcttcctgggcttcatcgcactgtccctgtacctggccatccgctcgcgcacgggcaagggtgcgcaaagcgtgcatgacttcttcgtcgcctcgcgccagttcggcgccttcctggtgtttttcctcgccgccggcgagatctacagcatcggcaccatggtcggctttccgggcggcatctacgccaaggggccgacctatggcgtctggttcctgggctacatcctgctggcctatccgctgggctacttcctcggccccatgatctggaaggccggcctgcgccacaacgccatcaccctgccggacctgttcaagggccacttcggcagccgcgcgctggagctgatcgtggccggctcggccatcctgttcctgctgccctggggccagctgcagttcacggggctggtggcggcgctcaaggggctgggctggaacttccagccgctgcacctgctgctgatctcggcgggcctggccttcacctacatcgccatctcgggcgtgcgtgcctcggcctatatcgccatcctcaaggacatcctcatggtggtggccatcatcgccacgggcgtggccgtgggctggcatgccggggtgggcgatgtgttcgccgccgccagcgccaaggtcagcaaccacatgaccgatacgcagctgcgcttttccatgagcaccatgctgttccaggcgctgggcttttacatgatgccgttcgccgtgcagaacttcttcacggccaagagttcgcacaccattcgccgcacgcagatcgccatgccgctgtacatgctgatgtacccgttcctggtgctggcctcgtactacgccatcagccagaacctggaactggcatcgcccaacgaggccttcttcgccgctgccgttcgcctgctgcccgactggctgctggggctggtggccgcaggcgccgcgctgtcgggcctgctggtgctggcgggcatctgcctggccatcggccccatcgtggcgcgcaacctgctgcccggcctgcccgaggccaagcaaaagcagggcgccaaggtggtgatcgtcatctacctgctgctgtccatcgtgatgacgctgctcacgcccaacctgatgctgaccctgatcaacaccacctactacggcgtgacgcagttcttcccgggaatgatggccatcctgtttggctggcgcatccggcccctggccattgccctgggcatcgtctgcgggcaggcgctggccatcgtgctgtacctgcagcaaccggacttcggcggcatcaacctgggcttcatcagcctggcgctgaacctgctggtcacggccatcgtccactgcctgccgcgtgcggcacacgtcaagaccgcctga

SEQ ID NO: 2282 - DNA, 1395 bp, Burkholderia multivorans ATCC 17616 JGI
atgtccacggtcgtcttcgccgcgctgatcgcgctgtcgctttacctggcctaccgctcgcgacgcgggcacggcaagcagagcgtgcatgacttcttcgtcgcgtccggccagttcggcacggcgctgctgttcttcctgaccgccggcgagatctacagcatcggcacgatggtcggctttcccggcgggatctacgcgaaagggccgacctacggcgtatggtttctcggctatatcctgctcgcctatccgatcggctatttcatcggcccgaagatctgggaagccgggcgtcggcatcatgcgatcacgctcgccgatctgttcaaaggccattacggcagccgcgcgctcgaactgatggttgcgctcgcatcgatcctgttcctgattccgtgggggcagatgcagttcacggggctcgccgccgccctgaaaggactcggctggcacgtcgatccgctgtatctgatcctcgtctgcgcggcgctcgcgttcacgtatatcgcgatgtcgggcgtgcgcgcgtccgcgtatatcgcgatcctgaaggatatcctgatgctgctcgcgatcgtcgtcacgggcacggccgtcgcattgaaggtcggcagcgtgcatcccgtattcgaagccgcgagtcggcacgtgagcaacacgatgaccgcaccgcagctgcgcttctccatgagcacgatgctctatcagtcgctcggcttctacatcatgccgttcgcggtgcagggctttttcacggcgcgcgggccgaacacgattcgtcgcacgcaggtcgcgatgccgctgtacatgttgatgtatccgttcctcgtcgtcgcgtcgtattacgcgatcagcgcgaatctgaagctcgcgtcgccgaacgacgcgttcttcgcggccgtcgtccatctgctgccgggctggctgatcgggctcgtcgcggcgggggccgcgctgtcggggctgctcgtgctcgccggcatctgtctcgcgatcgggccgatcgtcacgcgcaacctgatgccgaatctgcccgagacgcgccagaagcgcgcggcgaaatacgtgatcgtcggctatctgctgctgtcgatcgcgacgacgatgctgacgccgaacctgatgctcacgctgatcagcacgacgttctacggcatcgcgcagtttctgcccggcgtgctgatcctgctcgccgggcgtcgcgtgcggcccgtcgccgtggcgtcgggcatgctgtgcgggcaggcgctcgcgatgctgttttacctgttgcacgtcgatttcggcggcatcaatcttggcctggtgtgcctcgttatcaacatgctggtcgtcgcggccgtgcacgcgacgctgcgcgggcgaccggtcaagcactatgcggtgtcctga

SEQ ID NO: 2283 - DNA, 1386 bp, Burkholderia phytofirmans PsJN
atggccaccgcagtctttctcggcttcctcgctttctcgctttacctcgcgatccgttcgaacaagggacgtggtccgcaaagcgtgcatgacttcttcgtggcgtcgcggcagttcggcgcctacctcgtgttcttcctcgcggccggcgagatctacagcatcggcacgatggtaggttttccgggcggcatctatgcgaagggaccgacctacggcgtctggtttctcggctacattctgctggcctatcccgtcggctatttcatcggcccgaagatctggcaagccggcaagcgctataacgcgatcaccctgcccgatctgttcaaggggcattttcagagccgcgcgctcgaactgatcgtcgcgggctccgcgatcgtctttctgctgccgtggggccagttgcagttcaccggactcgtcgccgcgttgaacggactcgggtggaacttcaaaccgctgtatctgattctgttcgcggcgttgctcgccttcacctatatcgcaatcgccggcgtgcgggcatcggcttatatcgccgtgctgaaggatatcctgatggtcgtcgcgatcgtcgtcaccggcgttgccgtgtcgatggaagtcggcgtgaccgaggtctttcatgccgccagccagcacgttagcaaccggatgaattcgcaccagttgaccttctcgatgagcaccatgctgttccagtcgctcggcttctacgtcatgccgttcgcggtgcagaacttctttaccgcgaaaagcgcgaacacgatccgccgcacgcaggtcgccatgccgctttacatgctgatgtatccgtttctcgtggtcgcgtcgtactacgcgatcagtcagaacctgcatctcgcctcgcctaacgaagcgttcttcgctgccgcgatccgtttgctgccgggctggctgctcggactcgtcgcggccggtgcgtcgctgtcgggtttgctcgtgctggccggcatctgtctcgcgatcgggccgatcgtgacacgcaatctgctgccgggcatgccggaagctcgccagaagacgagcgcgaaagtggtgatcgtgctgtatctgctggtgtcgatcgtgatgacgctgctcacgccgaatctgatgctcacgctgatcaacaccacgtattacggcgtgacgcaattcttccccggcgtgatggtcgttctgttcggactgcgcgtgcggccgtccgcgattgcctcaggcatgttgaccgggcagttgctggcggtcatcctgtacgtgatgcagatcgatctcggcggcttcaatctgggactggtatgcctcggcgtgaatctgctggtgctgaccgccgtgaacctcaccgcgaaaccgagccgtgcgcacgcactcagttga

SEQ ID NO: 2284 - DNA, 1383 bp, Gluconacetobacter diazotrophicus PAl 5 JGI
atgtcaagtgtgacgttctgcctcgtgatcctgctgtcgctggggatcgcgctttattcccggcgagggcaccatcaccagggaacgcgggatttcttcgtcgcctcggggcagttcggcggtgcgctgctgttcttcctggcggtgggcgagacgtacagcatcggcaccgtgctgggctttcccgccggcacggtcagccacggcacggcgttcgtactctggttcctcagctacatcgtgctggcctttccggtggggtatttcctcaatcccaggatctggcaggccggacaggcctgcaatgccctgaccctggcggacctgttccgccaccatgtcggcagccgggcggtcgaaatcgccatggcgctgaatgccatcctgttcctgttgccgttcggcgacatgcagttcgtcggcctgctgacggtgctgcagggcttcggctggcaggtgcccagcatcctgctgacgacgctggcggcggtgatggcgttcttctgggtcgcgctgtcggggatacgcgccccggcctatgtctcgatcctgaaggatgtgctgatgatcgtcgcggtggtggcggtcggcggcgcggccctgctggccatgggccacctgccggacccgcaccaggccgggcgggcggtcgggcaggacatcgcggatatccgtcccaccgggcgggacgaggccttcgccatgtccaccgtcatcctgcagtcgatcggcttctgcgtcgcgccgcagacggtggcgttcctgttcaccgggcgctcgcggcggatcgtccggcgcaaccaggtcctgatgccgctctatatgctgatgttcccgttcctgtacctggtcgccgagtatgcgcgccggtcgggcatggcgctgcccacgccgaacgatgcgttcatgaccgtgtcgctggcgctgctgcccggctggatggacgggctggtggccgcggcctgcaccctgtcggcgctggtggtcctggccggaatgtgcctggcgatcggttcgctggtatcgcacaacctgctgcatggcctgtcggatcgccagcagcgctacggcgcgcaggtcgtgatcgcgctctatctgctgttttcggtcgtcagcgcggcacacgcgtccggcgtcctggtcaagctgaacaccatgtattattttggcgtgacgcaggcggcgcccggcctgttcgctatcctgcttgcccggccggtcagaccggcggcgctggtcgccggattgctggccggggacgggctttcggtcggactgtatctgggcggtgtcgatctgggcgggatcaatcccggacttgtggggctggtggccaacgccgccatcctgtgggccggcagttacatgccgcggcgccgctga

SEQ ID NO: 2285 - DNA, 252 bp, Rhodoferax ferrireducens T118
atggtcgtcatccgactcgcccgtggcggtgcaaaagcacgcccgtttttcaatattgtcgtcgctgacaagcgcacccgtcgtgacggccgtttcatcgaacgcctgggtttttacaacccgattgcgactgccaatgaagagagcatccgcattgcacaggaccgcctgacctactggcgcagcgttggcgctcaggcctctcccacggtggaacgcctgatcagtcaagcggccaaaaaagcggcttga

SEQ ID NO: 2286 - DNA, 252 bp, Polaromonas JS666
atggtcgtcattcgacttgcacgcggcggttccaaacaccgtccttttttcaatattgttgtggctgacaaacgcgttcgccgcgatggccgctttatcgagcgcatcggtttttacaacccgatcgccaaaggcggtgaagaaggtttgcgcattgcgcaagaccgtctgacccactggctcggtgtcggcgcccagccgtcgcctaccgttgagcgtctggtcaagcagggcgccgccaaggctgcctga

SEQ ID NO: 2287 - DNA, 258 bp, Acidovorax avenae citrulli AAC00-1
atggtcgtgattcgactctcccgcggcggctccaaaggccgtccgttcttcaacatcgtcgttgccgacaagcgcgtgcgccgcgacggccgcttcatcgagcgcctgggcttctacaaccccaccgccaaggaaggcgaagaaggcctgcgcatcgcccaggaccgcctgacgtactggaagagcgtgggcgcccaggtgtccgacaccgtcgagcgcctgatcaagcaggccgccaagaaggccgtcgccgcctga

SEQ ID NO: 2288 - DNA, 252 bp, Acidovorax sp. JS42
atggtcgtgattcgactctcccgcggcggctccaagggccgtccgttcttcaacatcgtcgttgccgacaagcgcgtgcgccgcgacggccgcttcatcgagcgcctgggcttctacaatccttccgccaaggaaggcgaagaaggcctgcgcatcgcccaggaccgcctgacgtactggaagggcgtgggcgcacaaccctctcccaccgtggaccgtctgatcaagcaagccgcccagaaggccgcctga

SEQ ID NO: 2289 - DNA, 276 bp, Polaromonas naphthalenivorans CJ2
atggtcgtcatccggctttcacgcggcggttccaaacaccgtccatttttcaatatcgttgtggctgacaagcgcgttcgccgcgatggtcgcttcatcgaacgcatcggtttttacaacccgattgccaaaggcggcgaagaaggtctgcgcatcgtgcaagaccgtttgacccactggatcggtgtcggcgcccaggcatccccaaccgttctgcgcctgatcaagcaaggcggcgccacggttgttgcgcctgctgccgtagctgctgcctga

SEQ ID NO: 2290 - DNA, 252 bp, Verminephrobacter eiseniae EF01-2
atggtcgtcattcgactctcccgtggcggcgccaaaggccggccttttttcaacatcgtcgttgccgacaagcgcgtgcgccgtgatggccgcttcatcgagcgcctcgggttttacaaccccaccgccaaggaaaacgaagaaggtctgcgcatcatgcaagaccgtttgacgtactggaagagcgtcggcgcccagtcttcgcccacggtcgagcgcttggtcaaacaagccgccaagcaaatggcctga

SEQ ID NO: 2291 - DNA, 261 bp, Methylibium petroleiphilum PM1
atggtcgtgatccgactcgcacgtggcggctccaagaagcgccccttctacaacatcgtcgccgccccggcccgcatccgtcgcgacggccgcttcctggagcgcgtcggcttctacaacccggtcgcggccggcggcgaagagccgctgcgcgtcgcgttcgaccgcatcgaccactgggtcagccacggcgcccagttgtcgccgactgtcgcgcgtctggtgaaggacgccaaggccaaggtcgcgccggcggcctga

SEQ ID NO: 2292 - DNA, 255 bp, Delftia acidovorans SPH-1
atggtcgtcattcgactctctcgcggcggttccaaggcccgtcctttctacaacatcgttgccgccgacaagcgcgtgcgccgcgatggttcgttcatcgaacgcctgggcttctacaaccccaacgcccgtggcggcgaagagggtctgcgcgttgctctggaccgcgtgaactactggaagggcgttggcgcgcaggcttccgagaccgcagagcgcctgatcaagcaggccacccagaagactgctgcctaa

SEQ ID NO: 2293 - DNA, 261 bp, Leptothrix cholodnii SP 6
atggtcgtgattcgactctcccgcggcggctccaagcggcgcccgttctacaacatcgtcgctgccaacagcgccaaccgccgtgacggccgcttcctcgagcgagtgggtttctacaacccggtcgcttcgggtggtgaagaagccctgcgcatcgccttcgaccgcgtcgagcattgggtcagccacggcgcccagctgtcgccgaccgctgcccgtctggtcaagcaggcgcaagccaaggtcgctccggctgcctga

SEQ ID NO: 2294 - DNA, 252 bp, Diaphorobacter TPSY uid29975
atggtcgtgattcgactctcccgcggcggctccaagggccgtccgttcttcaacatcgtcgttgccgacaagcgcgtgcgccgtgacggtcgcttcatcgagcgcctgggcttctacaatccttccgccaaggaaggcgaagaaggcctgcgcatcgcccaggaccgcctgacgtactggaagggcgtgggcgcacaaccctctcccaccgtggaccgtctgatcaagcaagccgcccagaaggccgcctga

SEQ ID NO: 2295 - DNA, 264 bp, Variovorax paradoxus S110
atggtcgtcattcgactttcccgcggcggctccaaaggccgtccgttcttcaacatcgtcgtgtcggacaagcgcgttcgccgcgatggccgtttcatcgagcgcctgggtttctacaacccgaccgccaaggaaaacgaagaaagcatccgtattgcccaggaccgcctggcctactggaagagcgttggcgcacaagcttcgcccacggtcctgcgcctgatcaagcaagccgcagccgcagcacccaaggcggcagcctaa

SEQ ID NO: 2296 - DNA, 507 bp, Dehalococcoides ethenogenes 195
atgagtcagcagcttcccgaaccagccgaagatttagccctgttccagctgcgcctaagaagtgaagctgaggcttcgggttatcacctgaacccggataacgcttttgtcaaaatgctggcagagggcttgctggccaaccgccagcgttatggttatcagtcctgcccctgccgtttggcagagggtaaccggaaagctgatttggatattatttgcccgtgtgattaccgtgatgcagatataaacgaatttggcagctgctactgtgcgctctacgttgacagccaaattgccaaaggtgaaaaaaagcctcagccggttccggaacgccgccatgcacccaaaaccctgccaaaagcaaaaactgcccaggcacctgctagtcttgcatatcctgtctggcgctgccgggtctgcgggtatctgtgcgggcgtgatgaagcccctgaccagtgccctatctgcaaagcagacaaagagcgctttgagctctttatgcaataa

SEQ ID NO: 2297 - DNA, 504 bp, Methanosarcina barkeri fusaro
gtggacaaagtctataagcgcttgaataatcaggtcgaaaagtcgggatatcatctcaaccctgatattgagttcacaaaggatcttgtacgggggttgcttgcgaatgaacagcggtatggctattggtcctgtccatgccgactttctgctaacaatctggaagaggacttggatattgtctgtccctgctactatagagaccccgacctgaacgattacggggcctgttactgtgcactttatgtttcggatgaagttatccggggagaaagaagtgtagaatcgattcctgaaaggcgtcctccgaaagaacagagggacgctgaaagagccgaagaaaagaaaagagcagaggtgatagagagtatggaatttacagggaaactttcaaaacctgtgtggagatgtaaggtttgcggatatctctgtgccatggacgaaccgcctggcatctgccctatctgtaaagcgaaaaaggaaagatttgaacgatttatgtaa

SEQ ID NO: 2298 - DNA, 345 bp, Desulfovibrio desulfuricans G20
atgagcaaaaccatgactccggaaaccctgtacgaaatgctcaaaaaatttcaggagcccaaaggcttttatttcaacgcggacatgggcatgaccatgccgttgctcgaaagcctgctgcagaccaaggaacgttacggttacatggcctgtccctgccgtcttgcgctgggtgaatacgaagcggacagagatatcatatgcccctgcgtgtaccgcgaaccggatatggaggagtacggggcctgtttctgcggactgtatgtgacaaaggaatggaacgaaggcaccatagaacacaaggtggtgcccgagcgtcgtccgccggaaaaactgctgggctga

SEQ ID NO: 2299 - DNA, 504 bp, Methanospirillum hungatei JF-1
atgacaccggatgtttcagagaacttacttgataaaaggcataatgaacttatacaggaagctaaaaaaagcggatataatcttaatcccgatacggtttttaccagagggttggttgaaggacttttaatcaatgccaacagatatggatacgaatcatgtccatgcagactttctctcggagataaggaatctgatcttgacattatctgcccctgcgattatcgtgatgatgacctcagtgagtatggagcatgcttttgcggcctttatgtatcagacactattgcctcggagaatcttccggcaccggtggttccggaaaggcgacctcttgcttctgaacgaatgaaaaagtcttcatcatcagttccggcaggaggccttccatttccggtttatcgctgtaaagtctgcggatatctttgtgctcggaataatccgcctgaaaagtgccccatttgtaaggctgaaaaagaacggtttgagatctttctccggtag

SEQ ID NO: 2300 - DNA, 492 bp, Methanosaeta thermophila PT
gtggtgagcgatgaggatgtggagcggctgtaccagaggctcaaagatgatgccgaatccgcagggtatcatctcaactccgacaggcagttcgtcatgggggtcgttcgaggcctcctgacgaatgaggagcgcttcgggtacatggcatgcccctgcaggctgccatccgggaagagggaagaggatctggacataatctgcccatgcgactacagggatcaggatctcgcggagttcggggcgtgctattgtgctctgtatgtctctgagcgcgtcgcgaggggcgaggaggggctgagaccggtgccggagaggcgtggatccaggagctcccggccagcctctgagaccgctgagccgcatatcgaaggtctgtccaagccagtgtggaggtgcagggtctgcggatatctctgcgccagagatgagcccccggagatatgcccgatatgcaaggcctctagggagaggttcgagaggttcatgtaa

SEQ ID NO: 2301 - DNA, 336 bp, Syntrophobacter fumaroxidans MPOB
gtgatggataaggaacagctctacgagatgttggaacgggcccaggaagccaaggggtactacttcaacaaagatcggaaaaaggtcctggaacttctcgaaagcctcttgatcaaccgggaacggtacgggtacatggcctgtccgtgccgcctggcatccgaggaccgcgagagggacagggacatcatctgcccgtgtgtttatcgggagccggacgtcgcggaattcgggagctgctactgcaatctctacgtatcccgggaatggaacgaagggaaaattcccgaaacatacgtcccggagcgtcgtcccgtggagaagatgctcttttag

SEQ ID NO: 2302 - DNA, 345 bp, Desulfovibrio vulgaris DP4
atgagcgcaccggctaccgccgagcaactcttcgagacgttgcgcaagttgcaggaacccaagggctatcacttcaatgccgacatggacatgaccatgtcgttgctcgagaatctcatcgccacacgtgacaggtacggttacatggcctgcccgtgtcgccttgccaacggcaccttcgcgcaggacagggacatcgtctgtccctgcgtgtaccgcgaggaagacgtgcgcgaatacggggcctgcttctgcgggctgtatgtctcacgcgaatggaacgagggcaaggtaccgcacgtattcgtgccggaacgtcggcctccggagaaaatattcggttga

SEQ ID NO: 2303 - DNA, 474 bp, Methanoculleus marisnigri JR1
atgcgcgacctcgaagtcgaggtggaggccggcggataccacctcaatcccgaccgggagttcacccgcgacctggtccggggtctgctcgcgaaccgggagcggtacggttacatctcctgcccctgcaggcttgcttcgggagaccgggacgacgaccttgacatcatctgcccctgcgactaccgggaccccgatctcgccgattacggggcctgctactgcgcgctctacgtcaccgccgacgtggagagggggaagcgtgccgccgcccccgtcccggaacgccggccggggcctgcggagcgcaagcggcagagagaggagcgcgccttggtgggccgcgcaccggggaccctgaactacccggtctggcggtgccgggtctgcggctacctctgcgcccggaacgagccgcccgagacctgccccatctgccgggtctcccgcgaccggttcgagcggtttatgtga

SEQ ID NO: 2304 - DNA, 504 bp, Dehalococcoides BAV1
atgagttcaaaacttcctgaaccgtcagaaggccctgtactttttcaggcacgcctcaaaaatgaggctgaggcttctggttatcaccttaacccggatgggtcttttgtaaagatgctggctgagggtttactggctaaccgccagcgttatggttacccgtcctgtccttgccgtctggcaaaaggtgataaaaaggctgacttggatattatttgcccgtgtgattaccgtgatgcagatctgagtgaatttggcagctgctactgtgcgctgtatgtaaatagccatattgcaaagggtgaaaaaaaggctcaggcagtgcctgaacgccgccatttgcccgaaacccgtccggaaacaaagcctgccgaagctccttccgggctggcttatcctgtttggcgttgccgggtctgcggatacctgtgcgggcgtgacgaagcgccggatgagtgtcccatttgcaaggcagacaaagaacggtttgagcggttcatgtag

SEQ ID NO: 2305 - DNA, 516 bp, Candidatus Methanoregula boonei 6A8
atgaacgtccccgaaattctggaaaactctgtcgaacccgcataccttgcacttaaaaccgatgccgaaaagaacgggtaccggctgaacccggatactgagttcaccaaaaacctggtcaggggcctcttaaagaacgagcagcggtacgggtaccgttcctgtccctgccgtcttgcctccggcaaaaaagacgaagaccttgacatcgtctgcccctgcgattaccgggacgccgacctggaggaatacggggcctgttactgcgccctgtacgtgaacgaggcaattgcccagggaaagaagcaggtcgcaccggtacccgagcgccgccctccccggtcccagcggggcaaagccgcatcggtcaaaatcgcttcaaccacagcgatgccgatctttcccctgccggtctggcgctgcaaggtctgcgggtatctctgcgcacgcgagcagccaccgggggtatgtccgatctgtaaggccacgaaggagaggtttgagaggtttgtgtga

SEQ ID NO: 2306 - DNA, 333 bp, Candidatus Desulfococcus oleovorans Hxd3
atgacaccggaaaagctttacgagcagcttcagtcggtccaggaacccaaaggctattttttcaacaacgaccgggaactggtgtttgacctgctgtcggccctgctgaccaacaaggagcgctacggttacatgtgctgcccctgccggctggcatccggggaccgggaaaacgacagggacattctctgcccctgcggctaccgggaggcggacgtggccgaatacggcagctgctactgcgccctttatgtttcaaaagagtggaacgacggcgcggttgaccgtgtctatgtgccggaacggcggcccgcggaaaagtttgcgttctga

SEQ ID NO: 2307 - DNA, 345 bp, Desulfovibrio vulgaris  Miyazaki F
atgagcggccccgccaccccgcaggcgctgcatgacatgctgcgcaagattcaggaacccaagggctacttcttcaacaaggacatggacatgaccatgcccctgctggaaagcctgctggtgaacaagcagcgctacgggtacatggcctgcccctgccgcctggcccttggcgagttcgaaaaggaccgcgacatcgtctgtccctgcgtgtaccgagaggacgacgtgaaggaattcggggcctgcttctgcgggctgtacgtgtcgcaggcctggaacgacgacgaaattgcccacgacatcgtgccggagcgcaggccgccggagaaattatttgggtag

SEQ ID NO: 2308 - DNA, 351 bp, Desulfomicrobium baculatum DSM 4028
atgactcccgaagaactttacgaaaagctgcgccccctgcaggaagccaagggctatttcttcaacaaggacaaggcattcgtgcttgacctcatggagagcctgctcatcaaccgcgagcgttacggctacatggcctgcccgtgccgcctggcctcgggcaaccgagacctggacaaggacattttctgcccctgcgtctaccgcgatcccgacgtggccgaattcggagcctgctactgcggtctctacgtatccaaagaatggaatgacggcagcatcccccaggaaaccgtccccgaacgacgcgatcctgaaaagctgatggcgggccttcttttcgaagaatga

SEQ ID NO: 2309 - DNA, 519 bp, Candidatus Methanosphaerula palustris E1 9c
atgaccgcagagaggacaccggttgccgatgaggacgccgttgccctgtttgagcggctgaaccgggaagctgggcaggccgggtaccatatgaatccggatatggagttcgtgctcggtctgatgagaggattgctgaccaacaaggagcggtatggatacatggcctgtccctgtcgtctggccagtggggttcgggagaaggatctggacattatctgtccctgtgactatcgtgacccggatcttgcagagtttggtggatgttactgtgcgctctatgtctcgaacgcggtgctgcaggggcgccagcatcttgaatctatcccggaacgtcgaccccccgcagatgagcgggaggtgaaggaggttgggcagcatgctcccccgctcggtgaggtgctaccatttcctgtctaccgctgtcctgtctgcggctatctctgcgcgatgaacacccctccgttagtctgcccgatctgtaaggcagaccgggaccggtttgttcggttcttctga

SEQ ID NO: 2310 - DNA, 360 bp, Desulfohalobium retbaense DSM 5692
atgaacgttgaagagttatacaccaagctgcgtgccttgcaggaacccaaagggtattacttcaacaacgacacagacatggtcatggatcttttgcagagcctgctgatcaacaaggagcgctacggctacatggcctgtccttgccgtctggcttccggcaacaaggaattggacaaggatatcctgtgtccctgtgtctaccgggaaccggatgtggcggactatggcagttgttactgcgggttgtacgtgtccaaagaatggaatgatggacggatcccccatgattttgtccccgaacgcagacccccggaaaaagtccttcaggccctgcaacatgccagcagcgacgagtaa

SEQ ID NO: 2311 - DNA, 1083 bp, Methanosarcina barkeri fusaro
atgcggcttttggagaaactctgggggcaaaaaccctcacgaaaatccgataagaagaaaaatggcacttctaactatccctatgccgtaacccgtgtccgagctatgaagagcaagctgctccctaaagaatcatacccccggcttcttaacatgggaattgatgggattacccgctttatccaagagtctgaatacaaaaacgacgttaacgaactggcaatgaaatatagtggtggcgatctggcagaacacgcattgaacagaaatcttgcgctcacatatgataagttggtaagaattaccggaggagaattgaattacctggttgttgcatacctcaaaagatacgacatctggaacataaaaacacttcttcgtggtaaaatctacaatgcatctgctgaagatatcatggaatcactgattgctgccggggagtttacctatacttctatgtcagaacttgcagccaaggctacatataaagaaataattgaagccctgaaatattctgagtactaccccctgctgcagaagtttgacggaactaacctggcatacatagagaatgaacttgacaaaatgtattacacaggcttgtttggagcaataggaaaaccaagatctaaggaccgcaagctctttcttaaagttgtcagattagaagtagacgtcaagaacttaataaatcttttcagactgaaaaaagcaggagttatgcagcttgatgaaatcatgcctctcatgattgaaggcggtcttgagttaaaacccgagaaactggcgactctcccatatgacgagtttgtcaatgagcttcaaagaactcagtactgggacgtaatttcaggcgttacgagttcagatatgacttctttgactactcttgaaagcaggctcacaagatattatcttgaatcttcaaccgttctctcgcatgtatccccgatctcagttgcacctattctggattatatcattcataaacataatgaggctactaatctcaggatcatcttcaggggtaaggagactggcctcagtgatgagttaatcaaagaccagttggtggttatataa

SEQ ID NO: 2312 - DNA, 1056 bp, Methanospirillum hungatei JF-1
atggttcagaacagtggcggcccggctccgtatatctatgtcagtacacggttacgggtcaggaaggccaaactgctcccccctgaagaatatcagcggatgctcaacatgagtcttccggagattattcgtctgattggagagacagagtaccagaaagaggtcgatgagctcggaacttcttttgaaggtatcgatctgattgaggtcgctctttcctggaatcttgccaaagaatatcagcgggttattgaacttgcccccggatccctcaaggaattcaccatggcataccttcgccggtgggatatctataatatcctgaccattctgcgtgggaagatacagggcatgaaggaagggaagattaaagaagtacttattcctgccggaagccttgaccggactatccttgaccgggttttagcagaagaaaactgcgaacgggttgcagacgctctgaagagctggaaaatgtatccgacactttctgcagaactttctgaaggatgtgccgttggttcatttgccagacttgaaaatgagctctacaagcggttgtatgcagatcttctccagattgcccggagaggagtgaagggaggtaaccagttcctgaaatttgttcagctggagattgatgtgaagaacatcaagacgctctttcggatgaggggtgacggatatgaagaagatgcacgtgaatttttcatccccggagccacattcacccctgaagagctgcaacagatgaaccagatgaccagcaggaacgaggtcattgatgccctgctcgcacggataaaggcaaaggctattcaggttgccctggaagatctgagaacagaaaagtcagagcaggaggtcgatgctgaacttaccaaaacacagcttgaccatatggaacagctctccaagattaatccgttctcaattcatcctatcctcgtctatcttgaaaagaagaaatacgaggtcttcaacctgagagccatagcccgtggaaaagaatcccgtcttgccggtgataccatcgcaaaatatctggtgatataa

SEQ ID NO: 2313 - DNA, 1074 bp, Methanococcoides burtonii DSM 6242
atgcggcttttgcaaaaattcacaagaaaaagtagtctgaagcagagcggaagtagctccaattacgcttatgtgactgcacgcgttcgcgcgatgaaaagcaatcttcttcctagagaagtgtatcctagattaatgaatatgggaatcgacgagatcacccgttttatcgaagagtcacagtataagcaggatgtcgatgaactggcaagaacatatgacggtgtggatctatttgaacacgcattgaacaggaatcttgcggtcacttttacaaaactgatcaatatctccgaaggagagttgaactatctgatctctgaatatcttagaaaatatgatatatggagcatcaagaccattctgcgtggaaagtactgtggtgcatctgtagaagagatcaatgatagcatagtctccgccggacaactgtcttatccgtttttgttaagcctttcagaaaaagaatcatatgaaagcatcatcgatgctctcagtggaaccgattattacccaacattaaaagaatatgatgggacaaacctctctgatatcgaaaacaaacttgataagatgtactataccggactgtccactacagtaaacaatccaaaatccaatgatagtaaactgttctcaaagtttatccgtactgagatcgacataaagaacctgagtacccttttcaggttgaagaatgccggtgtggaaaaggatgaaattgcagacctgattctagaaggcggtcttcatttaagtattaaagagattgaaaagctattaccacttccattcagtgaatttgttcagtcacttgagaagtatccttattgggaagatatatctggaatagtaaaaactgaaatggattcactgatagaactggaaactcaactcacgaggtccaacatcaaatccgcttcaagcttttcacatgtgtacccattatccattgttccgatcatggattacatactgaacaagacgaacgaagtacacaatttgcgtatcattctgcgcggaaaagcagcaaatcttgatgaagaaataatcaggaaccagttggtgatctaa

SEQ ID NO: 2314 - DNA, 1050 bp, Methanosaeta thermophila PT
atgccagtactacgtttgccgaagttcggaaaaccggtgaagtacgcatacatcacgggcagggtaagggcgatgaaaacgaagctcatacccaacgagatgtatgccagaatgctgaacatggatataccagagatcgcaagatacctcgaagagacccagtacaaagaggagatcgatgctctcgccaaggactactccggtgcagagctgatcgagcatgcaacctttgcaaacctggcaaagacctacaggaagctccttgaggtctcgatagacgagccccagttcctgatactggagtacctgaggcgctgggacatctggaacataaagacgatcctccgtggaaagttctatggcgccagcgactcggagataatgaagtacatagtgcctgcgggcgagctggaccaggagtttctggaagggcttgccaagaaggactcgatcaacgatgtcataacagcattcgagggcacagacttcgctgaggctctctccaagtacgatgggaagtccctcgcctctgtggagaacgcccttgacaagctctattacttcagaatggagcgcgctgtgggcgggacgctatcagttggcggcggtctccttctcaaatacgtgaagagagagatcgatatcaggaacctcataaccctcttccggatgaacaaggctggaatcgaggctagcatcgttcaagagaatctgatacctggcggcaagctcagcgaggagctgagcaggatggcaggacagccctatgcggatttcgtcagggggcttgaaggctatccgttctggagcgcaatctcggatgtggcgaccgcggacctcgatagcgtgagcagaatagaagcaaggctgaaggcatatctcataagatacgcctggtctctgtccaactaccatccgctgtcgatcctgcctgtgcttggctacatcgtcacaaaggagacagaggttgccaacatcaggaagatcgtcagagggaaggaggctggactgcctaacgagcttatcgaggagcagatggtggtggcataa

SEQ ID NO: 2315 - DNA, 1059 bp, Methanocorpusculum labreanum Z
atgactgaggtaatgagcggaactgctccctatatctatgtttcaacccgcatgcgggtccgcaaagcgaagctcatcccgcgggaagaatatcttcgcatgctgaacatgggtctcactgagtttaccagactcattgaggagatggagtacaaacgcgaaatcgatgaactttcagcatcctttaaaggtgtcgacctcatcgaaaacgccatgtcctggaaccttgcaaaggagtatcagcgtgtgatcgctctggctcctggagagatgaaaggatttacccgtgattacctgcataagtgggatatccagaacattctgagtatcctgcgaggtaaagaactcggattttccgacgggaagatccgtgcagtacttgtcccggccggtgcactcgatgcatcgacgctggaccggcttgtcgccgagtcatcggttgaacgtatcgttgaacagctgcccgtaaagcagatgtcggcgattctcagcgaaggactcagcgaggcaatcgagacccattcgtttgggaagatcgagaacgagctgtataagtactattatgcaacgctgatcaaagcagcacgtggcggtatgaagggcggacgtccgttcctgaaatatgtcatgttcgaaatcgacatcaaaaacatcaccagtgttttcagaatgcgtgcacagggcggcgacaacgcagcccagcagaacatctggatccccggcggttcattcaaacctgaagagctcgaaagactcagcagtgttgaaagcaccgatgaagtggtcgattcgctgaaaaagaagatcaaagtcaccgtgctccttgatgcacttgaatctctgcgtgagaagaaaccgatttattcgatcgaaagcaccctgattgcagctcagctcaatcagatggacaaagtatcgaaacgcaatccgttctcaatctcgccgcttctcgtgtatctcgaaagaaagaagtatgaagtatccaatctccgtgccattgcccgtggaaaagaagcaggcctggacgcggagacactcgaaaagtacctggtgatgtaa

SEQ ID NO: 2316 - DNA, 1056 bp, Methanoculleus marisnigri JR1
atggcaggagtaagtagcggatcggcccagtacatttacgcctgcacccgcatgcgggtgcgtaaatcgctgctgataccacgcgaggattatctccgcatgctgaatatgagcctgcctgagatcacccggttcatcggcgagaccatctaccggtcggagatcgatgaactcggcacctccttctccggaatcaacctcgtggaggtggccctgagctggaacctcgccaaggagtaccagagcatcctggaactggttccgggagacctgaagcactttaccgccagttacctgcgccgctgggatatccagaacgtcgtcaccgtcctgcgcgggaagatgcagaagatgcagccgggtaagatcaaagaggtcctggttccggccggcagactcgatcgggtcgctctcgaccgccttgtcgcggaagagtcgccggagcgggtcgccgagtcgctcaagggcgagcggttctaccccgtcatcgagagggaactccctcgcgcgacggagaccggatcgtttgctcacctggagaacgagctctataagggctactacgcgcggctgatcgcggacgcgaaaggaggcgtcaagggcggggatatcttcctcaagtatatccggctcgagatcgatatccggaacatccagaacctcttccggctgcgggccggacatgtccgcgaggatgtcagggaactgatgatccccggcggttcgttcacggtggacgagttgcagcggctctcgggactcgagagccaggacgagttcatcgacgccttaaaaagacaggtgaagatgatcccgctcttaaacgcgctagaggagatccggggcaagaccgcgctccacgagatcgaggttgcgctgacccgggtccagctggaccagatggagcggatgtcgaagcggtacgcgttttcgatcctcccaatcctcgtctacctggagaagaagaagtacgaggtcgcgaatcttcgcgcccttgcccggggcaaggaagccggcctccccggtgagcgattacagggctacctggtgatgtag

SEQ ID NO: 2317 - DNA, 1176 bp, Methanococcus maripaludis C7
atggtagatgctttaacacagttaatggaatcagcaggaatgcctactgatgtattcatgactttatttgtacttgcaggaatcgctatattcttggttattatgatcttcctgataagatacttgtcagaaactgctccatttgcttacgttaatgcaagagtaagaagtatggagtctagattattaaaagaccacaaaataaatgaattaatcgaatctgcaggaactactgagttaattggattcttggaagataccgactacgggccatacttatccgaagttatggggcaaagtgaagacccagtcgttgttgaaaaggcattggatattcatttagcacacgtttaccaaacacttgcaaatatctctccagatggagcaagaaaaatattaaaattgcttgaaaagaaatttgatgttaaaaacattaaaacacttctcagagcaaaatatgttggtttggatgctgaagaaactttcaaattattgatcccacttggaacaattcctgaaagcaaattaagagaattaagtgaaactaaagcaattgaagaaattgtaagtgctttagaaggaactggttattcaagcgtactttcagaaggattaacacaatacgagcaaaatggcaaattaactacccttgagatgtcactcgataaattaatccttgaaaacctctggaaaaacgtgagtgttgatggtaccgaaaaagacttgttcaaagaatttatcggaacaatgatcgacattgaaaacttgaaaatcatccttaaaggaaaagctgatggattatcatccgaagctatatccaactatacaacaagcaaaggatacgaacttgcttcttggaagttaaaagagctcgctgatgtagaatcaatcgaaggagttatcagttcacttgaaggcacaaaatatgccccaatgatggctgaaaacctcgaagaatttgaaaaaactaaatcagtttatgtatttgaaaaagctcttgacagttacttggttaaaatgggtaaaaaattatcactcagacagccatttggaataggcccgataattggactcattacctcgaaagaacttgagataagaaatttgaaaattatcattaaaggtaaaatcgaaggcctgtctgcaagtgaaatcagggagatactggtatcctaa

SEQ ID NO: 2318 - DNA, 1044 bp, Candidatus Methanoregula boonei 6A8
atgaaaggcatttcagcgcccacaatctacgtctgtaccaggatgcgggtgagaaaggcaaagctcctcccccgcgaagagtaccagcggatgctcaacatgagccttcccgagatcatccgtatcatcgaagagacatcctacaagcaggagatcgacgaactcggcaccacgtttaaggggatcgaccatctcgagattgccctgagctggaaccttgctaaagagtaccagcggatccagaagatcacgccgggaacgctcaagcagttcacccgggcgtatcttcgctactgggatatccagaacgtgctcaccatcctccgcggcaagctgcacggggaaaagacgggcaggatcagggaggtccttgtcccggcaggaaacctcgacaagattgtgctcgaccggcttcttgctgaagacggtcccgaccgtgttgtcgatgccctcaaagggcagcggatttacctggtgcttgcccgcgagtacccggcggcaaaagagtccggctcgtttgcaaagatggaaaatgagctgtacaagcagttctacgctgagctcattgcagagtgcggcggggatgccgggggcaggatgtttttagcttatatccggctggatatcgacataaaaaacgtcctgacactcttccggctccgggcagacaagggaggagaagatgcaaaggagctgtacatccccggcggtacgatcactgctgccgacttctccgctctggccacggcccaggattaccgggaatttaccgaccagctcagggccaaggtccgcaccgggccggttgttgaactcctcaaaagcatcgagaccgagcggcctgtccatgagattgcagcgcttcttgtacacgtccagatggaacagatggagaaactctcccggagaaatccgttctccatctatccgatcctcgtgtacctggagaagaagaagtacgaagtgttcaacctccgggcactggcacggggcaagcagtcgaatctccccgcagaaacgatcagcaagtacctggtgatataa

SEQ ID NO: 2319 - DNA, 1047 bp, Halorubrum lacusprofundi ATCC 49239
atgagcgccgtcgggagctcgaacccagagtacgtcgtcgcgcgggttcgtgcccgccgcggcagcctctacggggacgaggagtaccggaagctgacccggatgggcccggcggagatcgcccggttcatggaggagtcgagctacggcacggagatcaacgccctcgggagtcttcacggcggcgtggacctgatcgagtacgcgttaaatcggaacctcgctgggcagttcgacgatattctcgactggagcgaagggtcgctgtacggcctgatcgctcggtacctccgtaagttcgacgcctggaacgtgaagacggttattcgcggcgtctacacggacgcagatcagtcggaaatcgaggtcgacctgatccgcgccggcgagttcgacgaccggcggatccgtcggctgcttgaagccgactcgatcgacgcagtcgtcgaagtgctcgaagacactatctacggagacccgctgcgagaggcgtacgctgagtacgaggagacgggcgtgctggtgcctctcgaaaacgccgtcgaccgtgcgttctacgagcggctcctgtcggggctcggcaacgacgagccgacccgccagtacgaggcgttcctcaaagcggaggtcgacttccgaaacgcggcgaacgccctccggctcgcccggtcgggcgcggatatcgaccccgcagcgtacttcatcgagggcggcgagctgttcactcgcgggtcgctcgcgcgactcgcgcggaacctcgacgaactcgtggagtatatcgcggacagccagtacggtgacgagctcggacccgcgttgcgcgaactcgaggaggcgaacagcctcatcgcgttcgaacacgcgaccgacgccgccttgctggcgtacggcgaccagctcggcacgatccacccggtatcggtgaccccggtgatctcgtacatcctcgcgaaggagcgcgaagtcgagaacatccgggcgatcgcccgcggaaaggaggccggcctgtcggccgacgagatcgaatcggagctggtgataacatga

SEQ ID NO: 2320 - DNA, 1074 bp, Halorhabdus utahensis DSM 12940
atgagtcccatgagaaaccccagcggagcgaaaagcaactacgagtacgtggtcgctcgggttcgctcccggcgagcctcgctgttcgacgaggacgattaccgcaagctcgtccggatggggaccggggagatcgcccggttcatggaggaaagcgagtacgaacgcgagatgaacgccctgggctcgcgccactccggggtcgacctcatcgagtacgcgttgacccggaacatggcgaagcacttcgaggacctgctgtcgtggtcggaggggcaactctacgattacgtcgccaggtacctccggaagttcgacgcctggaacgtcaagacggcgcttcgggggatctactccgaggcggacgccgaggccatcgaggccgacttcatccgggcgggcgaactcaccgaggaggatctcgatcagctggcgacggcggagtcgatcgagggcgtcatcgaacgactggaagggacgatcttccaggagcccctcgaggatgcattcgaggagttcgaggggacgggactgctggttcccctggagaacgccgtcgaccggacgttctacgaggcgctgctcgccggacttccggacaccgcagagacgggcagtgcgatcggctactatctcgagttcctccgggccgagatcgacttccggaacctccggaacgcgttgcgactggtccggactggcgcggacatggatcccgccgagtactacatcgagggtggccaactcttcgatgcggcggaggttcgccagctcgtcgagaacgaggagcagttgctcgatcacattcgtgagagtcagtacggtagcgagctgtcgtcggcgctcgatgcgctggattcggcggaggagttgatcggcttcgagcacgccatcgacgcggcgttgctcgaatacgccgaccggctgtcctatcggtatccggtgtcgatcacggcggtgctttcgtacgtcctcgcgaaggaacgtgagatagacaacatccgggcgatcgcccgcggcaccgagagtggcctctcgcccgaggagatccagcgggagctggtgatgctatga

SEQ ID NO: 2321 - DNA, 1056 bp, Candidatus Methanosphaerula palustris E1 9c
atgacagaggtaacgtcggggccggctccctatatctatacctccacgcggctgcgtgtacggaaggcgaaactgcttccaaaggaagattacctgaggatgcagaacatgtcccttccggagatcgcacggtttatcggagagtcagaatacaagcctgagatcgacgaactcggtggcgtgtttcacggcatcgatctgatcgagatcgcactctcctggaaccttgccaaggagaatcagagtgtgcttgggatcacccagggctcgctgatgcagttcacggcgaactatctccgaagctgggatatcggaaacgtgctgatcatcctccgtggcaaacagcagggcttctcggtcaacaagatcaaggaggttgtgatccctgctggcgaactggacaagatcttcctcgaccggctgctggccgaagagtcacccgaccggatcgtggaattgctgaaaggatggcgtctctatccagtgcttgaacaggagtacggcagggtcatcgagagcgggtcatttgcacggcttgaaaatgagttatacaagaagtactatgtcgacctgatcgctgtggccaggggtggtattaaaggaggaagggagttcctccagtacctgcagctcgagatcgatacccggaactttcagtcgctctttcgacttcgggcgggtggtatgcccgaggatgtcagagaactgatgatccccggcggtgacttctcgctcgacgagctggcacgcctcggagcagtggattccaatgatgaattgatcgatgcgctgaagaagcggacgcatcttcagtcgttgatcgatgcactggagacattccgtgagggactgccgatccatgagatcgagaatgtgctgaccaggatcaaacttgagcagatggaccggatgtctaagcggtatccattctccgttgcaccgatcctggtctaccttgagaagaagaagtacgaggtgttcaaccttcgggccctcgcccgaggtaaggagtcgaacctttcgggtgaacggataatggagtacctggtgatctga

SEQ ID NO: 2322 - DNA, 1077 bp, Halomicrobium mukohataei DSM 12286
atgaccgtacgcttcgaagaacagaactgggaaagcgcaaactacgagtacgtcatcacgcgtgtccgctctcgtcgggcgaagctgttcgacgacgacgactaccggaagctcgtccgtatgggtccctccgagatctcccggttcatggaggagacggagtacgagaccgagatgaacgccctgggagcgcgatacagtggcgtcgacctcgtcgagtacgcgctaaaccggaacctcgccaagcacttcgaggacctgctgcgctggtcggacgggcgactgtacgactacgtcgcccgctacctccggaagttcgacgtgtggaacgtcaagacgatcgtccgggggatctactccgaggccgacgccaaggaggtcgaagacgacctgattcgtgccggcgaactgtccgagcagctgctcgaccagctcgtcgccgccggttcgatcgaggaggtcgtcgaactcctcgacggcacgatcttcggcgacgacctcgccgaggcgtaccaggactacgaggacagcggcgtactcgtcccgctggagaacgcgctcgaccgggcgttctacgacgtgttgctctcggggctgcccacgcagccggaagtcgactctccgactggcctgtacgtctcctttctcacggccgagatcgacttccggaacctccggaacgcccttcgactcgctcgcagcggggcggagatcgatccggccgagtaccacatcgagggcggtcgcctgttcgacgccgacgagatcggcgcactcgcaacgagcaccgaccagctcgtccagcgggttcgtgagagcacgtacggcgacgaccttgacgcggcactcgacaccctcgaagcggccgacagcctcatcgagttcgagtacgccctcgacgcggcactgctcgagtactccgatcagctgtcgaaccgctacccgctgtcggtctgtccggtcttatcctacatcctcgccaaggagcgcgaggtcgacaacatccgagcgatcgctcggggccgcgaggccggactcgacagcgacgagatcgaacaggagctggtgatactatga

SEQ ID NO: 2323 - DNA, 312 bp, Jannaschia CCS1
atgcgcatattcgggttgaaggcctgcgacacgtgccggaaggcggcgaaggcgctggacgcagaattggtggacatccgcgcgacgccgctggacccggaccagatcgaggcgtttcacacggaattcggcgcggcgctgatcaacacacggtcgaccacctggcgggagctggacgaggccgcacgggcgatggacccggtggcgctgatccaggcgcatccggcggtgatgaaacgcccggtgatcgagcgggatggcgcgctgacgctggggtggagcaaggacgtgcaggcgcgctacggggtttga

SEQ ID NO: 2324 - DNA, 318 bp, Ruegeria sp. TM1040
gtgaagctttatggtctgaaaacctgtgatacatgtcgcaaggcgctgaaatcactgccagatgccgactttaaggatgtcagaaccgagggggtgcctgcagacatcatggcgcaggcctatgctcaatttccagacaaactgctcaatacgcggtcaaccacttggcgcggcctcagcgaggaagatcgggcaaaaccgccacttgaactgctggcagaacacccgagtctgatgaaacgcccgttgatcgaggcagaggggcagctccatctggggtggaccaaagacgtgcaggctgcactcggtgtgacctga

SEQ ID NO: 2325 - DNA, 327 bp, Rhodobacter sphaeroides 2 4 1
atgatcctttacggcatctccacctgcgacacctgcaagaaggcgctgaaggcgctggaggccgccggccacagcgtcgagttccgggacgtccgggcggcccccctcagcgagagcgagatctcggagctggtcaccgaattcggcgatgcgatcgtcaatcgccagtcgaccacctggcgcggcctgtcggactggctgaaggcctcggagccggaggcgcagctggccgcccagccgacgctgatgaagcgtccggtgatccgtacggaggaagggctgttcctggggtgggatgcgggcgtgcagcgccggcttctggggtga

SEQ ID NO: 2326 - DNA, 327 bp, Rhodobacter sphaeroides ATCC 17029
atgatcctttacggcatctccacctgcgacacctgcaagaaggcgctgaaggcgctggaggccgccggccacagcgtcgagttccgggacgtccgggcggcccccctcagcgagagcgagatctcggagctggtcaccgaattcggggatgcgatcgtcaatcgccagtcgaccacctggcgcggcctgtcggactggctgaaggcctcggagccggaggcgcagctggccgcccagccgacgctgatgaagcgtccggtgatccgtacggaggaagggctgttcctggggtgggatgcgggcgtgcagcgccggcttctggggtga

SEQ ID NO: 2327 - DNA, 327 bp, Rhodobacter sphaeroides ATCC 17025
atgatcctctacggcatttccacctgcgacacctgcaagaaggcgctgaaggcgctggaggcggcgggacacagcatcgaattccgcgacgtgcgggccaggcccctgagcgagagcgagatctcggaactggtgacggagttcggcgatgcgatcgtcaaccggcagtccaccacctggcgcgggctttcggactggctgaaggcttcggaacccgaggcccagattgcggcccaaccgacgctgatgaagcggccggtcatccgaacggaagaggggctgtttctgggctgggattcgggggtgcagcggcggcttctgggatga

SEQ ID NO: 2328 - DNA, 312 bp, Dinoroseobacter shibae DFL 12
atgcgggtttacgggatcaagacatgcgacacgtgccggaaagccgtgggtgcgctgggcgcggaactgcgcgatatccgcgccgagcgcctgacggcggcggagatcgacaggttcctggcggccttcggtgacgcgctggtcaacacccgctcgaccacctggcgggggctggacgaggcggcgcgggcgcaggcgcccgaggcgttgctggcggcgcatccaaccttgatgaaacgcccggtgatcgagaccccggacggcacgcttcacctcggctggggggcggatgtgaaggcgcggctgctctga

SEQ ID NO: 2329 - DNA, 384 bp, Dickeya zeae Ech1591
atggctatcaccctgtacggtattaagaattgcgacaccataaaaaaggcccgtcgctggctggaagaccatcacatcgactatcgctttcatgattaccgcgtagacggattaaccgccgaacgcctgcaatcttttatcgataacatcggctggcaacctttactcaatacccgaggcaccacctggcggaagctggaagacgcgtatcgtaacaccatcaacagcgaagcagcggcaaaagctgttatgctggaacaccccgcgttgatcaaacgcccgttgctggtcagcgatgatggaaaaaccctgctcgctttcagcgacgatagctataggcacttttttacggagaacacctcacatgtcttgcccggtaattga

SEQ ID NO: 2330 - DNA, 780 bp, Rhodopseudomonas palustris HaA2
atgacggtccacttcatcggcgccggccccggcgcgcccgacctgatcacggtgcgcggccgcgatctggtgatgcgctgcccggtctgcctctacgcgggatcgctggtgccgcgcgagctgatcacgctgtgcccgcccggcgcccgcgtggtcgacaccgcgccgctcgatctcgacgcaatcacgagagaattcgtcgccgccaccgaagccggccacgatgtggcacggctgcattccggcgatttgtcggtgtggagcgcgatgggcgagcagatccgccggctcgaggctcacggcatcccctacaccgtcacgcccggcgtgccgtcattcgctgccgccgcggcggcgctcgggcgcgaactgacactgcccgaagtcgcccagaccgtggtgctgacgcgcacctccggccgcgcctcggcgatgccgccgcgcgaaaacctggacgcgtatgcggcgaccggcgcgacgctggcgatccatctgtcgatccacgtgatcaatagcgtcgtcgagaaactgcgcccgcattacggcgatgattgcgccgtcgccgtcgtcgttcgcgcgagctggcccgaagagcagatcatccgcggcacgctgacgacgatcgccgcgcaggtcgcggaggccggcatcgaccgcaccgcgctgatcctgatcgggccgtcgctcgcagcgagcgatttccgcaatagcgcgctctacagcacggactacgaccggcgctaccgtcgctccgcggaggacgatcgtgcccgcgactga

SEQ ID NO: 2331 - DNA, 786 bp, Novosphingobium aromaticivorans DSM 12444
atgaccgtccacttcattggcgccggtcccggcgcgcccgatcttctcactttgcgcggacgcgatctgatcgcgggcagcccggtgtgcctttatgccgggtcgctgatcccggtcgccgtgctggatcattgcccgccgggcgcccggatcgtgaacaccgcgccgctggaactggaccagatcatggccgaaatcgccgccgcccatgccgccgggcacgatgtggcgcggctgcattcgggcgatctttcggtgtggtctgccatgggcgagcagttgcgccgcctgcgcgcgctggacattccctttacgatcacacccggcgtcccggctttcgccgccgccgccgctgcgctggaggcagagctgaccctgcccgcgctggcgcaatcgctggtgctgacccgcacaccgggccgcgccagcacgatgccgcccgccgaaagcctggccaactttgccgtgaccggcgcgacgctggccattcacctttcggttcacaatctggcgcaagtggtggcggacctgacgccggcctatggcgcggattgccccgtcgcggtggtctggcgcgccagttggcccgatcagcggatcgtgcgcgccacgctcgacactattgaacaggccatcgccgggagcatggagcgcaccgccctgatcctggtcgggcgggtgctggcggcgcaggattttgccgaaagcagcctctatgcgcccggttatgatcgccggttcaggccgcaggatgccacgtcacgttttggcggtgcggccgaatga

SEQ ID NO: 2332 - DNA, 795 bp, Jannaschia CCS1
atgaccgtgcatttcatcggcgcaggccccggcgcgcccgaccttctgacgctccgcgggcgcgatctgatcgcggcttgcccggtatgcctttatgcgggctcgctggtgcccgaggcgatcctggatcactgcccggagggggcgcaggtgatcaacaccgcgcccatggcgcttgacgatatcatcggctccatcgctgtggcccatgacgcgggcaaagatgtggcccgcctccattcaggcgacctctcggtttggtcagcgatgggggaacagatccgccggttggacgcccttggtatcccctacacggtgacgcccggcgtgccgtcgttcgctgccgctgccgcgagccttggccaggaactgacgcttccgggggtggggcagtccctggtgctgacccgtacaccgggtcgcgcatcatccatgcccgagggcgaaagtcttgagaactttggcaaaaccggcgcgacgctggcgttgcatctgtcgatcggcaacctttcgcaggtcgtggcggatctggtgccgcattacggggcggcctgcccggtggcggtaatctatcgcgcgtcctggcccgatgagaagattgtccgtgcccgccttgggaccctggaagaggccatggaccccggcatcgcgcgcaccgccctgatccttgtcgggcctgccatcggggccagtgacttcaccgaaagccgcctttacgccgccgactacgaccgccgataccggccccagacggccgaaagcccctggtccgaatggcagcatggagatgactga

SEQ ID NO: 2333 - DNA, 780 bp, Rhodopseudomonas palustris BisB18
atgacggtgcatttcatcggcgccggccccggcgcgccggacctgatcacggtgcgcggacaaaacctggtcgcgcgctgcaaggtgtgcctgttcgccggctcgctggtgccgcgcgagatcgtggcactgtgtccgcccggcgcgcgggtgatcgacaccgcgccgctcgacctcgacgccatcgtcgcagaattcgtcgccgcgcatgacgcgggcctcgacgtggcgcggctgcattccggcgacctgtcgatctggagcgcgatgggcgaacagatccgtcgccttgaggcgctcggcattccctacacggtgacgccgggcgtgccggcgttcgctgccgccgccgccgtgctcggacgcgagctgacgctgcccggcgtggcgcagaccgtggtgttgacccgcacctcggggcgggcctcggcgatgccgtcgcgggaaaatctcgcggcctatgcggccactggtgcgacgctggcgatccatctgtcgatccacgtgctcgacgaggtggtagcgacgctgcggccgcattacggcgcggacggcgccattgcggtggtggtacgcgcgacttggccggaacagatcgtgttacgcggcacgctgtcgagcatcgccgataaagtacgcagcgccgcgatcgagcgcaccgcgctgatcctggtcgggccggcgctcgccaccaccgatttcgccgagagcgcgctgtattcgacggattacgatcgcaggtttcgtcccaattcgcagaccggactgatccgtgagtaa

SEQ ID NO: 2334 - DNA, 780 bp, Rhodopseudomonas palustris BisB5
atgactgtccatttcatcggtgcgggacccggcgcgcccgacctgatcaccgtgcgcggccgcgatctggtagtgcgctgcccggtctgtctctacgccggctcactggtgccgcgcgagatcgtcgcgctgtgtccgccggacgcgcgggtgatcgacaccgcgccgctcgatctcgacgccatcactgcggagttcatcgccgccgccgcagccggccacgacgtggcgcggctgcattccggcgatctgtcggtatggagtgcgatgggcgaacagatccggcggctcgaacagcacggcattgcctacacggtcacgcccggcgtgccgtcattcgcagcggcggcggcgttgctcggccgcgagctgaccttgcccgaagtggcgcagaccgtggtgctgacccgcacctccggccgcgcctcggcgatgccgccgcgcgaaacgctggaagcctatgcggcgaccggcgcaacgctggcgattcatctgtcgatccacgtgatcgatgacgtggtcgagcggctccgcccgcattacggcgacgacggcgcggtggccgtggtggtgcgcgcgagctggcccgaacagcaggtgatccgcggcaccttgaacacgatcgccgcgcaggtcgccgccaccggcatcgaccggaccgcgctgatcttggtcgggccggcgctcgccgcctccgacttcagagacagcgcgctgtatgaccgcggctacgaccgccgctatcgccgctcggcggaggacggccgtgatcacgactaa

SEQ ID NO: 2335 - DNA, 795 bp, Ruegeria sp. TM1040
atgaccgttcattttatcggtgccggacccggcgccgccgacctcattaccctgcgcgggcgtgatctgatcgcggcctgccctgtgtgtctttatgcaggctccctggtgcctgaagctctcctgagccattgccccgagggcgccaagatcatcaacacggcccccttgtcgctggatgagatcatggcagaaatcgcaagcgcccatgcccaaggccatgacatcgcccggcttcattcaggtgatctgtcggtctggtcggcgatgggcgagcagctgcgccggctgcgcgatctcgacatcccctatgacatcacccccggtgtcccagcctttgccgcaggggctgccgcacttggcaccgagctcacgctgccgggcgtggcgcaatcgcttgtgctcacacggacgtccgggcgtgcctctgccatgcccgagggcgagacgctggagaactttgccgccaccggcgccaccctcgcgatccacctctcggtgcatgtccttgatgatgtggtggcccggctcacacccgcctatggcgcggactgccccgtggcgatcgtctggcgcgccagctggccggatcaaaagatcgtcaaagccacgctcggcaccgtcatcgaggcgacggacggcgctcgcggacgcacgtcgctgatcctcgtcgggcgcgccctcggcgcggaggactttgcggaaagctgcctctatggcgcggaatatgaccgccgctatcgtccgcaaagtgccgacagcccctggtcggaatggagcgaaggcgatgattga

SEQ ID NO: 2336 - DNA, 783 bp, Rhodobacter sphaeroides 2 4 1
atgaccgtgcatttcatcggagcgggccccggagcgcccgacctcatcacgctgcgcgggcgcgacctgatcgccgcctcgccggtctgtctctatgcgggctcgctggtgcccgagggcgtgctggcccattgcccgcccggctgccgcatcgtgaacacggcgccgctcagcctcgaggccatcgtggaggagatcgccgccgcccatgccgagggcaaggacgtggcgcgtctccattccggcgatctctcggtctggtcggcgatgggcgagcagctgcgccggctgcgcgcgctgggtattccctatgacgtgacgccgggggtgccctccttcgccgcggccgcggccacgctcggggccgagctcacgctgccgggggtcgcgcaatcggtggtgctgacccgcacctcggggcgtgcctctcccatgcccgagggcgagagtctcgcggccttcgcggccacgggcgccgtgctggcgatccatctttcggttcatgtgctggggcgcgtcttggccgagcttctgccgcattacggcgcggattgcccggtggccgtggtctggcgcgcgagctggcccgacgagcgggtggtgcgcgcgaccctgggcagtctcgaggccgcgctcgggccggagctggagcggacggcgctcattctcgtgggccgcagtctcggcgcggaggatttcgccgagagccgcctctatgccggcgactacgaccgccgctaccgccccgtgggcacccatccgcgctttccggaggaggcatga

SEQ ID NO: 2337 - DNA, 774 bp, Paracoccus denitrificans PD1222
atgaccgtccatttcatcggcgccggcccgggcgcggccgacctgatcaccctgcgcggccgcgacctgatcgcgtcctgcccggtctgcctttatgccggctcgctggtgccgcaggcgctgctgggccattgcccacccggcgcgcggatcgtgaacaccgcgcccatggacctcgaccagatcgtcgccgagatcgccgccgcgcatcaggcgggccatgacgtggcgcggctgcattcgggcgacctgtcggtctggtcggccatgggcgagcaactccgccggctgcgcgagctgggcatcccctatgacgtgacgcccggcgtgccgtcattcgccgccgccgccgccgcgctgggggccgaactgaccctgccgggtgtggcgcaatcggtggtgctgacccgcacctcgggccgcgcatcggccatgcccgagggcgagacgcttgccaatttcgccgccaccggcgccacgctggcgatccacctgtcggtgcatgtgctggaccgcgtgcaagcggaactggtcccgcattacggcgccgattgcccggtcgccgtggtgttccgcgccagctggcccgaccagcgcatccaccgcgccacgctgggcacgctggaccccgccatcggcgagggcgagcgcacggcgctgattctggtcggccgggcgctggcggcggagggtttcgacgaaagccgcctctatgccggcgactacgaccgccgctttcgccccgtcggcaccgcaccgaggttcccggaatga

SEQ ID NO: 2338 - DNA, 783 bp, Rhodobacter sphaeroides ATCC 17029
atgaccgtgcatttcatcggagcgggccccggagcgcccgatctcatcacgctgcgcgggcgcgacctgatcgccgcctcgccggtctgcctctatgcgggctcgctggtgcccgagggcgtgctggcccattgcccgcccggctgccgcatcgtgaacacggcgccgctcagcctcgaggccatcgtggaggagatcgccgccgcccatgccgagggcaaggacgtggcgcgtctccattccggcgatctctcggtctggtcggcgatgggcgagcagctgcgccggctgcgcgcgctgggtattccctatgacgtgacgccgggggtgccctccttcgccgcggccgcggccacgctcggggccgagctcacgctgccgggggtcgcgcaatcggtggtgctgacccgcacctcggggcgtgcctctcccatgcccgagggcgagagcctcgcggccttcgcggccacgggcgccgtgctggcgatccatctttcggttcatgtgctggggcgcgtcttggccgagcttctgccgcactatggcgcggattgcccggtggcggtgatctggcgcgcgagctggcccgacgagcgcgtggtgcgcgcgaccctgggcagtctcgaggccgcgctcgggccggagctggagcggacggcgctcatcctcgtgggccgcagtctcggcgcggaagagttcgccgagagccgcctctatgccggcgactacgaccgccgctaccgccccgtcggcacccatccgcgctttccggaggaggcatga

SEQ ID NO: 2339 - DNA, 783 bp, Rhodobacter sphaeroides ATCC 17025
atgaccgtgcatttcatcggagcgggccccggagcgcccgacctcatcacgctgcgcgggcgcgacctgatcgcggcctcgctggtctgcctctatgcgggctcgctggtgcccgagggggtgctggcccattgcccgcccggctgccggatcgtgaacacggcgccgctcagcctcgacgcgatcatcgacgagatcgccgcggcccatgccgagggcaaggatgtggcgcggctgcattcgggggatctttcggtctggtcggcgatgggcgagcagctgcgccgcctgcgggcgctgggcatcccctatgacgtgacgccgggcgtgccctcgttcgccgccgccgcggcgacgctcggggcggaactcaccttgcccggcgtcgcgcagtcggtggtgctgacccgcacctcggggcgcgcctcgccgatgcctgaaggcgagagccttgcggccttcgccgccaccggcgcggtgctggcgatccatctctcggtgcatgtgctggaccgggtgatggcggatcttctaccgcattacggcgccgattgcccggtggcggtcgtctggcgcgccagctggcccgacgagcgggtggtccgcgcgacgctgggcacgctgcaggcggcccttggcgccgagctggaccggacggcgctgatcctcgtggggcgcagcctcggagccgaggatttcgccgagagccgcctctatgccggcgactacgaccgccgctaccggcccgtgggcacccatccgcgtttcccggaacaggcatga

SEQ ID NO: 2340 - DNA, 879 bp, Delftia acidovorans SPH-1
atgaccgtgcatttcatcggcgccggccccggcgccgccgacctgatcaccgtgcgcgggcgcgacctcatggcggcctgtccggtctgcctgtacgcaggctcgctgataccgcgcgagctgctggcgcactgcccgccgggcgcgcgcatcgtcaacaccgcctccatgagcctggacgacatcgtggccgagatccaggccgccgaggcgcgtggcgaagacgtggcgcgcctgcactcgggcgacctgtccgtctggtcggccatgggcgagcagctgcgccgcctgcgcgaggccggcattgcctacaccgtcacgcccggcgtgccctcgttcgcggccgccgccgccacgctgggcgcggagctgaccctgcccggcctgtgccagtccgtggtgctgacgcgcacctcgggccgcgccacggccatgcccgagggcgagaacctggccgccttcgcggccacgggcgccgtgctggccatccatctgtccatccatgtggccgccaaggtgcagtccgagctgctgccgcactacggcgccgactgccccgtggccatcgtctggcgcgccagctggcctgacgaaaccgtggtgcgcaccacggtgggcggcctgaccgaggccgtggccacccacatggagcgcacggccctgatcctggtgggccgcagcctgcaggccgaggacttcggcgaaagccgcctctacgcggccgactacgaccgccgctaccgcccgctgggcaccgagccgcgctttcccgccaccgatgtgcatgcgaatgccgcgctggataccgcgagggataccttgagggacaccgtgagcgacaccgtgatcgacgtgccccccgggagccccgccccatga

SEQ ID NO: 2341 - DNA, 780 bp, Rhodopseudomonas palustris TIE 1
atgaccgtccacttcatcggcgccggccccggcgcgcccgacctgatcaccgtgcgcggccgcgatctggtaatgcgctgtccggtgtgcctctatgccggttcgttagtcccacgcgagatcgtggcgctgtgcccgaaggacgcgcgcgtggttgacactgcgccgctcgacctcgacgccatcaccgcggagttcgtcgccgccgcggaggccggccacgacgtcgcgcggctacattccggcgatttgtcggtgtggagcgcgatgggcgaacaaatccgccgcctggagcagcacggcatctcctacaccgtcacgcccggcgtgccgtcgttcgcggcggccgccgccgtgctcggtcgcgaactgaccttgccggaagtcgcgcagaccgtggtgctgacccggacctcgggccgcgcatcggcgatgccgccgcgcgagacgctggaagccttcgccgccaccggcgcgacgctggcgatccatctgtcgatccacgtaatcgccgacgtcgtcgaacggctgcgcccgcactatggcgacgacggtgcggtcgcggtggtggtacgcgccagctggccggagcagcaggtgatccgcggcacactcagctcgatcgccgcgcaggtcgccgccgaaggcatcgaccgcaccgcgttgatcctggtcggcccgtcactcgccgccaccgacttccgcgagagctcgctctacgcacccgactacgatcgccgttatcgccgctcggcggaggacggccgtgatcgtgactga

SEQ ID NO: 2342 - DNA, 783 bp, Methylobacterium chloromethanicum CM4
atgaccgtccatttcatcggcgccggccccggcgccgccgacctcatcacggtgcgcgggcgcgatctcatcgccgcctgccccgtctgcctctacgcgggctcgctcgtcgcgcccgagatcctgcgctggtgcccgcaaggcgcccgcatcgtcgacagcgcgcccctcgacctcgatgccatcgtcgccgagtgcgcccgcgcccacgcggcggggcaggacgtcgcccggctgcattccggcgacctctcgatctggagcgcgctcgccgagcagacgcgccgcctcgacgcggccggcatccccttcaccgtgacgccgggcgtgcccgccttcgccgctgcggccgccctgctccggcgggaactcacggtgccgggccttgcacaatccgtcgtcctgacccggacctcgggccgcgccagcgccatgccggagcgcgagacgctggcggccttcgcggcgacgggggcgacgctcgcgctccacctctcgatccacgtcgccgagcaggtcgtcaccgagctgacccccttctacgggccggattgccccgccgcggtggtgttccgcgccacctggcccgacgagcgcgtgatcaccggccgcctcgccaccctcgcccaggcggtcgccgaagcggggctggagcgcaccgccctgatcctcgtcgggccggcgctcgcggcgcgcgatttccgcgagagcgccctctacgcaagcgactacgaccgccgcttccggtcggtgggcgcagcacccatccggaccgcgccatag

SEQ ID NO: 2343 - DNA, 858 bp, Rhodospirillum rubrum ATCC 11170
gtgacggcctccgccgatccccgcagcctgctcgccccccttggtcaggcgatcgccgaaggccggctgatccccttcctcgggccagaccttctggaaaccggcgaggccgaatgcccggtccccacctcgacccgggggttggtcgagcggctgacggcgcgggtgggcgtgcccgggcgcattcgcggcaacctgtgggccagcgcccaatacatcgagacctaccgccatcgcaccaccctggtgaagctgatgacggagatcttcaagcaaacgccgccggtcggcccgctgcaacgctggttggccgggctgccggggctgccgctgatcgttgacagctggtatgacgccaccctgagcgaggccttcaaggaccgcaacgactgggggcaggttcaggccgccagccgccacggcttggccgaagtggtgttcctgcgcgccatatccgccgccggcgtggaggttcccctggacgcggcggcggcgtggaagacgctgatctacaagccgcacggcgcaatctggccgctagccgacatgctggtcagcgacagcgattatgtcgaggccctgaccgagatcgacatccagacgccgatcccggtggctgttcaggagatccgggcgacgcgcggcttcctgttcctgggctgccgcttccacgaccagatgctgcgcatctatgcccgccagatcctcaagcgctcggccggcccccattacgccctgctgcccgaggacctgacccgcaacgaactgcgcttcctggacgaactctcgatcacccccctgttcctcgatctagaaacggccattcccctgctgaccgggggggatgggggcgggtga

SEQ ID NO: 2344 - DNA, 831 bp, Rhodobacter sphaeroides 2 4 1
atgacgcgcgagatgctgcgcgtggcgctcgaagcggtggggcagggccgggtcgtgccctatctggggccgggcgtggccgcgctcggcggggcgctcgccgcgcccgccgcgctctcggcccggatcgaggccgaggtgcgggtgccccggcgcgcgcagggcaatctctgggccgcggcgcagttcgtcgagacgcgccgcttccgcgccacgctcgaggccatggtggtgaaggccttcgccgcgcccacggggccgaacccgatccacgactggctcgccgcggtgcgcccgccgatggtggtcgatgcctggtacgatgcgggcctcgtgcgccgcttccggcagggggcgcccgactggggcctcgtgcagggcgtcagccgcaacggcgaatgggccgagatctggcaccgcgcctacgacgcggccgacgcgctctgttccgcggccgatcccggctggcggagcctcctctacaagccgcacgggatggcggtgccgggccattccttcctcgtctccgacagcgactatgtcgaggtcctgaccgagatcgacatccagagcccgatccccgaggaggtgcagaaccgccgcaccggccgcggtttcctcttcctcggctgccggttcgacgaccagctcctgcgcacctacgcccgccagatcgcgaaacgctcggcgagggggcatgtggcggtgatcgagggcccgctcacccgcatggaacggctcttcctcgaggaactggccatcgagcgcatcgatctgccgctcgaggcggtggtcgaggagctgaaggcctcgggcgcgcacgccgcctga

SEQ ID NO: 2345 - DNA, 831 bp, Rhodobacter sphaeroides ATCC 17029
atgacgcgcgagatgctgcgcgtggcgctcgaggcggtggggcagggccgggtcgtgccctatctggggccgggcgtggccgcactcggcggggcgctcgcctcgcccgccgccctctcggcccggatcgaggccgaggtgcgggtgcccaggagcgcgcagggcaatctctgggccgcggcgcagttcgtcgagacgcgccgcttccgggccacgctcgaggcgatcgtggtgaaggcctttgccgtgcccacggggccgaaccccgtccacgactggctcgccgcggtgcgcccgccgatggtggtggacgcctggtacgatgcgggcctcgtgcgccgcttccggcagggggcgcccgactggggcctcgtgcagggcgtcagccgcaacggcgaatgggccgagatctggcaccgcgcctacgacgcggccgacgcgctctgtcccgcggccgatcccggctggcggagcctcctctacaagccgcacgggatggcggtgccgggccattccttcctcgtctccgacagcgactatgtcgaggtcctgaccgagatcgacatccagagcccgatccccgaggaggtgcagaaccgccgcaccggccgcggtttcctcttcctcggctgccggttcgacgaccagctcctgcgcacctacgcccgccagatcgcgaaacgctcggcgagggggcatgtggcggtgatcgagggcccgctcacccgcatggaacggctcttcctcgaggaactggccatcgagcggatcgatctgccgctcgaggcggtggtcgaggagctgaaggcctcgggcgcgcacgccgcctga

SEQ ID NO: 2346 - DNA, 834 bp, Rhodobacter sphaeroides ATCC 17025
atgacgcgcgagatgctgcgggtcgctctcgaggcggtggggcaggggcgggtcgtgccctatctcggcgccggggtcgcggcactcggcggggctctcgcctcgcccgcggcgctctcggcccggatcgaggcggaggtgcgggtgccgaaacgcgcgcagggcaacctctgggccgcggcgcaattcgtcgagacgcgccgcttccgcgccacgctcgaaaagatggtggtcgcggccttcgctccgcctcccgggacgaacccgatccatgactggctcgcgctcgtgcgcccgccgatggtgatcgacgcctggtatgatccgggcctcgtccgccgcttccgcgagggccccgccgactggggcctcgtccacggagtcagccgcaacggagaatgggccgagatctggcatcgcacctacggcccagacgacagtccgctgccccagggagccgatccgggctggcgcacgctcctctacaagccgcacggcgtggcggttcccggacattccttcctcgtctccgacagcgactatgtcgaggtcctgaccgagatcgacatccagagcccgatccccgaggaggtgcggagccgccgcaccggccgcggcttcctgttcctcggctgccgcttcgacgaccagctcctgcgcacctacgcccgccagatcgcgaaacgctccggacaggggcatgtggcggtgatcgagggcccgctcacccgcatggagcggctgttcctcgaggaactcgccatcgagcgcatcgacgtgccgctcgaggccgtgatcgaggagttgaagaccctgggcgcgcccgccgcctga

SEQ ID NO: 2347 - DNA, 867 bp, Bradyrhizobium BTAi1
atgaatgcgccgcttcctcatatcgacatcgtcaagcaggccgacgccgaggcgctgctgaaggacgttgtcgcccggctaaaggccggccaggtcgttccattcctcggccccgcggtctcggaacagtccggtgccccggtgccgatgaatccggaagcgctcgcggcgttcttcggcaccaaggtggcgctgccgcgccgggccaagggcaatgcctgggcctccgcgcagcatatcgagagcacgcgccaccgttccaccgtgacggcgctgatggcggaggcgttcgcagcccccgtcgcgccgacgccgttgcagcagtacctcgcatcgctgccgctgccgatgatcgtcgacagctggtatgacggcgcgttgcggacggcgctggccggacgcggcgattggggcgaggtgcagggcatcacccgcgccggcatcggcgaggaccgctggtatcgcttctacgacgctgaaggcgccgaggccgaccgcgagaaggcgagtggctggaccacgctgctctacaagccgcatggcggcatcacgccggccaagaacttcctgatcaccgacgccgactatgtcgaggtcctgaccgacatcgacatccagacgccgattcccgacaccgtgaaggatcggcgcaccgatcgcggcttcctgttcatcggctgccgcttcaacgaccagctgctgcgcacctatggccgccaggtcatcaagcgctccggcacggagcattacgtcctggtcgagccggactcgctgtcgaagaacgagctgaaattcttcatcgccgagcggctgacgccgatcgcgattccgctcgcacgggcgaccgagatcatcatcggcggctga

SEQ ID NO: 2348 - DNA, 873 bp, Xanthobacter autotrophicus Py2
atgaatatttccgtcgccaatatcgagacgctgaagctcgccgacgccgaagccgtcctgaaggacgtggcggcggagctggtcgccggcaaggccgcgccctatctggggcccggcctgctggagctgtcgtcgcccgccattccggtaacgccggagggccttgcggcctttttcggcaccaaggtggcactgcccaagcgcgccaagggcaacgcctgggcctccgcccagcacatcgagagcatgaagcaccgctccaccgtgtcggccctcatggccgaggcgttcgccccgcctgtgccgccgctgccgttccacaccttcctcgccggcctgaacctgccgctgatcgtggacacctggtacgacggcgccatgcgttcggcgctggagggccgggagggctggggcgaagcgcagggcatcacccgggctggcatcggcgaggatcgctggtatcgcttctatgatgctgccggcaacgagaccgaccgggcggcggccgagacctggacgaccgtgctctacaagccccacggcagcgtcgcgccggccaagaactggctgatctccgacgccgactatgtcgaggttctcaccgagatcgacatccagacgccgatccccgacgtggtgaagaaccgccgcaccgagcgcagcttcctgttcctcggctgtcgcttccacgaccagatgctgcggacctatgcgcgccaggtgacaaagcgttcgcgtctgccccacttcgccatcgtggacgaagcggtgctgaccaagaacgagctgcgctttctgctgacgcacgccatcacgcccatcgccatgccactgcccaaggcgctggacatcatcatgtcggtcgccgcctga

SEQ ID NO: 2349 - DNA, 894 bp, Methylobacterium sp. 4-46
atggacccgtcgatccaggcgccgcccccgctcgccgcgccccgctccctcgccgcgccggacggcctcgcgccgctgcgggaggccgcggcgctgctcgcggacgaccggctcgtgccctatctcgggcccggcctccaggccgccgcgggcgcgggcggcacggtgccgctgagcccggaggcgctcgcggcggcgctcggccagcggcaggcggcgccgggccggatccgcaccaacctctgggccgtggcgcagttcatcgagcagcgccgccaccgccgcaccctcgccgcctggatggccgagatcttcgcgcccccgctcgccccgaccccgttccagaccgcgctggcggggcgcggcctcgggctgatcgtcgacacctggtacgacggcgcgctgcgggcggccttcgcggcgagcggccggacggattggggcgagatccagggcatcacccgggccggggcgcatcgggacgtctggacgcggggcttcgacgcggccgggacgccggtcgacgaggcggcctcgcgcggctgggtcactctgctctacaagccccacggcgccgcccgcccgccgggccaggccctggtcgccgacagcgactacgtcgaggtgatgaccgagatcgacatccagacgccgatcccggtcgaggtgcgcgcgcggcgcgtgagccggggcttcctgttcctcggctgccgcttccacgaccagatgctgcggacctatgcccgccagatcatgaagcgctcggccgggccgcatttcgcggtgatgaccggggcggacctcacccgcaacgagcggcgcttcctggacgatgccgggatcacgctgctcgacctgccgctcgccccggcgctggagcggctggtcgggtga

SEQ ID NO: 2350 - DNA, 828 bp, Gluconacetobacter diazotrophicus PAl 5 JGI
atgacgccggtcatcgacgacatcctggcgggcctgcgcgccggccggctggccccgtatctgggcccgggcgtcaccgccatggccgacggcgtgcccgttcccgccagcccggccgatctggccgcgttcctgggcaagcgggtcgcgctgccgaagcgcgcgcgcggcaacccgtgggccgcggcgcagtatatagaaagcaaccgccatcgttcgaccctgacggcgctgatggaccaggcctacgccgatcccgtgccgccgggggacctgcaccggatgctggccggcttccgcccgccgctgatcgtcgatacatggtacgacggcgcgatgcgggcggcgctgacggagtgcggcgcgggcgaatggggcgaaatccagggcatcacgcgtgcggggatcggcgaggcacgatggtatcgcgcctacgacgccgacgggaccgaagtgccgatggaccaggccgaaggctggcgcacgatcctctataagccgcacggcgccgtcacgcccgcgcggaactacatcatcgcggattccgactatgtcgaggttctgacggaaatcgacatccagacgccgatacccgacattgtccgaaagcgccggacggattgcggcttcctgttcctggggtgccggttcgacgaccagatgctgcggacctacgcacgccagatcatgaagcgctcggccggtccgtattatgccgtcctcgacacgaccctgctgtcgcggaacgaacggcgttttctcgacgacatgcacatccagccggtcggcgttccgcttccggcggtatcggcgctgctggcggcctga

SEQ ID NO: 2351 - DNA, 263 bp, Methylobacterium nodulans ORS 2060
atggactcgtcgatcctgaagccgcaggccccgatgcgctcggtcgctgccctcctgcgccaggaccggctcgtgccctatctggggccgggccgggcgcgggcggcaccgtatcgctgagcccggaggcgctggcggcgtccctcggccagcgtcgggcggcgcccggccggatccgcaccaatctctgggccgtggctcagttcatcgagcagcggcggcaccgccggacctatcgcaaaatacagcataggtgcttcgga

SEQ ID NO: 2352 - DNA, 3087 bp, Methylococcus capsulatus Bath
atgctgggcgccttggtccgcttcgcggtgtgccgcagcggtgtcgtgatcgcgctcgcggtgctgctggcggcctacggcctgtaccgtgcagcgacggcgaaactagacatctttcccgaattttccgccaagcgggtggtggtgcagaccgaagccccgggcctcaccacccggcaggtcgagatcctcctgaccctacccatcgagcgaaagctggccggcatcgtcggactggaaaccctgcgctcggagtcgatccagggcttgtcggtggtaacggcggtattcgccgaggaaaccgacatctaccgcgaccggcaactggtgagtgaacgcttggcgctgctggccggtcagcttccggaaggcgcggggacgccggtcctggtgccgttgtcctcctcctcggcgacggtgcagacgttcggcttgacttcggagaccctcggccccatggaactgcggacgctggcggactgggtgatgacgccgcgcctcctcgccgtgccgggagtcgccgacgtcaatgtcttcggtggcgcagtacagcagttgcaggtggaagtcgatcccgcacggctcaagcgcttcggtctcgacctcaacgccgtgagcctggcggtgcgccagtcgttccgcacccagggcgccggcttcgtggagaacgagaaccagcgtttggcccttcaggtcacgggcctcccgctcggtccggaaagcctcggcaacgtcatcctcaaccgttcgcccggcgcggtgctcaagctgcgggacgtcgggacggtccgtttcgggcccaggccgccgatcggcgcggccgcggtcaatggcgccgccgggatcgtcatgatggtgatcggccagtatggcgccaacaccctcgaggtatcgcgcggcgtggaacgcggcctggcggaactcgccccgatgctcgccgcacgaggcgcgacactgcatcccagactgttccgccccgccgactatatcgagcgggctctggacaacctcggcgctcacctgctggcgggcgggctgctggtgatggcggtactctacgccttcctgtatgaccttcgcaccgctctgatctcggcagtggcgatcccgctttcactgctgggcgccttcgtggtgctccaggctttcggtgtcagcctgaacctcatggtgctgggaggactggccatcgccttgggcgaagtcgtcgacgacgccatcatcgacaccgagaacatcttccggcgactgcgggaaaaccgcgccactgccgccccccgccccgcgctcacggtcgtttacgaggcatcactggaagtccgcgggtcggtggtctacgccagcttcatcgtggccctagtattcctgccgctgctgggattgggcggcgtcgccggccgtctgttcgcgccgctcggctacgcctacatcatcgccatcctgatctcgctggcgaccgcactgacggtcacgcctgcgctttgcgtcgccctgctgacaggttcgaaagaggcggcggaaacgccgccgctgatccgctggctgcaaccgctttatggacgctggctgcggtgggccgcgaggcagccggcccggctcgcggccggcagcctcgcggcctgccttctggcgaccgcgttggcccctgggctgggcggggacttcctgccgcacctgcgcgaggggcactacatcgtgcacaccacgagcctgcccggcacctcgctgcaggaatcactgcgccttggcggactggtcgtccgcgagatcctgcggatccccggggtggaatccgtctcgcaatgggcgggacgggccgagcgcggcgccgatacctacggcagccattacagcgaatacgaggtgcgcctccaaccgatgtccggcagcggacaacagaaggtgctggagcggctgcgcggactactggagggcttccccgggatacgggccgaggtgaacaccttcctcaccgaacgggtcaacgaaacgatttcgggctacacctcgccggtcgcagtcaatctgtacggtgacgacctggatctgctggaccggaaggcgcgcgagctcgccgacgaaatcggcaggatggctggagccacggacgtgcagctgcggtcgccgcccggctcgccgctggcggaaatccggctgcggcccgatcagctccaggtgtggggactacgtccgggagacgtcatggatgccgtcgacaccgctttcgccggccggaccgtcggccacttccccctcggccagcgtatcgtcgaaacgtccgtcatcctccggccggatttgcggcagtcgctcgacagcctgcgcgaactgccgctcaaaagccaggacggtacgctcgtatccctcggcgaggtggccgaaatctccgaaaccggggatcgctacaacatcctgcaccgcggcggccgccgcatccagaccgtgaccgctggcgtcgagggacgcgacctggcctcgttcgtggaggaattgcgggcccggttggatgcggtgctgggacgttcgaccggcgtctatgcggaaataaccggcgccgcgatggaacagggcgtcgcccggcgcgaactgatcgcccgcgcctgcctggctggcggcggcgtgctggtgctcacctatctcgccataggccgtttacgccataccgccatcgtcctggccaacctgccgttctcactggctgggggggtgctggcagcagggatttccggcgccagcctttcggtgggcgcgctggtaggtttcgtgactctgttcggcatcaccgtccgcaacaccatcatgctgctttcgcattaccgtcatctggtcgagagggaaaggcagacatggaatctcgacaccgccgtgcggggtgcccaggaacgcctgccttcgattctgatgacggcgctggtgaccgcgctggcgatgctgcccatcgccagcggcagcgacgacccgggactggaaatcatgggaccgatggctgccatcatcatcggcggcctgctgtcttccacctgcctcaatctcgcgttgctgccggcaatgctgctgcgctggggaggctctttcgaaaaccggtag

SEQ ID NO: 2353 - DNA, 3120 bp, Burkholderia thailandensis E264
atgcttcacgcgatcatccgcttctcgctgcgctttcgcggcatcctctttgcattggccgcgctggcggccggctacggcctttacacgctgacgcgcgcgaagctcgacgtcttcccggagttcgcgccgccgatgagcatcgtgcagaccgaagcgccggggttgaccagcgagcaagtcgaaacgctcgtgacgcagccggtcgaaaacgggctgggcggcatggccgggctgcggtcgatgcgctcgcgatcgatgcagggcctgtcctcgatcacgctggtgttcgacgctcacgcgaacgtgatgcagatacgccagttggtgtccgagcgcgtgaatgcgctggccgcgacgctgccggcgggcgtgccgccgccgcgcctgttgccgctgacgacgaccaccagcgtggtccgcacgatcggcctgacttcccggacgcgctcgctgatggacctgtacgacctggcccagtggacaatccggccgcagttgctgagcgccccgggagtcgccgacgcgatcgtgttcggcggcgaggctcggcaactgcagattcaggtcgatcccgccaagctgatgcgctacggcctgtccatccaggacgtgatcgcggcggcgcgccgctcgagcggcgtgcgcggcgccggtttcatcgagaacgacaatcagcgcatcgcgatcaatgcggacggtcaggtcgcgacgcccgagcgcctggccggcgtcgtgctgcgctggagcaacggcgtcgccgttcacctgtccgacgtcgcggccgtggcctggggcggcgcgccggcgatgggcgcggcgtcgatcatggggcggcccggcatcatgctggtgctcgaaagccagtacggcgcgaacacgctggccgtgacccgccatatcgaccagacgctcgccgcgctcgcgccgatgctggccaaggaaggcgtcgacttgcagccggacgtctttcgtccggccaacttcatcgacgcgtcgatcggacacctgcgtaccgcgctgctggtcggcgcggcgctcgtggtcgcggtgctgtttctgttcctgctcgatgtccggaccgcgatcatatcggcggtcgcgatcccgctgtcgttgctggtcgcgatcatcgtgctgacctcgttcggcgtgagcctgaacacgatgacgttgggcggcctggcgatcgcgctgggcgaggtggtcgacgatgcgatcatcgatgtcgagaacatctaccggcgactccgcgagaatcgcgcccggccaacgccgttgcccgcgtttcgcgtggtgctgcgcgcgtcgctcgaagtgcgaagcgcggtggtgttcgcgaccttcatcgtgatgctgatcttcctgccggtattgacgctctcgggcgtggccggccggctcttcgcgccgctaggcattgcgtacattctcgcggtgctggcctcgctcggcgtcgcgttgacgctcacgccggcgatggcgcttgcgttgctcacgcgcggcgcgctgccggagcacgagccgcgcctgatttcaggcatgaagcggcgctacacggcgctattgctgaaggtcgagcaacgggtgaaggccgtggtggccgcggcggcactgatgtgcgtcgcggcgctcgccgcgctgccgttcatgagcggcggcttcatcccggcgttgcgcgaggggcactatatcgtccacatgggactcgccccggggacgtcgctcgccgaatcgatgcgcatcggcgcgcaggtcacgcaggcgctgatgcgggtgcctggcgtgcgcctggtcgcgcagcgtgtcgggcgcgccaacgaggtggtcgacccgatgggcgtgcagctgagcgaattcgaggtcgatctgaagccgatgggcgcgtccggccagcgcgcgaccctacaccgcatccggcagtcgctcgcgcgcttccccggcctcacgacgtcggtcaatacgttcctcgtcgagcggatcgacgagacgatctcgggcgtgagcgcgccggtcgtcgtcaacgtgttcggcgacgacctcgacgtcatcgaccgcaaggcgcaggagatcgcccgcctgctcgggacgattcgcggcgcggcgagcgtacacgtcgaatcgccccccggcattcccgaactggaaatcagactcgatcccgatcaactgagccgctggggctttcggccggcggacgtgctcgatgcaatccaaagcgcctaccagggcgccgcggcatcgcaggtctatcatggcatccgtgcctacgacgtcgtcgtcattctgtcgcccgccgtgcgccggaacctcgccgacgtgggagcgctgacgctgcgcaatccggacggtctcgcggtgccgttgcgcgcgctggcggccatccgtcaggtgtcgggccgctaccagatcacccatgacggcggccgccgcatgcagacggtttccgtgaccctcggcagccgcgtcgcgagcgatttcgcgaaggaggcgcaggcgcgcgtgaatcgcgagatcgcgatgccgcgaggcacctatgccgtgttctccggcgagagcgaagcgcgcttgcggtcgcagcgcgatctgctgatgtacggcgcgatgtccgccgtcggcatcgcactgctgctgttcctcgcgatgaagagccgtcgcggcgtcgtgctggtgatggttaatctgccgttcgcgctcgtgggaggagtcttgagcgtggtgctgacgggcggcgacctgtcgctgggcagcatggtcggtttcgtcacgctcttcggcatttcgctgcgcaactcgatcatgctgatcagccattacgaacacctcgtacacgtcgaaggcatgccgtggggaatcgataccgcagtgagaggcgcatccgaacggctggtcccgatcctgatgaccgcactcgtgaccgcgcttgcgctgctgccgctcgcgctgacgagcggcgccgccggcaacgagatcgaggggccgatggcgatcgtcatcctgggcggcctggtcacgtcgaccgcattgaacctgatcgtgctgccggcgctcgcgctgcggcacggacgcttcgaacctgacgcgccggccgaaccgctcgctgcgccgtccaaccagtag

SEQ ID NO: 2354 - DNA, 3159 bp, Bradyrhizobium BTAi1
atgattgatggcatgcgtgcggtcgcgggcccgcaggccgcgttgatcgcgttcgcgatccgctttcgtggcatcgtgctggcgttggcctgcacgatcctgggctacggactgttctcactcggcgaggccaaatatggcgtcttcccggaattcgccccgccgcaggtctcgatccagacagaagccccgggcctcagcccggaacaggtcgaggtgctcgtcacccagccgatcgaaacctcgatcaacggcttggccggcgtcgagagcatgcgctcctcgtcgatccaggggctctcggttctttcggtcatcttccagcccggcactgacgtgttcagggcccggcaattggtggcggagcgcctgaccgccatcgtcaacggcctgccgcagggcgtgcgggccccctcgatgaccccgctcgttccggccgccggcaccgtcctcgtcatcggactgacgtcggagcagcgatcgttgatggatctgcgcacgatcgccgactggaccgtgagtcgtcgcctgctcgccgtcgccggcgtggcccaggtcacgacctatggccgggacatccgatcgctgcaggtacaggtgcgcgcggacgacctggtccgcttcggcatcggaatgaacgatgtggtggccgccgcgcgcaaggcaaccggtgtccgcggtgccggcttcgtcgacacggccaaccagcgtgtgatcctgcagacccagggacaatcgctgacaccggagcaactcgcgcgaacggtgctgctgcaccaaagcggcgccagcgttgtgctgggcgacgtcgcaacggtggtgagcgctcctgagccgccgatcggcggggcgctcatcaacggcaagcccggcatcatgatgatgatcagccagcaatatggcgccaacacccgcaacgtcgccgcgcgggtcgaggctgcgctgcaggagctgcgcccggcgctcgacggcgagaaggtccagctgcacgccgatctgtttcgtccggcgaccttcatcgattcggcgattcagaacgtgttgttcgcgttgctgatcggcggtgcgctggtgatcgtcgtcctgttcctgtttctctccgactggcgcacctcggtgatcagttgcaccgccattccgctgtcgctgttctcggcggtcctggcgctgcaatggatggggcagagcctcgatacgatgaccctgggcggcctggcgatcgcgatcggcgaggtggtcgacgatgcggtgatcggcgtcgagaacgtggtgcgacggctgcgcgagaaccgcgcgctgccgtcgccgcgcgctgcggcgcgcgtcgtctacgacgccatgctcgaggttcgcagcgccgttgcgtatgcgaccttcgccgtgctgctggtgttcgtccccatcctcgcactgcccggtcttgccggccggttgttcgggccgctcggcatcgcctatatcctcgccgtgctggcctcgctcatcgtggccctgacggtgacgccggctctggccatgatgctgctggccggccacaagccacgcggcgcgccacgcgagccgccgctggcgcgctggtcgcgccattactatgagcgcctgttgcggcggctcggccgctttcccaagctggtcatggcgaccgccttgctgatcacgctgggaggcgccggcctcgtgccctggttcggcggcaccttcctgcccgacctgaaggaaggccatctgatcctgcacgtgtcgatgctgcccggcacgtcgctcgacgaatcactgcgccttgggacgatgatcgcagaggccctgcgcgcagtgcccgaggtacgcagcgtggcccagcatgccggccgcgccgaggccggcatcgatacggccggcacccattccagcgagatcgaggtcgactttcagccgggcctgtccggcaacgcgcaggagctcgccgaacggcgtatccgcgccgccctcgccaactttgccggcatcaacctgtcgatcaagacttatctcacggagcgcatcgaggagaccctgtccggcttcaacgctgccgtggtcatcaacgtgttcggccctgatctcgacgacctggagactgcggcgcgcgacattgcgcgcgagctcggcgaggtctggggcgccatcgacatccagcagcaatcgccgccgggcatgcctcaggtcaacgtcacgctgcgcccgaccgacctgcaatcctggggcctcgacgccgtcgaagtcctggagctgatccgcaccgcctatcaaggcgacgtggtcggccaggcctatgaaggcaacgtcgtcttcaacgtgatcgtcaagctcgatccggaggcgagcgcgcgcccgatacagatcggggacatgccgatccgtacgccgagcggcgcctatgtgctcctgaagcaaatcgccgacgtctacgggacgtcggggcgctatgtcgtgctccatcgcaatggtcagcgcgttcagacggtgaccgcgaacgtggccgagcgggatctcgaatccttcgtggccgccgccaagaggaagattgccaaggaggtcaagctgccgcctggcgcccatgtcgagttcaccggagccgccgaggcccaggcgaaatcgcgccgtgatctcgtcgtcaacgcctcgctggcgacgctcggcatcgtgctgctgctcgcgctggtcaccaagcattggcgcaatctcgccttggtgctgatcaatcttccgttcgcgttcgtcggcggcgtggtcgcggtcgcgctgaccggcggcgtgctgtcgctcggatcgatggtgggattcgtgacgctgtttggcatcgcgctgcgcaactcgatcctgatgatttcgcactacgagcacctggtcgcggtcgaaggccgcagctggagcctcgatctggccatccagggcgcggccgaccggctcgtcccgatcctcatgacctcgctggtgaccggcctcggcctcctgccgctggcgctcggtgccggcgagccgggccgtgaaatcgagggaccgatggcgatcgtcatcctcggcgggctgctgacctcgatggcgctgaacctgctggtgctgccgacgctggccgtccgcttcggccggttcgtggccgatcccgccagcccggcccccggcctcgccacgccggggtga

SEQ ID NO: 2355 - DNA, 3195 bp, Methylobacterium extorquens PA1
atgctcgaccaacggcccgcacgcggaccggcgcgcgatgacccgccgggcccgcctccgccggccctctcccccgcgtccgtcgcttcgggccctcaggccgccctagtcgccttcgcggtgcgccggcccggtatcgtcctggcgctggtcctggcgctcgccgtctacggcatcgtcgccctgggttcggccaaatacgacgtcttcccggaattcgctccgcccacggtgacggtgcagaccgaggcgcccggcctcaaccccgagcaggtcgagacgctggtgacgcagacgctggaggtcgcgatcggcggcctgccaggactggcaacgatgcgctcgaactcgatccagggcctctcggtcatcaccgccaccttcgcctccggcagcgacatctaccgggcgcgccagctcgtgaacgaacgtctggcctccatcaccgcgcgattgccgcagggcgtgctgccccccaccatgacggcgctgacctcctcgacgagttcggtgctcctcatcggcctgacctccccgacgcagtcgctgatggagctgcgcacggtggccgattggcgcctgcgcctgcgcctgctcgccgcccccggcgtcggcgaggtgctggtctatggcggcgatctccgctcgatccgcatccaggtccggccgcaggatctggtacgcttccgcatcggcctgaacgacgtgctctcggccggccgcaaggcgacgggcgtgcgcggggcgggcttcgtcgataccgtcaaccaacgcatcactctgcagaccgaagggcaatccctgaccccggaggcggtggcgcgcaccgtgctcatcaacgagggcggggcgagcgtggtgctcggcgacgtcgccgacgtggcggtggcgccggaaccggcgatcagcgcggccctcgtcgatggcaaaccgggcgtgctgctgatggtcggcgcgcaatacggcgccaacaccctcgacgtgacggccggcgtcgaggcggcgctcgccgagatgcgccccgggttggagcgcgacggcatcaccctgcgcaccgacctgttccgtccggcgagcttcgtcacgcaggccaccgacaacgtggtccaggcgctggcactcggcggcatcctcgtcgtcgtcgtgctgttcgtcttcctggccgattggcgcacggctctaatcagcgccacggcgatcccgctctccctgatcggcgcggtgctgatgctcggcctgttcgggcagagcctcaacaccatgacgctgggcggcctcgccatcgccatcggcgaggtcgtggacgacgcggtgatcggcgtcgagaacgtcatgcgccgcctgcgcgagaaccgccgcgccgccgtgcccttacccggcgcgcgggtggtgctcgatgcgatcctggaagtgcgcgtctcggtcgcctacgccaccttcgcggtgctgctcgtgttcctgccggtgctggcgctgaccggtgtgcccggccggctgttcggcccgctggcgctggcctatatcctcgccgtgctgacctcgctcgccgtggcgctgacggtcacacccgcgctggcccgcctgctgctcgccgggcgcaccaacctgccgagccgcgagccgccggtgagccgccgcgtgcggggcgtctatatcagcgggctcgcgcggctcaaccgtcacccgcgtctcgtcttcgggaccagcctcgccctgacgctcgtcgcagccctgccggtgccgttcttcggcggcgtgttcctgccggacctgaaggaggggcacctcatcctgcacatggcgtcggcccccggcacctcccttcaggagacgctgcggctcggcgagcgccttacggcggggctgaaggcggtgcccggcgtgcgcgcggtggcccagcaggtcgggcgcgccgaagcgggctacgatctcggcggcacgcatgacagcgagatccatatcaatctcgaaccgggcctcgacggggaggggcaggagcgggcggaggccggcatccgcgcgctgatggcggcgacgcccggcgcgagcttttcgcttaagaccttcctgaccgagcgcatcgaggaggtcgtctcagggttcaccgcgccggtcgtgatcagcgtcaccggcacgaatctcgaccggatcgaggccaccgcccgcgacgtggcgcgcgaactcgccgaggtgcgcggtgcggccgacgtccagctcaagtcgccgccgggcctgccccaggtcaatgtgagcctgcgcccgaccgacctgcgccactggggcctcgacgcgatcgaagtcctggaaatcgtgcgcacggcctatcagggcgacatcgtcggccaagcctacgagggcaacgccgtgttcaacgtcgtcgtggtgctcgaacccatcgtgcgcacgcgcctctcgacgctcggcaacctgccgctgcgcacgccgagcggcagctacatccggctcgcccaggtggccgacatctacgagaccgccggccgctacgccgtcggccatatcggcgcgcagcgggtgcgggtcgtgaccgcgaacgtggaggggcgcgacgtcgcctccttcaccgaggccgcgaaacgcaagatcgcccgcgaggtcgcgcagccctcgggcatcgatatcgggttcgggggggcggccgagacgcaggcgaaggcgcggcgcgaactcgcgctctacgcaggtctcgccggtctcgggatcgtgctcctgctcctcgtcgtgacgggctcgttgaccaatctcgccctcgtcctcgtcaatctgcccttcgccttcgtcggcggcgtgctggcggtggccttgagcggcgcggtgatctcgctgggctcgatcgtcggcttcgtgaccctgttcggcatctcgctgcgcaacaccatcatgatggtcgcgcattacgagcatctggtgctggtggaagggcggccctggaacctcgcggccgccatcgagggcgccgccgaccgtctcgtgccgatcctgatgacgtccctcgtcaccggcctcgggctgttgccgctggcgctcggtgcgggtgaacccggccgcgagatcgagggtccgatggccctggtcatcctcggcggcctcgcgacctcgactttgctcaacctggccgtgctgccgatgctggccctgcgcttcgcccggttcaagcccgcggaaggcgcgctgtga

SEQ ID NO: 2356 - DNA, 3168 bp, Methylobacterium radiotolerans JCM 2831
atgactgagccccccgctgccgccggccgcggcggtccgcaggcggccctcgtcggcttcgccgtccggttgcccaaggtggtgctggcgctggcctgcgcggtcctggtcttcggcctctacgccctcgcgggggcgcgctacgacgtgttcccggaattcgcgccgccgaccgtcacgatccagaccgaggcgccgggcctcgattcggagcaggtcgaggtgctggtcacgcagcccgtggaggtggcggtcggcggcctgccgggcctggagactttgcgctccacctcgatccagggcctgtcggtgatcaccgccgcgttccagccaggcagcgacgtcgaccggatccgccagcgggtcaacgagcgcctggcggcgctcgccggccgcatgccggacggggtcgcggcgcccgccatgaccccgctgacctcctcgacgctgaccgtgctcctcgtcgggctcacctccgagacccgcgacgccatggacctgcgccaggtcgctgaatggaccgtgcgccgacgtctccagggggtgcccggcatcgcccaggtctcgctctacggcgggggcgtccgcgccctgcaggtccaggtccgccccgacgacctgatccgcttccagatcggcctcaacgacgtcctggcggccgcccggaaggggaccggtgtgcgcggggcgggattcgtcgacacgccgaaccagcgcgtcctgctccggaccgaggggcagtcgctcaccccggaagcgctcgggcagatcgtgctccacaacgacggcggggcgagcgtggtcctctcggacgtggcgaccgtcacggccgcgcccgagccggcgatcagcgcggccctcgtggacggcaagcccggcgtactgctgatggtcggcgcccaggcgggtgtcgatacacgcgccgtgaccgcccgcctggaggcggccctcgacgagttgcgaccggtcctaaagcgcgagggcgtgagcgtgcgggccgacctgttccggccggcgaacttcgtggacgtcgccaccggcaacgtgatccaggcgctggcgctcggcggcgtgctggtggtggtcgtgctcctcgtcttcctggcggactggcgggccgcgctgatcagcgcgacggcgatcccgctgtcgctgatcgccgccgcgctcgccctccaggcctggggcgagagcctcaacacgatgacgctcggcgggctggccctggccatcggcgaggtggtcgacgacgcggtcatcggcgtcgagaacgtctcgcgccggctgcgggaagcgcggggcggacggcgcggcctgccccgcgtggtgctggccgcgatgctggaggtgcggacctcggtcgcctacgcgaccctcgcggtgatcctgatgttcctgccggtcctggcgctgaccggcgtcgccggccgcctgttcgggccgctggcgttcgcctacatcgtggccgtcgtcgcctcgctcctcgtggcgctcacggtcacgccggccttggcgctcctgctcctcggaggccgcttggcgcgcgacacgggcgcggcgccgcccgacccgcccgtggtgcgctggagccgcgccgcctacctgcggttgctcgccgggatcgggcgggtgccgcggatcgcgatggcgggcgccctgctggtcaccctcgcgggggccgccatcctgccgaccctcggcgcggtgttcctccctgacctgaaggaggggcacatgatcctgcacatggtagccattcccggcacctccctgcaggaatcgcagcggctcgggacgctgatcaccggcgacctgaaggacatatcgggcgtgcgcgccgtggcggcgcagatcggacgggccgaggccgccgaggataccgccgggccgcattacagcgagatccacatcgacctggagccgggcctcgacggagccgctcagcgccgggtcgaggcggccatccggcagctgatcgccggcttcccgggggcggcgttctcgctgaagaccttcctcaccgagcgcatcgaggagaccgtctcgggcttcaccgcgccggtcgtcgtcaacgtggtcggcagcgacctcgaccggatcgaggccgcggcccgctcggtggcgcaggagctctcggaggtgaagggcgcccgggatgtccagcaggcctcgccggccgggctgccgcaggtcacggtggcgctgcgaccggtggacctgcggcactgggggctcgatcccgtggaggtgctggaggcggtgcgcacagcctaccagggcgacacggtcggtcagacctatcgcggcaacgccgtgttcaacgtgctggtgatcctcgacgcgcgcgtgcgggaccgcctcagcgcggtgggcgacctgcccctgcgggcgcccggcggacgctacgtccggctgtcccaggtcgccgacgtctacgagagcgccggacgctaccaggtccagcacctcggcgcgcagcgggtgcaggcggtgacggccaacgtcgccgaccgcgacgtggcgggcttcgtggcggcggccaagcgcaagatcgcccgcgaggttcggctgccggagggcgtctacgtcaccttctcgggtgccgccgaggcgcaggcggccgcccgccgcgacctgctggtccacgccgggatggccggcttcggcatcgtggtgctcctggccatcgtcaccggctccgcggcgaacctgctcctggtcctcgtcaacctgcccttcgccttcgtgggcggcgtcgcggccgcggcgctcaccggcggggtgctgtcgctgggctcgatcgtcggcttcgtgaccctgtcgggcatctcgttgcgcaacagcgtgatgatgatcgcccattacgagcagatggtcacccgggacgggcggccgtgggacgccgccacggcggcggagggcgccgcggaccggatggttccgatcctgatgacctccttggtcacgggcctcggcctgctgccgctggcgctcggcgccggtgaacccggccgcgagatcgagggcccgatggccctcgtgatcctcggcggcctcgtcacctcgacggtgctgaacctgctgatcctgccggtgatggcgctgcggtacgcccggttccgccaccaggaccccgcggatctggaactgacggcggtcgggtcctga

SEQ ID NO: 2357 - DNA, 3195 bp, Methylobacterium populi BJ001
atgctcgaccgacggcccgaccaacggcccgactcccgaccaatgcgcgacgacgcgccggctccggccccgccggggcctgccccctcgggcctccaggccgccctggtcgccttcgcagtgcgccggcccggcatcgtcctggcgctggtcctggcgatcgccatctacggcatcgtcgccctcggatcggccaagtacgacgtctttccggaattcgccccacccacggtgacggtgcagaccgaggcgcccggcctcaacccggagcaggtcgaggtgctggtgacgcaggctctggaggtcgcggtcagcggcctgccggggctggcgaccctgcgctcgaactcgatccagggcctgtcggtcatcaccgccaccttcgccaccggcagcgacatctaccgggcgcgccagctcgtgaacgagcgcctcgccgcggtgaccgcccggctgccccagggcgtcctgccgccgaccatgaccgcgctgacctcgtccacgagttcggtgctcctcctcggcctgacctcgccgacgcactcgctgatggacctgcgcacggtcgccgactggcgcctgaggctgcgcctgctcgccgcgcccggcgtcggcgaagtcctggtctatggcggcgacatccgctcgctgcgcatccaagtccggccgcaggatctggtgcgcttccgcatcggcctgaacgacgtgctcgccgccggccgcaaggccacgggggtgcgcggggcgggcttcgtcgacacggtcaatcagcgcatcaccctgcagaccgagggccagtccctgaccccggaagcggtggcgcgcaccgtgctcgtcaacgagggcggggcaagcgtggtgctcggcgacgtcgccgacgtcgcggccgcgcccgagccggcgatcagcgcggcgctggtcgacggccgaccgggcgtgctgctgatggtcggcgcgcagtacggcgccaacaccctcgacgtgaccgcgcaggtggaggcggccttggccgagatgcgccccggcctggagcgcgacgggatcaccctgcgcgccgacctgttccgcccggcgaacttcgtgacgcaggccaccgacaacgtggtccaggcgctcgcgctgggcggcatcctcgtcgtcgtggtgctgttcgtcttcctcgccgactggcgcacggcgctgatcagcgccaccgctattccgctctccctgatcggcgcggtgctggccctcggcgcgttcggccagagcctcaacaccatgacgctgggcggtctcgccatcgccatcggcgaggtcgtggacgatgcggtgatcggcgtcgagaacgtgatgcgccgcctgcgcgagaaccgccgcgccgagacgccccggcccggcgcgcgggtggtgctcgacgcgatcctggaggtgcgcgtctcggtcgcctacgccaccttcgcggtgctgctggtgttcctgccggtgctggccctgactggcgtgcccggccgcctgttcggcccgctggcgctcgcctacatcctcgccgtgctgacctcgctcgcggtggcgctgaccgtgacgcccgccctggcgcgcctgctgctcgccggccgctccgacgggccggtccgcgaggcaccggtgagccgcggcgtgcgcggcgcctatatccgcaccttggcacggctcaactgtcacccgcgcctcgtcttcaccgccagcctcgccctgacgctggcggcggcgatcccggttccgttcttcggcggccagttcctgcccgacctcaaggaagggcacctgatcctgcacatggcatcggtcccgggcacctccctgcaggaatccctgcggctcggcgagcgtatcaccgcggggctgaaggcgctgccgggcgtgcgcgcggtggcccagcaggtcgggcgcgccgaggccggctacgatctcggcggcacgcacgacagcgagatccatatcgatctcgaaccgggcctcgacggggaggggcaggagcgggcggaggccggtatccgcgcgctgatggcggcgacccccggcgcgaacttctcgctcaagaccttcctgaccgagcggatcgaggaggtcgtctccggcttcaccgcgcccgtggtggtcagcgtcaccggcaccgacctcgaccggatcgaggccaccgcccgcgacgtggcgcgcgaactcgccgaggtgcgcggcgcggccgacgtgcagctccggtcgccgccgggcctgccgcaggtcaatgtgagcctgcgcccggccgatctgcgccactggggcctcgacgccatcgaagtgctggagatcgtgcgcaccgcctatcagggcgacatcgtcggccaggcctacgagggcaacgccgtgttcaacgtcgtggtcgtgctcgaaccggccgcgcgcacccgcctctcgaccctcggcaccctgccgctgcgcacgaagggcggcaactacatccggctcgcgcaggtggcggacatctacgagaccgccggccgctacgccgtcggccatgtcggcgcgcagcgggtgcgggtcgtgaccgcgaatgtggaggggcgcgacatcgcctccttcaccgaggcggcgaagcggaagatcgcccgcgaggtcgcgcagccctcgggcatcgatatcggtttcggcggcgcggccgagacgcaggcgaaggcacggcgggaactggcgctctatgcgggcctcgccggcctcgggatcgtgctgctgctcctcatggtgacgggatcgctgaccaatctcgccctcgtcctcgtcaacctgcccttcgccttcgtcggcggcgtgctggcggtcgccgtgagcggcgccgtcgtctcgctcggctcgatcgtcgggttcgtgaccctgttcggcatctcgctgcgcaacaccatcatgatgatcgcgcattacgagcacatggtgctggtggagggccgccgctggaacgcggcggccgcggtcgagggcgccgccgaccgcttggtgccgatcctgatgacctcgctggtcaccggcctcggtctgctgcctctggcgctcggcgccggcgagccgggccgcgagatcgagggaccgatggccctggtcatcctcggcgggctggcgacctcgacgctcctgaacctcgccgtgctgccgatgctggccctgcgcttcgcccggttcaaatccttacagacgtcgccgtga

SEQ ID NO: 2358 - DNA, 3195 bp, Methylobacterium chloromethanicum CM4
atgctcgaccaacggcccgcacgcggaccggcgcgcgacgatccgccgggcccgcctccggcggccctctcccctgcgcccgtggccttgggccctcaggccgccctggtcgccttcgcggtgcgccggcccggcatcgtcctggcgctggtcctggcgctcgctatctacggcatcgtcgccctgggttcggccaaatacgacgtcttcccggaattcgctccgcccacggtgacggtgcagaccgaggcgcccggcctcaaccccgagcaggtcgagacgctggtgacgcagacgctggaggtcgcgatcagcggcctgccaggactggcgacgatgcgctcgaactcgatccagggcctctcggtcatcaccgccaccttcgcctccggcagcgacatctaccgggcgcgccagctcgtgaacgagcgtctggcctccatcaccgcgcggttgccgcagggcgtgctgccccccaccatgacggcgctgacctcctcgacgagttcggtgctccttatcggcctgacctccccgacgcagtcgctgatggacctgcgcacggtggccgactggcgcctgcgtctgcgcctgctcgccgcccccggcgtcggcgaggtgctggtctatggcggcgatctccgctcgatccgcatccaggtccggccgcaggatctggtgcgcttccgcatcggcctgaacgacgtgctctcggccggccgcaaggcgacgggcgtgcgcggggcgggcttcgtcgataccgtcaaccagcgcatcaccctgcagaccgaggggcaatccctgaccccggaggcggtggcgcgcaccgtgctcatcaacgagggcggggcgagcgtggtgctcggcgacgtcgccgacgtggcggtggcgccggaaccggcgatcagcgcggctctcgtcgatggcaaaccgggcgtgctgctgatggtcggcgcgcaatacggcgccaacaccctcgacgtgacggccggcgtcgaggcggcgctcgccgagatgcgccccgggttggagcgcgacggcaccaccctgcgcaccgacctgttccgcccggcgagcttcgtcacgcaggccaccgacaacgtggtccaggcactcgccctcggcggcatcctcgtcgtcgtggtgctgttcgtcttcctggccgattggcgcacggcgctgatcagcgccacggcgatcccgctctccctgatcggcgcggtgctgatgctcggcctgttcggccagagcctcaacacgatgacgctgggcggcctcgccatcgccatcggcgaggtcgtggacgacgcggtgatcggcgtcgagaacgtcatgcgccgcctgcgcgagaaccgccgcgccgtcgcgcccttacccggcgcgcgggtggtgctcgacgcgatcctggaagtgcgcgtctcggtcgcctacgccaccttcgcggtgctgctcgtgttcctgccggtgctggcgctgaccggcgtgcccggccggctgttcggcccgttggcgctggcttacatcctcgccgtgctgacctcgctcgccgtggcgctgacggtcacgcccgcgctggcccgcctgctgctcgccgggcgcaccaaccttccgagccgagagccgccggtgagccgccgcgtgcggggcatctatgtccgtgggctcgcgcggctcgaccgtcacccgcgtctcgtcttcggcaccagcctcgccctgacgctcgtcgcagccctaccggtgccgttcttcggcggcgtgttcctgccggacctgaaggaggggcatctcatcctgcacatggcctcggcccccggcacctcccttctggagacgctgcggctcggcgagcgcatcacggcggggctgaaggcggtgcccggcgtgcgcgcggtggcccagcaggtcgggcgcgccgaagcgggctacgatctcggcggcacgcatgacagcgagatccatatcaatctcgaacccggcctcgacggggaggggcaggagcaggcggaggccggcatccgcgcgctgatggcggcgacgcccggcgcgaacttctcgctcaagaccttcctgaccgagcgcatcgaggaggtcgtctcagggttcaccgcgccggtcgtgatcagcgtcaccggcacgaatctcgaccggatcgaggccaccgcccgcgacgtggcgcgcgaactcgccgaggtgcgcggtgcggccgatgtccagctcaagtcgccgccgggcctgccccaggtcaatgtgagcctgcgcccgaccgacctgcgccactggggcctcgacgcgatcgaggtcctggaaattgtgcgcacggcctatcagggcgacatcgtcggccaagcctacgagggcaacgccgtgttcaacgtcgtcgtggtgctcgaaccgattgtgcgcacgcgcctttcgatgctcggcaacctgccgctgcgcacgccgagcggaagctacatccggctcgcccaggtggccgacatctacgagaccgccggccgctacgccgtcggccatatcggcgcgcagcgggtgcgggtggtgaccgcgaacgtggaggggcgcgacgtcgcctccttcaccgaggccgcgaaacggaagatcgcccgcgaggtcgcgcagccctcgggcatcgatatcggattcgggggggcggccgagacgcaggccaaggcgcggcgcgaactcgcgctctacgcaggtctcgccggtctcgggatcgtgctcctgctcctcgtcgtgaccggctcgctgaccaatcttgcccttgtcctcgtcaacctgcccttcgccttcgtcggcggcgtgctggcggtggccttgagcggcgcggtgatctcgctgggctcgatcgtcggcttcgtgactctgttcggcatctcgctgcgcaacaccatcatgatggtcgcgcattacgaacatctggtgctggtggaggggcggccctggaacctcgcggccgccatcgagggcgccgccgaccgtctcgtgccgatcctgatgacgtccctcgtcaccggcctcgggctgctgccgctggcgctcggtgccggtgaacccggccgggagatagagggaccgatggccctggtcatcctcggcggcctcgcgacctcgactttgctcaacctcgccgtgctgccgatgctggccctgcgcttcgcccggttcaagcccgcggaaagcgcactgtga

SEQ ID NO: 2359 - DNA, 1074 bp, Brucella suis 1330
atgacctatgccgagcttggccggggcagcgcggttgcgcgcctgaaggacatcgccaccattcagggcgtgcgcgaaaaccagcttgtgggctatggtcttgtcatcggtctcaagggcaccggcgacagcctgcgcaattcgccgtttaccgaacaatccatgcgcgccatgctggataatctgggcatcagtgcaccgcgcaattccacccgctcgaagaatacggcggcagttattgtgacggctaaccttcctgcttttgccggtgccggttcgcgcatcgatgtaacggtgtcgtcacttggcgatgcgacctcgcttcaaggtggtacgcttgtcatgacccagctcatgggggcggataatcagatttatgccgtggcgcagggcaatatgatcgtctccggcttttcggcggaaggtgaagccgcaagcgtcacgcaaggcgtgccaacttccgggcgcatccccaatggcgcgctggtcgagcgcgaggtggcgggcagtttcggcaaggaccgggagatgatcgtggaactgcgtgaccccgatttcacgaccgccgtgcgcgctgccgatacgatcaatgtcttcgccaagcgccgttatggtcgcggggtggccattgcgcgcgatgccaagacgatccgcctgtcacgcccgaagaacgtgcctgccgcccgttttcttgcagagcttgagggcctgccgatcaccaccgacgaagtggcgcgggtggtagtggatgagcggaccggaacggtcgttattggcgaaaaggtgcgcatttccaaggttgcgatcagccatggcagcctgacggtccgtgtgacggaaacgccgatggtcgtccagccagagccgttcagtgacggcgagacggcggttgagcccaacaccgatatcgccgtcaaccagcagaacgccaagatcggcatcctgagcggcgccaatctcgaaaatctcgtgaaggggctcaatcagatcggcgtgaagcccaccggcatcatcgcgatattgcaggcaatcaagacatccggcgcgcttcatgccgaactggtggtgcaatga

SEQ ID NO: 2360 - DNA, 1104 bp, Rhodopseudomonas palustris BisB18
atgatagctcggctgctatggggcgtgatcatcgcgctgtcgatcaccgccgccgacgccgcggttcggatcaaggatatcgccaacctgaaaggcgtgcgcgagaatcagatcctcggttacggcttggtgatcggcctcaagggcaccggcgacacgctgcgcaattcgccgttcaccgagcagtcgctgcagtcgatgctggacaacatgggcatcaacatccgcggcacttcgctgcgcacgcgcaacgtcgcggcggtggtggtcaccgcggacctgccgccgttcatcgccggcggctcgcgcatcgacgttgcgatctcctcgctcggcgactcgtcgtcgctgctcggcggcacgctggtgatgacgcagttgcgcggcgccgacggcgaggtctatgcggtcgcgcagggcgccatcgcggtcggcggatatgcggtggagggcgcggcgcagtcgctcagccagggcgtcgccaccggcggccggattcccaacggcgcgctgatcgagcgcgaagtgcggggccgcttcagcgacatggaaacgctgctactcgaattgaagaatccggatttcgtcaccgcgacccgggtgctcgacaccatcaaccagcacagtcgcgggcgttaccaagccggggtcgcctccgagcgcgattatcgcaccatcatcctgtcgcggccgcgatcggtgtcgccggtccgcttcatcgccgagatcgaggaactgctggtggagccggacaccccggcgcgggtggtgatcgacgagcgcaacggcacggtggtgatcggccgcaacgtgcagatctcgacggtcgccgtcacccacggcaacctgacggtacgtatcaccgaagcgccgatcgtgtcgcaaccctcgccgttctcgccgcgcggcgagaccgtggtggtgccgcagaccttcatcgacgccaacgagccgggcgccaagatcgcgatcctgcgcggtaccgatctgcagcgattggtgcgcggcctcaaccagatcggtctgaaaccgtcggggatcatcgcgatcctgcaggcgatcaaggccgccggcgcgctgcaagccgacctcgtcatccaatga

SEQ ID NO: 2361 - DNA, 1110 bp, Mesorhizobium BNC1
atgatcctcagagcgttcctatgggggctgatgcttttccttgccgcagcaccggctggcgcagcgagcaagacccagatcaagcacatcgcccagcttcaggccgcccgcgacaaccagctcgtgggctatggtctggttatcgggttaaaccgcaccggcgacagcttgcgcaacgctccttttacggaacagtcgatgcgtgcgatgctccagaacctgggcatcgcttccgaggacgggcgatcccgtgcggagaatgtggccgccgtcatcgtgacggccaatctgccgcccttcgttcagtccggcgcgcggattgatgtcaccgtctcctcgcttggcgatgcaagctcccttgcaggcggcacattggtgatgacgccgctgcgcgccgccgatggcgaaatctatgcggtcgctcaaggctccgtcatcgtgtccggtttcaatgcccagggacaggcagagacgctcacacagggcgttccgacctccggccgagtgcccaatggagccatcatcgagcgcagcgtcaccgcctccttcgacgaactgctggcactgacgctacagctcaggaacccggacttttcaacggccgttcgcgtcgcagacgtggtcaatgcctatacaagccggcatttcggcgcaccgctcgccagtgaacaggattcacggaccgtcatcatcaagaagccgaaaggtgtctcagccgcccgcttttacgcgcaaatcgagaatcttcccgtcgaggtggatgcgccggcgcgcgttgtcgtggatgagcgcaccggaacggtggtgatcggaagcgacgttcggatctcgcgcgtggcgatcagccatggcgcccttacggtgcgcgtcaccgagatgccgcgcgtggtccagcccgagccattctcccgcggggagaccgcggtggagccctacacggtgatcgacgccacgcagcccgacgccagcgtggcggtgctcgacgggccggacctgcagacgctcgtctcgggcctcaacaggctcggcgtaaagccggatggtatcatcgcgatcctgcaaggcatcaagtctgccggtgctttgcagggcgaactggtcttgcagtag

SEQ ID NO: 2362 - DNA, 1239 bp, Bartonella bacilliformis KC583
atgagagtgtatcatcatctctttcattattttttggctttttggtttagcttttttgctgtcttttttccgatttttgcgaatggacaagaggaaggaacgcgctataactctgcagttgagtcggatgctgctttattaggatcaggcggcgatcctagtcagatgcattattctgatttagcacgcccaggtgctgtggcacgtttgaaagatattgcagaaattcaaggtgtgcgctccaatcaattggttggctatggtttggtgattgggttaaatcgtacaggggattctttacgaaattcaccttttacagagcaatctatgcgggctatgcttgataatttggggattagtcctcctgctggtgcatcgcgtgctaataatatcgctgctgttattgtgacggctgaaatggtaccttttgcgacaccaggttcacggattgatgtgacagtttcttcgttaggcgatgcaacatctttgcaagggggaacgttggtgatgaccccactgcttggtgcagatggtaaaacttatgctgttgcgcaaggaaatatggtgatttctggttttggtgcccaaggcgtggcagagagtgtaacacaaggtgtaccaacatcgggtcgtattcctaatggtgcgttggtcgagagaaaaattgaaggcaatttcaacaagagtaacgagattattttagaattacgcaactctgatttttcaacagcagttcgtgtgacagatttaattaatattttttctaatcaacgttacaagcagggtgtagcgaaagagagagattcaaaaaccattgtgttgagtaaacctcgcaatatttcaattacgcgctttattgctgaaattgaaagattgcctattcctacagatgaagtagcacgtgtggttgttgatgagcgcacgggaactgttgtcattggtgaaaaagtgcgtgtttcacgtgttgcgatttcccatggaagtttgacagttcgtgtcacagaagatccgcttgtttcgcagccaaatccttttgctgaggggaatacggttattgtgccaagaactaatgtagatatagcacagccaccctccaatataggtattctcaatggggtcgatttagacaatctcgttaaaggacttaatcaaatcggtgttaaaccaacagcaattatagcggttttgcaggctattaaaacctcaggcgctcttcatgcggagctgatagtacagtga

SEQ ID NO: 2363 - DNA, 1116 bp, Sinorhizobium medicae WSM419
atgaaaatgcgtgcatgcaagtggctgctgaccctcgccgtggccttcgccgcgacactgagctccgcctacgcggcttcgcgcatcaaggacgtagcgtccctgcaggcgggccgggacaaccagctcatcggttacggtctggtggtcggtttgcagggaaccggcgacagcctgcgctcctctcctttcacggatcagtcgattcgcgcaatgctgcagaacctcggcatctccacgcagggcggggattcgcgcacgcgcaacgtcgcggcggtgctcgtcaccgcgacactgccgccgttcgcgagccccggcagccgcctcgacgtgaccgtcggctcgctgggtgatgcgacgtcgctgcgcggcgggacgctggtcatgacctctctctcgggcgccgacggtcagatctatgcggtggcgcagggatcggtggtcgtcagcggtttcaacgcacaaggggaagccgcccagctgaaccagggcgtgaccactgcggggcgggtcccgaacggcgccatcatagagcgggaactgccgtcgaagttcaaggacggcttcaacctcgtgctgcagctccgcaatccggatttttcgaccgccgtcggcatggccgcggcgatcaacagatatgctgccgcccagttcgggggccgaattgccgaagccttggattcgcaatctgtcctggttcagaaaccgaaaatggcggatctcgcgcgcctgatggcggatgtggagaacctggtgatcgagacggacgcaccggcccgcgtcgtgatcaacgaacgcaccggcacgatcgtcatcggtcaggacgtccgcgtcgctcaggtggccgtgagctacggcacgcttaccgtccaggtcagcgaaacaccgacgatcgtccagccggagccgttttcgcgcggccagaccgcatacgagcccaataccacgatagaggcgcaatccgatggcggcacggtcgcgatcctcaacggctcaagcctgcgttcgctcgtcgcgggtctgaacagcatcggcgtcaaaccggatgggatcatcgcgatcctccagagcatcaaatcggcgggagccctacaggcggagcttgttctgcaatga

SEQ ID NO: 2364 - DNA, 1242 bp, Ochrobactrum anthropi ATCC 49188
gtgagaaaaacttgcgccgcccagatcgccactttgttcgccgtcctggcgctcgttttccagcctgttgcaggatttgcggacgagtcgtcgaagaatgcgcgggaattcggttccgcagtggatgctgatgccgattggcttggctcgggtggcgatccgtcgaaaatggcctatgccgaacttggccggggaagcgcggttgcgcgcctgaaggatatcgccaccattcagggcgtgcgcgaaaaccagcttgtgggctatggtcttgtcatcggcctcaagggcaccggtgacagcctgcgcaattcgccgttcaccgaacagtccatgcgcgccatgctggacaatctcggcatcagcgcgccgcgcaactccacccgctctaaaaacacggctgcggtcatcgtgacagcgaacctgcccgcctttgccggtgccggttcgcgcatcgatgtgacggtatcgtcactcggcgatgcgacgtcgctgcagggcggcacactggtcatgacccagctcatgggtgccgacaatcagatttatgccgttgcgcagggcaacatgatcgtgtccggctttgcggcggaaggtgaagccgcaagcgtgacgcagggtgtgccgacttccggtcgcatccccaatggcgcgctggtcgaacgcgaagtggcgggtaatttcggcaaggaaaccgaaatgatcgtcgagctgcgcgatcctgatttcaccactgccgtgcgcgctgccgacacgatcaatgtcttcgccaagcgccgttatggtcgcggtgtcgctattgcgcgcgacgccaagacgatccgcctgtcgcgtccgaagaacgtgcctgccgcacgtttcctcgcagagcttgaaggcctgccgatcacgactgacgaagtggcgcgtgtggtggttgacgaacggacaggaactgtcgtcatcggcgagaaggtgcgtatctccaaagtggcgatcagccatggcagcttgacggttcgtgtaacagaaaccccgatggtcgttcagccagagccgttcagcgatggtgtaacggctgtcgaaccgaacaccgatatcgccgtcaaccagcagaacgccaagattggcattctgaccggcgcaaatcttgaaaatctggtgaagggcctgaaccagatcggcgtgaagccgaccggcatcatcgcaatattgcaagctatcaagacatccggcgcgcttcatgcggaactggtggtgcaatga

SEQ ID NO: 2365 - DNA, 1128 bp, Methylobacterium extorquens PA1
atgatccgtcgcctgctcctcgcggtgctgctcggcctgctcaccggactgggcttcgccgtcatgaccggcccggtcttcgccgccggcacccgcatcaaggacatcgccacgctcaagggcgtgcgcgacaaccagctgttcggctacggcctcgtcaccggtctccagggcaccggcgacaccctgcgcaacgcgcagttcaccgagcagtcgctgcaatcgctgctcgaccggctcggcatcaacgtgcgcgacgcccgcctgcgcacccgcaacatcgcggccgtgatggtgaccgccgacctgccgccctataccggcaccggctcgcgcatcgatgtcaccgtgacctccatgggcgacgccacgtcgctgcgcggcggcaccctgctgatgacctcgctcaccggcggcgacggcctcgtctacgcggcggcgcaggggccgctcgcggtgtccggcttctcggtgcagggccaggccgagcagttgacgcaaggcgtgccgaccgcgggccgcatcccgaacggcgcgatgatcgagcgcgaggtgcccggcaccttccgcgatctgcccgaactcgtgttcgagctgaagaaccccgacttcaagaccgcgacccagatctccgacgcgatcaacgcgtggtcgctcggtgccttcggccgtcgcatcgccagcgcgcgggaccagcgcgccgtggtggtgatgcgcgggcgccagatggcccagacccggctcgtggcgcagatcggcgatctgacgatccagcctgacacgccggcccgcgtcgtcgtggaccagcgcaccggcaccgtcgtgatcgggcgcaacgtgacgatctccacggtcgcggtcacccacggcaacctcacggttcgggtcaccgaggcaccggaagtgtcgcagcccgaaggcttctccaacggccagaccgtcgtggtgccgcgcacggaagtgtcggcgcgggaggagcgcggcaagctcgccatcctcggcggctccgaccttcagacgctggtgcgcgggctcaatcaggtcgggctcaagcccaccgacatcatcgcgatcctgcaggcggtgaagaccgccggcgccctccaagcggagcttgtggtgcagtga

SEQ ID NO: 2366 - DNA, 1101 bp, Methylobacterium radiotolerans JCM 2831
atgcgcccgctgatcctcctgctcctcgccggcctcgcgctatggccggcgtccgcgtcggcgacgcgcatcaaggacatcgccacgctgcagggcgtgcgcgacaaccagatcgtcggctacgggctcgtcacgggcctgcagagcaccggcgacaccctgcgcaacgcgcagttcacggaacagtcgctgcaatcgatgctcgaccgcctcggcgtcaacgtgcgcgaccagcggctccggacccgcaacgtcgcggccgtgatggtgacggccaatctgccggcctatgtcgagccggggtcgcgcgtcgacgtctccgtgaactccatgggcgacgcgacctccctgcgcggcggcacgctgctgatgacgccgctctcgggcggcgacgggcaggtctacgcggtcgcccagggggcgctcgtcgtctccggcttcagcgtcaccgggcaggcggaatcgctggtctcgggcgtggccacggcggcccggatccccaacggggccctggtcgagcgcgcggtcgccggcacgttcagcgagttgcccggcatggcgctcgagctgaagaacccggacttccacaccgccgtcctgatctcggacgcgatcaacgcctacacgctccagaagtacgggcggcgcgcggcgagcccgcgcgactaccgcacggtggtcctgtcccgtcccggccacgtgggtcggacccggttcatggccgagatcggcgagctgcaggtccagcccgacatccccgcgaaggtggtgatcgatcagcggaccgggaccgtggtcatcggccggaacgtccaggtctccaccgtggcggtgacgcacggcgacctgacggtgcgcatcaccgagacgccgcaggtctctcagcccgcgcccttctccgacgggcagaccaccgtcgtgccccggaccgacatcgaggccggcgaacggacggcgcgcctcgccatcgtggcgggccccgatctgcagaccctgatccgcggcctgaacaatgtcgggatgaagccgacggacgtcatcgccatcctccaggcggtgaagacggccggcgccctgcaggcagagctggtgatccaatga

SEQ ID NO: 2367 - DNA, 1113 bp, Beijerinckia indica ATCC 9039
atgacaagaagaatattttctctcctggcttgttgctgcttggcctgcttctctgttgcaccagccttcgccagtgtccgcatcaaggatatagcggccttgcaaggggtccgggacaatcagatcatgggctatgggctcgtggtcggactccagggaaccggcgacacgatgcgtaattccgtcttcacggaacagtcgattcaatccatgctggatcggctcggcgtgaatgtccgcggcatcaacttgaggacgcggaacgtcgctgccgtcctcgtcactgccgatctgcctccctttgtacaacccggctcacgcatcgacgtgaccgtttcgtctcttggagatgcttcatccctcctcggtggcacgttgattttgacgtccctcctcggcgtcgatgggcaaacctatgccatggcgcaaggccaggtcgccgtcaccggcttcgcagaaacaggccccgcggcaagcgtcgtgcagaatgtaccgactgcgggccggatagccaatggcgccctgatcgaacgcgaggtgcccggccaattgcgctccatcggacctcttgtcctgcaattgcgcaatccggatttcggcacggcagtcaagatcaccgatgcgatcaacgcctttggcgttcataaatatggccatgaactcgcgcatgagatcgatcaaagatccgtcgccttgaacaagccggctaatctcggaaccacgcgattcatcgctcaaatcggtgacctctcgatcgagccggatacaccagcccgtgtcgtcatcgactcgcgcagcggtaccgtcgtcataggccaggatgttcaaatatccactgtcgctgtcacgcaaggcaatctgaccgttcggatctccaatgcgcccgtcatttcgcaacctgcccccttttcgcaagggaaaaccgtggtcgctccgattaccgaaattgacgccaatcagggcggcggaccgatctctatcgtgcgcggctccaatttgcggagccttgtcgccggcctcaatcagatcggcttgaaacccgacgggatcatttcgatcctgcaggccatcaaatcggcgggggctctccaagccgatctcgtggtccaatag

SEQ ID NO: 2368 - DNA, 1134 bp, Methylobacterium populi BJ001
atgaccccgcttcgccgtctgtttctcgccgtcctgctcggcctgctcaccggtctcggctttgccgtgatgaccggcccggtcttcgcggcgggcacccgcatcaaggatattgcgacgctgaagggcgtgcgcgacaaccagatcttcggctacggcctcgtcaccggcctccagggcaccggcgacaccctgcgcaacgcgcagttcaccgagcagtcgctgcaatcgctgctcgaccggcttggcatcaacgtgcgcgacgcgcgcctgcgcacccgcaacatcgccgccgtgatggtgaccgccgacctgccgccctacacgggaaccggctcgcgcatcgacgtcaccgtcacctccatgggcgacgccacctcgctgcgcggcggcacgctgctgatgacgccgctcaccggcggcgacggcctcgtctacgccgcggcgcagggaccgctcgcggtctccggattcacggtccagggccaggccgagcagttgacgcaaggggtgccaaccgccggccgcatccccaacggcgccctgatcgagcgcgaggtgcccggcaccttccgcgacctgcccgaactcgtgttcgagttgaagaaccccgacttcaagaccgcgacccagatctcggacgcgatcaacgcgtggtcgctgggcgccttcggccggcgcatcgccagcgctcgcgaccagcgtgccgtggtggtgatgcgctcgcgccagatggcgcagacccggctcgtcgcgcagatcggcgacctgacgatccagcccgacaccccggcccgggtcgtcgtggaccagcgcaccggcaccgtcgtgatcgggcgcaacgtgacgatctccaccgtcgccgtgacccacggcaacctcacggtccgcgtcaccgaggcgccggaggtgtctcagcccgagcccttctccaatggccagaccgtcgtggtgccccgcaccgaggtggcggcgcgggaggagcgcggcaagctcgccatcctcggcggctccgatctccagacgctggtgcgcggcctcaatcaggtcgggctgaagcccaccgacatcatcgcgatcctgcaggcggtgaagaccgccggcgccctccaggcagagcttgtggtgcaatga

SEQ ID NO: 2369 - DNA, 1113 bp, Methylobacterium sp. 4-46
atggaccggatcctcgcgctgctgctcgccctgctggtcgcgcccctcgccgcgctcccggccctcgccggcacccggatcaaggacatcgccgcgctccagggcgtgcgcgacaaccagctcgtcggctacgggctcgtcacgggcctccagggcaccggcgacaccctgcgcaacgcgcagttcaccgagcagtcgctgcaatcgatgctcgaccggatgggcgtcaacgtgcgcgactcgcgcctgcgcacccgcaacgtcgcggccgtgatggtgacggccgacctgccgccctacgcgaccgtgggctcgcgcatcgacgtcaccgtgacctcgctcggcgacgcgacctcgctcaagggcggcacgctcctgatgacgccgctctcgggcggcgacgggcaggtctacgccgccgcccaggggccgatggcggtctccggcttctcggtgggtggccaggccgagacggtcacgcagggcgtgccgaccgccgggcgcattccgaacggcgccctgatcgagcggcaggtgccgggctcgctgcaggacctgccgcagctcgtcctcgaactcaagaaccccgacttcaagaccgcgaccctgatcgtcgacgcggtcaacgcctacgcgctgcagcgcttcggccggcgcgtggcgatcccgcgcgaccagcgctcggtggtgctgcacaagccgcccgcgatcgcgcagacccgcttcatcgcggaggtcggcgacctgaccatccagcccgacaccccggcgcgggtggtggtggatcagcgcaccggcacggtggtgatcggccgcaacgtccagatctccacggtggcggtcacgcacggcaacctgacggtccgggtcaccgagacgcccgaggtctcccagcccaatccctcctcccgcaacggccagaccgtggtggtgccgcgcaccgaggtctcggcccaggagcagcagggccgcctcgccgtcctgggcggctccgacctccagaccctcgtcaagggcctcaaccaggtcggcctgaagccgagcgacatcatcgcgatcctccaggccgtgaagacggccggcgccctccaggcggagctcgtggtgcaatga

SEQ ID NO: 2370 - DNA, 1122 bp, Rhizobium leguminosarum bv  trifolii WSM2304
atgaaattgttcttccggttcttgacccttgtcgcggttctcgccatgagcctcgccgacgtcgcgcccgcctgggcgctgacctcccgcatcaaggatatcgcctcgcttcaggccggccgcgacaaccagctgatcggttatggcctgatcgtcggcctgcagggaaccggcgacggtttccgtgcttcgcccttcaccgagcaatcgatgcgggccatgctgcagaatctcggcatctcgacgcagggcggccagtccaacgccaagaacaccgcggccgtcatggtcaccgccaacctgccgcccttcgcaagccccggcagccgcatcgacgtgacggtgagctcgctcggcgacgcaacgtcgctgcgcggcggcacactggtcatgacctcgctttccggcgccgacggccagatctacgccgtcgcccagggcgctgccatcgtcaccggcttccaggctcagggccaggccgccaccgtgaccgaaggtgtgaccaccgccggccgcgtgcccggcggcgccatcatcgaacgcgaactgccgtcccgcttcaaggactcggtcaatctcgtcctgcagctgcgcaatcccgacttctcgacggcgatccgcatcgccgacatcgtcaatggttatgcctcggcgcgtttcggcggcccggtcgccgaagccaaggattcgcaggaagtggtgatccagaagccgcgcacggccgatctcacccggctgatggccgacatcgaaaatctcatcgtcgaaaccgatacgccggccaaggttgtcatcaacgagcgcaccgggacgatcgtcatcggctccgacgtccgcgtctcgccggtcgccgtcagctacggcaccctgacggttcaggtcaccgagacgccgcagatcatccagcccgaacccttctcgcagggccgcaccgcggttcagccacagaccgatatcgcggctgagcagaccggcgggcgcgtcgccatcatcgacggtcccgacctcaggaccctcgttgccggcctcaacaatatcggcgtgaaaccggatggcatcatcgccattctccagggcatcaagtcggcgggcgccctgcaggcggagcttgtgctgcaatga

SEQ ID NO: 2371 - DNA, 1104 bp, Methylocella silvestris BL2
atgatgctgcgcgccgggctcatcgtcgtcttcagcgcaatcttctgctgcgccgccacggcttccgtgcgcatcaaggacatcacctccttgcaggatgtccgcgacaatcagcttgtcggctacgggctcgtcgtcggtcttcagggctcgggcgacacgctgcgcaactcgacctttaccgaacagacgatgcagtcgatgctggatcgcatgggcatcaatgtgcgctccttcgcgctgcgcacgcgcaatgtcgccgccgtgcttgtgacggcggatctgccgcccttcatccagccaggaacgcgcatggacgtgaccgtttcctcgctcggcgatgcgacctccctttatggcggcacgctcatcctgacgtctttgacgggcgtcgacggccagacctacgccatcgcgcaagggcaggtcgcggtcgcgggattcgcagtccaggggcaggccgagacgattacgcaaaacgtggcgacggccggccgcatcgccaacggcgcgcttgtcgaacgagaggcgcccggtcacctaagggacatcgggccgcttgcgcttgttctgaaaaatcccgacttcaacacggcggtccagattgccgaggtcatcaacaaattctccatgcggcggttcaggctgcgcgtcgcgcaggacagggatctgaactccgtcgccctcgtcaggccgccagggatcagcacggcgcgattcatggccgagatcggcgatctcatggtggatcccgacgcgccggcgcgcgtcgtcatagacgcgcgcagcggcacgatcgtgatcggtcaggacgttcagatttcgaccgttgcggtgacccatggcaatctcaacgtgcgcatcgtcgagacgcccgaggtttcgcagccggcgcccttttcaaacgggcgcactgttgtcgtcccgcgcacggagatcgacaccaaccagcaaggcggacatatcggcatcgtcaagggcgcgagcctgcgcgaactcgtcgccgggctcaaccgcatcgggctgaagccgatgggcgtcattgcgatccttcaggccatcaaatcggcgggggctctccacgccgacatcgtcatccagtga

SEQ ID NO: 2372 - DNA, 1128 bp, Methylobacterium chloromethanicum CM4
atgatccgtcgcctgctcctcgcggtgctgctcggcctgctcaccggcctgggctttgccgtcatgaccggcccggtcttcgccgccggcacccgcatcaaggacatcgccacgctcaagggcgtgcgcgacaaccagctcttcggctacggcctcgtcaccggcctccagggcaccggcgacaccctgcgcaacgcgcagttcaccgagcaatcgctgcaatcgctgctcgaccggctcggcatcaacgtgcgcgacgcccgcctgcgcacccgcaacatcgcggccgtgatggtgaccgccgacctgccgccctataccggcaccggctcgcgcatcgacgtcaccgtgacctccatgggcgacgccacgtcgctgcgcggcggcaccctgctgatgacctcgctcaccggcggcgacggcctcgtctacgcggcggcgcaagggccgctcgcggtctcgggcttctcggtgcagggccaggccgagcagttgacgcaaggcgtgccgaccgcgggccgcatcccgaacggcgcgatgatcgagcgcgaggtgcccggcaccttccgcgatctgcccgaactggtattcgagctgaagaaccccgacttcaagaccgcgacccagatctccgacgcgatcaacgcgtggtcgctcggcgccttcggccgtcgcatcgccagcgcgcgggaccagcgcgccgtggtggtgatgcgcgggcgccagatggcccagacccggctcgtggcacagatcggcgatctgacgatccagcccgacacgccggcccgcgtcgttgtggaccagcgcaccggcaccgtcgtgatcgggcgcaacgtgacgatctccacggtcgcggtcacccacggcaacctgacggtgcgggtcacagaggcaccggaggtgtcgcagccggagcccttctccaacggccagaccgtcgtggtgccgcgcacggaggtctcggcgcgggaggagcgcggcaagctcgccatcctcggcggctccgacctgcagacgttggtgcgcgggctcaatcaggtcgggctcaagcccaccgacatcatcgcgatcctgcaggcggtgaagaccgccggtgccctccaggcggagcttgtggtgcagtga

SEQ ID NO: 2373 - DNA, 1116 bp, Agrobacterium vitis S4
atgagtatccgggttctgcttttctcgattttcaccggcttccttctggcggctgccggtcctgcgctggcgcagggctcgcgcatcaaggacgttgcctccctccaggccggccgtgataaccagttgatcggttacggtctcgtcgtcggtctgcaaagcaccggcgacagtcttcgttcctcgcctttcaccgaccagtccatgcgcgccatgctccagaatctggggatttccacccaaggcggtcagtcctcggccaagaatgttgctgccgtcatggtgaccgccactcttccacccttcggcagtcctggcagtcgtatcgatgccacggtcagttcattgggggatgccacgtcgctgcgcggcggtacgctgatcatgacctcgctttcaggcgccgatggccagatctacgccgttgcccaagggtcggtggttgtttccggctttactgcccaggggcaggcggccacggtgaccgaaggcgtcaccacctccggccgcgtcccgaacggcgcgatcatcgagcgcgaacttccgtccaaattcaaggattcggtcaatctcgtgctgcaattgcgcaatccggatttttcgacgtcgctcggcatggctcggcgtatcaacaattatgccaccgccacctacggcgctccgattgccgaggcacgcgacagccaggaagtggtgatccagaaaccgcgcacggcggatctggcccaattgatggccgatatcgaaaaccttgtcgtggagaccgacacaccggccaaggtggtgatcaacgagcgcacaggaaccatcgtcatcggcgctgacgtgcgtgtgtccaaggttgctgtcagctacggcacgctgacggtgcaggttaatgagacccctcaggtcattcaaccgcagcccttttccagcggcacgacggcgacgcagccgcagacggatatttccgcgcagaagactggtgacaaggttgccatcgttgatggacctgacctgcgcacgctggtggctggcctgaataatatcggcgtgaagccggacggtatcatcgccatcctgcaaggcattaagtcggcaggggcacttcaagcggagcttgtcctgcaatga

SEQ ID NO: 2374 - DNA, 1122 bp, Rhizobium leguminosarum bv  trifolii WSM1325
atgaaattgttcttccgcttcgtcacccttgtcgcggttctcgccatgagtttggctgatgtcgtgcccgcctgggcgctgacttcccgcatcaaggacatcgcttcccttcaggccggccgcgacaaccagctgatcggttatggcctcatcgtcggcctccaggggaccggcgacggcttccggtcctcgcccttcaccgagcagtcgatgcgcgcgatgctgcagaatctcggcatctcgacgcagggcggccagtccaacgccaagaacacggcggccgtgatggtcaccgccaacctgccacccttcgcaagccccggcagccgcatcgacgtgacggtgagctcgctcggcgatgcgacgtcgctgcgcggcggcacgctcgtcatgacctcgctttctggcgccgacggccaaatctatgccgtcgcgcagggtgccgccatcgtttccggttttcaggcgcagggccaggcggcgaccgtgaccgaaggtgtcaccaccgccggccgcgtgcccggcggcgcgatcatcgaacgtgaactgccgtcccgcttcaaggactcggtcaatctcgtcctgcagctgcgcaaccccgacttctcgacggcgatccgcatcgccgacatcgtcaacggttatgcctcggcgcgcttcggcgggccggtcgccgaagccaaggattcgcaggaagtcgtgatccagaagccgcgcacagccgatctcacccggctgatggccgatattgaaaatctcatcgtcgagaccgacacgccggccaaggtggtcatcaacgaacgcaccggaacgatcgtcatcgggtccgacgtccgcgtctcgccggtcgccgtcagctacggcaccttgaccgtccaggtcaccgagacgccgcagatcatccagcccgaacccttctcgcaaggccggaccgccgtccagccgcagaccgatattgcggccgagcagaccggcgggcgcgtcgccatcatcgatggtccggatctcaggacccttgtcgccggtctcaacaatatcggcgtgaaaccggatggcatcatcgccattctccagggcatcaagtcggcgggcgccctgcaggcggagcttgtgctgcaatga

SEQ ID NO: 2375 - DNA, 1062 bp, Nitrobacter winogradskyi Nb-255
atggacgctgtcctcaccgcctccgttccaccagttctccaccctgccgaaggtgcagtaagcagtcatgtgaatgtgcgcggcgcgctcacgcgccgcgcacccaacaaagcgggtagtatcgtgtcggttgtcgatcaaaaagccgttgagctgccgccccggatctcggaggcgggtgtcgccgattacttcgcgctgctgaagccacgagtgatgtcgctcgtgatcttcaccgcgctggtcgggctgatgattgcgccgggccatattcacccggtgctgggcttcatcgcgatcctgtgcatcgcggtcggagccggcgcctccggcgcgctgaacatggcgctggaaggcgatatcgacgtgctgatgtcgcgcacggccaaccggccgatcccgcgcggccgcatcacccgcggcgaggcgatggggttcggcctcacgctgtcgttcttctcggtgatgacgctcggcgcgctggtcaactggtacgccggggggctgctcgccttcacgatcttcttttacgtggtgatctacacgatggggctgaagcggcggaccgcgcagaacatcgtgatcggcggcgccgccggcgcgctgccgccggtggtggcgtgggcggccgcgacggggtcgttgtcggttgagccgctgcttctgttcttgatcatcttcttctggacgccgccgcatttctgggcgctggcgctgttccgctccgacgattacgcccgcgccggggtgccgatgctgccggtggtcgccggtcccgacgcgacgcggctgcagatcctgctctacaccatcgtgctggtggcgatcgccgccgcgccctggccgctcggctacttcgactgggtctatggcgtcacctcgctgatcctcggcgccggcatgctggtgctcgcgatcgaggtctatcgccaccggaccggaagccaggcgctgcgcgccacgcggcggctgttcgccttctcgattctctatctgttcgcgctgttcgccgttctgctgctcgatgtggtcgcgaaggccgtcgcgccgttgatctggtag

SEQ ID NO: 2376 - DNA, 942 bp, Rhodopseudomonas palustris HaA2
ttgtcggtcatagacaccaaccagatcgatctcgtcgcgccccgcatttccgaggccggcgtcgccgactacatcgcgctgctcaagccgcgggtgatgtcgctggtggtgttcaccgcgctggtcggcatgctgctggcgccgggcgactttcacccggtgctggcgatcaccgcgatgctgtgcatcgcggtcggcggcggcgcggccggcgcactgaacatgtggtacgaggacgacatcgacggccagatgacgcgcaccgccaaccggccgatcccgcgcggccgcgtcacccggccggaagcgctgaccttcggcatcacgctgtcgttcttctcggtgatgacgctcggcatcctggtcaactgggtcgccggcgcgttgctcgccttcaccatcttcttctacgtggtgatctatacgatgtggctgaagcgctcgaccgcgcagaacatcgtgatcggcggcgccgccggcgcgctgccgccggtggtggcgtgggccgcggtcaccggctcgctggcggtggagccgctgctgttgttcgccatcatcttcttctggacgccgccgcatttctgggcgctggcgctgttccgcaatgacgactacgcccgcgccggcgtgccgatgctgccggtggtcgccggtcaggatcacacaaggctgcagatcctgctctacaccatcgtgctggtcgcggtcgcggcggcgccctggccgctcggctatttcagcgcgatctacggcgtggcgtcgctggcgctcggcggctggatgctggtgctcgcgctgcgggtctatcgccatcgcaccggcagcgccgcgctgcgggcgacgcgcaatctgttcaagttctcgatcctgtatctgttcgcgctgttctcgatcctgttgctcgaggtggtggcgaaggcggtgtggcgattgttcgcctga

SEQ ID NO: 2377 - DNA, 942 bp, Rhodopseudomonas palustris BisB18
ttgtcggttgttgaaagccacgacatcgagttcgccgcgccgcggatctccgaggcgagcgttgccgattacatcgcgctgttgaagccgcgggtgatgtcgctggtgatcttcaccgctttggtcgggctgttgctggcgcccggctatatccatccggtgctggcattcacgtccatcctgtgcatcgcggtcggcgcgggcgcctccggggcgctgaacatgtggtacgaggacgacatcgacgccaagatgacccgtaccgccaaccggccgatcccccgcggccgggtcagcaagcctgaggcgctgaccttcggcctggtgctttcgttcttctcggtggtgacgctcggcattctggtgaactggttcgccgccgccctgctggctttcaccatcttcttctacgtcgtgatctacaccatctggctgaagcgctggaccgcgcagaacatcgtgatcggcggcgccgccggcgcgctgccgccggtggtggcgtgggccgcggccgcgggctcgctgtcggtcgagccgatgctgttgttcgccatcatcttcttctggacgccaccgcatttctgggcgttggcgctgttccgcgccggcgactacgccaatgccggggtgccgatgctgccggtgaccgccggacccgacgccacaaggctctcgatcctgctctacaccatcgtgcttgtcgctgtggctttcgcgccgtggccgctgggctatttcgacgcgatctacggcatcacctcgctggcgctgggcggctggatgctgctgctgacgctgcgggtgtatcggctgcgccacggcagcgccgcgttgcgcgccagccgcagcctgttcaagttctcgattctctacctgttcgcgctgttcgcggtgctgctgctcgaggtcatcgtccgcggcgtgatcggcgcgttggcgtga

SEQ ID NO: 2378 - DNA, 942 bp, Rhodopseudomonas palustris BisB5
ttgtcggtcatcgacaccaaccagatcgatctcgccgcgccccgcatctccgaggccggagtcgccgactacgttgcgctgttgaagccgcgggtgatgtcgctggtggtgttcactgcgctggtcggtatgctgctggccccgggcgatttccatccggtgctggcagtcaccgcgatgctgtgcatcgccgtcggcggcggcgccgccggcgcgctgaacatgtggtacgaaaacgatatcgacgcgctgatgacgcgcaccgcgaaccggccgatcccgcgcggccgcgttacccggcccgaagcgctgaccttcggcatgacgctgtcgttcttctcggtggtcacgctcggcgtactggtcaactggatcgccgcggcgctgctcgccttcaccatcttcttctacgtcgtgatctatacgatgtggctgaagcgatcgaccgcgcagaacatcgtgatcggcggcgccgccggcgcgctgccgccggtggtggcctgggccgcggtcaccggctcgctcgcggtcgagccgctgctgttgttcgcgatcatctttttctggacgccgccgcacttctgggcgctggcgctgttccgtaacgacgactacgcccgcgccggcgtgccgatgctgccggtggtcgcaggtcccgatcatacaaggctgcagatcctgctctacaccatcgtgctggtcgcggtcgccgcagcgccgtggccgctcggctatttcgacgcggtgtacggcattgcctcgctggcgctcggcggctggatgctggtgctcgccattcgggtgtatcgccatcgcagcggcagcgccgcgctgcgggcgacgcgcaatctgttcaagttctcgatcctgtatctgttcgcgctgttctcgatcctgttgatcgaggtcgtcgcgaaggccgtgtggcagttgttcgcctga

SEQ ID NO: 2379 - DNA, 987 bp, Nitrobacter hamburgensis X14
atgcggcgcgctcgccgcgccgcgtacctcaacaaagtgagttgtgtcttgccggtagtcgatcaaaacgccattgagctgccgccccggatatcggaggcgagcgtcgccgattacttcgcgctgctgaagccacgggtgatgtcgctcgtgatcttcaccgcgctggtcggactgatgattgcgccgggccatgtacacccggtgctgggcttcaccgcgatcctgtgcatcgcggtcggcgccggtgcctccggcgcgctgaacatggcgctcgaaggcgatatcgacgtgctgatgtcgcgcacggccaaccggccgatcccgcgcggccgcatcacccgcggcgaggcgatggggttcggcctcacgctgtcgttcttctcggtgatgacgctcggcgccctggtcaactggtacgccgggggattgctggcctttacgatctttttctacgtggtgatctacaccatggggctgaagcgccggaccgcgcagaacatcgtgatcggcggcgccgccggcgcactgccgccggtggtggcgtgggcggcggcgacggggtcgctgtcggtcgagccgctgctgctgtttttgatcatcttcttctggacgccgccgcatttctgggcgctggcgctgttccgctccgacgattatgcgcgcgccggcgtgccgatgctgccggtggtcgccggccccgatgcgacgcggctgcagatcctgctctataccatcgtgctggtggcgatcgccgccgcgccctggccgctcggctatttcgactgggtttatggcgtcacctcgctggttctcggcgccggcatgctggtgctcgcgatcaatgtctatcgccatcgcaccggcagcacggcgctgcgcgccacgcgacgcctgttcgcattttcgatcctctatctgttcgcgctgtttgccgttctgctgctcgatgtgcttgcgaaggccgtcgcgccgttgatctggtaa

SEQ ID NO: 2380 - DNA, 993 bp, Maricaulis maris MCS10
ttggacaccatcgtgaccccaagcgaccatcgcgcagagggcgaggctgtttcgacagcctcgccccgcgactattttgacctgatgaaacctcgggtgatgacgctggtcgtcttcaccgcctttgccggcctcatcgcggcaccggttgatgccgatcccttcctggccttcatgtccatcctctgcctggccgtcggtgccggcgcggccggggccttgaacatggcctatgacgccgatatcgacgccaccatgcagcgcacgcgcaagcgtccgatcccgcgtggcgtggtgtcggtgtcgaacgcttatggcttcggtgttgtcgcctcgatcctgtcagtcttgctgatggcgctggcgagcaattatctcgccgccggcctgctggccttctcgatctttttctacgcggtcatctacacgatgatcctcaagcgttcgacgccgcagaatatcgtgatcgggggtgccgccggtgcctttccgccgatgatcggctgggtcgcggcgaccggcgaaatctcgctcgatgcggtgatcctcttcatgatcatcttcctgtggacgccgccccattcctgggcgctggcactctacaagtccggcgattacgccgcggccaatgtgccgatgatgccggtcgccaagggcgccaaatcgacgcgtctgcaaatcctgctctattccatcgtgctggttatcttcgccggcgcaccggtcctgaccgggctgggcggcgccgtctatggcgcgacctcgctcggcggcggagcgctctttctgctgctggcctggcggatttttcgttcgcgggccggtgaggcgggttcggccgaggagggcgcgctgtatgccgtgcgcgccggcgacaaggcagcccgtgacctgtttgcctactctatcggctatctgacggtgctatttgccgcattgattgtcgagcacgcatttggtgcatatgtggccattcccggagtgagcccatga

SEQ ID NO: 2381 - DNA, 939 bp, Bradyrhizobium BTAi1
gtgtcggtcattgatcagaacgccattgccgtcggtccgcggatctccgaagccgatgtcggcgattatctcgcgctgctgaagccgcgggtgatgtcgctcgtgatcttcacggcgctgatcggcctgctgatcgctcccggccatttccacccggtgctcgcgatcacctcgctgctgtgcatcgcggtcggcgccggcgcctccggcgcgctcaacatggcgctggaaggcgacatcgattcgctgatgtcgcggaccgccaaccgcccgatcccgcgcggccgcgtcacccgccaggaggcgctggccttcggcatcaccctgtcgttcttctcggtgctgacgctcggcatcctggtcaattggtatgccggcgcgctgctggcgttcacgatcttcttctatgtcgtcatctacacgctgtggctgaagcgctggacggcgcagaacatcgtcatcggcggcgccgccggcgccttgccgccggtggtggcctgggtcgcggcgaccgggtcgatcgcgccggagccgctgctgctgttcctgatcatcttcttctggaccccgccgcatttctgggcgctggcgctgttccgcagcgacgactatgcccgcgccggcgtgccgatgctccccgtcgttgccggtcctgatgcgacccggctgcagatcctgctctacacgatcctcctggtggcgattgccgccgcgccctggccgctcggctatttcgacgccgtctacggcgtcgtctcgctggcgcttggcgccggcatgctgtggtttgcgattgaggtgttccgcaagcgcgaacgcagccaatcgctgcgcgccaaccgcaagctgttcgccttctcgatcctgtatctgttcgcgctgttcgcgacgctcgggctcgaggcggtcgcgcgcatgatcgcgccgttgatctggtaa

SEQ ID NO: 2382 - DNA, 951 bp, Sinorhizobium medicae WSM419
atgacggtcatcgacaatcacgaggcagtcggcatggaaggcgcaccacgcctgtccgaggcctctgcgcgcgattatttcgaactcctgaagccgcgcgtcatgtctctcgtcgtcttcaccgccttcgcggggctcatccttgctcccgggcatatcaatccgttcatcggattcacagcgattctctgtatcgccataggagccggcgcctcgggtgcgctgaacatgtggtacgatgcggatatcgacgcggtcatgagccgcacggccaagcgcccaattccggccggaaagattttgccccaggaagcgcttgccttcggcctgacgctctcggccttctcggtgatcatcctcgggctcgccgtgcactggctcgcagccgggctgctcgcctttacgattttcttctacgtggctgtatacacgatgtggctgaagcgctcgacgccgcagaacatcgttatcggcggagctgccggggcctttcctccgatgataggctgggcctgcgtgaccggcggcatatcggtcgagagcatcgtgctcttcctcatcatcttcctctggacgccggcgcatttctgggccctggcccttttcaagatgggcgaatacggcgccgtcggagtgcctatgatgccgaatgtctgcggcgaggcgacgaccaagcggcaaatcgtcatctatgccgtgctcactgcgatcagcggtatctgtcccaccttgctcggcttcgcgagccttggttatggagcccttgcgacggccttggggcttgggttcgtcgggtattcgctgggcgtgctgcgcatgcctgaaggcgacaagcgaatggtgccggcgaagaagcttttcgccttctccatcgtgtatcttttcgcgattttctcggcgctcctggttgattacgcaatcgcccggatctggttcggaggcgtcatctga

SEQ ID NO: 2383 - DNA, 957 bp, Parvibaculum lavamentivorans DS-1
atgtcggatacagcgatcagcaaccagcgcgacaccgccgccttccccgaaggcggcatgggaagcgcacgcgactttttcgagcttctgaagccgcgtgtcatgtcgctggtgatcttcacggcgctggtcggcattgccgtggcgccgggcggcatccacccggtcatcgcctttacggcactcctctgcattgccgtgggcgcgggcgcgtccggcgcgctgaacatgtggtatgacgccgatatcgacgcgcgcatggcgcggaccgcgaaccgcccgataccggcgggccgcgtgacggcgcgtgaggccgcggtgttcggctcgatcctttcggtcttcgccgtgatgaccatgggcgtgcttgtgaactgggtggcggccgcgctcctcgctttcaccatcttcttctatctcgtcgtctatacgatgtggctgaagcggcgcactcctcagaacatcgtgatcggcggcgcggccggcgccttcccgcccatgatcggctgggcggcggtgacgggctccgtctccatcgagcctttcgtgctcttcctcatcatcttcatgtggacgccgccgcatttctgggcgctcgcgctctaccggagcggcgattacgagaaagtcggcgtgccgatgctgcccgtggtttcgggcgaaaaggaaacgcgacgccagatcatgctttattcgctggcgcttgtgccggtaacgctgctgccgggctttctcggcttcgcgggcgcgctctatatgggcgcgacggcggcgctcggcgcgggcttcctgtggctggctttcggcatctggcggacggagccgggcgcggcgcaggacaaggcggcgaagcggcttttcggatattcgattctctatctcttcctgatcttttcgctgctgctggtggagaagatgctgggccttggcggcaccgccttcgccctggcgctgtga

SEQ ID NO: 2384 - DNA, 948 bp, Xanthobacter autotrophicus Py2
atgcgtgacgaacaagcgagcctgaccaatcccgagccgtatgccttcgcggcggccggagagggactggcgtcgccacgcgactatttcgagctcctgaagccgcgtgtgatgtcgctcgtcatcttcacggcgctggtgggtctcgtccgcgcgccgggagatgtgcaccccatcatcgccttcaccgccctgttgtgcatcgccgtcggcgcgggtgcggccggcgccctcaacatgtggtgggacgcggacattgacgccatcatgtcgcgcacccgcaagcgaccggtgccgtcgggccgggtcacggcccatgaggcgctggccttcggcctcaccctgtcggccttctcggtggtggtgctggggctgctggtcaacgcgctggcaggcgcgctgctcgccttcaccatcttcttctatgtggtgatctacaccatgtggctgaagcgctcgacgccgcagaacatcgtcatcggcggcgccgccggtgcgttcccgccactggtggcctgggcggcggcttctggcacggtgtcgctggagccggtgctgctgttcgccatcatcttcttctggaccccgccccatttctgggccctggccctctaccgggcggacgactacgcccgcgccggcgtccccatgctgccggtgacggcgggtcccgacgaaacgcgccttcagatcctgctctacaccctgttcctggtgccgctggctgccagtcctgccgtgctcggctatgtcggctacgcctatggtgcggtggcggtgctggcgggggcctggatgatcgctctggcctggcgcgtctatcgccgccgcgagggggaggctgccgtgaaggcggcaaagggcctgttcggcttctcgatcgtttatctgttcgcgttgttcgccacactcctcggcgaggcggtgattggtgggctgctgcgatga

SEQ ID NO: 2385 - DNA, 954 bp, Methylobacterium extorquens PA1
atgacgagcctgtcgaacagcctgagtgccgacaccggcaccacgtcgttctcccccgccgcggggggcgaggtttccgacttcttcgccctgctgaagccgcgggtgatggtgctcgtcatcttcaccgcgctcgtcggcatggtggtctcggacgcgaccgtgaacccggtgatcgcggcgatctcgctgctgatgatcgccgtcggcgcgggcgcctcgggctgcctcaacatgtggtgggacgctgacatcgacgcgctgatgacccgcaccgccaagcgtccgatcccggacggccgcatccgccccgacgaggcactggccttcggcatcgtcctgtcggtcggctcggtgctgatcctcgggctggcctcgaactggctcgcggccgggctgctcgccttcaccatcgcgttctacgccgtgatctactcgatgtggctgaagcgggcgaccgcgcagaacatcgtcatcggcggcgcggccggcgccctccccccggtggtgggccaggccgccgtgaccggccatgtcggcatcgagtcgctggttctgttcgcgatcatcttcatttggacgccgccgcatttctgggcgctggcgctcgtgaagagcggcgaatacgcccgcgccggcatcccgatgatgccgaacgtcgccggcccggattccacccgccgccagatcatctggtactcgctggtcctcgcgccgctggccctcctgccggtctggctcggcttcggcggctggctctacgccgtcgtcggcgtgctcggcgggctcggcatgctggcgggcgcggtgcaggtctaccggctgcgtgagggcgagcccgagcgcaaggcggcgatgggcctgttcgccttctcgatcctctacctgttcctgctcttctcggcgctgctcgccgagcagggactcggattgttccgcgcggtcgcagcgtga

SEQ ID NO: 2386 - DNA, 951 bp, Methylobacterium radiotolerans JCM 2831
atgacgagcctgacgaacacgatcggaccggacgttccgggtccggccctcacgaccgccggcggcgacgttccggactacttcgccctgctgaagccccgggtgatggtcctcgtcatcttcaccgcgctggtcggcatggtggtctcgcagggccacgtgcagccggccatcggcgcgatctcgctcctcgccatcgcggtcggagccggggcgtccggctgcctgaacatgtggtgggacgccgacatcgatgcggtcatgagccggaccgccacccggccgatcccgtcgggccggatcacctcggaggaggcgctgggcttcgggctgttcctgtcggtcgcctcggtggtcgtgctcgggctcgccgccaatctcctggccgccgcgctcctcgccttcaccatcgtgttctacgcggtggtgtactcgatgtggctgaagcgggcgaccgctcagaatatcgtcatcggcggcgccgcgggcgccctgccgccggtcatcggccaggcggtggtgaccgggtcgatcggcatcgagtcgctgatcctgttcgccatcatcttcatctggaccccgccgcacttctgggcgctcgccctgatcaaggccgacgagtacgcccgcgccggcatcccgatgatgcccaacgtggccggcccggcctccacccgccgccagatcgtgtggtactcgctgctcctcgcgccgctcggcctcgtcccggtggcgctgggcttcggcgggctcgtctacgctgtggtcggcctggtgggcggcctcggcatggtggccttcagcatccgggtgcttcggaacccggagggcgatgccgagcggcgcgccgccatgggcatgttcggcttctcgatcctctacctgttcgcgctgttctcggcgctcctggccgagcagagcttcggcctgttccgcccggtcctgggttga

SEQ ID NO: 2387 - DNA, 966 bp, Beijerinckia indica ATCC 9039
atgacctttatcagccaagcaccctccgtttcgatttcgagcgccggtccgtccgattatttcgcgctgctgaaaccccgggtcatgtcgctggtcatttttaccgccttggccggcatgttgatcgctcccgatcccgtccatccaatcgtcggtttcgcaagcctgctcgccattgccgtcggcgccggcgcttcgggcgccctcaatatgtggtatgacgccgatatcgacgccgtgatgaagcgcacggccaaacgcccgattccgcttggtcgggttatgccgaacgaggctttggccttcggcctgacgctgtccttcctctcagtcttcacgctcggcattgtcgcgaattggctggccgccggctttctggccttcaccatctttttctatgtcgtcatctatacaatgtggctgaagcgttcgacgcctcagaatattgtcattggcggcgcagccggcgcctttccgcccatggtcggttatgccgcggcgactggccacttcagcctctcaagcttcatcctcttcgccatcatcttcatctggaccccgccgcatttctgggcgctcgctttggggcgttcggaagattaccggcaggccggcatcccgatgatgcccaacgtcaagggcgccgcgcgcacgcggctggaaatccttctctatacgctgctgctcgccccgctcggtgtcgccccctggctgctcggtttcgcttcgttcgtctatggcatgctgtcgatcgcacttggcgccgccatgctctttttcgcggcgcgtgtctatatcgtgcaagaggggccctcggccgatcgtcatgccaaggccctattcggtttttctatcctctatctgttcctgctgttcgccgagatcgtcgtcgaaaggctcgtgccaatcgtcgtcgcgatgggcgcctggttgacctcgggcatgttccccgggttttttcattga

SEQ ID NO: 2388 - DNA, 954 bp, Methylobacterium populi BJ001
atgacgagcctgtcgaacagcctgagtgccgacgccggccgcgcgtcgctcgcctccgccgcgggcggcgaggtctccgacttcttcgccctgctgaagccgcgggtgatggtgctcgtgatcttcaccgcgctggtcggcatggtcgtctccgacgccaccgtgaacccggtgatcgcggcgatctcgctgttgatgatcgcggtcggggccggcgcctcgggctgcctcaacatgtggtgggacgccgacatcgacgcgctgatgacccgcaccgccaagcggccgatcccggacgggcgcatccgccccgacgaggcgctcgccttcggcatcgtgctctcggtcggctcggtgctgatcctcgggctcgcctcgaactggctcgccgccgggctcctcgccttcaccatcgtcttctacgccgtaatctactcgatgtggctgaagcgggcgacggcgcagaacatcgtcatcggcggcgccgccggcgccctccccccggtcgtcggccaggccgcggtgactggccatgtcggcatcgagtcgctcgtgctgtttgctatcatcttcatctggacgccgccgcatttctgggcgctggcgctcgtgaagagcggcgagtatgcccgcgccggcatcccgatgatgccgaacgtcgccggccccgattccacccgccgtcagatcgtctggtactcgctgctgctcgccccgctcgccctcgtgccggtctggctcgggttcggcggctggctctatgccgtggtcggcgtgctcggcggcctcggcatgctcgcgggcgcggtgcaggtctaccggctgcgcgagggtgagcccgagcgcaaggcggccatgggcctgttcgccttctcgattctctacctgttcctgctcttctcggcgctgctcgccgagcaggggctcggattgttccgcgcggtcgcagcgtga

SEQ ID NO: 2389 - DNA, 939 bp, Rhodopseudomonas palustris TIE 1
gtgtcggtcatcgacgtcaatccgatcccgcttgcgccccggatctccgaagccggcgtcgccgactacatcgcgctgctcaagccgcgggtgatgtcgctggtggtgttcactgctctggtcggcctgttgatggcccccggcagcttccatccggtgctggcgatcaccgcgatcatctgcatcgcggtcggcggcggcgccgccggcgcgctgaacatgtggtacgaggacgacatcgacgccaagatgacgcgcaccgccaaccggccgatcccgcgcgggcgggtaacgcggccggaggcgctgaccttcggcatgacgctggcgttcttctcggtggtcacgctcggcatcctggtgaactggatcgccgccggcctgctcgccttcactattttcttctacgtcgtgatttacacgatgtggctgaagcgctggaccgcgcagaacatcgtgatcggcggcgccgccggtgcgttaccgccggtggtggcgtgggcctcggtcactggatcgctggcggtcgagccgatcctgctgttcctgatcatcttcttctggaccccgccgcacttctgggcgctggcgctgtttcggaacgacgactacgcccgcgccggggtgccgatgctgccggtcgtcgcgggccccgatcacacccggctgcagatcctgctctacaccgttgcgctggtcgcggtcgcggccgcgccgtggccgctcggctatttcgacgcgatctatggcgtggcgtcgctggcgctcggcggctggatgctggtgctggcggtgcgggtgtatcgccatcgttccggcagcgccgcgctgcgcgcgacccgtaatctgttcaaattctcgatcctgtatctgtttgcgctgtttgcgctcctgttggtcgaggtgatcgctgcggccgtgctgcggctgatcggctga

SEQ ID NO: 2390 - DNA, 954 bp, Methylobacterium sp. 4-46
atgacgagtctgacgaacagcctgaatcccgcccggagcctcgcgccggcctcgaacggcgacgtcgcggatttcttcgccctgctgaagccgcgggtgatggcgctcgtgatcttcaccgcgctcgtcgggatgacggtgacgaagagccacgtgaacccggtcatcgccgcggtctcgctcctgatgatcgcggtcggcgcgggcgcttcgggctgcctcaacatgtggtgggacgcggacgtggacgcggtcatgtcccgcacccggacgcggccgatcccggcgggcaagatccgccccgacgaggccctggccttcgggatgacgctctcggtcggctcggtgctgatgctcgggctcgccgccaactggctcgcggccgggctcctcgccttcaccatcgccttctacgccgtgatctactcgatgtggctgaagcgggcgacggcgcagaacatcgtgatcggcggcgccgccggcgccctgccgccgatgatcggccaggcggtcgtcaccggcacggtcgggatcgagggcctcgtcctgttcctgatcatcttcgtctggacgccgccgcatttctgggcgctggccctggtcaagtctggcgactacgccaaggccggcatcccgatgatgccgaacgtggccggccccgactcgacccgccgccagatcgtcgcctacacgctgctgctcgcgccgctcggcctcgccccggtggcgctcggattcggcggcctgatctacggcctcgtggcgctgctcggcggcctcgcgatgctggcgctcagcctgcaggtctaccaccgccgcgagggcgagggcgccgacaaggccgcgatgggcctgttcggcttctcgatcctctacctgttcctcctgttctcggcgctgctcgccgagcagggcctcggcctgttccggccggtctcgcagctgttcggatga

SEQ ID NO: 2391 - DNA, 951 bp, Rhizobium leguminosarum bv  trifolii WSM2304
atgacggttatcgacaatcacggggcgcttgcaaaggacggcgaattgtcggaagcgagtgcgcgcgattatttcgaattgctgaagccgcgggtgatgtcgctcgtggtcttcaccgcctttgccggcctggtgctggcgccgggccacatccatcccgtcctcggcctgatcgccattctctgtatcgccgtcggcgccggcgcttccggcgcgctcaatatgtggtacgacgccgatatcgacgccatcatgagccgcaccgccaagcgtccgatcccggccggccgcatcgcgccctcggaggcgctggccttcggcctggtgctatcaggcttctcggtcgtcatcctcggccttgccgtcaactggctctcggccggcatccttgccttcaccatcttcttctatgccgtcgtctacaccatgtggctgaagcgctcgacgccgcagaacatcgtcatcggcggcgctgccggcgccttcccgccgatgatcggctgggcctgcgtcaccaacagcgtgacgatcgagagcaccgttctcttcctgatcatcttcctgtggacgccggcgcacttctgggcgctggctctgttcaagatgcgcgattacgaggccgtcggcgtgccgatgctgccgaacgtcgccggcgagcgggtaaccaagcatcagatcgtcgcctatgcggtgctgaccgcggtttgcgggatattgccctccttcctcggtttcgcaagcttcggctacggcctggtggccgccgcgctcggcgcgatcttcatctactgttccatcgccgtctggcgtatgcccgacggcgatctgaagatgatcccggcgaagaagctgttcgccttctcgatcttctatcttttcgccgtgttctccgccctgatgatcgaccggctggcctcgatcttcgtctcgcacaccggaggctggttctga

SEQ ID NO: 2392 - DNA, 951 bp, Methylocella silvestris BL2
atgagtttcgtcagcgacagcaatacagccatcgaccaggccgccatctcgatcgcgagcccggcggattatctcgcgctgatgaagccgcgggtcatgtcgctcgtcattttcactgccttgaccggcgttttgatcgcgccgacccatgtcaatccgatcatcggcttcgcctccttgctcgccatcgccgccggcgccggcgcgtcgggcgccctcaacatgtggtatgattctgacatcgacgccattatgcggcggacgcagaagcgtcccatcccggcaggccgggtggcgcgggaaagcgcgctcgcctttgggatggtgctcgcgcttttgtcggtgatcacgctcggattcgtcgccaattgggcggccgcggcccttctcgccttcacaatcttcttttacgtcgtcatctacacgatgtggctgaagcgctcgacgccgcagaatatcgtgatcggcggcgccgccggcgcttttccgccgatcgtcgcctatcttgccgtcgccggtcaggtcagcctgcccgcgctcgcgctgttcgccatcattttcgtctggacgccgccacacttctgggcgctggccctcgtcaaggccggcgatttcgagcgcgccggcattccgatgctgccgaacgtcaaggggccggaccgcacgcggcgggatattctgctctacacgctgctcctcgctccgataggcatgacgccctatttcatcggcttcgcctcgccggcctatggccttctttcctttggcctgggcggcgtcatgattcttcatgcggtgcgagtctatctggcgcgcgagggagatcaggcaaaccgcgtcgccatgcgcatgttcggcttttcgattctctatcttttcctgcttttcgcggcgatcgtcgccgaacgcattctcgccctgctgccgatctctagcgcgacgccgtggtga

SEQ ID NO: 2393 - DNA, 954 bp, Methylobacterium chloromethanicum CM4
atgacgagcctgtcgaacagcctgagtgccgacaccggcaccacgtcgttctcccccgccgcggggggcgaggtttccgacttcttcgccctgctgaagccgcgggtgatggtgctcgtcatcttcaccgcgctcgtcggcatggtggtctcggacgccaccgtgaacccggtgatcgcggcgatctcgctcctgatgatcgccgtcggcgcgggcgcctcgggctgcctcaacatgtggtgggacgccgatatcgacgcgctgatgacccgcaccgccaagcgtccgatcccggacggccgcatccgccccgacgaggcgctggccttcggcatcgtcctgtcggtcggctcggtgctgatcctcgggttggcctcgaattggctcgcggccgggctgctcgccttcaccatcgtgttctacgccgtgatctactcgatgtggctgaagcgggcgaccgcgcagaacatcgtcatcggcggcgcggccggcgccctccccccggtggtgggccaggccgccgtgaccggtcatgtcggcatcgagtcgctggttctgttcgcgatcatcttcatctggacgccgccgcatttctgggcgctggcgctcgtgaagagcggcgagtacgcccgcgccggcatcccgatgatgccgaacgtcgccggcccggattccacccgccgccagatcatctggtactcgctggtcctcgcgccgctggccctcctgccggtctggctcggcttcggcggctggctctacgccgtcgtcggcgtgctcggcgggctcggcatgctggcgggcgcggtgcaggtctaccggctgcgtgagggcgagcccgagcgcaaggcggcgatgggcctgttcgccttctcgatcctctacctgttcctgctcttctcggcgctgctcgccgagcagggactcggattgttccgcgcggtcgcagcgtga

SEQ ID NO: 2394 - DNA, 954 bp, Methylobacterium nodulans ORS 2060
atgacgagtctgacgaacagcctgaaccccgcacagaccctggcgcccgcctccaacggcgacgtcgcggatttcttcgccctgctgaagccgcgggtgatggcgctggtggtcttcacggcgcttgtcggcatgaccgtgtcgccgagccacgtgaacccggtgatcggggccgtgtcgctgctgatgatcgcggtcggggcgggcgcctcgggctgcctcaacatgtggtgggatgcggatatcgacgcggtgatgacccgcacccgctcgcgcccgatcccggcgggccggatccgcccggaggaggcgctgaccttcggcctcgtgctcgcggtgggctcggtgctgatgctgggcctcgcggcgaactggctggcggcggggctgctcgccttcacgatcgtcttctacaccgtgatctactcgatgtggctcaagcgtgcgacggcgcagaacatcgtgatcggcggcgcggccggagcgcttcccccgatgatcggccaggccgtggtgaccggcagcgtcggcatcgagggcatcatcctgttcctcatcatcttcatctggacgccgccgcatttctgggcgctcgccctcgtcaagtccgccgactacgccaaggccggcatcccgatgatgccgaacgtggccggcccggattcgacccggcgccagatcgtcggctacacgctcctcctcgcaccgctcggcctcgcgcccgtggcgctcggcttcggcggcctgatctacggcctcgtggccctcctcggcggcctcgccatgctggtgctgagcctgcaggtccaccgccgccgcgagggcgagagcgccgacaaggccgccatgagcctgttcggcttctcgatcctctatctcttcctcctgttctcggcgctgctcgcggagcagggcctcggcctgatgcggccgattcccgtgttgctcggatga

SEQ ID NO: 2395 - DNA, 978 bp, Agrobacterium vitis S4
atgacaggtcaggacagcataatggcagccatagacaacagcaacatcatcggtctggacagtgagatctgtctgtccgaagcgggcgcgaaggatttcttcgcgcttttaaagccgcgggtgatgtcgcttgtggtgttcacggccttcgcaggtctggtgctggcaccaggcacgatcaaccccattctgggtgtcattgccatcctgtgcattgcggttggggctggcgcctccggcgctctcaatatgtggtatgatgccgatatcgatgcggtgatgacccgcacggcgcgccgccccatcccggcaggccgtatccgtccgcaggaggcgctggccttcggcatcacgctgtcggtcttttcggtctcgattcttggcctcgcggtcaattggttcgccgccgcctttctggccttcaccatcctgttttacgctgtcgtctatacgatgtggctgaagcgctcgaccccgcagaatatcgtcattggcggcgcatcgggtgcctttccgccgatgatcggctgggcctgcgtgactggtggcgtgtcgctggatagcgtcattctgttcatggtgatcttcctgtggacgccagcacatttctgggccctggcgctctacaagatgcgcgattacggctcggtcggcgtgccgatgatgccgaatgtggcaggcgaaacctccaccaagcggcagatgttcgtctatgccgtgctgaccggggtctttgccgtggcaccggcttttaccgggcttgcttcgctctggtacgggctggtggctggtgtgctgagtgccgtctttgttgcctgctccgttgccgtttggcggatgcgagagggcgatgaacgcatggcaccggcccgcaaaatgtttgcctattcgatcttctatctgttcgcggtgttttcagccctgctggtcgatcattatgcggcgagtcttctcgcccatgcgtcgggagcactgtga

SEQ ID NO: 2396 - DNA, 951 bp, Rhizobium leguminosarum bv  trifolii WSM1325
atgactgtcatcgacaatcacgaggtgcttgcaaaggacggcgaattgtcggaagcgagtgcgcgcgattatttcgaattgctgaagccacgagtgatgtcgctcgtggtcttcactgcctttgccggtctcgtgctggcgccgggccacatccatccggtcctcggcctgatcgccatcctctgtatcgccgtcggcgccggcgcctccggcgcgctgaacatgtggtatgacgccgatatcgacgccatcatgagccgcaccgccaaccgtccgatcccggccggccgcatcgcaccctccgaggcactcgccttcggcctggtgctttcaggcttctcggtggtgattctcggcctggcggtcaactggctctcggccggcatcctcgccttcaccatcttcttctatgccgtcgtctacaccatgtggctgaagcgctcgacgccgcagaacatcgtcatcggcggtgctgccggcgccttcccgccgatgatcggctgggcctgcgtgaccaacagcgtgacgatcgagagcaccgttctcttcctcatcatcttcctgtggacgccggcgcatttctgggcgctcgccctcttcaagatgcgcgactacgaggccgtcggcgtgccgatgctgccgaacgttgccggcgaacgggtgaccaagcatcagatcgtcgcctatgcggtgctgaccgccgtctgcgcggtattgccgtccttcctcggtttcgccagcttcggttatggcctcgtcgccgccgccctcggtgcgatcttcatatactgttccatcgccgtctggcgcatgcccgacggcgatttgaagatgatcccggcgaagaagcttttcggcttctcgatcttttatctcttcgccgtgttctccgccttgatgatcgaccggctggcctcgctgctggtctcgcatgcgggaggttggttctga

SEQ ID NO: 2397 - DNA, 940 bp, Wolbachia endosymbiont of Drosophila melanogaster
gtgttagaaatattaaatgtagtgttacttttgttgttactaacagttacggtttttatagttttctcgcgacatttagtcgtaagtgctgttctaatgtgtgtatttagttcactgattgcgcttatatacttaattatgaatgcacctgatgttgcaattactgaagcttctgttggtgcggggctcagtacagtttttacgtttgcagcactctccttgataaagaatcataaagtaaatctatctcataaccctataacgcttttttttatgttatttctggctgtatgtttgtcatattttatgattcaattgccagattttggcagccacaatgctccgatccacttgcatgttgctccttattatgtggaaaataccgaaaaagctaccggtattcctaatatagtgacagctattttggcaagctttcgtggttatgacacgtttggagaaactatagtagtttttactgctgcgctttgtataacgttgatattaaaagaagaaaaagaaaatgattaaagatccgatattaaatgcagtaacatttttgatgataccttttatcattttatttggtttatacatacaatttcacggtgattacactccgggtggaggttttcaagcaggaataattattgcctccgggataatattatattcaatgctatttggtgtatctacaactctaaaagcaataccttattctgtgattagattgactaacgtgttaggtattttaatttatggaggaacgggcgttgcaacaactttacttggccaaaattttttatcttatgatatcttgttaaccaataatagaaccggtcaaaaattaggtatttttttggtggaattaggtgtagcatttactgtctgctcctctatgttaattatatatataaattttgctcgtaggaaaaaacaatga

SEQ ID NO: 2398 - DNA, 2949 bp, Thermobifida fusca YX
ttgatatggctactggttgcgcacttcacggctgcggcactagctccggcgctagtccgtaagtgggggcggcaggccttcttcgcgctcgcacttgtccccgcgagcgccgcaatctgggcactcccccgggcgccaggcgtgatcgccggtgaaccggaactgttcttcctcccatgggcgcccaactaccagctggccctggccttccgcatggatgcgctcagcctcgtcatgctgctgctggcagcggggatcggcgccctcatcctcctctactgcgcccgctacttcagcgacgacgaaccgggcctcggccgcttcgccggagtcctcaccggtttcgccggtgccatgatcggcctggtcctcgccaacgacctcatccagctctacctgtactgggagctgaccaccgtcttctcctacctgttgatcggccactaccccgagcggcgcgacaaccggcgtgccgcagccatggcgatcaacgtgaccaccatgggcggcctcaccatgctggtcggcctggtcatcctgggggaaagcgcgggcacctacctcatctccggcatccttgccgagccgccgagcgggaccgccgtcaccgtggcgctcgtcctgatcctggtcggtgccctgtcgaagtcggcgatcttcccgttcagcctgtggcttcccgcagccatgcaggcccccaccccggtcagcgcctacctgcacgccgctgccatggtcaaagccggggtgtacctgatcgcacggctcacccccgccttcggtgacatcccggcctggcagtacaccgcggtcatcctcggcacagcgacgatgatcgggtccgggtggcgggccctgcgccagcacgacctgaaactgctgctggcccacggaaccgtgagccagctcggcttcctcaccgcgatcttcggcatagggacgcgggatgccgcactcgccggactggccatgctgtgcgcgcacgcactgttcaaagccccgctgttcctcgtcgtcggcatcatcgaccacagcaccggaacgcgggacctgcgggagctgtccgggctgcgcaagaagatgcccgtcgtgttctggacgtcggtagtcgcactgatgtccatggccggcctgccgcccatggccgggttcgccgccaaagaggccgcgttcggcgcgttcgagcacgccgacaccctcctcgccaccctcgccctggccggagtggtggtcggcacgctcttcaccgtcggctacagcctgcggttcctctggggcgcgttcttcgacaaagagaacacctcccccactccgctcctccatcccccgggaccgctgttcgtcgctcccgccatcgtcctcgcggccctcagcctcctcggcgggttcggcgcgtccctcgccgacccggtgttcgccagctacgccgacaccgttcccggcgctgggcacgaccccgcccacctagcgctctggcacggcttctccctcccgctgctgctgaccgcgctctgcctggccggcggtctcctgctgttccgctggcgggtcatggtcgcgtggctgggcgcccggttcgcgcttcccgaagccgggaacgtctaccggcggatcgtctactacctctccagcttcgccacccaggtcaccggcctcacccagcgcgggtccctcccgctctacctgggcacgatcctcgtgtccctgctcgtcgtcagcacggcgccgatcgtgtggggacggctgtggacgctggacgtgccgccggtgcgctggatcgacacgccgccccagctcatcccggccgcgatcatcatcattgcggcgctgtggacgctgatcgtgcgcgggcggctgttcgcggtagtgctcgtcggcatgaccggctacggcaccgccaccctgttcgccctgcacggcgcccccgacctggcgctcacccagttcctagtggagaccgtcagcctcgtcgtgttcgtgctcgtgctgcggcgcctcccaccccagttctccacgccggtgctccgcagccgccgcctcgtgaacctggcgatcggcatcggcagcggaatcctggtggctgtcatggcctacctcactctcgcgggacggcaggccgaatccatctccgaaggattccccgccgcggcggaagaagccgggggaagcaatatcgtcagcgtgctgctggtggacgtccgcagttgggacaccatgggggagatctcggtgctggccgcggtcgccgccggcgtggcgagcctgctgttcgtccggcgccgcacccgcctgccccacacccacatcgaaaccgggcgaatcgtggcgcggctcccccagccgccctccaacggggaaagcgaatggtcgccgctgccgctgacctatgtcggcgacatcatcaccccccgcgtggcgcacaagccgctgtggctgcccggggtgctgaccctcgcgcaagagcgccggtcgatcatcttcgaggtcgtggcgcgcctcatgttccccgtgatcatcctcatctccgtcttcctcctgctcaccgggcacagccacgtcggaggaggattcgcgggcggcatcgtcgcgggcctcggcctcatggtgcgctacctggcgggcggccgccacgagctgtacctctcgctgcggctccccccgggcctgctcatcggcctcgggctctccatcaccacgggcacggcactggccggagccatcttcgggaccgagatcttcgccggaggggcgttcgacctgcacctgcccttcttggagccgatccacctcacctcggcactcgctttcgacttcggtgtctacgtgctggtcatcggcctcatccaggacatcctgtacagcctcggcgcgggcatcgacgaacaggctgagaaggacagccgtaccggtaaggcacccgaatacgaaagcgaggaggtgaccgcgtga

SEQ ID NO: 2399 - DNA, 961 bp, Ehrlichia chaffeensis Arkansas
atgatgctgactgatgtgaattttattataaatgttattttatctttatttttagtattcgtgtcatcttgtttggtattatttaaaagtcttactgtgaatgtgataatgatgtgtatatttagctttttgatggcattgttgcatttagtaatggatgctccagatgttgcaattacagaagctgctgtaggggcagggataagtactatactaatgttggttgctttatcattaattgatacagatgagaaacaaacgtgtggtaatataaaaatatttcctattattgttgtattaggagtgtttgtaagtttgatgtatgtaatacctgatttacctgtttttggtgatgctaattcttttgcaaataatcacgttgcatcttactatgtaaaaaacacttactcttatatgggaattcctaatatagttactgcaattttagcaagttttcgaggatatgatacttttggtgaaacggttgtaatatttactgcttctttgggaatttctttattgcttgctaaggataatcatcatgtttaaagatccagtgttgcgaacagtatctattttaatgatacctgttataattttgtatggattgtatattcaatttcatggtgactatagtccaggtggtggttttcaggctggtgttattgttgcatctgcaattattttacatggtatattatttggattaaaggtcactttaaaagtgatatcaccctatattgtcagattaattggtggtattggtattttgatatatggaggtactggtattgcatctatgttacttggtggtgaatttctctcgtattctactttggctagtgatccagtattgggacaaaagttagggatatttcttgtagaactaggtgtgggcatgactgtgtgtagttctatgttgactattttttttaattttgtatcttcttataaagaataa

SEQ ID NO: 2400 - DNA, 1005 bp, Shewanella sediminis HAW-EB3
gtgcggaccaaagatctgctcgccgtggtgatgttaaccgggatctacggcttactctccgcgagcttctttgttgtactcgatgccgtggatgtggcctttaccgaagcctctgtaggcgcgggaatatctggcttactcatgctggcagctatcaccatgacaggtcgcaccgaggcccctaaacggcataaacctctgctggctctattagtggtatttatcactggtggcatgctgatctacggcaccttagatatgccctactttggcagtttcgacgcaccggttcatcaacatgttgcccctcgctatattaatgattctatgcaggagatcggtgttcccaacattgtcacttcagtactggctagctaccgtgcctttgacaccttaggtgaggtcgccgttatctttactgcgggtattggtgtgctgtcactgctatcgctgcctctacgccgcaggtcacttcaattaggtgagagcagcaatgagagcaaaaaagatcagatgcatgagcagcatatggtgctacggatcatcagcaaaatattgatcccctttatcttgctgtttgcactctatgttcagttccacggtgactttggccctggtggcgggttccaggcaggtgtgatttttgccgctgcaatcatcctctatgccatgttatttgggctagacaccgcaaggcgtgtctttaatcaatcgcttatccaactgatcgctgctatcggcttgctgctctatgccagtgtcggtgtggtctcgctatttaacggcggtaacttcttagattacaacgtactcgctgatgaccccattgctggtcagcacttaggtattttgcttatcgagctgggcgttggctgcacagttgctgcggtgatgatcattatctatttcaactttgcaggtcgcagagaagcgcaacagcaggctactgagataaacagcattgaactgagctttactaaacagaacaaaggcgagggggaataa

SEQ ID NO: 2401 - DNA, 1038 bp, Shewanella pealeana ATCC 700345
atgttgacggggatctatggattactctctgcaagcttttttgttgtattagatgctgtggatgtggcctttaccgaagcctctgtaggcgcaggtatatctggtttattgatgctggcagccatcagcatgacaggccgcaccgagtcgcctaagcgtcacaagcctttactggctttatttgtggtacttatcacaggtggcatgctgatctacggcaccatggatatgccttactttggcagtttcgatgcacctattcatcaacatgtcgcacctcgttacattaatgactcgatgcaggaggtcggtgtacccaatattgtcacctcggtactcgcgagctaccgagcatttgataccttaggtgaggtagccgttatctttactgccggcattggggtgttatcactcttggcattgccgcaacgacgtaagtcatatcgcttagatgagcccaaaaaagagcagatgtatcagcagcatatcgtactgcgagtcatcagcaaagccttgatccctttcatcctgctgtttgcactctatgtgcagttccacggcgattttggtcccggagggggctttcaagctggggtgatctttgccgcagcaatcattctctatgccatgttatttggcttagacaatgccaagcgtgtctttagtctatcgctgttccaactgctcgcagctatcggactcttgctatacgccagtgttggtgtggtctcgctatttaacggaggtaacttcttagattacaacgtattggccgacgaccctattgctggccagcacttaggtattttgctgatcgagcttggtgtgggctgcaccgtcgcctcagtgatgatcattatctttttcaactttgccggccgcagagaagcacaacagcactctactaaacagaactgtcatgaactaatcagtccagaactaaaccgcaatgttctaaatagtactgagctaaacagtactgaactaaacagtgctgagctaagcattactgtactaaacaacggcgaggtgaagtaa

SEQ ID NO: 2402 - DNA, 996 bp, Shewanella woodyi ATCC 51908
gtggtcatagccatcgcaattgtccgcactagagatctattagcggtcgtcatgttaaccgggatctatggcttactctctgccaacttctttgtggtacttgatgcggtagatgttgcctttaccgaagcctctgttggggctggaatatctggtttgttgatgctgacggccataaccatgacagggcgaaaagaagctcctagacgtcataaaccatttcttgcactctttgtagtactcgtcactggcagtatgctgatctacggcaccatggatatgccctattttggtgccgttgacgccccagttcatcaacatgttgcacctcgctatattcatcaatcaatggaggaggttggtgtccccaatattgttactgcggttttaggcagttatcgtgcattcgatactttaggggaagtggcggttatctttaccgcaggtataggtgtgctctctttgctgtcactgcctcgtcgccgcagggccgtcaaatctgatgaggcaacggtagagcagatgcatgagcgccatatggtgcttcgtattgtaagcaaggttcttattcctttcatcttgctgtttgctctctatgtgcaatttcatggcgacttcggtcccggtggcggcttccaggccggtgtgatattcgcagcagcgattattctctacaccatgttatttggtttagaaaccgctaagaaggtgtttaacccgtcgataatccagctgctcgcagcggttggattgctgatctacgcctgcgttggggtggtatccatgctcaatggcgccaacttcttagattataacgtgctggctgatgacccagttgcaggtcaacatatagggatcttgctgattgaattaggggtaggtattacagtcgcagcagtgatgttgagtatcttttttaactttgatggtcgcagacaagcacagcaacactgcacagaacaaaaaggggagcatgatgtttctcggactctataa

SEQ ID NO: 2403 - DNA, 1070 bp, Desulfohalobium retbaense DSM 5692
atgatttggcaaatcgacctgctggtcttgaccctggtacttatttgcgggttcttttccctgcgcatcaaggacctcttgagcgcggccattttgtacagcgcctatagttttatgatgtgtctgctctgggccgtcatgggcgcggtggacgtagccttcaccgaagccgcggttggagccggagcgagtaccgtctttttcctggctgccatttaccgcacgacaaggaggacaaaagattgagaaagctagctctgctcagcatctgcatcagcggcctcctgctgatttatgccactggcgattttccgtccttcggtgatccccattccccggcggcggaatatctctctccccactatatcgaacagacattggaagagacgtccgtccccaacatcgtttccgccgtgttggctgactacagaggatacgacaccatgttcgagacggtggtggtcttctctgccgccctggcctgctttttcctgctgcgctttcgcaaagcctctcctcgggacagattttatcggcacaacttgaccggagtggtcctgcatctgaccggggacaaaaagattcctgaagggtctgtccattttgagcgtatcgactccaaatggaccccacagacgcccatcgtgcgcatcgtctcgcggttgttaactccttttctccagctttttggcctctatgttattttccatgggcaccacagccctgggggaggcttccagggcggtgtcatactgggggcgtcgtttctcctcctggcgctttcccatgacctgcggtttgtcatttcccgcgtcggggaaaaattcctctccatcttcaatgccctcggggtcatgctttacagcggtgtcggccttatctgtcttggccttggtgccaatttccttgactactcaagtttgtcggccatcatgccggtcaacgaagtcgcggcccgttcatggggcattctttttgttgaaatcggcgttggtatcacggtcatggcttccatgatacttatctacaacaatgtggcctctgaaggccgttgggacgaggggctctaa

SEQ ID NO: 2404 - DNA, 1155 bp, Ralstonia solanacearum
atgattgcctgctggaaacacctggcgatggcgctgctgctgggcagcgcggcggcgctcgcatcggcgcagcagccggccagcgtgcccgccgtcgcgcccgccaatccggccgtgcagcccgcgcagccgttcgccaacgtcgtctccgagagcgtcttcgacctgccccggcgcgacctggccaaggaggcgcaggaccagaccgcgcgccgcgtcacgcagccgggcaacaacgcgccggtctggcgcgaggtcaattccgaccaggccggctacgcgagcctgcccgggctggagagcggcgtgctgatccagcgtaccggccagaagtggcggctgttccgcaacggtgtcatcaccgtgtggggcggctggctggtggtgctggtgccgctggcgatcctggcgttcttcctgcggcggggccagatccgcttgaaggcggcgcccaccggccgccggatcgaacgcttcacgcccaccgagcgttacgtgcactggaccatggcgatcagcttcgtcacgctgggcgtctcgggcatcgcgatgctgtggggcaagcatttcctgctgccgctgatgggccaccagctgttcggctggctgacctacgtgctgaagaacctgcacaacctggtcgggccgctgttcaccgtcagcatcgtcgtcgccttcgtgatgtgggcgcatgacaacctgccgcgccgcggcgatctgcaatggctgctgcgcctgggcggcatgttcggtggccatggcgccgaggtgccgtcgcatcgcttcaacgcgggcgagaagctgtggttctggggcgggctggtggtgttcgggctgatcctgtcggcctcgggctgggtgctggaccgcatcgtgccgggcgtcgactactaccgcagcaccatgcagctggccgagatcgtccacgccatcgccgcggtgggcatgatctgcatgtcgctcggccacatctatatcggcaccatcggcatggaaggcgcctatcgcgccatgcgcgagggctatgtcgacgaggcctgggccaaagagcaccacgtgctctggtacgacgacatccaggccggcaggattcccgcgcagcgctccaagccgccggagccgcccgaggcgcgcgaacagccggccaagggctga

SEQ ID NO: 2405 - DNA, 1197 bp, Ralstonia eutropha JMP134
atgaggcccacgcagaacccttgccgctggctcgctgccagcgcactggcctggctggcactcgcgggcagcgccgcgctggcgcaggcaccggcttcggcgccgccggcttctgccgccgctatcgccgcacaaccggcggacgcgaacgacccggccacgcatcctgcgcagccgctggcgggtatagcctcggagaacatcttcaacgtgcctcgccgcgatatcgccggcgaggccaggtcgcagcaggaacgcacggtgacgcagccgggcaacaacgcgccggtatggcgcgaggtcaattccgaccaggctcactacagcagcctgccggccaaggaagccggcgtgctgatccagcggaccggccagaagtggcggctgttccgcaatggcgtgatcaccgtatggggcggctggctgctggtgatcgtgccgctcgcgatcctcggtttcttcgcctggcgcgggaccatcccgctgcgcgagccgcgcaccgggcgcatgatcgagcgcttcacgccgatcgagcgcatcgtgcactggaccatggcgatctcattcgtactgctcggcgtgtcgggcatcgtgatgctgttcggcaagcatttcctgctgccgatcatgggacacacgctgttcggctggctgagctacctgctgaagaacatccacaacctggcggggccagtgttcacgttgtcgatcatcgtcgccttcgtgattttcgtgcgcgacaacctgcccagccgcgacgacgtccgttgggtgactagcctcggcgggctggccagcggcaagcatgtgccgagcggccggttcaatttcggcgagaagatgtggttctggggcgggctggtgatcttcggtctgatcctgtccgcgtcgggctgggtgctcgacatgatcgtgccggggctcgactactaccgcgccaccatgcagatcgccaacgtgatccatggcatcgcggccgtgctgatgatcgcgatgtcgctgggccatatctacatgggcaccatcggcatggaaggcgcctaccgtgcgatgcgcgacggctgggtcgacgaagcctgggccagggagcaccacgaactctggtacgacgacatcaagtccggcaagatcccggcgcagcgctcgacgacgccggaaccaggcaccgctggccggcgtaccccgggcgaggcctga

SEQ ID NO: 2406 - DNA, 1206 bp, Polaromonas JS666
atgaaacacgcgcggttagctatatttttgatggcggttggctttacagggctgactggggcgcagacgcctgcgactcagccggcaccatcagcccaggcatcgggcgtcgtcacgccagcgcccgcagcatctgcttcgcctgcagcggctggcgggattcagagccagaacatttttcaggtcaagcctgacgcgagtgccgatcccaaatatgcggggcaaaccaacgccgagcgcgccaaggtccagcccggcaacaatgcgcccatgtggcgccaggtcggccagggcacgaccggctacagcagtcttcccaaaagtgaagcgcccgaagccggcaacctgatccagccctttgtgcagtaccccggctcgcgcctgaccaatgcgggtgaggcctggcggcaggtgcgcaacaactggctgattccgtatggtggtgcgctgctgctgatcgtggcgctggccattgcgattttttacttcagcaagggttccatcaagacccatggcgccgacacgggccgcaagatcgagcgattcacgccgtttgaacgcgccgcgcactggtccaacgccacggcatttgtcattctggccgtgtccggtctggtgatggctttcggtaaattttttctgctgccggtcatggggctcaccctgttcggctggctgacctacgcactcaagaatttgcacaactttgcgggtcccctgtttgccgtgtcgctgctcattgtgtttgtgacctttctgcgcgataactggccgcaaaaaggcgatctgaactggctgctcaaggggggaggcctgatctccggcgcggaaccggcgtccagccggttcaatgccggtgaaaaagtgattttctggggtggtgtgtttttcctcggcgtggtggtggtgtcatcgggctttgtgctcgacaagctgctgccaggcctggtctatgagcgcgcgaccatgcagattgcgcacatggtgcatgcggtggccaccgtgctcatgatgtgcctgtttctgggccacatctatataggcacccttggcatgcagggcgccttcaaggccatgggcaccggctatgtggatgagacctgggcgaaggagcatcacgagtactggtatgacgacgtgaaggcgggcaagatcccccgccagcgtagtgagcctgcgccacctggccagacagtacaggtttaa

SEQ ID NO: 2407 - DNA, 1206 bp, Acidovorax sp. JS42
atgaaacacctcttgtgtgcattgctgctcgccagcggtgccgcgtgggcgcaggccccggcggcgcccgccagcgacgcggcagcgcccgcggcggcagacgctgcccctgtgccggcggcggttggtgccgtcaaaagccagaacatcttcgacgtgaagcccgatgccagtgaggagccgggctacgcccagcagaccaacggtgagcgtgccaaggttcagccgggcaacaacgcgcccatgtggcggcaggtgcgagatggggtgacgggctacagcagcctgccggcgagccaggcccctgaggccggcaacctgatccagccgttcgcgcaataccccggctcgcgctacaccacggcaggccaggcgtggcgcgaggtgcgcaataactggatcattccctacggcgcggccttgctgggcatcaccgtgctggcgctggccatcttctttgtgaccaagggcaccctgggccacgcggatgccgaggctggcggtcgccggatcgagcgcttcacgcccttcgagcgcgcggcgcactggtccaatgcgattgcgttcgtcacgctggccatcacgggcatcctgatggcgttcggcaagttcttcctgctgcccgtgctgggcgcacagctcttcggctggctggcgtacgcggcgaagaacgtgcacaacttcatgggcccgctgttcgccgtgtcgctcacggtgatcatcgtcactttcatcaaggacaacatcgccaaccgcgcggacttcgtctggctgtccaaggcaggtggcatgttcaccaacaaggaagtgccgtcgcaccgcttcaacgcaggcgagaagggcatgttctggtggggcatcactattcccggcgtgtttgttgtgctgtcgggcctggtgcttgacaagttgatccccggctggggcctgctgcgcggagagatgcagatcgcccacatggtgcacgccacgctggccctctggatgatggcgctgctgctgggtcacatctacatgggcacgatcggcatgcgcggggcctacaaggccatgaagaccggttacgtaagcgaggcctgggcgcgcgagcaccatgagctgtgggccgacgatgtccgcagcggcaagattcccgcacagcgcagtggtgcggctaccgccgcgcaaaccacgccttcccaccccgccgtaggaggaacctcatga

SEQ ID NO: 2408 - DNA, 1173 bp, Polaromonas naphthalenivorans CJ2
atgagacaagcgcaattagctctgtttttaatagcggcttgtctggcgggcgcggccggtgcgcaagcgcctgcgcctgccgcttcatcgccctccgtggtggcgccggctgccgtgggcggcatccagggccagaacatctttgaagtcaaacccgacgccagtgagattccgggctatgccagccagaccaatggcgagcgcgcccgggtccagcccggcaacaacgcgccaatgtggcaccaggtcggcgcgggcgcgacgggctacagcagcctgcccaaggcccaggcgcccgaggccggcaacctgatccagcccttcgtgcagtaccctggctcgcgcctgaccaacgccggtgaagcctggcgccaggtgcgcaaccactggctgattccctacggcggcgccttgctgctgatcgtccttggcgcgattgccctgttctacatgggcaagggcagcatcaagctgcatggcgccaaaaccggccgcagggtcgagcgcttcacgccctttgagcgctcggcgcactgggccaacgccattgcgttttcgattctggcgatttcgggcatcgtgatggcattcggcaagttttttgcgctgcccgtcatgggcggcatgctgttcggctggctggcctatgcgctgaaaaacctgcacaactttgccgggccggtgtttgtcgtctcgctgctgatcgtgttttttacctttgtgcgcgacaacctgcccagccggggcgacctgcgctggctgcttcagggcggaggcatgttttcgggcaaggaagtgccgtcgcaccgcttcaacgcgggtgaaaaactggtgttctggggcggcgtcttttttctcggcatggtggtggtggcttcggggctggtgctcgacaagctgttgcccggcctggtgtatgagcgcggcacgatgcagatcgcgcacatggtgcatgccgtggccacggtcctgatgatggccatgttcacggggcatatctacatgggcacgattggcatggaaggcgcctacgagggcatgaggaccggctacgtcgatgaaacctgggccaaagaacaccatgagttctggcatgacgacatcaaggcggggcgcattcccgcgcagcgcagcgaacccgcgccgcccgccagcccggcggtccaggcctga

SEQ ID NO: 2409 - DNA, 1167 bp, Methylibium petroleiphilum PM1
atgacacacacgatgcttcgatggtgggctgccggctgcctggcatggctcggcagcgtggcggtggcgcagggcaccccggtcgccgacccagccgtgtcgcctgttgcacaggccgcgccgaccgccccggccgccagcgcggcggccctggcgctgcccgacgcgaacgagaccaacgcccagcgcgccaagacccagccctacaacaacgcgccgttctggcgtgcggtgcgcgagtcggggcagcaatcgggcatcagcaacctgccgggcgccgagaagggtgtgctgatccagcagttcgtgcagtaccccggctcgcgcttcacgacggcgggcgaggcctggcgtgaggtgcgcaaccgctggatcattccctacggcggcgcgctgctgctgatcgtggtggtggcgatcggcctgttctttctggccaagggtccgatcggcgtgcacgcaccggatacgggccgcaagatcgagcgtttcacctacttcgagcgtgccgcgcactggagcaatgcggtggccttcgtggcgctcgcggtgtcgggcgtggtgatggcgttcggcaagttcttcctgctgccggtgatcggcggcacgctgttcggctggctggcctatgcgctgaagaacctgcacaacttcgccggaccggtgttcgcggtctcgctggtgatcgtgttcttcaccttcgtgcgcgacaacctgccacgcaaggaagacctgttgtggctggccaagggcggtggcctgttcaacggcgcccacgtgccttcgcaccgcttcaacgcgggcgagaagctcatcttctggggcggcgtgtttgcgctgggcatcgtggtggtgggctcgggcctggtgctcgacaagctcatccccggcctcgcctacacgcgcggcgacatgcagatcgcccacatgatccacgccgtggccacggtgctgatgatggcgatgttcctcggccacatctacctcggcaccatcggcatgaagggcgcctaccgcgcgatgcgcgacggccaggtcgacgccgcctgggcacgcgaacaccacgaactctggtacgacgacatccaggccgggaagatccccgcgcagcgcacgccgtcgccgacaccggcggccggcacgcagggcgcggccgtgcagtcctga

SEQ ID NO: 2410 - DNA, 1062 bp, Polynucleobacter necessarius asymbioticus QLW P1DMWA 1
atgaaacgatcattttctaaagttcttcgcactttgatagtggctgctggtttgtctctagctttagcgagcggcatgagtctggctgaacgtgcgccgatggcgccattgccatctgctagtggggtagatatttcaccatcatcgattccagcaaatccaaatgccctagctaacggaactcaagcccaatctcaaccagctaatccctctatctttattgcgcccaatagtgatccgcagaactacgtcagcattccagacaagcaagcgggcgtattaattcagcgtgctggccaacagtggcgcgtgattcggaatggcatcatcactgtttacggtggctggcttttggcaattgcattcttcggtatcgccggcgtatatacgcttaagggttcggtcaagcttcatgagccactttcaggggtcatgattaaacgtttcagtggttttgatcgccttgttcactgggtaatggcatttagcttcttggcattggcctttaccggtctaatgattttgttcggtaagtattttgcaatgccgttaatgggcggggtagcgtacggctcattcttgatggtatgtaaaaacatccataactttactggcccgttatttacattaagcattgtgattttcttcttgctgtttgtaggaaaaaatattccagaaaaaggtgacctccagtggatgctcacatttggtggcatgttcagtggtaagcatgttccagctggctttttcaatatgggtgaaaagttctggttctggtttggtatgacttttcttggcttgctaatttccgcttctggttttgtgctcgatatgattgtcccattcatgcagattgagtacctccgcggaacaatgcagattgccaatatgattcatagcagcgccgctatcttaatgacggcaatggcgatgggacatatctacatcggtactatcggaatgcaaggatctattgatggcatgaagacgggctacgttgatgctacttgggctaaagagcaccatgaaatttggtacaacaaagtggataaaaagggataa

SEQ ID NO: 2411 - DNA, 1155 bp, Leptothrix cholodnii SP 6
atgcaagacatccttcggcacctgacgcgcagtgtggttcttgccgtgctgctggcaggcggcctggccgctccggtgctggcccagcaggctgtgtcggcgggcgcttcggcgccggccggtttcgtggtccaggccgaaccgaagcccgacgagaccaatgcccagcgcgcccagacccagcccggcaacaacgcgccgttctggcgctcggtgcgcgagtccggcgagcaggcgggttattcgagtctgccgggcgtcgagcgcggcacgctgatccagtccttcgtgcagtaccccggctcgcgctacgccaccgcgggcgaagcctggcggcaggtgcgcaacaactggatcattccgtacggcggcgcgctgctgctgatcgtggcggtggcgatcgcgatcttctactggcgcgtcggcgcactcggcggtcacatccccgacaccggccgcaaggtcgagcgcttcacgccgttcgagcgcgccgcgcacggggtcaacgcggtggcgttcacggtgctggcgatctcgggcatcgtgatggcgttcggcaagttcttcctgctgccgatcctgggcgggctggtgttcggctggctgacctatgtgctcaagaccttgcacaacttcgccggcccgctgttcgcggtgtcgctgctggtggtgatcgtgaccttcgtgcgcgacaacctgccgcgcaagggtgatctgaactggatgctgcgcatgggcggcctgttcggcgatcacgaggtgccgtcgcaccgcttcaacgccggcgagaagctggtgttctggggtggcgtgttcgcgctgggcctgatcgtcgtggcatcgggcctggtgctcgaccagctggtgccctcgctcgactacacccgtggccagatgcagatcgcgcacatggtgcacggcgtggccaccgcgctgatgatggcgatgttcatcggccacatctacatgggcacgatcggcacccggggtgcgctcgacggcatgcgcaccggccaggtcgacgaggcctgggcgcaggagcaccacgagctctggtacgacgacatcaaggccgggcgcatcccggcgcagcgctccggtggcgcggccccggcatcggccccgacgggtggtgcggccggcgcgcacacctga

SEQ ID NO: 2412 - DNA, 1164 bp, Ralstonia pickettii 12J
atgggcacttcctggaaacatcttgtgatggccgtgctgctcggcggcgcggcggcgtgggcgagcgcgcagcagccggccagtgcgccggcagccaaccatgccccggtcaatccggccgtacaaacggcccagccgttctccaacatcgtctcggagaacgtgtttgatctgcagaagcgcgatctcgccaaagaggcgcaggaccaggccgcacggcgcgcgacgcaaccgggcaacaacgcgcccgtctggcgcgaggtgaactccgatcaggcgcactacgccagcattcccgggctggaagccggcgtgctgatccagcgcaccgggcagaaatggcggctgttccgcaatggcgtgatcaccgtgtggggcggttggctcatggtgctggtgccgtcggccatcctggccttcttcctttggcgcggcatgatcccgctaaaagaagcgcctacgggccgcaagatcgagcgcttcacgcccaccgagcgctacgtgcactggacgatggcgatctccttcgtcacgctcggcgtgtcgggcatcgtcatgctgtggggcaagcatttcctgttgccgatcctcggtcatcagttgttcggctggctgacgtatttgctgaaaaacctgcacaacctggtgggcccgctcttcacggtcagcatcatcgtggccttcgtgatttgggtgcgggacaacctgccgcgccagggcgacgtgaaatggctgctgagcctggggggcatgtttgccggagagcacggcgccgaagtgccgtcgcaccgcttcaatgcgggcgagaaactctggttctggggcgggctcgtcgtgtttgggctgatcctgtcggcttcgggctggacgctcgatcgcatcgtcccgggcgtggattactaccgcagcacgatgcaactggccgaggtcattcacgcgatcgcggcggtgggcatgatgagcatgtcgctgggccacatctacatgggcacgatcggcatggaaggcgcttaccgcgccatgcgtgacggttatgtcgacgaggcctgggcgaaggagcaccacgaactttggtacgacgacgtcaaggccggcaagattcccgcgcagcggtcccagccgcccgcgccgccggcgccgagcgagcagcccgccaagtcatga

SEQ ID NO: 2413 - DNA, 1206 bp, Diaphorobacter TPSY uid29975
atgaaacacctcttgtgtgcattgctgctcgccagcggtgccgcgtgggcgcaggccccggcggcgcccgccagcgacgcggcagcgcccgcggcggcagtcgctgcccctgtgccggcggcggttggtgccgtcaaaagccagaacatcttcgacgtgaagcccgatgccagtgaggagccgggctacgcccagcagaccaacggtgagcgtgccaaggttcagccgggcaacaacgcgcccatgtggcggcaggtgcgagatggggtgacgggctacagcagcctgccggcgagccaggcccctgaggccggcaacctgatccagccgttcgcgcaataccccggctcgcgctacaccacggcaggccaggcgtggcgcgaggtgcgcaataactggatcattccctacggcgcggccttgctgggcatcaccgtgctggcgctggccatcttctttgtgaccaagggcaccctgggccacgcggatgccgaggctggcggtcgccggatcgagcgcttcacgcccttcgagcgcgcggcgcactggtccaatgcgatcgccttcgtcacgctggccatcacgggcatcctgatggcgttcggcaagttcttcctgctgcccgtgctgggtgcacagctcttcggctggttggcgtacgcggcgaagaacgtgcacaacttcatgggcccgctgttcgccgtgtcgctcacggtgatcatcatcactttcatcaaggacaacatcgccaaccgcgcggacttcgtctggctgtccaaggcaggtggcatgttcaccaacaaggaagtgccatcgcaccgcttcaacgcaggcgagaagggcatgttctggtggggcatcactattcccggcgtgtttgttgtgctgtcgggcctggtgcttgacaagttgatccccggctggggcctgctgcgcggagagatgcagatcgcccacatggtgcacgccacgctggccctctggatgatggcgctgctgctgggccacatctacatgggcacgatcggcatgcgcggggcctacaaggccatgaagaccggttacgtgagcgaggcctgggcgcgcgagcaccatgagctgtgggccgacgatgtccgcagcggcaagattcccgcacagcgcagtggtgcggctcccgccgcgcaaaccacgccttcccaccccgccgtaggaggaacctcatga

SEQ ID NO: 2414 - DNA, 1227 bp, Variovorax paradoxus S110
atgaagcaagcgctgaccgctctcgctctttgctgtgccgtgctgggtacggccttcgcgcaggcgcagccgccggccgcccctggaacggcgtccgcccccgcggcacctgccgcaaccgccgcgccggaggccgccgtgggcggcatccgcggccagaacatcttcgaggtcaagcccgaagccagcgccgaccccaactacgcgaaccagaccaatggcgagcgcatgaaggtgcagcccggcaacaacgcgccgatgtggcgccaggtggggcagggcgtgaccggctacagcagcctgccgaaaagccaggcgcccgaggccggcaacctgatccagcctttcgtgcagtaccccggttcgcgcttgaccaatgccggcgaagcctggcgccaggtgcgcaacgactggatcattccctatggcgcggcgctgctgttcgtcgtgctgctggcgctggccatcttctatttcacgcgcggcccgatccgcctgcacggccaggaaaccggccgcaagatcgagcggttcacgcccttcgaacgcgccacgcactggtcgaacgccatcgccttcgtcacgctggccatcaccggcatcgtgatggccttcggcaagttcttcctgatgccgtggatgggcagcgcgctcttcggctggattgcctacgcgctcaagaacgtccataacttcgtcgggccgctgtttgtggtgacgacggtgttcatggtcttcaccttcatccgcgacaacctgccgcgcgccagcgacctgcaatggctcgcgcgcttcggcggcctgttcggcggcaaggaagtgccatcgcaccgcttcaatgcgggcgagaagctggtcttctggggcggcgtgctgttcctcggcctcttcatcatcggctcggggctcttcctggacaagctgctgccgggcttcgtctacacgcgcggcgagatgcaggtggcgcacatggtgcacggcgtcgccaccttgctgatgatggcgatgatcatgggccacatctacatcgggacgctcggcatgacgggcgcctacaaggccatgcgcaccggctacgtcgacgagacctgggcccgggagcatcacgaactctggtacgacgacatcgccgcgggcaagattcctgcgcagcgcacggcgccggccggctcggccgctgcaccggccgcgcggcccgtgagacccgccgaaggaacaccctcatga

SEQ ID NO: 2415 - DNA, 1164 bp, Ralstonia pickettii 12D
atgggcacttcctggaaacaccttgtgatggccgtgctgctcggcggcgtggcggcgttggcgagcgcgcagcagccggccactgcgccggcggccaacaccgccccggtcaatccggccgtacaaccggcgcagccgttctccaacatcgtctcggagaacgtgtttgatctgcagaagcgcgatctcgccaaagaggcgcaggaccaggccgcacgccgcgcgacgcaaccgggcaacaacgcgcccgtctggcgcgaggtgaactccgaccaagcacattacgccagcattcccgggttggaagccggcgtgctgatccagcgcaccgggcagaaatggcggctattccgcaatggcgtgatcaccgtgtggggcggttggctcatggtgctggtgccgtcggccatcctggccttcttcctttggcgcggcatgatcccgctaaaagaagcgccgacgggccgcaagatcgagcgcttcacgcccaccgagcgctacgtgcactggacgatggcgatctcctttgtcacgctcggcgtgtcgggcatcgtcatgctgtggggcaagcatttcctgttgccgatcctcggtcatcagttgttcggttggctgacgtatttgctgaaaaacctgcacaacctggtgggcccgctcttcacggtcagcatcatcgtggccttcgtgatttgggtgcgggacaacctgccgcgccagggcgacgtgaaatggctgctgagcctgggtggcatgtttgccggagagcacggcgccgaagtgccgtcgcaccgcttcaatgcgggtgagaaactctggttctggggcggcctcgtcgtcttcgggctgatcctgtctgcctcgggctggacgctcgatcgcatcgtcccgggcgtggattactaccgcagcacgatgcaactggccgaggtcattcacgcgatcgcggcggtgggcatgatgagcatgtcgctgggccacatctacatgggcacgatcggcatggaaggcgcttaccgcgccatgcgtgacggttatgtcgacgaggcctgggcgaaggagcaccacgaactttggtacgacgacgtcaaggccggcaagatccccgcgcagcggtcccagccgcccgcggcgtcggcgccgagcgagcagcccgccaagtcatga

SEQ ID NO: 2416 - DNA, 189 bp, Methanosarcina barkeri fusaro
atggaacagagaaaatgctatttctgcggaaagatgctggagcccggaaccggtaagctctacgtcaagaaagacggttctacctactacattcactcttccaagtgtatgagtaacttcaacctgggtaggcttccaaggcgtaccgaatggactgaaaaaggcaaaatccagttgaagaaagcataa

SEQ ID NO: 2417 - DNA, 192 bp, Methanospirillum hungatei JF-1
atgattgatacgcatatctgttctttctgcggcctgcagatggagcctggaaccgggaagatgtacgtcaaaaaggacggacagattttctattattgcagcaccaagtgccagaagaaccataagctcggacgtattccacgccgtgtcagatggaccaccgctggccggaaagctcttggcaaggtataa

SEQ ID NO: 2418 - DNA, 189 bp, Methanococcoides burtonii DSM 6242
atggaacagagaaaatgttcattttgcggagagttgcttgagccaggtacaggtctcctttttgcaaagagggacggatccacatattatttctgttcttctaagtgtaagggcaacttcgatcttggaagacttccaaggcgtactgtctggacagaacagggtaggatctaccttaagaaagcataa

SEQ ID NO: 2419 - DNA, 171 bp, Methanosaeta thermophila PT
atggaagagagaagatgctcattctgcaacaccaggatcacccctggcacggggaagctgtatgcaaagaaggacgggactgtatactacttctgctcgtccaagtgtgaaaagaacatgcggcttggccgcgtttccaggaagataaagtgggctcgaaagggggcgtag

SEQ ID NO: 2420 - DNA, 177 bp, Pyrobaculum islandicum DSM 4184
atgaagatttataaatgtgcattctgtggggctgacatcttgccgggctacggcataatgtatgtaaaaacagacggcactacgctgagattttgtagtaggaaatgttttgtaagcgctgtgaaattcaaaagagaccctcggagactcgcttgggtgagaaaacgacagaaatag

SEQ ID NO: 2421 - DNA, 192 bp, Methanocorpusculum labreanum Z
atggtagatacatatacctgcagctactgcggaaagcagcttgagcccggaaccggtaagctctttgtgagaaaagatggcgcagtcttctatttctgctcatcaaaatgccagagcaattataatctcggcagaattcccagacgtgtagcctggaccgcagcaggtcgcaaggcacgcggtaaggagtga

SEQ ID NO: 2422 - DNA, 192 bp, Methanoculleus marisnigri JR1
atggtcgacaagtacgtctgcaatttctgtggagaggttctggagcccggaaccggcaagatgttcgtcaagaaggacggaaccatcctctacttctgcagcaccaagtgccagaacaactaccggctcggccgggtgccgcgccgcgtcgagtggaccgcggccggacggaaagcccgcggcaaagagtga

SEQ ID NO: 2423 - DNA, 189 bp, Methanococcus maripaludis C5
atggaatggaaaacatgtagcttttgtgaaggcacaattgaacctggatgcggaaaaaaatacgttaaaaaagacggttcagttatgcacttctgttcatcaaagtgtgaaaagaacttcaaactcggaagagttggaaggaaattaaaatggactaacactttcaaaagaattaacagaggacaataa

SEQ ID NO: 2424 - DNA, 198 bp, Pyrobaculum arsenaticum DSM 13514
atgaagatctaccagtgcgccttctgcggtgccgatataccgcctggctacggcataatgtatgttaagtcagatggcacagtacttaggtactgtagcagaaaatgcttcgtaagcgcaaccaagtatggcaggaaccccagaaaactagcttgggttagaaaactgcaacgaaaacaaaaacagtctacctcctag

SEQ ID NO: 2425 - DNA, 186 bp, Metallosphaera sedula DSM 5348
atggtagtttcccacaagtgcagtttctgtggaggagatataccgccagccactggcatgatgcatgtgagaaatgacggtacgattctttggttctgctcaaacaaatgcaggaaatatatgctaaagtatcataaggatgctaaaaaactgaagtggacaacctcctactcgagggtaagataa

SEQ ID NO: 2426 - DNA, 189 bp, Methanococcus vannielii SB
atggaatggaaaacatgcagtttttgtgaaggcaaaattgaacctggatgcggaaaaaaatacgttaaaaaagacggttcagtaatgcaattctgctcatcaaagtgtgaaaagaacttcaaacttggaagagttggaagaaaattaaaatggacaaacatgttcaaaagaatgaacaagggccaataa

SEQ ID NO: 2427 - DNA, 195 bp, Methanococcus aeolicus Nankai-3
atggaatggaaaacctgcaatttttgtggaaaaagcatagaaccaggaactggtaaaaagttcgtaaaaaaagatggttcagttatgtttatttgttcctcaaaatgtgagaaaaactataaattaaagagagtcgcaagaaaattaagatggactccaatttattacaataataaacatagtaataaaaaataa

SEQ ID NO: 2428 - DNA, 189 bp, Methanococcus maripaludis C7
atggaatggaaaacatgtagcttttgtgaaggcacaattgaacctggatgcggaaaaaaatacgttaaaaaagacggttcagttatgcacttctgttcatcaaagtgtgaaaagaacttcaaactcggaagagttggaaggaaagtaaaatggactaacactttcaaaagaattaacagaggacaataa

SEQ ID NO: 2429 - DNA, 192 bp, Candidatus Methanoregula boonei 6A8
atggttgaacagcacatctgcagtttctgcggtgaaccgcttgagccgggcaccggcaagatgtttgtcaagagagacggtacgatcttctatttctgcagcaccaaatgccagaacaaccacaagctgggcagggtcccgcgccgggttgagtggacaactgcagggcagaagggtacaaacaaggagtga

SEQ ID NO: 2430 - DNA, 189 bp, Methanococcus maripaludis C6
atggaatggaaaacatgtagcttttgtgaaggcacaattgaacctgggtgcggaaaaaaatacgttaaaaaagacggttcagttatgcacttctgttcatcaaagtgtgaaaagaacttcaaactcggaagagttggaaggaaattaaaatggactaacactttcaaaagaattaacagaggacaataa

SEQ ID NO: 2431 - DNA, 201 bp, Nitrosopumilus maritimus SCM1
atgagtcttttagttaaaccatgtaatttctgtaacagaccagttgcaaagggttctggtacgatgcttgcaaaaaatgatggaactgtcttgtggttttgttctgcaaaatgcaaaaagaatgcactagaactaaaacgtgacccaagaaaattcaagtggacaaagaaatacgtcaaaggcggaattagaaagaagtaa

SEQ ID NO: 2432 - DNA, 177 bp, Thermoproteus neutrophilus V24Sta
atgaagatccacaagtgctccttctgcggggccgagataccgccgggctacgggattatgtacgtaagaaacgacggcaccatacagaggtactgcagcagaaagtgcttcgtaagcgccacgaaatacggaagaaacccaaggaagcttgcctgggttagaaaacgccaaaaatag

SEQ ID NO: 2433 - DNA, 189 bp, Halorubrum lacusprofundi ATCC 49239
atggttgagacacgcacctgcgactacaccggcgaagaaatcgagcccggcacgggcacgatgtacgtgaagacgaacggacagatcctccacttcgtcgactcgaaggcggagaagaactacttcctcggccgcgaggcgcgcgacctcgagtggaccgaggaagggcgcaatcagggtggcgagtag

SEQ ID NO: 2434 - DNA, 420 bp, Halorhabdus utahensis DSM 12940
atgccacagacacgcgaatgtgactactgcggcgcggacatcgagcccggcaccgggacgatgttcgtccggaagaacgggacgacgatccacttctgctcgtcgaaatgcgagaagaacgccgatctcggtcgggaggcacgcgatctctcctggaccgaggccggtcgcggaacgggcggcgacgctgccgccgagcagcaaacggacaccgccgacgctgacgagcaagccgagaccgaaaacgaagacgaagctgccgaagacgctgcagccgctgacgatgcggacgaggccgaagacgaagtcgaagcagacgaggccgaagacgaagtcgacgcggacgacgaatctgacgccgaagctgacgcagacgccgaggagaccgacacggaggagccgacggaggctgacgcatga

SEQ ID NO: 2435 - DNA, 192 bp, Candidatus Methanosphaerula palustris E1 9c
atggttgaaatgcatacctgtacgttctgcggtgaagggctcgaacccggaaccggcaagatgttcgtccgcagggatggttctatctattacttctgcagcaccaagtgccagaataacttcaagctcggaagagctccgcgccgggtcgcttggaccaaggccggcagaaaggcactcggtaaggagtga

SEQ ID NO: 2436 - DNA, 432 bp, Halomicrobium mukohataei DSM 12286
atgcctcgaatccgagaatgtgactactgcggcgcggacatcgagcccggcaccgggacgatgttcgtccgcaagagcggaacgacgatccactactgctcgtcgaaatgtgagaacaacgccgatctcggccgcgaggcgcgcaacctcgagtggaccgaggccggtcgcgagaccaccgctgcagagcagaaagcggccgccgaagccgaggcagccgccgaagcagcggacgagcagacggcagacgaggcggacgccgacgaagacgagtccgccgagacagacgaggcggccgacgaggacgagtccgccgagacagacgaggcggccgacgaggacgagtccgccgagacagacgaggcggccgacgaggacgaagcggagtccaccgaggccgacgacgaagagaccgaggaggccgaggcatga

SEQ ID NO: 2437 - DNA, 252 bp, Brucella suis 1330
gtgagcacgtccgcacgcctgcgcaaacattccgtcagcatacgcggccacgcgacaagctacacgcttgaagacccattcttcaaaatcatcgaggaaatcgcagccgcgcgaaatatgactgtcgccgctctcgtcgcggagattgacagcaggcgcgagcgcaccatcaatctctcgtctgccctgcgccttcatgtcctcgactggctgaaatcgaaattgccagagagcaattcatgccccccgtga

SEQ ID NO: 2438 - DNA, 255 bp, Nitrobacter winogradskyi Nb-255
atgaaatcgccggtcgtgaaacgatcgatcgtggtcgccggtcacaagaccagcgtgagcctcgaggaagcattctggaacgggatgaaggaaatttcgagtcaccgtgacatgaccctgtccgaactcgtcggggagatcgacagcaaccgtcaacagggcaacctctcctcggcgatccgtctcttcgtgctggactacttccgaagccgtgcggcgacgtccggacccgaaaacagtcccagcctcggatag

SEQ ID NO: 2439 - DNA, 285 bp, Rhodopseudomonas palustris HaA2
atgaaatcgccggtcgtcaaacgatcgatcgtggtcgcgggccacaagaccagtgtcagcctcgaagaggcgttctggaacggcatgaaggagatctccggcgtgcgggacatgactttgtccgagctcgtcggtgaaatcgacggcaatcgtcagcagggcaatctgtcgtcggcgattcgcctgttcgtgctggactacttccgcagccgcgcgatgcagcaaccgcagcagccacagcccgtggtcgaagccaaggtcgatagcagcatcgtggcgcactga

SEQ ID NO: 2440 - DNA, 264 bp, Rhodopseudomonas palustris BisB18
atgaaatcgccggtcgtgaaacggtcgatcgtggtcgcgggccacaaaaccagtgtcagcctcgaagaggcgttctggaacggcatgaaggaaatctccggtttgcgcgacatgacgctgtccgaattggtcggcgaaatcgacagcaaccgtcaacaaggcaacctgtcatccgctatccgcctattcgtgctggattatttccgcacccgcgcggtccagccgatgccggaagtaaagaccgaaagcttggccgcgcactga

SEQ ID NO: 2441 - DNA, 276 bp, Rhodopseudomonas palustris BisB5
atgaaatcgccggtcgtcaaacggtcgatcgtggtcgcgggccacaagaccagtgtcagcctcgaagaggcgttttggaacggcatgaaggaaatctccggcgtgcgggacatgactttgtccgagctcgtcggtgaaatcgatggcaatcgccaacagggcaacctgtcgtcggcgatccgcctgttcgtgctggattacttccgcagccgcgcgttgcagcagcagcagcccgcggtggaagccaaagtcgatagcagcctggtggcgcactga

SEQ ID NO: 2442 - DNA, 255 bp, Nitrobacter hamburgensis X14
atgaaatcgccggtggtgaaacgatcgatcgtggtggccggccacaagaccagcgtgagcctcgaggaggcattctggaacggaatgaaagaaatctcgagccttcgcgacatgacgctgtccgaactggtcggcgagatcgacagcaaccgtcaacagggcaacctgtcctcggcgatccgccttttcgtcctggactactttcgaagccgcgcgatggctgcggaatccgaaaacagcccgagcgccggatag

SEQ ID NO: 2443 - DNA, 222 bp, Rhodobacter sphaeroides 2 4 1
atgaacggccgcccggagaaacactcgctcactctgaagggccaccgcaccagcgtctcgctcgaggccgacttctggcgcgccttccgcgagatcgcagccgagcgcggcctgccgctcaatgcgctggcggccgaggtggacgaggcccgcgacccggaggtgggccttgcctccgcgctccgcgtcttcgtgctgcgccactaccgcaccggccgctga

SEQ ID NO: 2444 - DNA, 276 bp, Paracoccus denitrificans PD1222
atggcgacgaatgatccacctgccgcggggcctttgcccctgccgctgccgccgatgtcggcgcccagcaagcgctcggtgaccatcggcgggcaccggacctcggtcagcctcgaggatgcgttctggcgcgagttgcgcgagttggcccgggcagggggtcgcaccaccgccaccctgatcgccgagatcgacgccgcccgcccgcccgaggtggggctggccactgccttgcggcttttcgtgctggccgagatcgtcaagaatcgggcgtaa

SEQ ID NO: 2445 - DNA, 222 bp, Rhodobacter sphaeroides ATCC 17029
atgaacggtcgcccggagaaacactcgctcactctgaggggccaccgcaccagcgtctcgctcgaggccgacttctggcgcgccttccgcgagatcgcggccgagcgcggcctgccgctcaatgcgctcgcggccgaggtggacgaggcccgcgacccggaggtgggccttgcctccgcgctccgcgtcttcgtgctgcgccactaccgcaccggccgctga

SEQ ID NO: 2446 - DNA, 219 bp, Rhodobacter sphaeroides ATCC 17025
atgaggcccgagaaacactcgctgacgctgcggggccaccgcaccagcgtctcgctggaagaggacttctggcgcgccttccgcgagatcgcggccgagcggggactgccggtcaatgcactcgccgccgagctggacgaggggcgcgacccagaggtggggctggccaccgccatccggctcttcgtgctgcgccactaccgcgaccgccgggtttag

SEQ ID NO: 2447 - DNA, 288 bp, Bradyrhizobium BTAi1
atgaagtcgcccgtcgtaaaacgttcaatcgtggttgctggtcacaagaccagcgtcagcctcgaagaggcgttctggaacggaatgaaggagatttcgggtctccgtaacatgaccctgtccgaactggtcggagagatcgacagcaatcgccagcagggcaacctgtcgtcggcaatccggctgttcgtgctcgatcacttcaagaaccgcgcagccggcaccccggcgggcgagccgaaggcaacggtggacagccggcatacggcctctgccgcggctccttga

SEQ ID NO: 2448 - DNA, 252 bp, Brucella ovis; identical to SEQ ID NO: 2437

SEQ ID NO: 2449 - DNA, 255 bp, Sinorhizobium medicae WSM419
ttgaatccgtttgcgagcaagggaaaggtcgtcaaacactcggcaaccctgcacgggcatcgcaccagcttcactctcgaagaaccgttctggcaggagttgaaagcgatcgcgaaggaccgtgacatgccgctcgcgcggctgatcgccgaaatcgacgacggtcgcggccaggaaggaaatctctcgtcagccttacgtgtctatgtgctcgcctgggtcaaggcacgcgccgacgcgacaggtggggcatag

SEQ ID NO: 2450 - DNA, 237 bp, Ochrobactrum anthropi ATCC 49188
gtgaactcgtcaggaggtttacgcaaacattccgtcagtattcgcgggcacgcaaccagctatacgcttgaagacccgtttttcgaactggttgaggaaattgcggccacacgagagctttccgtagcggccctgatcgcagaagtcgacagcaagcgtgacagatcaatcaatctgtcttccgcacttagacttcatgttctggattggctcaaatccagaataattcaaggctga

SEQ ID NO: 2451 - DNA, 237 bp, Methylobacterium extorquens PA1
atgacgcgcgcgcccctgcgggagaacgcgaaacgctcggtgatgatcgcgggccaccgcaccagcgtctcgctggaggcggagttctggactgcgcttcaagagatcgcgcaggcgcgcggacaatcggtgcaggcgctgatcggcgcgatcgattccgagcgcggcgcgcgcaatctctcctcggcgatccgggtgttcgtgctcggcgcgtttcgcgacgaacgcgcgccgtca

SEQ ID NO: 2452 - DNA, 225 bp, Methylobacterium radiotolerans JCM 2831
gtgagcgccggcatcaccaagcgctccgtgatgatcgccggccaccgcaccagcgtgtcgctggaggacccgttctgggcggccctgcgggcgatcgcggaggcgcggggccagtcggtccaggccctcatcgggcacatcgacgccggccgcgacgggcagaacctgtcctcggcgatccgcgtgttcgtgctggaggccgtccgcgcgatgccggaaacgtga

SEQ ID NO: 2453 - DNA, 264 bp, Beijerinckia indica ATCC 9039
atgcaggacgtgccgtcacacaaggccgcatccccgacgccggcgagcattatcaaacattccgtcacgatcgctggccacgccaccagcatttcgctcgaatctgctttttgggatgcgttgaaggagattgccgaggcgcgcactctttctgtcgccgcactcattgccgagatcgatgccgcgcgtgtcgagagttcgccatcgcgcaaaaatctatcctctgcgatcagggtctatatcctgcgcaccgtccggaagtga

SEQ ID NO: 2454 - DNA, 312 bp, Methylobacterium populi BJ001
atgacgctgggccctctgcgggaaaacgcgaagcgttcggtcatgatcgccggtcaccgcaccagcgtctcgctggaggcggagttctggagcgcgctgcaggagatcgcgcgagcgcgcggacagtcggtccaggccctgatcggcgccatcgattccgcgcgcggggagcgcaacctctcctcggcgatccgggtgttcgtgctcggcgcctttcgcggcgcctccgcgccctcagagagcaccctcgcggatggcgccgggatcggccagggcgtgcaggagcccggcggcggaatgggcgaagcgtag

SEQ ID NO: 2455 - DNA, 279 bp, Rhodopseudomonas palustris TIE 1
atgaaatcgccggtggtgaaacggtcgatcgtggtcgcgggccacaagaccagtgtcagcctggaagaagcgttctggaacggcatgaaggaaatctccagcgtgcgggacatgactttgtccgagctcgtcggagagatcgacagcaatcgtcagcagggcaacctgtcttcggcgatccggctgttcgtgctcgactacttccgcagccgcgccttgcaggcgcagcagcaggcagtggctgatacaaagaccgaaagctcgctgacggcgcactga

SEQ ID NO: 2456 - DNA, 249 bp, Methylobacterium sp. 4-46
atgacgggatcggcggccggcctgcgcaagcgctcggtgatgatcgccgggcaccgcaccagcgtgtcgctggaggacccgttctgggaggcgctccagcggctcgcgcgggcgcgcggcctctccgtcccggcgctgatcgggcgcatcgacgccgggcgcgcggggcagaacctctcctcggcgatccgggtcttcgtgctgcgcgccctgcaggaggaggcgggcgggccggaggcgccgacctga

SEQ ID NO: 2457 - DNA, 225 bp, Rhizobium leguminosarum bv  trifolii WSM2304
atgatccgtaagcattcggcgacattgcacggccaccgcaccagcttctcgctggaagacgagttttgggacgagttgaaggtgatcgctgctagccgttcgatgccgctcgccgctctgatttccgaaatcgatgaccatcggccgccggacagcaacctgtcctcggcgctgcggcttcacgtactggcctgggcgaaggccgccgctggccgcggattataa

SEQ ID NO: 2458 - DNA, 261 bp, Methylocella silvestris BL2
atgagcgccgcgccgctcgatgagggcgcgcgcgatctgcgctccaacgtcaaacattccttgaccatcgctgggcatagaacgagcatttcgctcgaacgcgccttctgggagcgtttgaagcggatcgcggccgaacgcggctcctcgcttgccgcctgcgtcgcagagatcgacgccgcgcgcggcagcgccaatctatcctcggcgatccgcgtctatattcttcagtcggcgctttcgcccgaagctggcgaataa

SEQ ID NO: 2459 - DNA, 312 bp, Methylobacterium chloromethanicum CM4
atgacgcgcgcgcccctgcgggagaacgcgaaacgctccgtgatgatcgcgggccaccgcaccagcgtgtcgctggaggcggagttctggactgcgttgcaagagatcgcgcaggcgcgcggacaatcggtgcaggcgctgatcggcgcgatcgattccgagcgcggcgcgcgcaacctctcctccgcgatccgggtgttcgtgctcggcgcgtttcgcgacgagcgcgcgccgtcagagcgccccctcgcggatcgcgccgggatcggccagggcgtgcaggagaccggcggcggaatgagcgaagcgtag

SEQ ID NO: 2460 - DNA, 267 bp, Methylobacterium nodulans ORS 2060
atgaccggcgcgcccgaggggctgcgcaagcgctccgtgatgatcgccggccaccgcaccagcgtctcgctggagggacccttctgggaggccctccagcagctcgccgctgcgcgcgggctctcggtccaggccctgatcggccggatcgatgccggccgggccgagcagaacctgtcctcggcgatccgggtcttcgttctgcgcgaggtgcaggccgcgcagaccgcagaacccctctcccgagtgggagaggggcaggggtga

SEQ ID NO: 2461 - DNA, 243 bp, Agrobacterium vitis S4
atggcgcagtctatgccgctgatccgcaagcattctatttccctgcatggccatcgcaccagcttttctctggaagatgccttctggcaggaaattcgggcgattgcagaaaaccgcaatgttgcgattgctgcattgattgccgatattgacagcaaacgcccggctgattgcaatctctcctcagcgctgcggctctatgtgctggaatggctcaaacaatcgggttccgattcgcattga

SEQ ID NO: 2462 - DNA, 225 bp, Rhizobium leguminosarum bv  trifolii WSM1325
atgatccgcaagcattcggcgacattgcacggccatcgcaccagtttctcgctggaggatgagttctggaccgagctgaagacgattgccgcagcccgttcgatactgctcgccgccctgatctccgaaatcgacgaccaccgcccgccggacagcaacctgtcctcagcgctgcgcttgcatgtgctttcctggctgaaggccggcgccagccaccagccctga

SEQ ID NO: 2463 - DNA, 936 bp, Rhodopseudomonas palustris BisB18
atgcgcgtcctgatcaccggcgctcgcggcttcatcggacggcacgttctgcgtcggctcgaagccgatccccgtgtcactgagatccacgccacgcaatcgcgccggcgggacagcgacaatggccaggcccgcaccgtctggcacagcctcgatctgttgcagccggacgcggctcatgcgctctgcctgaagctgcgtccgacgcatgttttgcatgcggcctggatcaccgcgcacaacgactattggggcagcccggagaacctggcgtggctggccgcgagctgcgacctattgcgcgccttcgcagcatcgggcggcgagcgtttcgtacagatcggcaccgccgcggaatatgattggtcgtatggctgcatggtcgagggcgtcaccccggagcggccgaacacgctgtacggcagcgccaagaagtcattccatgacgtgctgcaggcggcctccgccaagctcggcctgtccgccgccaccggccgggtgttcttcggctatggcccttacgaaaatgccggccggatcattccttacgcctgccggcaattggcgctggggcagcccgcggaattctcctccggcgcggcctggcgcgatttcctctatatcgaagatttggcggccgccgccgtggcgctgctgaattcgccgcttgaaggcgcggtcaacctcgcctccggcgacccgatccaactgcgacgcattgtcgaactaattggcgagatcagcggccgcgcggagctcatccggctcggcgccaggcccgaccgcgagggcgacccggcgatgatcgttgccagtccgacgctgatccgctccaccgggtggcagccgagctattcgctgcgccgcggcctcgagacgacttacgcctggtgggcaagcgaagtggcgagagccgatgcagacgggcggaggtga

SEQ ID NO: 2464 - DNA, 855 bp, Pelobacter propionicus DSM 2379
atgaagatactcctgaccggcgcaaccggtttcgtgggaagccatgtaatccgccgcctcattgagagggggcacaatgtcactgttgtcgtccgcgatcagacgaaaatcctatcatgtccactgcttcgcgatacagatatcatatgcggcgatattctcgagccggcgttcgttctcaaagtacctcccgactccttcgacgctgtcatgcacttggcatggccgtacctgcccgactattattccatgaggcacctggaagcagccttccccgccagctttcagtttctcaagctgctcattcaattgggtgtacggcaggtgctggttacgggcacctgctttgaatacggcttgcgcaacggtcctctgtctgaggagatggatacccatcccgtaacgccctacgccctctcaaaggatattctccgccgtgcactggaaatgctgcaaaaagatattcagtttactctccaatgggcaaggcctttttatatgtacggcacggggcaaaatccctgcagtctcctggcgcaacttgacgcttcaatcgaaagaggcgataaggtcttcaatatgtcagacggagaacagttacgggattacttggcggtagaaaccgttgccgggcatcttgccgaacttgtggaacgtccgcagtttgacggcatactgaatatctgcagcggtacccccatatcggtcagacggcttgtggaggaacgtatttccgtacgtggcgccgctattcgccttaacctcggccactatccctatcccgcccatgagccgatggctttctggggagatgccacaaaaatgtcaaaaacccttgctccttcttctcattga

SEQ ID NO: 2465 - DNA, 930 bp, Prochlorococcus marinus MIT 9515
atgaaaaatttagtatttatactcgggagtaatggctatgtaggtagtgcgctagttaaaaaattcataagtaaagataactttgtgattggactaggtagatcggaaacctctaggcaatataaagaaaaatatataaaagattcaaattttcactacttttctttaaaagacaaaaatatactaagtataaaatctcaaattaaagactatgtgagtgagttcaatatgaattccatatttattaattcagcatggcatggtgataaatcactctcagatgggaacttatctgaacaaattgcaaatatttatttatctaatgacgcaattaaattagcaacagaaattagatgtgataaatttttgtatattggaagtgtttttgaaaattatattgataaatttactaatagtaattggtatgaacataaatataatttcaaagatcaattaaattattctttagcaaaaaatatttgtagagattttaatagactggtctcatatttacaaaaaattgaatatattcattgctcattttcagtatttattgatcaagatttaagtggcaaaggatatataccttcaaccctaaaaaaaatatcgaaaggattagaatatagtgaacctgagaataaggaactttttgatattactttattagatgaaggttgtgaggctatatatttgttaagtcagaaggccaaaatcaataagaattactatattggtacttcatttccaaaaacattaaaagatatatttattacttttgaagaagcaaaattaaaaaaacataaaagtcatgaaatattatatgagtcaccttataatgatttattttgtattaataaccttgaaaaagatatcggttataaaccaacaaaaacttttaacaaattttcctttgaattttttaataaatga

SEQ ID NO: 2466 - DNA, 849 bp, Methanocorpusculum labreanum Z
atgaaaatcctggtaaccggctccaccggattcgttggacgccacgtcgttcaatggcttgtcgatcatggatatgaggatgtggttgccacaggaacatctgttgaaaaagcaaaagagttcccgtggttttcgaaagtcaagtttattccctgtgattatttcgctgaagatatcaattatcacaagttcttcgaccgcccggatcttctgatccatcttgcatggaaaaatcttccaaattatatggaacgctttcatatggaagagaatcttccagtcgagatgcggtttctgcggtcatttgccgcatcaaatatgacaaagatcgcagctattggaacctgttatgagtatggtgtcgtgaacggctgtatttctgaagatcatccaacgaacccaaataccatatacgcagccgccaaggacacacttcgcagatatcttgcatttctgggggcagagtcaggcatttcctggaactggatcagactgtttttcctgtatggggagggacagagcccaaaatcgcttcttccgcaactggatgcggcgatcgcacgcggagatccggattttccgatgtcaggcggggagcagctgagagattatcttcctgtggaaaaagtggctgagtatatctgcaggatcgctttgtctaaagagagcggagtcgtgaactgctgctcgggcgcgatgatttccgtgcggcgtctggtcgaggaacgggttgctgcaagcggctcatcgatccggctgaagactggggtgtatggctatcctgcgtatgaagggatggcattttggggggataatacccagctccgtgaggtgatcggtgatgcgtga

SEQ ID NO: 2467 - DNA, 1041 bp, Methylobacterium extorquens PA1
gtgaagcgggttctcgtgaccggcggggccggcttcgtcggccgccacgcggtcgccgctttggccgctcgcggcttcgaggttcacgccatcggccgaaccgcgccggagggtgcccatgcctttcacgcggccgacctgctcgatccggtgcaacgccgggccgtcgtgcaggcggcctcggcgagccacctgctccacctcgcctggatcaccacacccggccgctactggcaggcaccggacaacctcgactggacggctgcgagcctcgacctcgtgcggacgttccgcgaggcggggggcacccgcgccgtggtggccgggacctgtgccgagtacgattggacggggatcaaccttctgccacgtgcagaattggaatccccctctccccgcacgcggggaaagggcttcggcgagcctgtcgtcgcgaccctatccccgcaagcggggcgcggggatgcagcggcgatccaagagggtcatttggcggaagcggccccctgccgcccggcgacgctctatggcgccgccaaggacggtcttcgcctcattctgcaagcctatgcggcgaccgccggcctctccctcggctgggggcgattgttctacctctacggtcccggcgagacgccgggccgactcgtcggcgatgcggcgcgggcgctgctcacgggccagcgtctcgccaccagcgagggccggcagcggcgcgatttcctgcatgccgccgatgtgggagcggccttcgcggccctgctcgactcgggggtggaggggcccgtcaatatcggctcgggcgaagcggtgccggtgcgcagaatcctggaaacgatcggtgcgctgaccggacgccccgatctgatcgatttcggcgcccgccccctcggcccggcggagccggcccgcatcgaggccgacatccggcgcctgacggacgaggttggcttttcggcccgctacggcctcgaacagggcctagagcaaaccgtcgcggcttggcgcgccgcgctcagcaatgcggcatcaatcccttga

SEQ ID NO: 2468 - DNA, 948 bp, Methylobacterium populi BJ001
gtgaagcgggttctcgtcaccggcggggccggcttcgtcggccgccacgcgatcccggcgctcgccgcccgcggcttcgagatccacgccgccggtcgcacggagccggagggcgtccacgccttccacgccgccgacctgctcgatccgggccagcgccgggccgcggtgcagcgggccggcgcgagccacctcctccatctcgcctgggtcaccacgcccggccgctactggcagacaccggacaatctcgactggaccgcggcgagcctcgacctcgtgcgggcattccgcgaaacgggcggccgccgtgcggtcgtggcggggacgtgcgccgagtacgactggacgacgatcgcccggctcggcgaggcgacggcggccggcacgggtcacctgccggaatcggcgccctgcgaccccgcaaccctctacggtgccgccaaggacggcttgcaccggatcctggcgtcctacgccgccagcgccggcctgtcgctggcctgggggcggctgttctatctctacggccccggcgagacgccgggccggctcgtcggcgatgcggcgcgggcgttgctcgcgggtcagcgtctcgccaccagcgagggccggcagcggcgcgacttcctgcacatcgccgatgcaggcgcggctttttccgccctcctcgacgcccccgtcgaaggcgccgtgaatatcggctcgggcacggcggtgtcggtccgaagcattctcgaagagatcggcgcgcgcaccggccgcccggacctgatcgatttcggcgcccggccgctcggtccggcggaaccggcctgcatcgaggccgatatccgccgtctggccgacgaggtcggtttttgtccccgctacggcctgaaacgcggcttggcggagacggtggcgtcgtggcgcgccgcgctcagcaatggggcatcaggcccttga

SEQ ID NO: 2469 - DNA, 909 bp, Cyanothece PCC 8801
atgaaaaaagttttagtgactggagcaactggatttattggtcgtcattgtcttcccttattgttatcaagggattatgaggttcatggtctttatttaaaaagtccccctgacaactttttggcagtacagtggcacaaagcaaatttgttagattcagaacaggttactgttttaatggctaagattaaaccgactcacttattgcattttgcttggtttgctgtcccaggaaaatattggtcgtctttagagaattttctctgggtacaggctagtcttcacttactacaaacatttgtgaatcatggtggagaacgtatcgtcatggccggaacttgtgctgagtatgactggcaatacggatatttatctgagagaacaactcctctaatttctgatactgtttatggaacttgcaagcattcgttacaaattttgcttaatacttttgctcaaaaagttagcatcagttctgcttggggacgtatcttttttgtttacggtccccatgaatatcctcagagacttgttgcttcagtgattcgttctttattaacaggagaaattgcccgttgctctcatggaaaccagattcgcgattttctctttgttcaagatgtggcagatgcctttattgctcttttggacagtcaggtaaaaggtgtcgtcaacattgcctccggttttcccattgccttaaaggacgtaatttataacattgccagtcaattaaatagggagaatttgattcaattggaggctatcccaactaccccaaatgaacctcgtttactggtagctgatgttggccgtctttttgaggaagttggttggcgacctcaatacaatttagcccatggtttgcaggtaacaatagattggtgggaacaacaattgactcaataa

SEQ ID NO: 2470 - DNA, 1041 bp, Methylobacterium chloromethanicum CM4
gtgaagcgggttctcgtcaccggcggggccggcttcgtcggccgccacgccatcgctgcgctcgtcgctcgcggcttcgaggttcacgccatcggccgaacggccccagagggtgtccacgccttccacgcgaccgacctgctcgatccggcgcagcgccgggctgccgtgcaggcggcctcggcgagccacctgctccacctcgcctggatcaccacacccggccgctactggcaggcaccggacaacctcgattggacggcggcgagcctcgacctcgtgcggacgttccgcgaggcgggcggcaaccgcgccgtggtggccgggacatgtgccgagtacgattggacagggatcaaccttctgccgcctgcagaactcgaatctccctcgccccgcacgcggggaatgggcttcggcgacccggtcgtcgcgaccctctccccgcaagcggggcgcggggatgcagcggcgatccgagagggtcatttggcggaggtagccccctgctgcccagcgacgctctacggcgccgccaaggacggtctcagccgcatcctgcaagcctacgcggcgaccgccggactctccctcggctgggggcgattgttctacctctacggtccaggcgagacgccgggccggcttgtcggcgatgcggcgcgggcgctgctcgcgggccagcgtctcgccaccagcgagggccggcagcggcgcgatttcctgcatgtcgccgatgtgggagcggccgtcacagccctgctcgactcggaggtggaggggcccgtcaatctcggctccggtgaagcggtgccggtgcgcagaatcctggaaacgatcggtgcgctgaccggacgctccgatctgatcgatttcggcgcccgccccctcggcccgacggagccggcctgcatcgaggccgacatccggcgcctgacggacgaggttggcttttcgccctgctacggcctggaacagggcctagagcaaaccgtcgcggcgtggcgcgccgcgctcagcaatgcggcatcaatcccttga

SEQ ID NO: 2471 - DNA, 921 bp, Desulfomicrobium baculatum DSM 4028
atgtctgaacgggtgctggtgaccggaggaagcggcttcgtggggctgcctctcgtggccgcgttggcggccgaaggggcgtgggtagaggctctgggatgccggaatgtcgggcccgaattgcccggcgtgcgctggcaccgggtggatctgcatcactccggggatgttcgtctcctgctgcgcgagctgaggcccgctgtgctggtgcactgcgcctggaatgtggagcatggccggttctggtccgcgccggataaccgggtttggctggacgtctccttcgaactggcgatgcggttcttcgagacgggcggacggcgcttcgtcggcatcggcacttgcgccgaatacgcgagtcaggatctgaacgacaacatgccctggtccgagagccgcaaaattgatccctgcaccctctatggccagtccaaggccgaactgtggcgcagactccttgccctggccgaaaggcgtcctggcgctcaggcgtcctgggcgcgcctctttcatctcttcggagcgggcgaacacccggagcggcttgtgtcctcaatcattcgttccgtgctcgccggtcgagaggcgtgttgcgggtccgggcgcctggtccgcgatttttcaagcgtctggtttgtcgccggggcgctggccgcactggcccgctcccgagtgacaggccccgtcaatgtcggctgcggacagccccgctccattgccgccctgtccaggcaggtcgcccggttcgccggacgacccgacctattgcgccttggagccttgccggacaggccgaacgatgtcccggtcatggtggccgacaccaagcgcctgcggcttgaagtcggtcatagtcagcggccagtcatagaagacgatctgcgacgcctgatctctctgtatcgattgcaaaattcctag

SEQ ID NO: 2472 - DNA, 909 bp, Cyanothece PCC 8802
atgaaaaaagttttagtgactggagcaactggatttattggtcgtcattgtcttcccttattgttatcgagggattatgaggttcatggtctttatttaaaaagtctccctgacaactttttggcagtacagtggcacaaagcaaatttgttagattcagaacaggttactgttttaatggctaagattaaaccgactcacttattgcattttgcttggtttgctgtcccaggaaaatattggtcgtctttagagaattttctctgggtacaggctagtcttcacttactacaaacatttgtgaatcatggtggagaacgtatcgtcatggccggaacttgtgctgagtatgactggcaatacggatatttatctgagagaacaactcctctaatttctgatactgtttatggaacttgcaagcattcgttacaaattttgcttaatacttttgctcaaaaagttagcatcagttctgcttggggacgtatcttttttgtttacggtccccatgaatatcctcagagacttgttgcttcagtgattcgttctttattaacaggagaaattgcccgttgctctcatggaaaccagattcgcgattttctctttgttcaagatgtggcagatgcctttattgctcttttggacagtcaggtaaaaggtgtcgtcaacattgcctccggttttcccattgccttaaaagacgtaatttataacattgccagtcaattaaatagggagaatttgattcaattggaggctatcccaactaccccaaatgaacctcgtttactggtagctgatgttggccgtctttttgaggaagttggttggcgacctcaatacaatttagcccatggtttgcaggtaacaatagattggtggaaacaacaattgactcaataa

SEQ ID NO: 2473 - DNA, 498 bp, Jannaschia CCS1
atgagtatgcacgcgccccttgcctcgccaacccagaccgggtttctggcaggctatctggaatcccttgccatggtggagcgcctgcatcggctgctgctcgacgtgatcaaggacgaatttgaacgtttgggggtgcttgatatcaacgccgtccaggccctgttgctgttcaatatcggcgacaatgaggtgacggctggcgagttgaaatcgcgcggctattatcagggctccaacgtcagctacaacctcaagaagctggtggacatgggctatatgcatcaccagaagtgtgagattgaccgccgctcggttcgggtgcgcctgaccgaaaagggccgccatgtgcgcgacaccgtggacggtctattcgagcggcactcggaaggtctggagaagcagggcgtgatgagcgcggatggcgtggaccgcctgaaccactccctcaagcggatagagcggttctggtcggatcagattcgctacatttactaa

SEQ ID NO: 2474 - DNA, 498 bp, Ruegeria sp. TM1040
atgagtatggaacgaccaatcagccagctggaccgcaaggggttcatgactggttatcttgatgccctggcactggtggagcgtttgcaccgcctgttgcttgatgtcatcaaggatgagtttgaacgcgtaggtgtccttgacatcaacgcggtgcaggctctgttgctgttcaacattggcgacaatgaggtgactgccggggaactcaaaacccgtggttactatcagggcagcaacgtaagctacaatctgaagaagctggtggagatgggctatatgcaccatcaacgctgcgagatcgaccgcaggtcggtgcgtgtgcgtcttactccccgtggccgtgaaattcgcgatatcgttgcctcgctgttttcgcgtcacgcagagggtctggaaaccaaaggcgtgatcagcgccgaagggatcgaggacatcactggctccctcaaacgcatggagcggtactggtccgaccagattcgctacatctattaa

SEQ ID NO: 2475 - DNA, 510 bp, Rhodobacter sphaeroides 2 4 1
gtggagacaggaatgacggtacacgcaggcattctcgatgggacgcagaaggcctttctgctgggctatctggaaagcctttcgctagtggagcgtctgcaccggctgttgctcgacgtggtcaaggacgagttcgagcggatcgggctgctcgagatcaatcctgttcaggcgctgctgctgttcaacgtgggcgacaacgaggtgacggcgggcgaactgaagacccgcggctactatcagggctcgaacgtcagctacaatctgaagaagctggtcgaactcggctacatgcaccaccagcggtccgagatcgaccggcgctcggtgcgggtgcggctgaccgacaaggggcgccacgttcgccaggtcctgtccgacctcttcgcccgccatgccgaggggctcgaacggcgcaatgtcgtgggcgtctctgggatggaggatctgaaccaggcattgcggcgcatggagcgctactggaccgaacagatccgctacatctactga

SEQ ID NO: 2476 - DNA, 519 bp, Paracoccus denitrificans PD1222
atgcaacagcgcagctctgcccaaacggtgcccgccctgcggcccccgccgccgcagaccgaccggaccgaggcttatctggaaagcctgcagatactagagcgactgcaccggctgctgctggatctggtcaaggacgagttcgagcggctgggccgatccgacctgacgccggtgcaggcattgttgatctacaacctcggcacgtccgaggtgacggcgggcgagttgcggtcgcgcggcatgtatcagggctcgaacgtgtcctacaatctcaagaaactggtcgagctgggctatgtccaccacgaacgctgcgacatggaccgccgcgccgtccgggtgcggctgacgcaggcggggcaagaggtgcgcgactgcgtggcgcagctgttcgcccgccatgccgaggggctggatctgtcgggcgtgctggacgacccgccgatcgaggcggtgaacctgcaatggcgccgggtcgagcggttctgggccgagcagatccgctatatctattga

SEQ ID NO: 2477 - DNA, 498 bp, Rhodobacter sphaeroides ATCC 17029
atgacggtacacgcaggcattctcgatgggacgcagaaggcctttctgctgggctatctggaaagcctttcgctggtggagcgtctgcaccggctgttgctcgacgtggtcaaggacgagttcgagcggatcggcctgctcgagatcaatcccgttcaggcgctgctgctgttcaacgtgggcgacaacgaggtgactgcgggcgaactgaagacccgcggctactatcagggctcgaacgtcagctacaatctgaagaagctggtcgaactcggctacatgcaccaccagcggtccgagatcgaccggcgctcggtgcgggtgcggctgaccgacaaggggcgccacgttcgccaggtcctgtccgacctcttcgcccgccacgccgaggggctcgaacggcgcaatgtcgtgggcgtctcggggatggaggagctgaaccaggcgctgcggcgcatggagcgctactggaccgaacagatccgctacatctactga

SEQ ID NO: 2478 - DNA, 498 bp, Rhodobacter sphaeroides ATCC 17025
atgacggttcacgcaggcattctcgatgggtcgcagaaggcctttctgctcggctatctggaaagcctctcgctggtggagcgtcttcaccggctgctgctcgatgtggtgaaggacgagttcgaacggatcggcgttctcgagatcaactcggtgcaggcgctgcttctgttcaatgtgggagagaacgaggtgacggcgggcgagctgaagtcccgcggctactatcagggctccaatgtcagctacaacctgaagaagctggtggagttgggctacatgcaccaccagcggtccgagatcgaccgccgctccgtccgtgtgcgcctgaccgagaaggggcggacggtgcgcggcatcctgtcggatctcttttcccgccatgccgaggggctggagcgtcggggcatcgtcggccccgcggggatggaggatctgaatcaggcgctccgacggatggagcgctactggaccgagcagatccgttacatctactga

SEQ ID NO: 2479 - DNA, 498 bp, Dinoroseobacter shibae DFL 12
atgagcttgcacgcgcgactggaagacgcccccgatctcggtgttctgaccgggtatctcgaaagcttgtcgcttgtggaacgtctccatcgtctgctgctcgatgtgatcaaggacgagttcgagcgggtcggtgtgctggagatcaacgcggtgcaggcgctgctgctctacaatatcggcgataacgaggtcacggcgggggagctgaaatcccgcggctattatcagggctccaacgtttcgtacaacctcaagaagcttgtggagatgggctacatgcatcaccagcgcagcgagatcgaccgtcggtccgtccgggtgcgcctgaccgaggaggggcacaaggtgcgccgggtggtcggcgacctgttcgcgcgccatgcaagcgggttggaaagcaagggcgttctggggcgcgaaagtctcgaagagatcaacaccgccctgcggcggatggagcggtactgggccgaccagatccgctacatctactga

SEQ ID NO: 2480 - DNA, 786 bp, Brucella suis 1330
atgaaagacgccgcaaaaactgcaagctggcttgatctggccaatcccacacgtttccttgcctttgcgggcagggttgtgccctggcttgggctggcatcggcaatctttcttgctgtcgggctttacatggttttcctgtcgccggacgattatcagcagggcagcacggtgcgcatcatgtatattcatgtgcctttcgcgtggctctccatgatgtgctattcgatcatggctgtttcctcgcttggcacactggtctggcggcacccgctggccgatgtttcggtgcgtgccgcggctcccatcggcgcggtgttcacggcactggcgcttgccaccggctcgctatggggcaagcccatgtggggaacatggtgggtatgggatgcgcggctcacctcggtttttgtcctctttctcatgtatctcggcattattgcgctctcgcgcgccatggatgacccggcaagaagcgcaaagcccgtagcagtgctcacgctcgtcggcttcatcaatgtgccgatcatcaaattctcggtcgattggtggaatacgctgcatcagcctgcttccgtatttcgtctcgacggcccaaccatcgacggctccatgctgcgcccgcttttcgtgatggctatcggcttcacgcttttgttcttcacgctgcatatgatggcgatgcgtaatgaaatctggcgccgccgcgtggcgtcgatgaaaaaactggcggctcgcaatgtggaccgcaatcgcgccgggcaggtggaggagggcgcgctatga

SEQ ID NO: 2481 - DNA, 732 bp, Nitrobacter winogradskyi Nb-255
atgtcgttgattgacctcgccaacccctcccggtttctcacgcttgccggccggattctgccgtggctcgtggcggtcaccgcgctcgtgctcgcggtcggcctctaccagtccgccatcgcgcccgatgactatcagcagggcgcgaccgtgaagatcatgttcatccacgttccgaatgcgtggctgtcgatgttcgtgtggggcgtgatgagcgtcgcggcgctgggcacgctggtgtggcggcatccgctggccgacgtcgcggccaagaccgcagcgccgatcggcgcggccttcacatttctcgcgctgctgacgggatcgctgtggggccgaccgatgtggggcacctattgggaatgggatgcgcggctgacctcggttttgatcctgttcctgatgtatcttggcctgatggcgctatggcgcgcggtcgaggatccgtcgcgcgccgcgcgcgccgccgcggtgctgacgctggtcggctcggtcaacattcccatcatcaagttctcggtcgactggtggaatacgctgcatcagccggcctcggtggtgcgcatgggcggctcgacgctcgaccgcgccttcctgattcccctcgtggtgatggcgatcggcttcaccctgctgttcctgacgctgcatatcgcggcgatgcggaatgaaatcctgcgccggcgcgtgcgcaccttgcagatgctgcaagccagcaaatcggtggcgtga

SEQ ID NO: 2482 - DNA, 753 bp, Rhodopseudomonas palustris BisB18
atgacgctgatcgatctcgccaatccgacccggttcctgaagctgacggagcgcgtgctgccttggctgacggggctgaccgcgctgctgctggcgatcgggctcgtccaatcggcgctggcgccggacgattatcagcagggcgccaccgtcaagatcatgttcgtccacgtccccaacgcctggctggcgatgttcgtctggggcatcatgagcctgtcggcgctcggcacgctggtgtggcggcatcccttggcggacgtcgcggcgaaagccgccgccccgatcggcgccgccttcacttttctggcgctggtcaccggctcgctatggggccggccgatgtggggcacctattgggaatgggacgcccgcctcacctcgatgctgatcctgttcctgatgtatctcgggctgatcgcgctgtggcgcgcggtggaggatccttcccgcgccgcccgggccgcggcgatcttcacgctggtcggcgcgatcaatctgccgatcatcaagttctcggtggactggtggaatacgctgcatcagccggcctcggtgctgcgggttggcgggccggcgctcgacaagtcgttcctgatgccgctgctggtgatggcgatcgcgttctcgctgttgttcatcacgctgcatctcgctgcgatgcgcaacgagattttgcgccgcagggtgcgggcgctgcagatgctgcaggccagcgagcagcagggtcagctgcgatcgggggcgctgtga

SEQ ID NO: 2483 - DNA, 735 bp, Rhodopseudomonas palustris BisB5
atgacgctgaccgaactcgccaatccgacccggttcctgtcgctcgcgggccgcctgctgccgtggctggcgggcgcgaccgcgctgctgctcaccgtcgggctggtgctggcgatgctggcgccggacgactaccagcagggcgcgaccgtgaagatcatgttcgtgcacgtcccgaacgcctggctggcgatgttcgtgtggggcgtgatgagcctggcctcgctcggcacgctggtgtggcggcatccgctcgccgacgtcgccgccaagaccgccgccccgatcggcgccgccttcaccttcctggcgctgctgaccggctcgctgtggggccggccgatgtggggcacctattgggaatgggacgcccggctgacctcgatgctgatcctgttcctgatgtatctcggcctgatcgcgctgtggcgcgcggtcgaggacccgtcccgcgcggcgcgcgccgcggcggtgctgacgctggtcggcgcgatcaatctgccgatcatcaaattctcggtcgactggtggaatacactgcatcagcccgcctcggtgatgcggatgagcggcccggcgctggacaaggcgttcctgtctccgctgctggtgatggcggtcggcttctcactgctgtttctcacattgcacgtcgccgcgatgcgcaacgagatcctgcgccggcgggtgcgcaccctgcagatgatgcaggccagccgggccgaggcggcgtga

SEQ ID NO: 2484 - DNA, 732 bp, Nitrobacter hamburgensis X14
atgaccctgatcgatctcgccaatccctcccgatttctcgcgcttgccggccggattctgccgtggctcgtggccgtgaccgtgctcgtactggcgatcggcctgtaccagtccgcgaccgcgcccgacgactaccagcagggcgcgaccgtaaagatcatgttcatccacgttccgaatgcgtggctgtcgatgttcgtgtggggcgtgatgagcattgctgcgctgggcacgctggtgtggcggcatccgctggccgacgtcgcggccaagaccgccgtcccgatcggcgcggcgttcacattcctcgcactgttgacgggatcgctgtggggccgcccgatgtggggcacctactgggagtgggatgcgcgactgacctcggtgctgatcctgtttttgatgtatctcggcctgatggcgctgtggcgcgcagtcgaggatccgtcgcgcgccgcgcgcgccgccgcggtgctgacgctggtcggctcgatcaacattccgatcatcaagttctcggtggactggtggaacacgctgcatcagccggcctcggtgatccgcatgggaggctcgacgctcgaccgcgccttcctgattcccctgctggtgatggcaatcggattcacgctgctgttcctgaccctgcatatcgcggcgatgcggaatgaaatcctgcgccgtcgcgtccgcaccctgcagatgctgcaagccagcaagtcggcggcgtga

SEQ ID NO: 2485 - DNA, 771 bp, Mesorhizobium BNC1
atgaacgaaaaaaccgtccgccgctggacagacattgccaacccgacccgcttcctggagctggcgggcgccgtgctgccatggctttggggggcgaccgtgctggtattggccgcgggccttaccatggcgttcacggcgccggaggactaccagcagggcatcacggtgcgcatcatgtatgtccacgtgcccttcgcgtggctttccatgctctgttacacggtgatggcggggtcggcgctgggcacactggtgtggcggcacccgctggccgatgtttcgctcaaggcggccgcccccatcggagccgtcttcacggcattggcgctcgccaccggctccatctggggcaagccgatgtggggcacctggtgggtatgggatgcgcggctcacttccgtcttcgtgctctttctcatgtatctcgggataatcgcgctcacgcgtgcgctggatgatccggggcgctcggctcgggctgcagccatcctcacactggtcggcttcatcaatatcccgatcatcaaattttcggtcgactggtggaacacgctgcatcagccggcctccgtcttccgccttgacgggcccacaatccatccgagcatgctctggcctcttctggtttgcgcggtcgggttcacgctgcttttcctggccttgcatctgatggccatgcgaacggagatctggcggcggcgcgtgatcgcgatgcggcggctttccgcacgggcagcggaaatcaagccactggaggcggcacgatga

SEQ ID NO: 2486 - DNA, 777 bp, Bradyrhizobium BTAi1
atgtcgctgatcgacctcgccaatcccacccggttccttgcgctgacggcacggctgctgccgtggctggcgctggtcacggtcgtgctgctggccgccggcctgtacctctcggcgctggcgcccgacgattatcagcagggcgccaccgtcaagatcatgttcatccacgtgccgaacgcgtggctgtcgatgttcgtctggggcgtgatgagcctcgcctcgctcggcaccctggtgtggcggcacccgctcgccgatgtcgcggcaaaagcagccgccccgatcggcgccagcttcacctttctcgccctgctgaccggctcgctgtggggccggccgatgtggggcacctattgggaatgggatgcgcggctgacctcggtgctgattctgttcctgatgtatctcggcctgatggcgttgtggcgcgcggtcgaggatccgacgcgcgccgcccgcgcggccgccgtgttgacgctggtcggcgcgatcaacctgccgatcatcaagttctcggtcgactggtggaacacgctgcaccagccggcttcggtgatgcggatgggcggaccggcgctcgacaagtcgttcctgattccgcttctggtgatggcgatcggcttctcgttcctgtttgtgaccttgcatgtcgctgccatgcgcaacgagattctccgccggcgcgtgcgcagcctgcagatgatgcaggcgcgcgcctatactggcagcgcccctgcgagcggggcaaccggtccgatcgtgggagccgcctga

SEQ ID NO: 2487 - DNA, 789 bp, Brucella ovis
atgatgaaagacgccgcaaaaattgcaagctggcttgatctggccaatcccacacgcttccttgcctttgcgggcagggttgtgccctggcttgggctggcatcggcaatctttcttgctgtcgggctttacatggttttcctgtcgccggacgattatcagcagggcagcacggtgcgcatcatgtatattcatgtgcctttcgcgtggctctccatgatgtgctattcgatcatggctgtttcctcgcttggcacactggtctggcggcacccgctggccgatgtttcggtgcgtgccgcggctcccatcggcgcggtgttcacggcactggcgcttgccaccggctcgctatggggcaagcccatgtggggaacatggtgggtatgggatgcgcggctcacctcggtttttgtcctctttctcatgtatctcggcattattgcgctctcgcgcgccatggatgacccggcaagaagcgcaaagcccgtagcagtgctcacgctcgtcggcttcatcaatgtgccgatcatcaaattctcggtcgattggtggaatacgctgcatcagcctgcttccgtatttcgtctcgacggcccaaccatcgacggctccatgctgcgcccgcttttcgtgatggctatcggcttcacgcttttgttcttcacgctgcatatgatggcgatgcgtaatgaaatttggcgccgccgcgtggcgtcgatgaaaaaactggcggctcgcaatgtggaccgcaatcgcgccgggcaggtggaggagggcgcgctatga

SEQ ID NO: 2488 - DNA, 771 bp, Sinorhizobium medicae WSM419
atgagcgaaaacagcctggccatacgcaagttcagcgatctcgccaacccgacccggttcctggcgctggcggcgcgtgccctgccgtggcttgccgctcttaccgctcttttctttgccgccgggctctggctctccttcaccaccgagggcgactatcagcagggagagaccgtgcgcatcatgtatgtgcatgtgccttcggcctggctgtccatgatgtgctatacggtcatggcgatctcggcgctcggcaccctcgtctggcgccatccgctcgcagacgtctcggcaaaggccgcagcgccgatcggcgcctgcttcacctttctggcgctcgtcaccggctcgctctggggaaagccgatgtggggcacctggtgggtatgggatgcgcggctgacctcggtcttcgtgctcttcctcatgtatctcggcctgatcgcgctgaatcgcgccatggatgatccgagccgttcggcgcgcgtctcggccgtgctcgttctcgtcggtttcgtcaacatcccgatcatcaagttctcggtcgattggtggaacacgctgcatcagccggcgagcgtcatacgcctggacggtccgacgatcgatccggaattcctgcggccgctcatcgtcatggcaattgccttcacgctgctgttcttcacgctgcacatcggcgcgatgcgcaacgagatctggcgccgccgggtggcctcgctcaggcggcaggcggctcgaaacgcgggccgggagcagcttgcaccatga

SEQ ID NO: 2489 - DNA, 798 bp, Ochrobactrum anthropi ATCC 49188
atggaaaaagacatgaccaaagacgccgttaaaaccacgagctggctcgatctggccaatcccacgcggttccttgcctttgcaggcaaggtgttgccatggctggccgtgctttcggtgctgtttctggcggctggtctctatatggtctttttcctgtcgccggaagactaccagcagggcatgacggttcgcatcatgtatatccatgtgcctttcgcatggctttccatgatgtgctattcgatcatggctgtttcggcgctgggcacgctggtctggcgacatccgctggccgatgtctcgatccgcgcagccgctccgctcggtgccgtcttcaccgcgcttgcgctcgccaccggttcgctctggggcaagccgatgtggggcacgtggtgggtgtgggatgcgcgactgacttcggtgttcgtgctgttcctgatgtatctcggcattatcgcgctgtcgcgcgccatggacgatccggcgaaaagcgccaaacctgtggccgtgctcacgctggtcggcttcatcaatattccgatcatcaaattctcggtcgactggtggaacacgctgcatcagccagcctcggtgttccgcatggatggaccgaccatcgacggctccatgttgcgcccgcttttcgtgatggctatcggcttctcgcttctgtttttcaccctgcatatgatggccatgcgcaatgaaatctggcgccgccgcgtggcgtcgatgaagaagcttgccgcacggaatgccgaccgcaatcgcaaagcacaggagggtgcagtatga

SEQ ID NO: 2490 - DNA, 735 bp, Rhodopseudomonas palustris TIE 1
atgaagctgaccgaactcgccaatccgacccggttcctgacgctcgcggggcgcctgctgccctggctggcggccgcgaccgcattggcgctggcggcgggactgacccagggcatgctggcacccgacgactaccagcaaggcgccaccgtcaagatcatgttcgtgcacgtgccgaacgcctggctggcgatgttcgtgtggggggtgatgagcgtcgcctcgctcggcacgctggtgtggcggcatccgctcgccgacgtcgcggccaagaccgccgcgccgatcggcgcggccttcacctttctcgcgctggtcaccggctcgctgtgggggcggccgatgtggggaacctattgggaatgggacgcccggctgacctcgatgctggtgctgtttctgatgtatctcggactgatcgcgctctggcgcgcagtcgaggacccgtcccgggccgctcgcgccgccgccgtgctgaccttggtcggcgccgtcaacctgccgatcatcaagttctcggtcgactggtggaatacgctgcatcagccggcctcggtggtgcggatgggcggatcgacgctcgacaaggcgttcctgatcccgctgctggtcaccgcgatcgggttttcactgctgtttctgacgctgcatctagccgcgatgcggaacgagatcctgcgccggcgggtgcgttcgctgcagatgatgcaggccagccgggccgaggcggcgtga

SEQ ID NO: 2491 - DNA, 762 bp, Rhizobium leguminosarum bv  trifolii WSM2304
atgagccaaacgagccttgccatcagcaaattcagcgatctcgccaacccgacgcggtttctggcgctggcggcacgcgtcattccgtggctggccggcatcaccgccctctgttttctgatcggcctctatctgagcttctccacggagggcgattaccagcagggcgagaccgtgcgcatcatgtatgtccacgtgcccgccgcctggctgtcgatgatgtgctatacgatcatgagtatctcggcgatcggcacgcttgtctggcgccatccgctggccgacgtctccgccaaggccgcagccccgctcggcgccgccttcaccctgctcgcgctcgtcaccggctcgctctggggcaagccgatgtggggcacctggtgggtctgggatgcgcggctgacctcggttttcgttctcttcctgatgtatctcggcctgattgcgctcagccgcgccatcgacgatccgtcgaaggccgcgcgcgtttccgccgtgctcatcctcgtcggcttcatcaatatcccgatcatcaaattttcggtcgagtggtggaacacgctgcatcagtcggcaagcgtgatgcgcctcgacggcccggcgatcgacccggaattcctgcggccgctcttcgtcatggcgattgccttcaccctgctctttttcacgctgcatatcatggcgatgcgcaacgagatctggcgccgccgcatcgccgcccagcgccgtcttgccgcccgcatggcgagccgggaggaatag

SEQ ID NO: 2492 - DNA, 783 bp, Agrobacterium vitis S4
atgaccgacaatagccttgcttcgaccaagcttactgcccgattaaacgcgctggccaatccgacccggtttctggcactggtagcgcgtgtcctgccatggatggcgggaataaccgttattctgctggccgttggcctgacgctcgcctttacgacagagggcgactaccagcagggcgatacggtgcggatcatgtatattcatgtgcccgccgcctggctggcaatgatgtgctattcggtcatggcgatttccgccatcggcacgctggtctggcgtcatccgctggccgatgtcagccatcgggctgcggccccgttgggggcagccttcaccttcatcgcgctggtcaccggctcgctctgggggcgaccgatgtggggaacatggtgggcctggggcgatgcccgcctgacctcggtgttcattctgttcctgatgtatctgggcctgatcgccctcaaccgggccatggacgatccgtcgaaatcggcgcggatcagttcggtgctgatcctggtcggcttcgtcaatattccgatcatcaaattttccgtggaatggtggaatacgctgcaccagcctgccagcatcatgaagcttggcggcccaagcgtcgatccggagtttttgcggccactgctgatcatggccgtggccttcacgctgctgttcttcaccctgcatttgatggcgatgcgtaacgagatctggcggcggcgaatcatggcccagcgccgtcttgccgcccgggtcgcctcgcaggagagcgcatcatga

SEQ ID NO: 2493 - DNA, 762 bp, Rhizobium leguminosarum bv  trifolii WSM1325
atgagcgaaacgagccttgccattagcaaattcagtgacctcgccaacccgacgcggtttctggcgctggcggcgcgcgccattccgtggctggccggcatcaccgcactctgtttcgcggtcggcctctatctaagcttcgccaccgaaggcgattaccagcagggcgagaccgtgcgcatcatgtatgttcatgtgccctcggcctggctttcgatgatgtgttatacgatcatgagcgtctcggcgatcggcacgctggtctggcgccatccgctggccgatgtctccgccaaagccgcagccccgctcggcgccgcctttaccctgcttgcactcgtcaccggttcgctctggggcaagccgatgtggggcacctggtgggtctgggatgcacggctgacctccgtcttcgttctcttcctgatgtatctcgggctgattgcgctcggccgcgccatcgacgatccgtcgaaggccgcgcgcgtcagcgccgtgctcatcctcgtcggcttcgtcaacatcccgatcatcaaattctcggtcgagtggtggaacacgctgcatcagtcggcaagcgtgctgcgcctcgacggcccggcgatcgatccggaattcctgcggccgctcttcgtcatggcgatcgccttcaccctgctcttcttcacgctgcacatcatggcgatgaggaacgagatctggcgccgccgcattgccgcccagcgccgtcttgctgcccgcatggcgagccgggaggaatag

SEQ ID NO: 2494 - DNA, 2655 bp, Pseudomonas putida KT2440
atgagtgactccgcccgcgccgatgcgctgttggccaacctcccacgcaccggccggggccggctgaaggtgttcctgggcgctgcccccggcgtcggcaagaccttcgccatgctccaggccgcacacgcccagcaacgccagggcgtgcaggtgttggccggggtggtcgaaacccatggccgcgccgaaaccgaagcgttgctcggagggctgcatcagcagcccttgttgcgcagccagtaccgtggcgtcacccttgaggaaatggaccttgacggcctgctgcgtgccgcgccggccttggccctggtggacgaactggcccacacgaacgcccccggcagccgccacgccaaacgctggcaggatgtgcaagaactcttggccgcgggcatcgacgtgtacaccacggtcaacgtccagcacctggaaagcctcaacgacaaggtccgcgacattaccggcgtgcaagtgcgcgagaccctgccggactgggtgctgcaggaagcgttcgagctggtgctgatcgacctgcctccgcgagagctgctcgaacgcctgcgtgaaggcaaggtgtacgtgcccgagcaggcaagggcggccatcgatgcgtatttttcgcaaaccaacctcaccgccctgcgcgagctggccatgcagaccgccgctgctcaggtcgatgccgacctggcccacggctatcgtcagcgcggccaggaggcgccggccttgcgcggccggttgctggtgggcatagacggtgacgaccaggccgaacgcctggtgcgccatgccagccgcgtggcccagcgccgccacctgccctggagcctggtgcatgtggacaacggccgcctgcgtgacgaaaccgcacggcatcgtttgcaagccgcgcagcaactggccgagcgactgggcggggaggtggtactgctgcgtgctggcgaagtggcccgtacgctgatccagcatgctgtcgagcggcgggccagcctggtgctggtcgggcagtcccgcaaccgcctgcgtaggcgtttgttcggcgcgggtgtggcggcgcggctgctgcgcgaaagccgtggcctggaaatcaacgtgctggaccgcgacgtgcagccgccagcgccgcgttcagccgtgcggcgggtgtgggtgtggcgtcattacctgcttgcgctgctggccaccgtgatggctgcgggtctggcctgggcggtgtccagtgtgctcgcgttgcccaatatctcgctggtgttcctggcggcggtgttgctggtcgcggtgcgcagtagcctgggacctgcgctggcttgcgccgcgctgtcgttcctggtctatgacttcctgttcataccgcccaacttctcgttcaccatccagcgcgaagaagacgtgctgacactggtgttctttctgttgatggctgcgcttaccggcaacctggccgcgcgccagcgtcgccagttgcaggcgctgcgcgagacccaggcacagaccagccagttgctcgacctgtctcgccggttgacggtagccaccgaccgccaagccatattcaaggctgccggccagcacctggacgggtggcaggacgcccaggtgtgcttgctggagcgcaacgccgaaggccagttgcaagtggccagcggggaagcctgcaccttcagcgacaccgaacgggcggctgccgattgggcctggcagcatgggcaggccgccggtcacggcagcgataccctgcctaatggccgctggtggtggtggccattggcggtagacgatcagccgctggcgctgctgggtgtgcgcccgcgcaacgggcagccgctcagcgacccacgccggcgcctgctcaccgccctaggccagcccctggcccaggccctggcccgcgcacgcctggctgaacagctggaagccgcacgcctgcacggcgaaaccgagcaactgcgcagcgccctgctggcttccgtatcccatgacttgcgcacgccgttgaccgccatgcgtggcagcatcgacagcctgttggcgttgggcgatgcgatcccggctgaagaccgccgcgagctgctggagggcacccgtaacgaagccgaacgcctcgatcgctacatccagaacctgctggacatgacccgcctgggccatggcggcctcaagctggcccgcgactgggtggccccggcggatatcgtcggcagtgcgctcaaccgcctgcgggtggtgctggcgccgctgcgtgtgcacacggacgtgccgaccgagctgccattgctgttcgtgcatgcggcgttgatcgagcaggcactggtcaacgtgctggaaaacgccgcacgcttttcgccggccaatggtcggcttgagctgcaggtggcggtgcatgacgaccaactgcgcttgaccgtcagcgaccagggccccggcattcctgaagccgaccgcgagaaaatcttcgatatgttctacaccgccgcccgtggcgaccgcggcgggcagggtaccgggctgggcctggctatctgccagggcatgatcggtgcccatggcgggcagattctggtgggcgaaggcattgatggccaaggcaccagcatcactctatgcttgccgctgcctcctcaacctgaagccgaaagcgaaaccccatga

SEQ ID NO: 2495 - DNA, 2664 bp, Pseudomonas syringae tomato DC3000
ttgagtgattccggtcgagctgacgcattgttggcccagttaccccgcgaaggccgtgggcggctgaaagtttttctcggcgcggcgcctggcgtcggcaaaacctacgccatgctccaggcagcccacgcgcagttacgccagggcgtcagggtgatggcgggcgtggtggaaacccacggccgcgcggaaaccgaggcgttgctcaacggcctgccgcaacagcccttgctgcgcaccgaataccgcggcatgaccctcgaagaaatggacctcgacgcgctgctcaaggcggcgccgagcctggtgctggtcgacgaactggcgcacaccaatgcgcccggcagccggcacaccaaacgctggcaggatattcaggaattgctcgcggccggcatcgacgtctataccaccgtcaacgtccagcacctggaaagcctcaatgatcaggtgcgcggcatcaccggcgtgcaggtgcgtgaaacactgcccgattgggtgttgcaggaagccttcgacctggtgctgatcgacctgccgccgcgcgagctgctcgagcgcctgcgcgacggcaaggtctacgtaccggagcaggcgcgcgctgccatcgacgccttcttcacccagaccaacctcaccgcgctgcgcgaaatggccatgcagaccgcagcggcgcaggtcgataacgatctggcgcagggctatcggcaattgggccagtctgccccggcggtgcgcgggcggatgttggtgggcattgatggcgacatgcatgccgagcgtctggtgcgccacgccagccgggtggcccagcgtcgtcatctgccttggagcgcggtgcatgtggatgacgggcaaaccctcgacgagcaatcgcgggcacgcttgcaaaacgcccagcaacttgccgagcgactcggtggtgaagcggtttcgttgcgcgccggggaagttgccagaacgctggtgcagcatgccatcgaacggcgtgccagcgtggtgctggtcgggcaatcgcggcggcactggcgacgccgggtgttcggtggtggcgtcgcggcgcgtttgctgcgcgaagggcacgggctggaaatctcggtgctcgatgacagtgaagagctgcctgatcaaccgccgcgtgcgcgcccggcgcgcgaagtggtgtggttcgactacggcctggctttcgtcgccacgctgatcgccagtctggtggcctggggtgtggcgggggtgctggcgctgcccaatatttccctgatctttctcgccgcggtgctgctggtcgccgtgcgcagcagcatggggccggcgctggcctgtgccggattgtcgtttctggcttacgacttcttgttcataccgccgagtttttccctgaacatccagcgcgaagaggacgtgctgacgctgttgttcttcctgctgatgtcggcgctgaccggcaaactggctgctcgccagcgcaggcaattgcaggcgctgcgtgatactcaggaacagaccagcgagctgctcgacctgtcgcgcaagatgaccgccgccactgaccgcaaagcggtactcaacgccgccgaacagcatttttccggctggaaggagctgtacctgtgcctggtggatcgcgatacgcagggcggcctggtggtcgaaaccggcgggccgctgacgttttcggaagccgaacgggcagcggccgactgggcgtggcagcacgatcaaccggcaggcagcggcaccggtacgctaccttcgggtcgctggtggtggtggccgattaccgcagaagaagggccactggcattgctgggtgtgtgtgcacgggaagggcagtcgtttaccgatcagcacagacggctgctggccgcactgactcagccactcgcccaggccttggcccgtgcgcaactggcgcaggagcttgaggcggcgcgtctgcacggcgaaaccgagcaactgcgcagcgccttgctggcctcggtgtcgcacgacctgcgtaccccgctgacctcgatgcgcggcagtatcgacagcctgctagcgctgggcgaagccattgcgctggaggatcgccgcgagctgctggaaggcactcgtgacgaggctgagcgcctggaccgctatatccagaacctgctggacatgacccgtctgggccatggagcgctgaaactggcgcgcgactgggtgtcgcctgccgatattgtcggcagcgcgctgaaccgcctgcgtgcggtgctgacgccgttgcaggtcagcacgcaggtcaccggcgacttgccgttgctgtatgtccacgcggcgttgatcgagcaggcgctggtcaacgtcctggagaacgcggcacgtttttcacccctcggcgggcgcttgcaagtaacggccggcgtggtcgacagcgagctgttcttctcggtcagtgacgaagggcctggcatccccgaggatgagcgggcgaagattttcgacatgttctacaccgccgctcgcggtgatcgcggcgggcagggcaccgggctcggcctggcaatctgtcagggcatgatcggcgcgcatggcggacggctcacggtcgaggaaggcatcgacgggctgggtacgcgcatcacgttgtttctgccgctacaggcccagcctgacgctgaaatggaggaacccgcttga

SEQ ID NO: 2496 - DNA, 2658 bp, Geobacter sulfurreducens
atgctgaagctggcccaggccgaagaggccgaggcaaagcgggggaagctgaagatcttcctcggctacgccgccggtgtcggcaagacctacgccatgctgcaggcggcccgggagcgcaggcatgaagggcgcgacgtggtggccgcctacgtggaatcccacggccgaccggaaaccgatgcactcctggaagggctggaaatcctccccgcggcccggatcgagtaccagggggtcatgctcccggagctggatatcgacggggtgctggcccgccggccccagctcgccctggtggacgagctggcccacaccaacgcgccaggctcccggcacgagaagcgctggcaggacgtggaggaactgctggcggccggcatcgacgtcttcaccacggtcaacgtccagcacttcgagagcctcaacgacgtggtggcgcagatcaccggcatcgccgtgcgcgagaccgtgccggaccgcctcctggacctggcggcggagatccggttggtggacatcccgccggaggatctcctgcagcggttgcgcgaagggaaggtctacgtgccggagcaggccgcgtttgccgcggaaaagttcttccgcgccggcaacctgatcgccctgcgggagctatcgctccgccgcgccgcggtccgcgtggacgaagagatgcgggcctacatggaggcgcgggccattccgggcccctggccggcggccgagcggcttctggtgagcatcagcggcagcccgttcagcgagcggctgatccggaccacccgccgcctggcggacgaactgaaggccccctggttcacggtctacgtggagacccccggcaacggcaggcatgagcaggaaaaccggaaacgggtctggaaggatctccgcctggcggaaagcctcggcgcccaggtcgccaccgtcaccgccacgtcggtggcggaggcgctcatcgactacgcccgcaggcacaacgtgaccaggatcgtggtcggcaagccggcaaagccgcgctggcgcgagtttctgcgcctccccctggtcgaccggattatccgcctgagcggcgccatcgatgtgcacgtggtcagctacgagccggccgaggccggaaaggggccggtccttcccgtacggagggggccgatctccttctccggctacctggcgagcctggcactggtcgtcgcggcctccctggcctgcctcctgctccgtcccttcctggcgccgaccaacatggtcatgatctacctgctggcagtggtgctggcggcactgaggctcggcctcaagccggccatcctcacggcctttctgggggtcctggccttcgacttcttcttcattccgccgcacctgacctttgccgtggcagacacccagtacctgatcacctttgtcgccctgttcaccgtgggcgtggtcatcagcaccctggtctccacggtgcgcgaacgggccgaggccgtgcgggaacgggaggagcagaccgcctccctctactatctgagccgcgacctggcagcagccgccgacatcgagaccctcgtggccgccgtgatcaggaacatcggcgagaccctgttcgccagggccgccgtgctccttcccgagggagaccggctcagagtcgccgccgccagcaaggggctcaagcccgacgtcaaggagatggccgtggccgactgggcgttccgcaaccgccagaccgcgggccaggggaccgaaaccctcgcctcggcgggatttctctacctgccgctccagacatcgggctccgtcctcggggtgctgggggtcaggctgaaaaacgatgccgattaccgctccacccaggtccgccgcatgctggacgcattcacctcccagaccgccatggccctcgagcgggtccagctctcccggcaggccgagcaggcccagatcctccaggcccgcgagaacctcgaacgggccctgctcaactccatctcccacgacctgcgtacccccctggtcgccatcaccggcgccctggacaccctgcgcgacaaggtccataccctggccgacgaatcccggctggaactgctcgacaccgcgtgggaagaggcagagcggctgaaccgcttcgtgggcaacctcctcgacatgacccgcctggagtccggggcgatcaaactgaaacgggagctgagcgatgttcaggacttgatcgggtgcgccctggcggccctggagcggcggatcggcgagcgcgggatcgacgtgcgccttgctcccgacctgcccctggtcaggatagacatggtcctgatgacccaggtgctggtcaatctgctcgacaatgcgctgaaatattcgccgcccgacagcggcgtggagataacggcccgggtggacggaggcaggctccgcatcgagatggcagaccgcggcccgggcattcccgagcaggacctgaagcgggtattcgacaagttctaccgcattgcggttcccgaaggggcgcagggaaccgggctggggctttccatctgcaaaggaatcgtcgaggcccacggcggctccatccgggccgagaaccggaccgggggcgggctccgggtgatcgtgaccctgccgctggccggcggggcgaaagagggtgtttcccatgggccatga

SEQ ID NO: 2497 - DNA, 2664 bp, Pseudomonas syringae pv B728a
gtgagtgattccggtcgagctgacgcactgctggcccagttgccccgcgaggggcgcggaaggctgaaggtttttctcggggctgcgccaggcgttggcaagacctatgccatgctccaggcggctcacgcgcagctgcgccaaggcgttaaggtgctggcgggcgtggtcgaaacccacggccgcgcagaaaccgaagcgctgctcaacggtctgccgcaacagcccttgctgcgcactgattatcgcggcatgaccctcgaagaaatggacctcgacgcgctgctcaaggctgcgccgagcctggtgctggtcgacgaactggcgcacaccaacgcgcccggcagtcgccacaccaagcgctggcaggacattcaggaactgctcgccgccggtatcgacgtctacaccacggtcaacgtccagcatcttgaaagccttaatgaccatgtccgcggcatcaccggcgtgcaggtgcgtgaaaccctgccggactgggtgctgcaggaagcctttgaactggtgctgatcgacctgccgccccgcgagctgctggagcgcctgcgcgacggcaaggtctacgtgccggagcaggcacgtgcggccatcgatgccttttttacccagaccaacctcaccgcgttgcgcgaaatggccatgcagacggcggcggcgcaggtcgataacgatctggcgcagggctaccggcaattgggccagtcggccccggcggttcgcgggcggatgctggtgggcatcgatggtgatatccatgccgagcgtctggtgcgtcacgccagtcgggttgcccagcgtcgccatctgccgtggagcgccgtgcatgtggacgacgggcaaactctcgacgagcagtcccgcgcgcgcctgcaaagcgctcagcaactggccgagcggctgggcggcgaggcggtttcattgcgcgccggtgaggttgccagaacgctggttcagcatgccatcgaacgacgtgccagcgtggtgttggtcggccagtcgcgtcggcattggcgtcgccgcgtgtttggtggcggcgtcgcggcgcgcttgttgcgtgaagggcatgggctggaaatctcggtgctcgacgacagcgaagcactgcccgatcagccgccgcgtgcgcgcccggcccgcgaggtcgtgtggttcgattacggcctggccttcgcggccacgttgattgccagtctggtcgcctggggcgttgcaggcgtgctggcgctgccgaacatttccctgatctttctcgctgcggtattgctggtcgccgtgcgcagcagcatgggcccggcgctggcctgtgccgggttatcgttcctggcgtatgactttctgttcattccgccgagcttttccctgaacatccagcgcgaagaagacgtgctgacgctgctgttcttcctgttgatgtcggccctgaccggcaagctcgcggcacgccagcgcaggcagttgcaggcgttgcgcgatacccaggagcagaccagtgagctgctcgacctgtcgcgcaagatgaccgccgccactgacggtaaagcggtgttcagcgccgccgaacagcatttttccggctggaaggaactgcacctgtgtctggtcgaccgcgacggagagggcggctgggtggtcgaaaccggcgggccgctgaccttctcggaagccgagcgtgctgccgccgactgggcctggaagcacgatcaacctgcgggcagtggcactggcaccttgccgtccggacgctggtggtggtggccgatcaccgcagaagaaggcccgttggcgctacttggggtctgcgcgcgggaaggccagtcgttcaccgcgcagcatcgacgtctgctggcggcactgacccagccgctggcccaggcgctggcccgtgcgcaactggcgcaagagcttgaggcggcgcgcctgcacggtgaaaccgagcaactgcgcagtgccttgctggcctcggtgtcccacgacctgcgtaccccgctgacctcgatgcgcggcagcatcgacagcctgctggccctgggtgaagccattccactggaggatcgccgcgagctgctggaaggcacccgcgatgaagccgagcgcctggaccgctatatccagaacctgctggacatgacgcgtctggggcacggtgcgctgaagctcgcccgcgactgggtggcgcccgccgatatcgtcggtagcgcgctcaaccggctgcgtgccgtactggcgccgttgcaggtcagcactcaggtgaccggcgagctgccgctgctgtacgtgcacgcggcgctgatcgagcaggcgctggtcaatgtgcttgagaacgctgcgcgcttttcacccgtcgatggacgcttgcaggtagcggccggtgtggtcgacagtgaactgtttttctcggtcagtgacgaaggccccggcattcccgaggacgaacgagcgaagattttcgacatgttctacaccgccgcccgcggcgatcgtggcgggcagggcaccgggctggggctggcgatctgtcagggcatgatcggcgcgcatggcggacggctttcggtcgaggagggtattgatgggctgggtacgcgcatcacgctgtttctgccgctgcaggcgcagccggatgtggaactggaggagtccgcttga

SEQ ID NO: 2498 - DNA, 2856 bp, Ralstonia eutropha JMP134
atgcccgaattgcgatctcccgccgaacgtccggatccggacaccctgctgcaacgcatgcaggaggagggcgcgcgcgccgcgcgtggcaagctgcgcgtctatttcggtgcctcggccggcgtgggcaagacctttgccatgcttgccgcggcgcggtcgctgcgagagcagggcgtggacgtggtcatcggcgtggtcgagacgcatggccgcgccgagaccgaggcactgatcgatggcatcgagcgcctgcccatgaaggacgtgccgtaccgcgaccgcgtgctcaaggagttcgatctcgacggtgcgctggcgcgtcgtccggcgctggttctcgtcgacgagttggcccattccaatgctgcgggcagccgccacccgaaacgctggcaggacatccaggaactgcagtcgtctggcatcgacgtctggacgaccgtcaacgtgcagcacctggacagcctcaatgaagccgtcggcggcattaccggcattcgcgtctgggaaaccgtgccggacgccgtgttcgacggcgccgacgaagtgatcctcgttgacctgcctgccgacgagttgctgcgtcgcctgcgtgagggcaaggtgtacctgccggagcaggcccgccatgcggtgcgcaacttcttccgcaagggcaacctgattgccctgcgtgaactggcattgcgacgcaccgcggaccgtgtcgatgacgatgtgcgtgcctatcgccgcgccgaatcgatccagtcggtgtggcgcacgcgcgaggcggtgctcgcctgcatcggcactggcagcgatgccgagcaggtcgtcagaagcgcgcgccggctggccggccagctcgattgcgactgccatgtgatcacggtagcggcgccacgactggcgtctgtccccgatgccgagcgcgtgcggctggagtcggcgatgcggctggccgaggaactcggcgcgcgcaccgagacgctggccggcagcgacatggtgcaggcggtggccggctatgtccggcggcacaacctgaccaaggtcgtgcttggccgcacgccgacgcgatggcggcgcgaagatgactcgctgctgatgcaggggcgttcgctactggcctgggtactatctccattcctgggcgcgcgcgcatggctgttcggccgcaagagctttgccgatgctctgtcggccgcgtgcccggagatcgacgtgatacgcgtcgcggctgataccacgcgcgtagacgtcaagcccgccagcgcgccgatcccgctcgaggaaagcgaggccgcgcacgcacaggagcgtcgcgtgcgcatgcagtcgtacctgtgggccattgcgtggtgcgccggcgcgacggcagtgtcgatgctcgcacggccgtggttcgaccttgtcaacatcgccatgctgttcctggtggcggtggtcggcgtggcgctgcgccatggccgcgcggcggcggcactggcctcggtagttgccgtgggcgcattcgatttcttcttcgtgcccccgcgaatgtcgtttagcgtgagcgacgtgcagtacctgctgaccttcctggtgctcctgtcggtgggcctggtcatcggtcagctcacggccggactgcgcgaacaggccgaagtcgcggtgcaacgcgagaccgatgcgcgcacgctgtacgagctcgcgcgcgaactgtcgtcggccctgatgaacgagcagatcgtctcgattggcagccgcttcctgcgcgcggccttcgacgcacgctcggcattcttcctcgtcggaccggacggccggctgctgccgcctgtggtggatacgcagggacaggccggcgggcacagcgacgcgatcgaccgcgtgctcgcgcagtgggtgttcgaccatggccagccggccggcacaggcacccatacgctgccggccggtaccgtgctgtacctgccgctcaaggcgccgatgcagacgcgtggcgtgctggccgtcgagccgcaggcgtggcgcgcatttgcgcagccggcactgcggcgccaggtcgatgtattcgcgacgctgatcgccatcaccatcgaacggctgcactacgtggacgtcgcgcagcgggcgctgttgtcgatggagtcggagcggttgcgcagttcgctgctggccgcggtgtcgcatgacctgcgcacgccgctgaccagcctgatcggcatggccgagaccctgcagcgcggcgatccgccgctcgcgccgcgcgtagcggatacggtctcggcgatgcgtgaccaggccaggcgcatgagcacgatggtcgtcaacctactcgacatggcgcggttgcaagggcgggacgtgcgcatgcagaaggagtggcagtcgttcgaggagcttgttggcgcggcgcttggagccttgcgcgatgcgcttgtcggacatcgtgtcgcggtggcggatctgcacaagatgccgctggtggagtgcgatgccgtgctgatggatcgcgtgctgtgcaacctgctggagaacgccgccaagtacacgcctgccggaaccgaaatccgcatccgcgcggaggtcgtggacgacgaggtgcgcctcgtggtggaagatgatggccccggcgtgccccccggcagcgaacggcagattttcgagaagttcacgcgcggtgaacgtgaatcggtgacaaccggcgtgggcctgggccttgccgtctgcgacgcgatcgtgcaggcgcatggcggacggatctgggtcgagcctgtgcgcgatgctgccacggcaggggctggcatcggtgcacgattcatagtggccttgccgcgcggcaatccgccggtgatcgagcccgaagccgcggacattcccgcataa

SEQ ID NO: 2499 - DNA, 2703 bp, Rhodopseudomonas palustris HaA2
atgtcgacctcgaccgccaccgcacgcgcttcacccgacgccctgctggccctcgccggcaaggaagggcgcggccggctcaagatctttgtcggcgccgcgcccggcgtcggcaagacctatgcgatgctgtctgctgcgcgcagcgagcgggatggcggccgtgacgtggtggcgggattgatcgagacccatggcaggctcgagaccgaacacttgctgcagggcatcgaagtgctgtcgcggcacccgatcgtttatcgcaaccgggtgatgcgcgaattcgacctcgacggcgcgctggcgcgcaagccttcgttgctgctggtcgacgaatacgcccacaccaacgtgccgggcagccgccatccgaagcgctggcaggacatcgacgaactgctcgccgccggcatcgacgtctggaccacgctgaacatccagcatctcgaaagcctcaacgacgtcgtgctgaagatcagcaagatccgcgtgcgcgagacggtgcccgacaaggcgttcgaccgtgccgacgagatcgtgctggtcgacctgccgccggacgaactgctgaaacgcctcgcccagggcaaggtctacgtccaggacaccgcggcgcgcgcggtcgagagcttcttcaagccgcagaatctcaccgcgctgcgcgaactggcgatgcgccgcgccgccgagcgggtcgacgccgctttggtcgagcggatgcaggcgcacgcgatcgaagggccgtgggccgccggcgagcgcatcctcgcctgcgtcggtccggacaccggctcgcccggcgtggtgcgcaccgccaagcggctcgccgacctgatggacgcgccgtggatcgcggtgacggtcgaacgctccggcgtcaatcccgactccgcggcgcgccggcagatcgacgaggcgctgaagctcgccgagagtctcggcgccgagacccatacgctgaccggcaacgacattcccgacgagctgctgcgcttcgcccgtttcgaaaacgtcacccagatggtgatcggccgcgcccgcggcggcgcgctgcggcaatggctcgcgggctcgctgccgcagcaattgatgcagcgctcgaccgacatcgccatccatctggtgccggtgcagggggaacccgccgaacgcgacagccgctcgctcgcggcacggctgaatgcgtccaagccggcgcattttgtctatgcgaccgtcgcggtcgccggcgcggtggcggtcggcaaggcgttcgcacaggcgatcccgacggcgagcctgtcggtggtgttcctgatggcggtgctgttcagcgcggtgaagtccggtgtcggcccggcgatcttcgcctcggtgctgtcgttcttcacttacaatttcttcttcatcgccccgctctacaccttcaccgtcgcggagccctacgaactgctggcgctgctgatgtatctggtggtcgcgatcgtcgccgcgacgcttgccggccggctgcgtgatcaagcgcggatctccgcaggccgggttcgggcgatgcggagactctacgagttcacccgccggttgtcggggctcgccaccagcgatgatatcgccgaaggcgcggcgagcgaaatccacgccagcctgggccgcccggtgatggtgatgctgccgcgcgaggacgatctggtgctggccgcagcctggccgccggaggacgcactcgacgaggcggcgatgatggcggcacgttgggccttcacccacaatgaacccgccggcttcgacaccggcacgctgccgatcgtgccgtggcgtttcctgccggtgcgcaccggcgccaccacctacggcgtgatcggcgtgatgcagaagaaggacagcgctgcgctcgactccgaggcccaggcactgctcgatacactcaccgaacagaccgcggccgcgctggagcgcgccgcattgacgcgcgacatggtgagggcgcggacggcgaccgagaccgagcgcgtccgcaacaccttgctggcttcgatttcgcacgacttccgcacaccgctgtcctcgatcctcggctcggccaccagtctgtccacctttggcgacaagctcgacgacgccgcgacccgcgacctgctcgccaatatccgcgaggaggccgaaggcctcgacgagatggtgcgcaacctgttgtcgatcacccggatcgaatccggcgcgctcgaactgcgccgcgactgggtcgatctgcgcgagatcgccgcacgcgtgatcgaagcggcacggcggcgcggcgcggcgcaacacatagacctcgactgcccggccgatagtccgctggtgcgggccgacgcggcgctggtcgaacaggcgctcggcaacatcgtcgccaatgccgttgcgcacacgccgccaacgtcgcacatcctgatcgacgccgagaacgacgcgtcatcggtgaagctgcgcgtcaccgacgacggcccgggcgttgccgtggccgatctgccgcgcatcttcgatcgcttcgtgcgcagcgccagcggcaccgcgccgtcctcgagtcgcggccagggcgtcggattgggactggccatcgccaagggaatcatggaagcgcatggcggcgcggtgtccgcgctcagccccgtcgcgaacgggcacggcacgcgcttcgtgctcaccttcatgcgcgacaggacacaggagacgccgcagccatga

SEQ ID NO: 2500 - DNA, 2685 bp, Nitrobacter hamburgensis X14
atgtccggcgagccggccacacgagcctcacccgacgcgctgctggccctcgccaaaaaggagggacgcggccatctgaagatttttctcggcgccgcgccgggcgtcggcaagacctacgcgatgctggcggcggcacgcagcgagattgccggtggtcgcaacgttgtcgtggggctcgtggaaacccacggccgccgcgagaccgaccagatgctcgacggctttgaggtgctcgcgcgcaaaccgatcgtctatcgcaatcaggtgatgcacgagttcgacctcgatgccgcgcgggcgcgcaaaccgggcctgctgctggtcgacgaatacgctcacaccaacgtgccgggcagccggcaccccaagcgctggcaggacatcgatgaactgttgcgggcagggatcgacgtctggaccacgctgaacattcagcatctcgaaagcctcaacgacgtcgtccagaaaatcagcaaggtgcgcgtgcgcgagaccgtgcccgataaggtcttcgatcaagcggacgaggtcgtgctggtcgactttccgccggacgaattgctgaagcgcctcgcggaaggcaaggtctacgttcaggataccgccgcgcgcgccgtcgagaatttcttcaagccgcaaaacctgacggcgctgcgcgaactcgccatgcgccgcgcggccgagcgggtggatgcatccctgatcgagcggatgcaggcgcaggcgatcgatgggccttgggcggccggcgaacgtattctggcatgtatcggtcccgatccggtgtcgcccaccgtggttcgtaccgccaagcggctcgcagacctgatggatgcgccgtggatcgcggtgacggtcgagcggcccggtgccagcctcaatagtgcggcccgtcaacgtctcgatgaggtgatgaagctggcggaaagtctgggcgcggagacgcaaaccctgactggtgccgatctccctgccgagttactgcgctttgcgaaattcgagaacgtcacccagatcgtggtcggccgctcgcgcggtggatttttcagcgaactgctgcgccggtcgctgccgtacgaactggtccggcgaacacaggacatcgccattcatctggtcacgcgcgaaagcgatgtgtccgaaccggcgtcgggctggttgctgcacaacaggagtccgctgcgtccacttccgttcgtctacgccaccctgacggtggctgcggcgctcgccgtcagcaaagtattgaccgaactgatgccgatcccgaatctgtcgatggtgttcatgctatcggtgctggtgagcgccatcaacttcggcgtctggcccgcgatctacgcctcggtgctgtcattcttcatctacaacttcttcttcattccgccgctctacaacttcacgattgccgagccctatgaactgctggcgctggtcatcttcctggtcgtcgcgattgttacctccgcgatggcaggtcgggtgcgggatcaggcgcgcgtatccgcgggccgggttcgcgccatgcgccgactctacgaattcacacgccgcctgtcgggattggcgacacgggacggcattgctgaaggcgcggccggggaaattcatgccagcctggcgcggccggtcgtggtgctgctggcggagggcgatggtcttgccctgaccgcagcctggccgccggaagatgcgctggatacggcgaccatgacggccgcgcgttgggcctacaaccatgcggaacccgcgggcgccgacaccgggaccttgccgatcatcccgtggtatttcgttccgctgcgaatcggcgacaaagccctcggcgtcatcggcgttgcaaaggacaaggatacgccgcccctcgattcggaggcgcgtaccttgctcgacacgttatccgagcaaaccgccgcggcgcttgaaagggccgcattggcaagcgagatggtgagcgccaggacagcgaccgaaaccgagcgcgttcgcaatacgctgctggcctcggtttcgcatgatttccggacgccgctgtcctccattcttggcgccgcaaccagcttgctgagctacggcgacaagatcggtgccgcagccaagaccgatctgctcgggcagatcaagcaggagaccgaagggcttgatgagatggttcgtaacctgcttgcgatcacgcgcatcgattccggggcgctcgaactgcgccgtgactggatcgacctgcgcgagatcgtcgaacgcgtggccagcgccgcgcggcggcgcagcgcaccgcaacgtatcgatattacgatgccgcccgatcttccgctggttcgtgccgatgcggcgctggcggagcaggcgatcggcaatgtcgtggccaatgcaattgtgcatacgtcgaaggagacgcacatcgtgatcgatgcgcagtccggattgtcagacataaccgtacgcgtgaccgacaacgggcccggaatcgggtccgatatactgccgcacgtcttcaaccggttcgtcaggggaaacggtgcggacgacgtgcatgacggcggggagggaacgggcctcggtcttgcgatcgcaaggggaattatggaggctcatggcggatcgattaccgtcgacagccccgtggaggggcagcccggtgcccggttcgtgatggtctttccgcgagaggacggcgcaacgtga

SEQ ID NO: 2501 - DNA, 2904 bp, Cupriavidus metallidurans CH34 uid250
atgtacgcatggcaatcgcctgcgtggcacaatcatcgccaccaaccgccgttgccgatgaccgatccagacgcccgcccggaccccgacgccctgctgcaacgcatgcaggcggagcgcgcgcgtgccgctcgcggcaaactgcgcgtgtactttggcgcgtcggccggcgttggcaagacctttgccatgctgggcgccgcgcgtgcgttgcgcgagcagggcgtggacgtggtggtcggcgtggtcgagacacatggccgcgccgagaccgaggctctgctcgatggactcgagcgcctgccgctgcgcgaggttccatatcgggaccgcgtcctggcggagttcgatctcgacggcgcgctggcccgacgccccgcgctgattctggtggatgaactcgcgcattcgaatgctgcgggcagccggcatccgaaacgctggcaggacattcaggaactacaggccacgggcatcgacgtctggaccacggtcaatgtgcagcacctggacagcctcaatcaggccgtgggtggcatcaccggtgtgcgcgtctgggagaccgtgcccgatgcggtgttcgacggcgccgacgaagtggtgctggtggacctgcccgccgatgaactgctgcgccggctgcgcgagggcaaggtctacctgcccgatcaggcgcgccacgccgcacgtaatttcttccgcaaaggcaacctgatcgcgctgcgcgaactcgcgttgcggcggaccgccgatcgcgtcgacgacgatgtgcgcgcgtatcgacatgccgaatcgatcgatctggtctggcgcacgcgggaagccctggtggcgtgcatcggcgccggcgacgatgccgagcaggtggtgcgcagcgcgcagcgtctggcgggccagctcgattgcgactggcatgtggtgacgatcgccacgccccagttgatgccgccatccaacgaggtccgcgcgcgcatgcgcgccgccatgcaattggcagaggaactgggggcccgcacggagacgctcgccggcaacgacatggtcaaggcggtggcaggctacgtgcgacgccacaacctgaccaaggtgctgcttggccgtgcccccgccgactggtatgcgcgagggaactggatcgacaaggggcgtgccttgctggcccgtgcgctgtcgccgttgcttggtgtcggtaaccggctgttcggccggcagatgttcgccgatgcgctggcggcgggttgcccggagatcgacgtgatcagggtggcggccgactccacacgggcggacctgcgtccgcgagtccaggaggggctatccaccgaggcgcacgatgcggaggccgaagccgagttggcccgcgtgcgccgtcataactatggctgggccgtggtctggtgcatggcggcgacgttcctgtcgacgttgaccagaccctggttcgacctggtcaatatcgcgatgctgttcctggttgccgtggtaggcgtggcgttgcgtcatggccggggaccggcggcattggcatcggtgatttcggtggcggcgttcgactttttcttcgtgccgccgagaatgtcgttcgccgtcagcgacgtgcagtacctgttgacgttcttcgtgctgctgacggttggtctggtgatcggccagcttacggcgggactacgcgagcaggctcaggtgtccgtgcggcgcgaaaccgatgcgcgcacgctctatgagctggcgcgcgagttgtccgctgcgctgacggcgcagcagatcgtcgagatcggcggtcgcttcctgcgtgccgcctttgacgcggatggcacttttttcctcgtcgcagagaacggacggctcatgccgatggccggcggagaaaagacaccggagccgcggacaggcaaaggcgatgccatcgacaaggtgttggcgcaatgggtgttcgatcacggtcagcctgccggcacgggcacgcacacgctacccggcagcacggtgctgtatctgccgctgaaggcgccgatgcagacgcgcggcgtgctggccgtggagccgcgcgcgtggcgggcgctggcggacccggcgttgcgtcgtcaggccgatgtctttgccacgctgatcgcgatcgcgatcgagcgtatccattacgtcgacgtggcgcagcgcgcgctggtgtcgatcgagtcggaacggctgcgcagttcgctgctggccgcggtgtcgcatgatctgcgtacgccgctgaccgggctgatcggcatggccgaaacgctgcagcgcgcggagatgccgctgccggccagcgtcgcggagacagtcgaggcaatgcgcgttcaggcacaacggatgcgcacgatggtcgtcaacctgctcgacatggcgcgcctgcagcatcacgacctggcgctcaagcgtggctggcaatcgcttgaggaactgattggcgcggcgctggcgtcgatgcgcgacgtgctcggtcggcaccatgtggaagtgatgaatcttgtggagctgccgctggtggagtgcgacgatgtgctgatggagcgtgtgctgtgcaacctgctggagaacgcggcgaagtacacgccggcaggcaccgccatccgcatccgcggcgcggtggtgggcgacgaggtgcaactgtcagtggaagacgaaggcccgggcgtgcagtcgggccaggagcgctacatcttcgagaaattcacgcgtggcgagcgcgaatcggccacctccggcgtcgggctcggcctggcggtctgcgaggcgatcatgcaggcccatggtggtcgcatctgggtggaggccgcccacccacatggttcgcgattcacgctggcgctgccgcgcggcaatccaccggctatcgagccagagtcgctggacgaacccattccggatcatcactga

SEQ ID NO: 2502 - DNA, 2658 bp, Pseudomonas aeruginosa UCBPP-PA14
atgaccgacaccgcacgcgccgacgcgctgctggccgacctgcccgctgacgggcgcggccgcctgaaagtctttctcggcgcggcgccgggggtgggcaagaccttcgccatgctgcaggccgcccaggcccagttgcgccagggcgtgaaactgcgcgccggggtggtcgagacccactcgcgggcggaaaccgagtccctcctcgcaggcgtgccgcagcagccgctgcgcagcctcgagtatcgagggatgaaactgcaggaaatggacctcgacggtctcctcgccgacccgccggcgctggccctggtcgacgaactggcccacagcaacgttcccggcagccgccacgccaagcgctggcaggacatccaggagttgctggcggcgggaatcgacgtctacacaacggtcaacgtccagcacctggagagcctcaacgaccaggtccgcgacatcaccggcgtgcaggtccgcgagacggtgccggactgggtgttgcaggaggcctacgagatcgtcctcatcgacctgccgccgcgcgagctgctggagcgcctgcgcgagggcaaggtctacgtgccggaacaggcgcgggcggcgatcgatgcgttcttctcgcagaccaacctcaccgcgctgcgtgaactggcgatgcagaccgccgccgcgcgggtcgacgccgacctcaaccaccgctaccgccagcgcggcgaggaggcgccggcgttgcgcgggcggctgctggtgggcatcgacggtgacgaacaggccgaacgcctggtgcgccacgcctgccgggtcgccgaacgtcggcacctgccctggagcgtggtacacgtcgataccggcggcttgcgcggcgagcaggcgcggatgcgcctgcagggtgcgcagcaactggccgagcggctcggcggcgagatcgtcgtgctgcgcgccggcgaggtggcgcggaccctcctgcaacatgcccgcgagcgccgcgccagcctggtcctggttggccagtcgcggcgccgctggtaccgccgggccttcggcggtggtctcgccgggcgcctgctgcgcgacggccagggcctggagatcagtgccctggacagcgaggccgacctgcgcccggcggaaccgcggccacgctatccggtggtgtggaacgactatctgctggcgctgctggcgaccgccctggccagcggcctggcctgggtcgtggcgcacctgctggaactgccgaacatctccctggtgttcctgatggcggtgctgctggtggcagtgcgcagcagcctgatgccggcactgctgtgcgcggtggcgtcgttcctggcctatgacttcctgttcatcccaccgcatttttccttcgccatccatcgccatgaagacctgctgagcctggcgttcttcctgttcatggccggcctcaccggcaacctggcggcacgccagcggcgccagctggaggcgctgcgtgatacccaggaggaaaccagcctgctgctggagctgtcgcgcaagctcaccgccgccaccgaccgccaggcggtgctggccgccgccgcccagcagttcgacgactggaaggacgtcgaggtctgcctgctcggtcaggtcaatggcgagtggaagaccgaggccggcgtgcagcggcaactcgccgaccaggaacgggtcgccgccgactgggcctgggcccacgaccagccggccggcctcggtactggcacgctgcccggaggacgctggtggtggtggccgctgtcggcggaagaggggccgctggcactgctcggcgtcgcgccgctggacggccagccgctgagtccgcagcgccggcgcctgctcgccgccctcggccagcccctggcccaggccctggcccgtgcgcgcctggccgaggacctggaggccgcgcgcctgcacggcgagaccgagcaactgcgcagcgccttgctcgcctcggtgtcccacgacctgcgcacgccgctgacggccatgcgcggttccatcgacagcctgctggcgctgggcgaggcgatcccgccggcggatcgtcgcgaactgctggaaagcacccgcgacgaggccgagcgactggaccgctatatccagaacctgctcgacatgacccgtcttggccacggtggcctgaagctggcgcgcgactgggtggcgccgggcgacatcgtcggcagcgcgctgaaccgcctgcgcgcggtgctggcgccgtaccgggtgcaggcgatcgtggccaacgacctgccgttgctctacgtgcatgcggcgctgatcgaacaggcgctgatcaacgtgctggaaaatgccgcgcgcttctcgccgagccacggccggttgcgcatcgaggtcagccaggatgccgccgagctgcgtttcgcggtgagcgacgaggggccggggattcccgaggccgagcgggagaagatcttcgacatgttctacaccgctgcccgtggcgaccgcggtggccagggcaccggcctgggcctggcgatctgccagggcatgatcggcgcccacggcgggcgcatcagcgtcggcgaaggcctcgacggtcgcggcaccacgctggtcctgcacctgccgctgcatccgcagccggacctcgggcaactggagggcgacgaatga

SEQ ID NO: 2503 - DNA, 2700 bp, Polaromonas naphthalenivorans CJ2
atgaacctacccgccggccagcgccccgaccccgacgagctgctgcaacggctgcagcagcaggaagcgcagcgtgcgcgcggcaggctgcgcatctatttcggcgccagcgcgggcgtcggcaagacctacgccatgctcggcgccgcccagcgcgagcgcaaggacggccgtgacatcgtcgtcggggtgatcgaaacccacggccgcagcgaaaccgccgaactgctggccgggctggagcagttgccgctgcgcgaggtcgcctaccggggccgaacgctcagggagtttgacctggacgccgcgctggcgcgcaagccggccgtgctgctggtcgatgagctggcgcacagcaacgtggaaggctcgcgccaccccaagcgctggcaggacgtgcaggaactgctggacgccggcatcgatgtctggtcggccatcaacgtgcagcacctggaaagcctgaacggcacggtgggcgccatcaccggcatccgtgtcaacgagaccgtacccgacaccgtgctggacgccgccgacgagatcatcctggtcgatgtcacgcccgacgaactgacggcgcgcctgaaggccggcaaggtttatctgccgcagcaggccgagcgcgcggcgcagaactttttccgcaagggcaacctgatcgcgctgcgcgagattgccctgcgccgcaccgccgagcatgtcgaggacgatgtgcgcagctaccgggtcgagaaatcgatttccccggtgtggaacaccgaaggcgcgctgctggcctgcatcggcccgcatgaaggcgccgagcagaccgtgcgcacggcggcgcggctggccggccagctcaatgtgcgctggcatgcggcgtatgtcgaaaccccgcgcctgcagcggctcaaggaggccgagcgcgaccggattctggccgtcatcaagctggccggcgagctgggcgcgactaccgccgtgctggccgccagcgatgcggccgccgagctggtggcgcaggcgcaggcgctcaactgcgccacgctggtggtcgggcggcccgcgctgccggactggcgaacgctgtggagcgggcgcagcatgacgcgccggctggcccggctggcgcccacgctggacatcgtggaagtggctgatgcccgcagcagccggcgcctggccccggccgtgccgcgcagcgacgacgacgcggccagcgcctggcatggcagcctgccgcgctatgcctgggcggtggccagcagcgtggccatcacgctgctggccacgccgctgctcaatgtgttcgacctggccaacatcgtcatgctgttcctgctcggcacggtgctggtggcgctgaagctggggcgcggcccggcggcgctggcggcgtttctcaatgtcgccgcgttcgactattttttcgtcgcgccgcgcctgtcgctggcggtcagcgacgtgcagtatctggtgacgttcgccgtcatgctggtggtcgggttgctgaccggccagttgacggcgggcctgcgctttcaggcgcgcatctcaagcagccgcgagcgccgcgcgcagtcgctgttcgagttgacgcgcgatttgtcggcggccctgatgccctcgcaggtggccgagctgggcgaggccgccgtgcagcgcgacttcggcgggcaggcgctggtgctgaccaccgatgcccgcgaccagctggtgctgccggtgcatgcgccgccgggctttgacgccagcgtggccgactgggcgtttcgccatgcgcaggccgccggcctggccacatcgacgctgtccgcgcagacctggcattacgtgccgctgaaggcgaccatgcgggtgcgcggggtactcgcgctgcagcccgccaggccgcgctggctgttgattcccgagcaactgcagcagctcgacacgctggcgcggcaaatcgccatcgcgctggagcgcgtgcattacgtggacattgcccagcaggcagtggtcgagatggagtcggagcggctgcgcaacacgctgctggcggctctttcgcacgatgtgcgcacgccgctgacggcgctgatcgggctggccgagtcgctgcagcgctcgcagccgccgctggagccgcagcaggccggcatggcgcaggcgatggcgcagcaggcgcgccagctcaatgcgctggtgagcaacctgctcgacatggcgcgcctgcagaacggcgcggtcagcctgcaccgcgactggcagtcggtcgaggaggtggccggttcggcgattcgcgccgcccagcccgcgctcaacggccggacggtgcgcaccgacatcgcgccggacttgccgctggtcgagtttgacgccgcgctgatggagcgcgtgctggtcaacctgctggaaaacgccgccaagtacggcgcgccgccgtttgaaatccatgcgcgcgcggcgcccgacagcctggtcttgagcgtgcgcgaccacgggccggggctgccacccgcgctgcgcggccgcgaggccgaactgttcgagaaattcacccggggccaagctgagtccgccacgccgggcgtcgggctggggctggcgatttgcaaggccatcgtcgatgcgcatcgcggaaagatcgtggccggcaatgcccaaggcggcggcgcgcagttcaccatcacgctgccgcgcggttcgccgcccgagccggcgccggaataa

SEQ ID NO: 2504 - DNA, 2694 bp, Serratia proteamaculans 568
atggtggaagaggaacaacagcgccccgaccctgacagcctgctggcgctggccaatgaaaagccccgtggccgcctgaaggtgttcttcggcgcttgcgccggggtaggcaaaacctacgccatgctgcaggaagcccagcggctgcgtgcccaggggctgaacgtgctggtcggcgtagtggaaacccatggccgcagcgaaaccgccgcgctgctgggcgggctggatttgctggcgcaaaagcgcattcagtatcgcggcagaatggtacaagagtttgatctcgacgctgcattggctcgccacccggcattgatcctgatggacgagctggcgcacagcaacgcccatggctcgcgccatccgaagcgctggcaggatgtcgaagagctgctggatgccggtatcgacgtgctgaccaccgtcaacgtacaacatctggaaagcctgaacgacgtggtcggcggcgtgaccggggtacgggtacgtgaaaccgtgcccgatcacgtgttcgacgaagccaccgaggtggtgctggttgacctgccgccggacgatctgcgccagcgtctgaatgaaggcaaggtgtatatccccggtcaggccgaacgtgccatcgagcactttttccgtaagggcaatctgattgccctgcgcgaactggcattacgccgcaccgccgatcgggtcgatgaccagatgcgcgccttccgcgacactcaggggcgtgaacgcgtgtggcatacccgcgacagtatcctgttgtgcgtcggccataacagcggcaacgaaaaactggtgcgtatcgccgcccgcctggcggcccggctgggctgccactggcacgcagtctatgtcgaaacgcccaaattgcaccgtttaccggagagccagcgccgggcaattttgcgagcgctgcggctggcgcaggagttgggggccgaaaccgccaccctgtccgaacctgatgaagaacgcgcggtgctgcgttacgcccgtgagcacaacctgggcaaaatcattattggccgtcgcagcgaacagcgctggaaactacgcggcagctttgccgatcgcctcggcaagttgggtccggacctcgatctggtgattgtcgcgctggaaaacgacagccccccgcagccaggcaaagaacacgacagccgcaactttggcgagaaatggcgtatgcaactgcgtggctgtgccgtcgccgtcgcactctgcgccctgatcactctgctgtcccagtggctgctgccggggttcgaccaggccaatctggtgatggtctacctgcttggcgtggccattgtcgcgctgttcttcggccgctggccgtcggtgctggcggcggtgatcaacgtcgccagttttgacctgtttttcgtccagccggaatggtcgtttgccgtcagcgatatgcaatatctgctgaccttcggcgtgatgctgacggtcggcatcactatcggtaacctgaccgccggcgtacgttatcaggcgcgggtggcgcgctaccgcgagcagcgggctcgtcatctgtatgagatctcccgcgggctgagccaggcgctgactaccgaagacatcgccaaaaccagccgccacttcctctccagcagtttccaggccaaaaccgtgctgctgctgccacaggaagacggcaagctgcagcaaatggtcggggaaaccggcgggctgctgtcggtagatgaggctattgctcgctggagtttcgacaagggcatgccggccggagccggtaccgataccctgcccggcgttccctatcaactgttgccgttagccacgtcgaaacaaacctttggcctgttggccatcgagcccagcaacctgcgtcagctgatggtgccggaacaacagcggctgctacagacttttgcggtattgattgccagcgcgctggaacgcttgcatttggcgcgcagcgccgaggaagcaaaactggacgccgaacgcgaacaactgcgcaactcgctgctggcggcgctgtcccacgatttacgcactccgctgacggtgctgttcggccaggcagaaattctgacgctcgatctggcggcggaaggctccaaccatgcgacccaggccagtcagatccgccagcaggtgctgagcaccacccggctggtgaacaacctgctggatatggcgcgtattcaatccggcggtttcaacctgcgtaaagagtggcaatcgctggaagagatcgtcggcgcatcgctgcatatgctggagccgctgatgactcagcatcaaatcaaggttgagctaccggcggagctggtattggttaattgcgacggcagcctgctggagcgcgtgttcactaacctgttggaaaatgccaataaatatgccggctacgatgctactatcggtattcgtgcccatactctgccagagtggctggaagtcgaagtctgggacgatgggccgggcattcccgaagggaaaatgcagcttattttcgataagttttctcgcggcaataaagagtcggcgatccccggcgtgggtttggggttagcaatttgccgtgccattattgaagtgcacggtggccgtatctgggccgaaaacggtgccaacggcggtgccagtttccgctttgtgctaccgctggagaaaccgccagaaatagacagcgaagcctttgatctttaa

SEQ ID NO: 2505 - DNA, 2655 bp, Pseudomonas putida GB 1
atgagtgattccgcccgcgcagacgcgctgttggctaaccttgcgcgaaccggccggggccggctgaaggtgttccttggcgccgcccccggtgtcggcaagacgttcgccatgctccaggccgcacacgcccagcagcgtcagggcgtgcaagtgctggctggcgttgtcgaaacccacggccgcgccgaaaccgaagcgctgcttgccggccttcagcaacagcccttgctgcgcagccagtaccgtggcgtcacccttgaggaaatggacctcgacggcctgctccaagcctcaccggccttggccctggtcgacgaactggcccacaccaacgcccccggcagccgccacgccaagcgctggcaggacgtgcaggagttgctggccgccggtatcgacgtgtacaccacggtcaacgtccagcacctggaaagcctcaacgacaaggtgcgcgacattacgggcgtgcaagtgcgcgaaacgctgccggactgggtgctgcaggaagccttcgagttggtgctgatcgacctgcccccgcgcgagctgctcgaacgcctgcgcgaaggcaaggtgtatgtgcccgagcaagcgcgtgcggccatcgacgcgtacttctcgcaaaccaacctcaccgccctgcgcgaactggccatgcagaccgccgctgctcaggtcgacgctgacctggcccacggctatcgccagcgcggccaggaagccccggccttgcgcgggcggttgctggtaggcgtggacggcgatgaccaggccgaacgcctggtgcgtcatgccagccgtgtggctcagcgccgccacctgccctggagcctggtgcatgtggacaacggccgcctgcgtgacgaaaccgcgcggcatcgtttgcaggccgcgcagcaactggccgaacgtctgggtggggaggtggtactgctgcgtgctggcgaagtggcgcgcacgttgatccagcatgctgccgagcggcgggccagtctggtgctggtcgggcagtcccgcgaccgcctgcgtcggcggctgttcggggccggtgtggcggcgcggctgctgcgcgaaagccatggcctggaagtcaacgtgctggaccgcgacgtgcagccgccagcgccgcgttcggcggtgcggcgggtatgggtgtggcgccattacctgctggcgctgctggccaccgtgatggcggcgggcctggcctgggcagtgtcgagcgtactggcgctgcccaacatttcactggtgttcctggcggcagtgttgctggtggcggtgcgcagcagcctggggcctgcgttggcctgcgccgcgctgtcgttcctgacttacgattttctgttcatcccgcccaacttctcgttcagcatccagcgcgaagaagatgtgctgaccctggtgttcttcctgctgatggccgcactcaccggcaacctggccgcgcgccagcgccgccagttgcaggcactgcgcgagacccaggcgcagaccagccagttgctcgacctgtcgcgtcggctgacggtggccaccgatcgccaagccgtgttcaatgccgccggccaacatctggacggctggcaggacatgcaggtgtgcctacttgagcgcaatgccgaaggccagctggaagtggccagtggcgaagcccacgccttcagtgacaccgaacgggctgccgccgattgggcctggcagcacggccaggccgctggccatggcagcgacaccttgcccaatggccgctggtggtggtggccgctggcggtggacgaacaacctctggcgctgctgggcgtgcgcccgcgcaacgggcagccgctcagcgacccacgccggcgcctgctcaccgcccttggccagccactggcccaggccctggcccgcgctcgcctggccgaacaactggaagccgcgcgtctgcacggcgaaaccgagcaactgcgcagcgccttgctggcctcggtatcccatgacttgcgtacaccgttgaccgccatgcgtggcagcatcgacagcctgctggcgttgggcgaggcaatcccggctgaagaccgccgcgagctgttggaaggcacccgtaacgaggccgaacgccttgaccgctacatccagaacctactggacatgacccgcctgggccacggtggcctcaagctggcccgcgactgggtagccccggcggacatcgtcggtagcgcgcttaaccgcctgcgcgtggtgctggcaccgctgcgggtgcacaccgacgtaccggccgagctgccgttgctgttcgtacatgcggcgctgatcgaacaggcgctggtcaacgtgctggaaaacgccgcacgcttctccccgacccagggtcgcctagagctgcaggtggccgtgcaggatgaccagttgcgctttatcgtccgcgatcagggccccggcattcccgtcgccgaccgcgagaagatcttcgacatgttctacaccgctgctcggggcgaccggggcgggcagggcaccgggctgggcctggcgatctgtcagggcatgatcggtgcacatggcgggcagattctggtgggcgaaggcatcgatggccagggcaccggcatcactctatgcttgccgctacctcctcaacctgaagccgaaagcgaaaccccatga

SEQ ID NO: 2506 - DNA, 2625 bp, Azotobacter vinelandii DJ
atgacccatgccatgaacgaagcccgcgatgttcccgagcggacggccgcgcaatccagccacggcgaagggggcggccggctcaggcgcggccggctgaggatctatctcggcgcggcgcccggggtgggcaagaccctggccatgctccaggccgccacggagctgctgcgccagggcgtcgatctgcgggtcggcagcctcgactgcgccgacgatgccgcccgcggcgagctgcggatgcggctcgccgcgctgccgggcggccgggaggcggccggcgaactggacctcgatgcgctgctggcccgtccgccggccctgctgctggtcgaccgcctggcgcgcgccaatccgcccggcagccgccatgcccagcgctggcaggatgtgcaggaactgctggccgccggtatcgatgtccacgccaccctcgacgtgtcgcacctggaaagcctgaagaaccgggtcgaagccctgaccggccagccggtgacggaaacgttgcccgactggctgctggaggaggctcacgaggtgctgctgatcgactgcctgccgggcgagctgcgcgacttcgcgccgaccaccctggccgcgctgcgcgccctggccctgcaggtggtggccgggcgcgccgacagcgaggtgcagcgccgctaccggccttccgggcgcgaggcgccggccgtgctcggtcgcctactggtggcggtggacggcgacgagcagtccgaacagttggtgcgccatgccagccaggtggcgcgccgacgccagttgccctggacgctggtccacgtggacgacggccgcgcgcgcggcgaggagtcccgccgcctgctgcaggcggcccagcggctggccgagcgcctgggcggcgaagtggtcggcctgctcggcgatgaggtcgccgataccctgctacgccacgcccgcgagcgccgcgccagcgtgttgctggtcggtggccaccgccgccgctggttcggcaggggcgtggtcgagcgcctgctacgccgggcgcgtggcctggagatcggcgtgctggccgccgaagaggcggtttccgtgccgtctttcgccgtgcgcggcttcgtcgccggtccgctcgactatgctctggcgctgctcgccacgctgctggccagcgccgtggcctggggcttctcgcggatgctggcgctacagaacatttccctggtgtttctcgccgctgtcctgctggtcgccgtgcgcagcggcttcggccccgcgctgtgctgcgcgctgctgtccttcttcgcctacgacctgctgttcatcgcaccgaccttttcgctgatcgtggcgcatcgggtggatgtactgggcctgttgttcttcctgctcatggccgcgctgaccggcaacctggcgacccgccagcgccggcagatgcaggcgctgcgcgagacccaggcggaaaccgcggcattgctcgatctgacccgcaagctgagcgccgccaccgaccggcgcgcggtgctggccgccgccgtggagcagttcgccgcctggcgcgatctcgacgtccgcctgctcggccccgatggcgccggtgctctgcgggtcgaggcgggcgtcgccggcgatctcggcaaaagcgagcgggccgccgccgaatgggtctggcagcacgaactgccggccggcctcggtaccgacaccctgcccgacggccgctggtggtggtggccgctgtccggcgagcgcggccccctggccctgctcggcatcgccccgcgggacggccggccgctgccggcgtcccgccgccaccggctggtcgccctctgtcagccgctggcccaggccctggcgcgcgcgcaactggccgaggaactgcaggccgcccggctgcgcggggagaccgagcagttgcgcagcgccctgctggcttcggtgtcccacgacctgcgcacgccgctcaccgtcatgcacggcgccatcgacagcctgctgaccctggacgggcagatcgccgccgccgaccgccgcgaactgctggaaagtacccgcgacgaggccgagcggctcgaccgctacatccagaacctgctggacatgacccgcctcggccacggcggtctcaagctggagcgcgactgggtggcgccggcggacatcgtcgccagctccctgcagcgcctgcgcccggtgctggcgtccttccgtctggagacgcgcatcgccggggaactgccgctgctgcatgtgcacgcggcgctgatcgaacaggcgctggtcaacgtcctggaaaacgccgcgcgcttctcgccgcccggtggccggctgcgggtggcggtcgacagcgacggcggcgaactgcgcctgtcggtgagcgaccagggacccggcatcccgccggcggaacgggaaaagatcttcgacatgttctacaccgcggcccgtggcgaccgcggcggccccggcaccggcctgggcctggcgatctgccagggcattctcggcgcccacggcgggcgggtgacggtgggcgaggggctggacgggcagggcgccaccctgaccctgcacctgccgttgcagccgcagccgccgggcgagagcgagcgcgacgacgaggcgccggtcctgccatga

SEQ ID NO: 2507 - DNA, 2763 bp, Variovorax paradoxus S110
atgagcgacattccccgccccgaccccgacgcattgctcgcgcaactgcgcagcgacgaggcgcgcgcactgcgcggcaagctgcgcatctatttcggcgcgagcgcgggcgtcggcaagacctgggccatgctgagcgccgcgcagcgcgaacgtgccgcggggcgcgacgtgctcatcggcgtggccgaaacccatggccgcagcgaaactgcggcactgctcgcggggctcgagttgctgccgctgcgcgaggtggaccaccgcggccgcaggctggccgaattcgatctggatgccgccctcgcgcgcaagcccgccgtgctgctggtcgatgaactggcccacaccaatgcgcccggctcgcgccatgccaagcgctggcaggacgtgcaggaactgctggccgcgggcatcgaggtgtggtcggcgctcaacgtgcagcacctggaaagcctcaacggcacggtcggcgccatcaccggcgtgcgggtgcacgagaccgtgcccgacaccgtgctcgacgaagccgacgaggtggtgctggtcgatgtcacgcccgacgaactcgcggcgcggctcgcggcgggcaaggtctacctgccccagcaggccgagcgcgctgcgcagaatttcttccgcaagggcaacctgatcgcgctgcgcgagattgcgctgcgccgcaccgccgagcatgtggaagacgacgtacgcggctggcgcgtcgagcagtcgggcgcggccggccgcaatggaaaggacgggcagggcggcgaactgcaggcctggaacacctcgggcgcgatcctcgcgtgcgtcgggccgcacgagggcgacgcgcagacggtgcgcaccgccgcgcggctcgcgggccagctcaacgtgcgctggcatgccgcgtacgtcgagacgccgcggctgcagcggctcgccgccgaggagcgtgaccgcatcctcgcggtgctcaagctggccgaggagctgggcgcggccaccgcggtgctcaccggttccgacgtggccgagcaactggctgaacaggcgcggcggctcaactgcgccacgctggtgctggggcaaccggagccggccaccggctggcgccgctggtggcccgccacgccgatgccgctgccgcgcgcgctggcccggcgcgcgcccgcgctcgacatcatggaagtcggccgcgccgacagctcgcgccgcttgtcgcgcgcgcccatcgccgccacgcgcgccgacgacgacgaccacgagaaggcacccgtccactggccgggctacgcctgggccacggccgcgagcatcgcgctcacgctgttgtgcacgccgctggcccatgtgctggagctgtccaacatcgtgatgctgttcatgctgggcgtggtgggcgtggccatgcgcttcggccgtggaccctcggcgctcgcggcgctgctcaacgtggcggcgttcgattatttcttcgtgccgccgcgcctgtcgttcgcggtgagcgacgtgcagtacgtgctgaccttcgcgatcatgctcggcgtgggcctgctcgtgggccagctgatggcggggctgcgctttgcggccggcgtgtcgaccagccgcgagcggcgcgcgcgctcgctgttcgaactcacgcgcgagctctcggccgcgctggagagcacgcaggtggtggcgctgggcgcagccgccgtgcaggggcacttcggtggccaggcgctggtgctggtcaccgatgcggccgaccagctcgtgctgcccaagagcccgccggagggcttcgatgcgcaggtggccgactgggcctttcgccacggccagcccgccggcctggccaccgccacgctggcggcgcagccctggcattacgtgccgctgcaggcaccgatgcgcgtgcgcggcgtgcttgcgctctcgccggcgcagccgcgctggctgctgattccggagcaggcgcagcagctcgacacgctggcgcggcagatcgcgattgcgctggagcgcgtgcactacgtggaggtggcgcagcaggcggtggtcgagatggaatcggagcgcctgcgcaacgcgctgctcggcgccatctcgcacgacgtgcgcacgccgctcaccgctttgattgcgctggccgagtcattgcagacgctgccgcccgaggcgcacgccgaggcggcgcgcgccatcgtcgcgcaggcgcacgagctgcatgcgctggtcaacaacctgctcgacatggcgcggctcgaaagcggcattgcgggcggtgcggtgaacctgcggcgcgactggcagtcggtggaagaggtggtcggttcggccatccgcgcggcgcgccccgcgctcggccctgccgtggtgcagaccgcgctcgagcccgggcttccgctggtcgagttcgatgccgtgctgatcgagcgcgtgctggtcaacctgatcgagaacgccaccaagtacggcgcgccgcccatcgtggtcggcgcacgggccgagcccggcatgctgaggctcacggtgcgcgaccacggcccgggtctgcccgccgcactcttgggccgcgagcagaagctgtttgacaagttcacgcgcggcgaaaccgaatcggccacgccgggcgtgggcctgggcctcgcgatctgccgcgcggtggtgagcgcgcacggcggcgagattgccgcggccaatgcgcagggcggcggtgcagaattcacggtcagcctgccgcgccgcgagccgccggaaaccgccgaagaagcccagccctga

SEQ ID NO: 2508 - DNA, 342 bp, Jannaschia CCS1
atgctgagcctacgcctgtacatgctgcaacggatcaccgcgcttttgatggcgccgctggtgatcggccatctcgcggtgatgatctacgcgatccaaggcgggttgtcggcggaggaaatcctgggccgcacccaagggtcatttgcgtggttcgccttctacggcaccttcgtggtcgctgtggcgatccatggagccatcgggttacggacaatcctccacgaatggggcggcttgcgcggcttcgcgttggaggtcgtcatgtggatcatcgggctggggctgtttgcaatgggggcccgcgccgtctgggccgtgacatttgggggtgcggcgtga

SEQ ID NO: 2509 - DNA, 336 bp, Rhodobacter sphaeroides 2 4 1
atgctcgatctgcgactctacatgctgcaacggctctcggcgctggtgatggcgcccctcgtgctgggccatctggcgctgatgatctacgcggtgcagggcgggatcagcgcgggcgagatccttgcgcggacgcagggcagcctcggctgggcgctctattacggccttttcctcgtggcggcggcgatccatgcggccatcgggctgcgggtgatcctcgccgagacgctgacgctccgcaaccgcccgctcctcgacctcttcaccctcgcggtgggtgcggtcttcctgatcctcggcctgcgcgcccttcatgcggtgacgctcgcatga

SEQ ID NO: 2510 - DNA, 336 bp, Verminephrobacter eiseniae EF01-2
atggagcaaggtcttttcgcgctgcaaaggctcagcgccatggccatggcgcctttcgtgctggtgcatctgggtctgattttgtacgcagcgcgcgccgatctcacggcccaggacatcctggcgcgcacccggggcagttggggctggatcgctttttacacgctgttcgtgctgagcctgagcatccatgtgcccatcggtctgcgctgcatcctgatcgagtggacgcatctgggtcgccgcgcagccagcgtgctgtgcctggtcttcgcgctggcgctgctgttcatgggtttgcgcgccgtggtcgcgctgggagggctggcagcatga

SEQ ID NO: 2511 - DNA, 336 bp, Rhodobacter sphaeroides ATCC 17029
atgctcgatctgcgactctacatgctgcaacggctctcggcgctggtgatggcgcccctcgtgctgggccatctggcactgatgatctacgcggtgcagggcgggatcagcgcgggcgagatccttgcgcggacgcagggcagcctcggatgggcgctctattacggccttttcctcgtggcggcggcgatccatgcggccatcggcctgcgggtgatcctcgccgagacgctgacgctccggaaccgcccgctcctcgacctcttcaccctcgcggtgggcgcggtcttcctgatcctcggcctgcgcgcccttcatgcggtgacgctcgcatga

SEQ ID NO: 2512 - DNA, 330 bp, Methylobacterium radiotolerans JCM 2831
atgagtccgctcctgtacctcgcccagcgcggcacggcggcgatcctcgcggtcacgatcgcggtccatctcggcacgatcgtctacgcggtgcgcggcgggctcacggccggcgagatcctgggccggactcagggcaatctcgccttcctgctgttctacgcggtcttcgttctggccgccgcgatccacgccccgatcggcctgcgcagcgtcctgcgcgagtgggccggctggcgcggccgctccctcgacgtcgccatgatcgccctttcggccctgctcgccgggctgggcctgcgggcggcactcgcggtgtacgtggcatga

SEQ ID NO: 2513 - DNA, 330 bp, Methylobacterium nodulans ORS 2060
atgaacgtccgtctctacgtctggcagcgcggcaccgcggcgctgatggcgccgctggtcctcatccatatggccgtaatgttctacgcgacgcggcacggtctttcggcgtccgacatcctaagccggacgcgcggcagcatcgcctgggccctcttctacgggaccttcgtggccgccgcggcgatccatgccgcaatcggcctgcgcggcatcctgaccgagtgggtaccgatgcaaccacgcacggcctccctcgccgcctcggccttcggtgtcctcctcgtcgtgcttggcgctcgggccgtctttgccgtggtgttcggatga

SEQ ID NO: 2514 - DNA, 336 bp, Variovorax paradoxus S110
atggaagctcgcctcttcgctcttcagcgcctcacggcaatggtcatggcgccatttgtcttcacgcatgtgggactcatcatctacgcggtccgcggcggactgaccgctggcgaagtcctctctcgcacgcaaggcaactgggtgtggatcgcgttctacggcctctttgtgatcagcgtggccgtccacgttccgatcggcgtgcgcaacattctcatcgaatggctgcgccttggacgaagcgctgcgtccctggtgagcctggtgttcggcgccgcattgctgtacctgggccttcgcgccgtcgccgcggtggggggactgatgccatga

SEQ ID NO: 2515 - DNA, 288 bp, Methylococcus capsulatus Bath
atgagcagccgggtcgaacagattcgcgaacgccttcagggggcactggcgcccctgcatctggaaatcatcgacgaaagcgcgtcccatgccggtcatgcgggggcgatggcgggcggtggacatttccatgccacgatcgtgtcagccgctttcgacgggaaatctctggtgcaacgtcaccagatggtgtattcggcgctgggcgacatgatgcacaacgaaattcatgccttcagcatgaaagccctgactccttctgaacatccaacaacaggaaatttttga

SEQ ID NO: 2516 - DNA, 267 bp, Dechloromonas aromatica RCB
gtgagtgcagaaaccatcgagttgctgcgccagcgtctggtcgtgctgcaagctgaatcgatcaccatcattgacgactcgcaccgccacgccggccacgccggcgcccgtgacggcggccattaccagttacaaattgttgcacaggcatttgccggtaaaagtaccatagcccgtcaccgcatgatttatgatgctgcgggagacctgatgcgtggccggattcatgcgctcagcatccgcgccgaagtgcctggcgaagtataa

SEQ ID NO: 2517 - DNA, 264 bp, Thiobacillus denitrificans ATCC 25259
atgagtaccgccgacctgatccgccagcggctcgcggcgctggagcccgaaacctacacgctggacgatgaaagcgcgcagcacaaaggccacgccggcgcggcctctggcggcgggcactttcgcctcaccatcgtatcgccgcgattccgcaatctttccacgctcgcccgtcaccgcctcgtctacgacgccatgggcgaactgatgcagcgagagattcacgcgctgtccgtcacggccctcacccctgaagaactctga

SEQ ID NO: 2518 - DNA, 282 bp, Nitrosococcus oceani ATCC 19707
gtgactccagaggaacggatcgtatttattcaaactcatttaaaggcagctctttccccccagtatatagccgttgaagatgaaagcgcccgccatgctggccataagggccatggcggcggcggccactaccaggtcaccattgtagcggaagcttttaacggaaagtctttattagagcgccaccgcatggtctacagtgcggtccaggaaggcataggtcaggatattcacgccctgagcattaaagcttatacaccccaggagaacccattaagttag

SEQ ID NO: 2519 - DNA, 276 bp, Nitrosospira multiformis ATCC 25196
atgaacactatagaattgatgaaggaaaagctcgctgcgctggagcctgtcgtaatccggattgtggacgaaagcgcgcgtcatgcgggacatgaaggcgccaaggcagggggtggccactatttacttaccatcgtctcacatcaattcacctgtaagtcggcgctggcgcggcaccggctggtttacgataccctgcgcgagatgatgcacaagaatattcacgccttgggtgtaaaagcgtatactcccgaggaatttgattcgatccactga

SEQ ID NO: 2520 - DNA, 279 bp, Methylobacillus flagellatus KT
atgaccctgatagaagaaatccgcaaccgactctcggcactctcgcctaccatgctggaaatccgtgacgatagcgccctgcacaagggccacgcaggcaacaacggcggcgggcattttttcctgaccattgccagcgcggaattttccggcaagtcgcaggtcatgcggcatcgccaggtctatgccatgctgggcgacctgataccgcacaaaatacacgcgctcagtatccaggcaattgcaacagatgatcctcctgttgtcacaatcgactga

SEQ ID NO: 2521 - DNA, 279 bp, Alkalilimnicola ehrlichei MLHE-1
gtgagtggaaacgaacgcgttgagatgatccgccagcgcctggagcaggcattggatgtccacagcctggagatccaggacgacagccacaagcacgccggtcacgccggggcccaagccgggggcgggcactaccaggtgcgggtggtcagcccggactttgcggggctgaacaccctacagcgccatcgcaaggtctacggcgccatgggtgatgccatgcgcaacgacatcatccacgccctggggatcaaggcccttacccccgacgaggcgtga

SEQ ID NO: 2522 - DNA, 324 bp, Xanthomonas oryzae PXO99A
atgaaccgggtcgagcagattcgtgcagcattgcaggctgcgctggcaccgaccgaactcgatgtggtggacgacagcgcgcgccatgccggccatgccggcgcgcgcgacgggcgcgggcatttcaatgtacgcgtggtcagtgccgccttcgttggcaagccactattggcccggcaccgcgcggtctatgccgcggtgggcgagatgatgcagaccgatatccacgccttgtcgatcaaggcgtttgcgccgggcgaggcggggggggcgcctgggtcggagcaggtggtgcccccgctcgatcgcctgccgttgtcatag

SEQ ID NO: 2523 - DNA, 276 bp, Stenotrophomonas maltophilia R551 3
gtgaacgcggaacggatcgagcggattcgtgatgcgctgcagcaggcgttgaccccgagcgtgctcgaaatcgaggacgacagccatcgccatgccggccatgccggtgcccgcgacggtcgcggccatttcaacgtgcatgtggtcagcgatcgcttcgccggactgggcccgctggcccgtcaccgcgcggtctacaccgcgctgggggcgatgatggagaccgatatccacgcgctgtccatccgtgcgctgaccccgtcagaacagggctga

SEQ ID NO: 2524 - DNA, 312 bp, Acidithiobacillus ferrooxidans ATCC 53993
atgaataaagaaatccttggtaatttattgcgtgacgccctgaatccggaattcctggaaatcaatgaccggacgaaatcccacagtggtcatgcgtcgtccggcggcggcgggcattacgaggtacgcattgtcagcagtcggttcgcgggcttgcctccgttggcacgtcaccgtctggtcaatgcggctaccgacccggtgcgtcaggagatacacgcactgacgatcaaggcctatagcccggaggagtttgccgcccaaaaccagcccaaaacacagcgtccagccatcgccctgaacgtcctttag

SEQ ID NO: 2525 - DNA, 288 bp, Thauera sp. MZ1T
gtgagcgcgacgagggtcgagcgcatccgcgccgcgctgcaggaacgcttcgcaccgacacgcctcgagatcggcgacgacagcgcgctgcacgccgggcacgcgggtgcgcgcgagggaggcggacattatcgggttttcatcgtctcggaagctttccagggctgcagcagagtcgtccggcagcgtatgatctacgacgcggtcggggacatgatgcacaaggacatccatgccctcgccatccgcgcgctaacggccgcagaggccgaatcacaaggacattga

SEQ ID NO: 2526 - DNA, 312 bp, Acidithiobacillus ferrooxidans ATCC 23270; identical to SEQ ID NO: 2524

SEQ ID NO: 2527 - DNA, 330 bp, Pseudomonas syringae tomato DC3000
atgagcaatggcaacagcgtcaccgttcagatcctcgacaaggaatactcgatcatctgccctcaggaagagcgcaccaacctggtcagcgccgcccgttacctggacggcaagatgcgtgaaatccgcagcagcggcaaagtcatcggtgccgatcgcatcgccgtcatggccgccctcaacatcactcacgacttgctgcacaaggagcatctgcctgacgtgcagagcagcggctcgactcgcgaacaggtccgcgatctgctcgacaaggtcgatctggtgctggccacagacacgcccggcacaccggactcaactcggggctga

SEQ ID NO: 2528 - DNA, 330 bp, Pseudomonas syringae pv B728a
atgagcaatggcaacagcgttaccgttcagatcctggacaaggaatattcgatcatctgccctcaggaagagcgcaccaacctggtcagcgccgcccgctacctggatggcaagatgcgtgagatccgcagcagcggcaaagtcatcggtgcggatcgcatcgccgtgatggctgccctgaacatcactcacgacctgctgcacaaggaacatctgcctgacgtacagaccagcggttcaacccgcgaacaggtccgcgatctgctcgacaaggtcgatctggtgctggcgacagacacgcccggcacaccggattcaactcggggctga

SEQ ID NO: 2529 - DNA, 312 bp, Nitrosococcus oceani ATCC 19707
atgaatgatgaagcccagccagtagtcttgcatatattgggtaaagaatatcgggtggtttgcccatctggcgaggaagaagcactgttaacagcggcccgctatctgaataagaagatggaggagatcaaggctggcggtaaaattatcggggtagaacgggtagctgtgatgagtgctttgaacattgcccatgagttgctgcgagaacagagtaagaaggagggagagcgggagctaaataagcgaatccaaacgcttcggcataaggttgaagcagtgttggaagaatgccgtcaagtggatccgtaa

SEQ ID NO: 2530 - DNA, 294 bp, Saccharophagus degradans 2-40
gtgacggatagcaatcgagtttacgtaaacatactggataaggattaccagattgcctgccccgccgaagagcgagatgcactgcaccgcgctgcagaggagctggacgaacgcatgcgcgccattcgcaatacaggcagtattattggcttagaacgcatcgcggtgatggcagctttaaacctgtgccacgaactgcaacaacagcgcaaaaatacagctaagccgaatgatgccgaatctatttcgcgcatgatgcaaaaaatagataaagtactcacttcgcacgaatag

SEQ ID NO: 2531 - DNA, 285 bp, Alkalilimnicola ehrlichei MLHE-1
atgaccgaacccgtcaagatccagatcctggacaaggaatacatgattgcctgccccgaggacgagaaacaggggctgttgcagtccgccgattacctgcatcggaagatgaaggagatccgggatcgcggcaaggtgctgggcaccgaccggatcgcggtgatggccgcgctcaacatcacctacgaacttctggaggcgcgccaggagaacgccagcatggaggacgtgcggcgccggctgcgggcgttggatgcgcgcatcgccgaggccaccggtgagtag

SEQ ID NO: 2532 - DNA, 315 bp, Pseudomonas aeruginosa UCBPP-PA14
atgagccagtcgaataccctcaccgtgcagattctcgacaaggaatactgcatcaattgcccggacgacgagcgcgccaacctggaaagcgccgcccgttacctggacggcaagatgcgcgagatccgctccagcggcaaagtcatcggcgccgaccgggttgccgtgatggccgccctcaacatcacccacgacctgctgcaccgcaaggagcgcctggaccaggaaagcagctcgacccgcgagcgcgtgcgcgaactgctcgatcgcgtcgaccgcgccctggcgaatccggccgatgccggcgaagcctga

SEQ ID NO: 2533 - DNA, 291 bp, Halorhodospira halophila SL1
atgaccgaagcggtcaaggtacgcatcctggatcaggactttaccgtcgcgtgtcctgaggacgccaagaacgagttgctgcaatctgccgattatgtggatcgcaagatgcgcgagatccgcaagagcggcaacgtggtcggcacggaccgggtggcggtggtggcggcgctgaacatcgcctacgaactgctcagcgtgcaggccgagaacgagcagttggcggacgtgcgccagcgcctggcccggctcgacgcccgcatctccgaggcggtcgacggcagctcctga

SEQ ID NO: 2534 - DNA, 297 bp, Marinobacter aquaeolei VT8
atgtcacagaccccaaccaccgtggaagtgaggattctcgacaaggaatacctggtggcctgtccgcaggaagagcaggaagccctgctacgtgcggcccggcatctggacaccaaaatgcgtgaaatccgctccagcggcaaggtattcggtaccgagcgcattgccgtgatggccgccctgaacatcacccatgaactgctggaacgcgacaccatgtcggacgccaccagcagcatcctgcgtgccatggataaccggcttgatgaagcgctgggagagccttcgggcaactga

SEQ ID NO: 2535 - DNA, 306 bp, Pseudomonas mendocina ymp
atgacccagtcgaacaccgtgaccgtccacatcctggacaaagaatattgcatcgcctgcccgcaggacgaacgcgccaatctggagagcgccgcccgctacctggacggcaagatgcgcgagatccgcaccagcggcaaggtgatcggcgccgatcgcgtggccgtgatggccgcgctgaacatcacccatgacctgctgcacaagcagcagcgcctggaccaggacgccagctccacccgccagcaggtacgcgatctgctcgaccgcgtcgaccaggccctggccgacgatcaggcctcctga

SEQ ID NO: 2536 - DNA, 321 bp, Pseudomonas putida F1
atgagttcaagcaatagcgtcaccgtgcagatcctcgacaaggaatactcgatcatctgcccgccggaagagcgcaacaacctggtcagcgctgcgcgctacctggacggcaagatgcgcgagatccgcagcagcggcaaggtgatcggtgccgaccgcatcgcggtgatggcggcgttgaacattacccacgaaatgctgcaccgccaggaagaccgcaacgatgcgccggtcagcggcacaaaccgcgaacaggtgcgcgacctgctggatcgggtagataaggctttgtccgacgacacggataccaaaatcggctga

SEQ ID NO: 2537 - DNA, 315 bp, Pseudomonas aeruginosa PA7
atgagccagtcgaataccctcaccgtgcagattctcgacaaggaatactgcatcaattgccccgacgacgagcgcgccaacctggaaagcgccgcccgctacctggacggcaagatgcgcgagatccgctccagcggcaaggtcatcggcgccgaccgggtcgccgtgatggccgccctcaacatcacccacgacctgctgcaccgcaaggagcgcctggaccaggaaagcagctcgacccgcgagcgcgtgcgcgagctgctcgatcgcgtcgaccgcgccctggcgaatccgtcggatgccagtgaagcctga

SEQ ID NO: 2538 - DNA, 324 bp, Coxiella burnetii RSA 331
atgagcgacaacaacagcgagcagagtcttatttccgtaaaaatccttgatcgcagctatcacattaaatgcccccccgaccaaacccaagcacttcaagaagcagccgcctatgtggaagaagaaatgcggaaaatacgccaaacagcgaatatcaatagcatggaacgcatcgcggtggtcaccgctctgaacatttgccatgaactcatgcagttgcgcaaacaaaaaaataattacatcgatgtcatgaatcaacgcattcaagatttgcaacggcgaattgaaaatttcctggaaacaaatgctgaaattgaagtataa

SEQ ID NO: 2539 - DNA, 321 bp, Pseudomonas putida GB 1
atgagttcaagcaatagcgtcaccgtgcagatcctcgacaaggagtactcgatcatctgcccgccggaagagcgcaacaacctggtcagcgccgcgcgctacctggacggcaagatgcgcgagatccgcagcagcggcaaggtgatcggtgccgaccgcatcgcggtaatggcggcgttgaacattacccacgaaatgctgcaccgccaggaagatcgcaacgacgcgccggtcaccggcaccaaccgcgaacaggtgcgcgacctgctggatcgggtagacaaggctttgtccgacgacacggataccaaaatcggctga

SEQ ID NO: 2540 - DNA, 321 bp, Pseudomonas putida W619
atgagttcaagcaatagcgtcaccgtgcagatcctggacaaggaatactcgatcatctgcccgccggaagaacgcaacaacctggtcagcgccgcacgctacctggacggcaagatgcgcgagatccgcagcagcggcaaggtgatcggtgccgaccggatcgcggtcatggccgcattgaacatcacccacgagatgctccaccgccaggaagaccgcaccgacgcccccgctggcagtgccacccgcgagcaggtccgcgacctgctcgatcgcgtcgacaaggctttgtccgacgacacggataccaaaatcggctga

SEQ ID NO: 2541 - DNA, 300 bp, Xylella fastidiosa M12
atgagcgatactgaaccggtcagcatccgcatcctcgaccgtgaatataccgtcggagttggcatcgaagaacgcaagggcttaatctctgccgcacaactgctcgacgcacacatgcgtgagatccgcagcagcaaccgcatggcatccatagatcgcatcgcagtacttgcagcactcaacttagctcacgagctgcaacaactacatgaaaaacacgcggatagagagcgtgcattgctgacaacactggatacactgcaacagcgcctgaagaatgcgatggatacatcccattga

SEQ ID NO: 2542 - DNA, 300 bp, Xylella fastidiosa M23
gtgagcgatactgaaccggtcagcatacgcatcctcgaccgtgaatataccgtcggagttggcatcgaagaacgcaagggcttaatctctgcagcacaactgctcgacgcacacatgcgtgagatccgcagcagcaaccgcatggcatccatagatcgcatcgcagtacttgcagcactcaacttagctcacgagctgcaacaactacatgaaaaacacgcggatagagagcgtgtattgctgacagcactggatacactgcaacagcgcctgaagaatgcgatggatacatcccattga

SEQ ID NO: 2543 - DNA, 300 bp, Xanthomonas oryzae PXO99A
gtgagcaacaacgaaccggtcagcgtgcgtattctggatcgtgaatacacggtgggcgtgactgcggacgaacgcgagagtcttacagccgccgcgcggctgctggatctgcgtatgcgcgagatccgcggcagcaatcgcatggcggcagtggatcgtgtcgccgtgctggctgcgctcaatctggcgcacgagttgcagcaactgcgcgaacagcaggcgcgctacgatcgtgaattggcaaatacgctggaccacttgaatcgccggctcgacagcgttgccgacacaccgcgctaa

SEQ ID NO: 2544 - DNA, 297 bp, Stenotrophomonas maltophilia R551 3
atgagcgccgaaccggtcagtgtccgcatcctcgatcgtgaatacaccgtgggtgtcggcggcgatgaacgcgacagcctgatggccgccgcgcgcctgctcgatgcacgcatgcgcgagatccgaggcagcaaccgcatggccgcggtggaccgcattgcggtgctggccgcgttgaacctggcccacgaactgcagctgctgcgcgacgaaaacgcccgccaggcggtggcgctgcagcagacgctggccgacctgaaccggcgtctggaccgcgcgatcgacggcaccccatag

SEQ ID NO: 2545 - DNA, 315 bp, Thioalkalivibrio HL EbGR7
gtgagcaatcccgctgagccggttgcggttcagatcctgggcaaggaatacaaggttgcctgtccccaggatgaacgcagtgccctgatcgcctccgccagcctgctggaccggcgcatgcaggagatccgcgacagcggacgcatcatcgggggcgaccggatcgccgtgatggcggccctgaacatcacccacgagatgctggtgacccgcaatcagcgggagagcctgagtcagaacctgagcgcgaggattcgcgccctgcaagacaagatcgaccacgccctggaaaacgggcaacagatggacctgtaa

SEQ ID NO: 2546 - DNA, 315 bp, Azotobacter vinelandii DJ
atgagccagtcgcacaccatcaccgtccacattctcgacaaggattactgcatcgcctgcccaccggaagaacgggccaacctggaaagcgccgcccgttacctggatgggaaaatgcgggaaatccgctcgagcggaaaggtcatcggtgccgagcgcatcgcggtgatggccgccctcaacatcacccacgacctgctgcacaagcaggagcgcctggacctgcaggccagctcgacccgcgagcaggtgcgtaccctgctcgagcgtgtcgaccgcgcgctgaccaacaatccggatgagctgacgacctga

SEQ ID NO: 2547 - DNA, 582 bp, Shewanella oneidensis
atgcaagtgtcaagtactcgtaagtcaaaggtcaatttactgccgcaggaaatccgcgatcaactgcatgcgttgctgcgcagtggcaccatgcatcaaaaggatatcctcgaagccgttaatcaaatgattgacgaagctggccttggtgaagatgccaaacttagccgcaccggctttaatcgctttgcgaaaaagtttgagcaagtgggcgaacgtattcgccaaagccgtgaagtggccgaggtctggaccgccaagttaggccaagcgccgacatctgatgtgggcaagctgctgcaagagttcgtgcgcaccatggcctttgaaacatcgatgaagatgatggacgccgcagaccaagaggatgccgaacccatatcacccaaagcccttgggcaactggcgctggtcgtgcaacggattgaagccgcagccatgtcgagtattaaggttgaaaaagaaatccgcagtgcctttgcagccgaggccgcaactaaggttgagcagattgtaaaacaggcggggatctcagctgaaaccgctattgatattaaaaaccaaatcttggggattgcgtaa

SEQ ID NO: 2548 - DNA, 564 bp, Methylococcus capsulatus Bath
atgccgccccgttcgtcggtctatcagctgccgccggaggtccaggaggagctcaatacccgcctggtcggctccggcttcggcggctaccgggacctatcggcctggctgaaggatcagggctaccacatcagcaagagcgccctgcacagctacggccaggagttcgagctggagttcaagtcctccatggaggcggcgttcacggtcgagaagctctcgaaggcgttggtcgcccagcgtgacgatagcgaagcggcgatgctggaagccgccgccatggtcgggcaggaaatcctgctcaagctcatgatcgccctgcgtcaggcggaaagcgatcccaccaaggcggccaagactatttcgctggccacccgttcattggcggatctgggccggatgaccctggaccagaaaaagtggcaggaccagctgcgcaaacagctccaggaagaagccggcgccaagctggatcggctcgaagccggtgccagagccggcaagggcaagcttgatgccgagacccttcggatcgtccggcaggaggtctacggactggcatga

SEQ ID NO: 2549 - DNA, 558 bp, Methylobacillus flagellatus KT
atggctaaacgctccgaagtgcaagggttgccagccgaggtccggaaatggctggaccagacgctggccgagaacaattttagcggttacatggagattgcggccgcgctgaaagagcgtggctatgccattagtaaaagctcagtgcatcgctatggccagaagctggagaaccgcctggccgcgatcaaggccagcacagaagccgctgaagccatcgtgaatgcatctcctgatgaaggtgatgctcgatctgaagccatcatggcactggttcaaaccgagatgtttgacgccatcctcaatctgcaggaagccgttgagtctgagccggaaaagcgcatgaagatactggcatccgctgccaagtccatcgcgctggcatcccgcgccagcgtaaaccaaaagaaatgggcagtcgaggtacgcgcaaaaatagcagccaaactcaatgcagccagtaatgaagctgagtctattgccaaggatgctggtatgtcagacgacacctgggcagcgatacgagccaagttcctcggtatcaaggttgaggtctag

SEQ ID NO: 2550 - DNA, 540 bp, Rhodobacter sphaeroides ATCC 17025
atgccgccgccccgcaagatcgacctcctgcccgtggaactgcgggcctggctccaggaggagctgcgcgcccgcggcttcggccagtacgaggagttggccgaagcgctgaacttccgcctggaggaggcggggctcgacctgcggatccgcaagtccgcgctccatgacttcggctccgagtacaaggagttcgtgaagctccaggagcaggcgtcggactgggcgaaggaatggctcggcgacatggggatggaggaccaggcgcagcgccagaacgtcctcttccagatgctgaccacgctggccttcaaggtcatgcaggccgaggtgacgaaggagggcgtcgagatcagcccgcagaacctgcacttcctcgcccgcatgatgaaggacgtcatgagctcgtccggcatcgtccaggcgatgcaggagaaggagaagaaggcgcaggtggccaagctcgatgctgcggtcacctcgggcgatatcgatgccgaggcggccgagaaggcccgccgcattctggggttcgcgtga

SEQ ID NO: 2551 - DNA, 582 bp, Vibrio cholerae O395
atgcaagttgccagtaaccgcaaaagcaaagttgaactgctgccggaagatatccgcaatacgctgaatgtctttatccgcagcggcaacatgacgcaaaaagacattctagaagcggtcaatcaaatgattgatgacgcaggcttgggagatgatgccaagctaagccgcacagggtttaaccgctatgccaagcgcatggaagatatgggccaacgcttgcgccagtctcgtgaagtcgcggaagtgtgggtttctaagcttggtgaagcaccaaccagtgatgtcggtaagctgctgcaagagttcgtgcgcactatggcgtttgatacctccatgaaaatgatggagcaatctgatggtgaagatggcgaagtgatctcacccaaggcgctcggccagttagccttggtggtgcagcgcatcgaaaccgccgccatgaccagtatgaagcgcgagaaagagattcgcgccgcgttcgctgctgaagccgcagaggccgctgagaagattgttaagcaagcgggcatttcggcggataccgccaccgatatcaaaaaccaaatcttggggatcgcgtaa

SEQ ID NO: 2552 - DNA, 570 bp, Shewanella baltica OS185
atggcaagtgaaacccgaggtcgccgctctaaagtggatttactgccagatcctatccgcaaaaagctcgatgcggggctgcgtaatggctcgattcagcagattgatttgctcgatgaaatcaatgcgctgattaaagccgcaggcttgcctgaggaaaaccagctttcccgcgcgggcattaaccgctatgccaccaagatggaggccgtgggtaaatccctacgtgaaatgcgtgagatcacccaagtgtggacggcagagctgggtgacaagcccacgggtgaagtgactaaactcatcctcgaaatggcgcgttcgcagctgtttaaagccctgttaaaccaagatgaaacgggcgaaggtgccgacgttggcatgattaaagatgccatgttagcagtgcagcgtttggagtctgctgccatggccagccataagcgcgagaaagagatccgcactgcgttcgcggccgaagcggctaatgccgccgagaaggtcgcgaaaaccgcaggcttaaccagtgatgccgtggccttgcttaaacgtgaaatcttggggattgcatga

SEQ ID NO: 2553 - DNA, 582 bp, Xanthobacter autotrophicus Py2
atgggcaaacggtcctcggtcgacgtgctcccccaggaggtcaaggactggctcatgcgcctgcgggagcagggcgcgacctatgaccagatcgtcgccaagctgcgcgagatggacagcctcgcggtgccgatcccctcgcgctcggccctgcaccgccacatgcaggaggcggagcgcacgaaggagatggtggaccggcagcgcgtcgtcgccgaggccatggtcaaggaactgggcgaggtcgacgacagccgcgtcacccgcggcaacatcgccatgctgcacgccatcctcacccgcgtgcagcagacggcgctggacgcgatgatgaccggcgacggcaacatcgacatgtcggccggcgaggtgatgcagctcgccaaggccctagatcatctgggcaaggccgcgaaagacgacgtggcccgcaccgccgcgatccgaaagctcgccaaagaggaagtgctcaagaccgccgaggcggccgttggtgcagcggaggccggcggccatgccatgagcggcgaagagctgctgcggaaaatccgcgaggacatctatgggatctacgagaaatga

SEQ ID NO: 2554 - DNA, 570 bp, Shewanella baltica OS195
atggcgagtgaaacccgaggccgacgctctaaggtggatttactgcctgatcctatccgcaagaagctcgatgcggggctgcgtaatggctcgattcagcagattgatttgctcgatgaaatcaatgcgctgattaaagccgcagggctaccagaagaacagcagctttcccgcgcaggtattaaccgctatgccaccaagatggaggccgtgggtaaatccctgcgtgaaatgcgtgagatcacccaagtgtggacggcagagctaggcgataaaccgacgggtgaagtgaccaaactcatcctcgaaatggcgcgttcgcagctgtttaaagccctattaaaccaagatgaaacgggcgaaggtgccgacgtgggcatgattaaagatgccatgttagcggtgcaacgtttggagtctgccgccatggccagccataaacgtgagaaagagatccgcaccgcgttcgcggccgaagcggctaatgccgccgagaaggttgcgaaaaccgctggcttaaccagtgatgccgttgccttgcttaagcgtgaaatactggggattgcctga

SEQ ID NO: 2555 - DNA, 573 bp, Leptothrix cholodnii SP 6
atgccccccgtcggcaagatcgcccagctgcccgaagagatccgcgcctggctgcacgccacgctggtgaagcgctcgtttggcgacatccacggcgtgaccgaccagctgcaggcgatgctgcaggaagccggcattgcgatgtacatcggcaagagcgccgtgggtgccgagtcgctcaagatcaagcgggcccaggagagcatcaaggcgtcgaccgaggcggccaagctgatcgccgagagcagccgcgacgatggcgacgcacgcggcgaggcgctgatggccctgatcagcagcgacatgttcgactgcctgatgaaggcccgcgaagccgagagcgaagaagacccgatcgcccggctcgggatgatgggcgaagccgccaaggccgccacccgcctgaccgaagccagcgtgaagcaacgccgctggcgccgtgaggtcgagaccaaggccaaggaggccgccgacgcggtggccaagatcgccaagaccggcgggctgcaggccgcgcaggtgaaggagatccgggagcagatcctggggatcacgaagagggtgacggcgtga

SEQ ID NO: 2556 - DNA, 579 bp, Rhodopseudomonas palustris TIE 1
atggcgaaccggccttcgtcgatcgaccggctgccgcaggaggtgcgcgattggatcgggcgcctgcgcgatcagggctgcacgatcgacgagatcatcaccaagctgcgcgagctggacaaggacgcggtgccgtccaggtcggcgctcggccggcatctgaagaaggccgaggaagtcgccgagcgcctccgcaagtcgcgggcggtggcggacgtgatcgtgcgccggctcggcgaaagcgatccggacaagaccacccggatgaacatcgaactgatgcacaacatcctgttcgagctggcgacccagaccgagggcgaagacggcgagcccgtcaccttcgaccctatgcaggtgatgctgctggcgaaggcgctggatcatctcggcaaggccagcaaggacgacgtcgcccgcaccgtcgcgatcgagaagcgagcggccgagaaggcgaaagccgaggcgttgaggcagaccgagaaagcgattgcaggggccgccggcactgacggtcaggtcgacggcgccgcgctgctcaagaaaatccgcgaggatatctacgggatcaccacatga

SEQ ID NO: 2557 - DNA, 621 bp, Rhodopseudomonas palustris TIE 1
atgaaggcggcgcggcacaaacgcgggcggttgtcggaaatcgacaagctgccggaatgggccgacgaagccaagctgtgggcgttcgagcaactcaaggagcgcaagctcactcagctggagatcctcgacggcttcaatggccggctgaaggtggcggccttcgaacagggcatcaccgatccgccggtgatctcgcgctcggcgttcaaccgcaccgcgatccgcatcgctatcctgtcgcgccgcctcgaagagacccgcgagatcgccgcggtgatcgccccgaagctggacgaggccggcgacaattcgctgaccctgatggtggccgaaacgctgaagacgctgatcagcgaaatgctcggcaacgccggcgagctgaccgccgacggcgccaccgccgaaatgctgatgatgacggcgcgagcactcgccgccgccgaacaggccaagcgcatcagcgccgacggccgccgcaagatcgaggccgagttgaacgccaaggcatcgaaggccgtcgaccaggtcgccaaggccaagggtctcaccaccgaaaccgtcgacgccatcaaggcgaagatcctgggcatcgacaccagcaagggagcgaagccgtga

SEQ ID NO: 2558 - DNA, 552 bp, Thioalkalivibrio HL EbGR7
atgccgaaacgctccaaggtcttcgaactgccccaggacgtgcgcgaggagctgaacgagaagctggtggccacgggcttccagggctacgaggcgctggcggggtggctcgccgagcgcggcttccaggtgtcgcgctccagcgtgcagcgctacggctcggagctgcaggccgagttcgaggcggcgatgggcgacgtgcgcaagaccaccgagatggccaaggcgttcaccgagggcgacgacgacgccaagggctcgctggtggacgccacggcgcggatcgtgcaggagcagctgctgcgcatcaccatcgcgctgcgcaaggccgagcacgagccggagaaggccgccaagtacatggccagcgtgacccacgccctggccgacatcggccgcatgagcctgggccagaagaagtgggcccgcgaggtgcgccgcgaggtggcccaggaggccgccgacaaggcggccgaggtggccaagcgcggcggactctccgccgaggtagtcaacgacctgcgccgcgagctgctggggatcgccaaatga

SEQ ID NO: 2559 - DNA, 585 bp, Agrobacterium vitis S4
atggcgaagggacgcggccgactgagttcgctccaactgctgccgagggaatgcagccatgtggtccaatgggcggcagagcagcttcaggataccaccacctctcaggtggatatctaccaggaatttgtcactaggcttgaacaggtgcagagggaatcccgtggcgaactcgaattcaagatccccagcctcagctctttcaacagatactcggtgaacctggacgaactgacgcgtcagatcaacgaagcgagagaaatggcatcggccgttgcttcaacctttgatgccgggaaaagcgacgatctaacgcttgtcgcgacagaagccatcaagggtctcgttttggcctgtgcccgaaccaaaaaaggaacaatcgatccgaaaggcatcgccgcgcttgctgctgccgttcacaaagcggcccaggcccaatcggtttcgtcggaccggcgcaggaaagtcgaggcacattttgcagagaaggcaaaggaagccgtggcgaccgtcaccaaatccaagggcctttccgctgaagctgctgatgaaatcctcgcgaaaattcttggtgtcgagaaatga

SEQ ID NO: 2560 - DNA, 1434 bp, Brucella suis 1330
atgcccgtgtctttatcgcaaacgcgacttctggctgattttcctgctttcttccgggtttcgggcgaagtggtggcggtcgtgggtggtggcgaggaagccttgaacaaggctcgcctcgtggcgcagacggctgcgcgcctgcgcatcattgctgaaaaggctgagccgcatcttgccgcttttattgaaagccatggggtggagcatattgcgtcaccctttgcgccggaactgctggatggtgcgaagctcgtttttgtcgcgaccggcgatgaggccggggatcgtgccgccgctgccgccgcaagggcccgcaaaattccggtcaatgtggtggaccgtcctgccctttgcgattttctgacacctgccatcgtcaatcgtgcgccggtcacgatcgccatcggttcgcagggaaccgccccggttttggcgcagatggtgcgtgcgcgtatcgatgcagccttttcgccgcgtcttggcgagcttgcgcattttgcggaaagctggcgccctctggtcgagcgggcgcttccaaaagggcttgcgcggcgtggtttctggcgcacattcttttcgggaaaagtggcccgcgcggtggagagtggcgaccacgaggcggcgcacagggctgcggcggaactgatcgggcaggggcaggacgcttccggccatgtctggctggttggggccggtcccggtgctgaagaccttttgacgctgcgcgcccagcgcgtgctgatggaagccgatgtgatcgttcatgatgcgctggtgccggaaggcgtcatcgccatgggacgccgcgacgccgagcgcctgccggtcggcaagcgcaagggttgccattccaaaagccaggatgagatcaaccgcctgctggtgaagctggggcaggagggcaagcgcgtggtgcgcctgaaatccggcgatccgctggtctttggccgtgcgggtgaggaaatggccgccttgcgcgccgccggaataggctttgaggtggtgccgggcatcacctctgcctttgccgctgccgccgatatggaactgccgctgaccttgcgcggcgtcgcgtcctcgctcgtcttcaccacgggccatgacatgaccggcgatgtgctgcccggctgggcgaagcttgccgtctccggcgctacgattgccgtctatatgggctccacggttgccgcttccgttgcctcgcgtctgattgccgccggcctgcatgaggatacggcggttgcagtggtggaaaatgcaagccgcagcaacaagcgcatgttccatggcacgctgaaggatttgccgcagcttgaaaaccgcaaggagctttccggcccggtcatggtggtcattggcgatgccgtcgccggtgccgccatcggcagggcgcaggccctttccctgaaacctgttcccgtcgcagcctga

SEQ ID NO: 2561 - DNA, 1437 bp, Rhodopseudomonas palustris HaA2
atgcgttttcttccggtctttctcgatctcgcggcagggccggttgtgctggtgggcgccggcgagatggcgcgtgccaagctgcggctgctgctgtcggcgggcgccgcgatccgctggcatgtcaccgacggcgacaatgatctcgccggtatcagcgaggccgaccgcgcgcgcatcacgttggcgacgggggaacccgccgaggccgatctgtccggcgcgatcgcgctgatgtgcgccggcgccggcgatctcgcggccctgctggcggcgagggcccgtgcgctcggcgtgccggtcaatgtgatggatgagctgtcgcactccacgttcatctttccggcgatcgtcgatcgcggcgatgtggtggtcgcgatcggcaccggcggctcgtcgcctgtcgtcgcgcgccgcgtgcgcgagatgatcgagacattgctgccggcgcggatcggcgatctcgccgcgctgatcgggcgttggcgcaaaccgatcaaggcgcggattgcggaatttccgctgcgccgccggttctgggagcgcgtcgtcgacggcccgatcggcaaggcggtgctcgaagggcgcggcgccgaggccgaggatctgctcgaggcaatcaccgatccctcggcctatgcacgcgattctgtttcagcgcataccgaaggccacgtcaccctggtcggcgccggccccggcgatcctgatctcttgaccatcaaggcgctgcgcgcgctgcaggacgccgacgtggtgttctacgacgaactggtgtcgcccgaaattctcgaccggatccgccgcgatgccgcccgcgtgccggtcggccgccgcatcggcaagcccgggatcggccaggaggcgatcaacgcgctgctgatcgaagcggcgcaagccggccagcgcgcggtgcggctgaagggcggcgatccgttcgtgttcggccgcggcggtgaagaaatcgaggcgttgcgcgacgccggcgtgtcctatgcggtggtgccgggcatcagcgcgggcttcggtgcggcggcgcaattcgaggtgccgctgacctatcgccacgaggcgctgcgcatcacattcctcaccgcgcacaaggccaaggatgccgaggccgtcgactggacggcgctcaccgaccagaagatgacggtggtggtgtacatgggcatggccgcggcgccgacggtgcgcgcgggcctgctgacggccggccgttcgccgcagacgccggtcggcgtgttcgcccgggtaacgcggccggacgccaaggccgcggtgggcacgctcgacgatctgccggcactggtcgagcaggtcgaggtcggtccggcgatcctggtgatcggcgatgtcgtcgcgcattcggcaccgtggcgccggcaacaactccagcaactcgtgtcgacctatcaggtagccgccgaatga

SEQ ID NO: 2562 - DNA, 771 bp, Novosphingobium aromaticivorans DSM 12444
atgagcaattcttcttcgagaatcgggacagtccatctcgtgggcgcgggtccgggcgatgccgacctcctcacgctgcgcgcggcgcggctggtgatgaatgcccgcgtgctggtgcacgacgggctggtggatccttcgatcctggcgatggcgcccaagggttgccggatgatctccgtcgccaagagccggtcgcgccacaccatgaagcagggcgagatcaacgccctgctggtgcgcgaggcgctggcgggcaacgacgtggtacgtctcaagggcggcgatccgttcgtgttcgggcgcggcggagaggaagcggaagactgccttgcggcgggcgttccggttcaggtcgtgcccggagtgagcgccgcaatgggcgcggcggcagcggcgatgatccctctcacccaccgcgagagcgcgagcatcgtgagcttcgtcgcgggccagtgcaagggcctgaccgaccagaactgggccggccttgcaggggttggcaggacgctggtgatctatatgggcgtcgccacttcggaagcgattgccgaaaagctgatggcggacgggctggcgcccgagatgccggtggccgtggtggaaaatgccgcacggccgcagatgcgcgtgctgcgcgggacgctggcgggcctcgggtgcctggtggcggacaacaaggtcaggagccctgccctcatcgtgatcggtgaagtggcaggccggggagacatgatggaattgagacaagttttggaggccgcgcgatga

SEQ ID NO: 2563 - DNA, 1500 bp, Rhodospirillum rubrum ATCC 11170
atggacagcttcccgatttttctgacccttaccggggtccgcgttcttgtcgtcggcggcggcgccgccgcggccgccaaggcgcgtctggcgctcaaggccggcgccagggtcagcgttttcgcgcccgccttatcggccgattggcaagatctgcgcggccatcccgcccttgatcaccgccagggctttcccggccagggcggcgaggaggagtggcgcgacgtgcggttggtctatgccgccggcgaaagcctggaagaggacagggccgttcatgccgccgccagcgcccggggggtgctggtcaatgtcgtcgatcgccccgaattatgcgatttcctgacgccggccatcgtcgatcgcagcccgatcgtcgtggccatcggaactggggggcgggcgccggtgctggcgcgccgggtgcgcgccgccatcgaccgcttgctgcccgcccggctgggagccctcgcccggctggccgagggctttcgcggcacggtcgcccaagccctgcccgatggcgaccggcgccggcgcttctgggaccgcttcttcgacggcgccccggccctggccgccctggaaggcgacgagccgcgcgcccgaaccgccgccctgcgcctgctcaatgacggcgaggccctggacaacggcgcgccggccgccggggtcgttcatctggtcggcgccggaccgggagaccccgatcttctgaccctgaaggcccagcgcctgctccaggaggccgatgccctggtttatgacgatctggtgggcgaggggatcttggatatggcccggcgcgacgccgcgcggatctacgtcggcaagcgcaagggccgggcgagcctgacccaggagcagattggccggttgatgtgcgatctggccgcagcggggcgggtggtggtgcgcctgaaaggcggcgacccggcggttttcgcccgcctgtccgaggaaatcgacgccctggccgccgccggggtggcctggacggtggtgccggggatcaccgcggcttcggccgccgccgccgccatcggcatctcgctgaccgatcgtgacggggcgcccagcgtcaccttgctgtcgggccatcggcgcgctccggcggccggcgagagcgaggccgccgtcgattggcgggcggcggcgcggaccggtggcaccctggcggtctatatgggcctgtcacgggccacggcggcggccgaggggctgatcgaaggcgggctgtcggccgagaccccggtggccgtggttcatgacgccagccgccagggccagcgcgtttcgcgcggaaccctgggcgagctgccccggctggtcgcccaaggggccttggccgcgcccgatgccccggggctggtgctggtcggcaaggtcgtcgccaaggccggccgcctgccggcgatcgccccggttttttccaccccgcgcgccttcgccggcgatccgtccttcgcctcccaagccctgccgtcccaggcgggctga

SEQ ID NO: 2564 - DNA, 1443 bp, Mesorhizobium BNC1
atggctggcgaaacggcaaagctgaacgcatttcccgttttcttacgggtggaaggacgacgcgtcgtcatcgtcggttccggcggcgaggctttggctaaggcgcggctgatggcgcagtcaagcgctgaaatcctgattgtcgccgaaaagccggagccagcgcttgcagcctgggctgcggagaacggcgcggctcttacccgctcctcatacaaccccgcccttctcgacggtgccgtccttgtcttcgccgccacgggcgatgaagaggccgatcgcgccgtggtggccgatgcgcgggaacggtccatcccggtcaatgccgtggatcggccggaactttgcgatttcttcaccccggccctggtcaaccgtgcgcctgtggctgtcgctatcggcacggaaggtgcaggcccggtgctggcgcagatgatccgcgcccgcatcgatcagatgctttcgccctcgctcgggcggcttgctcttcttgccgcttcctaccgcgcggcggttgagcaccgccttgccaagggcgtcgtgcgccgtcgcttctggaaagctttctttaccggcggtccggcatgcgccgtggaggcaggcaatgcggatcgcgccgcgtgggcagcagaaatgctgctggattcacagggcgttgagcccggccacgtggcgctggtgggtgccggcccaggcgcggaggatctgctcacgctgcgcgcccagcgccttttgatggaagccgatgtgatcgtgcatgacgcgctggtgcccgaggcggtcgtcgccatggggcggcgcgatgcggagcgcatcgcggcaggaaagcgcaagggttgccactccaagacccaggccgagatcaacgagctccttgtcgcgcttgggcgtaatggcaagcgtgtcgtgcggctgaaatcgggcgatccgctcatcttcggccgtgcgggtgaggagatagccgcgctgcgtgaggccggcatttcctatgaagtcgtaccgggcgttactgccgctttcgccgccgccgccgatttcgagctgccgctgacgctgcgtggcatagcctcgtcgctcgtcttcacaaccggccacgatctgaaagggcaggcgctgccggattgggccaagctcgccatcgatggcgcgacggtcgctgtctatatgggtcgctcgaccgctgccgaggtagcgcagcatctgcaggaagctggcctgtcgccggataccgcggtggctgtggttgagaacgccagcctcggaaaccggcgcctctttcacggcacgctttccgatttgccggcgcttggaaggcgcgctgatctttccggcccggtgctcacgatcataggtgatgccgtcgctggcgcgaatctggcgcgctcggaaccgctcgctgcttaccacgagcacggcgcacgcactccggcagaagaggaatga

SEQ ID NO: 2565 - DNA, 1437 bp, Brucella ovis
atgatgcccgtgtctttatcgcaaacgcgacttctggctgattttcctgctttcttccgggtttcgggcgaagtggtggcggtcgtgggtggtggcgaggaagccttgaacaaggctcgcctcgtggcgcagacggctgcgcgcctgcgcatcattgctgaaaaggctgagccgcatcttgccgcttttattgaaagccatggggtggagcatattgcgtcaccctttgcgccggaactgctggatggtgcgaagctcgtttttgtcgcgaccggcgatgaggccagggatcgtgccgccgctgccaccgcaagggcccgcaaaattccggtcaatgtggtggaccgtcccgccctttgcgattttctgacacctgccatcgtcaatcgtgcgccggtcacgatcgccatcggttcgcagggaaccgccccggttttggcgcagatggtgcgtgcgcgtatcgatgcagccttttcgccgcgtcttggcgagcttgcgcattttgcggaaagctggcgccctctggtcgagcgggcgcttccaaaagggcttgcgcggcgtggtttctggcgcacattcttttcgggaaaagtggcccgcgcggtggagagtggcgaccacgaggcggcgcacagggctgcggcggaactgatcgggcaggggcaggacgcttccggccatgtctggctggttggggccggtcccggtgctgaagaccttttgacgctgcgcgcccagcgcgtgctgatggaagccgatgtgatcgttcatgatgcgctggtgccggaaggcgtcatcgccatgggacgccgcgacgccgagcgcctgccggtcggcaagcgcaagggttgccattccaaaagccagggtgagatcaaccgcctgctggtgaagctggggcaggagggcaagcgcgtggtgcgcctgaaatccggcgatccgctggtctttggccgtgcgggtgaggaaatggccgccttgcgcgccgccggaataggctttgaggtggtgccgggcatcacctctgcctttgccgctgccgccgatatggaactgccgctgaccttgcgcggcgtcgcgtcctcgctcgtcttcaccacgggccatgacatgaccggcgatgtgctgcccggctgggcgaagcttgccgtctccggcgctacgattgccgtctatatgggctccacggttgccgcttccgttgcctcgcgtctgattgccgccggcctgcatgaggatacggcggttgcagtggtggaaaatgcaagccgcagcaacaagcgcatgttccatggcacgctgaaggatttgccgcagcttgaaaaccgcaaggagctttccggcccggtcatggtggtcattggcgatgccgtcgccggtgccgccatcggcagggcgcaggccctttccctgaaacctgttcccgtcgcagcctga

SEQ ID NO: 2566 - DNA, 1455 bp, Sinorhizobium medicae WSM419
atgccgcagaaactatccgtctttccggccttctttcgcgtcgcgcagaaaagcgtggcggtgttcggcaatggggacgaggccttcgccaaggtgcggctgctgctgagtaccgaggcgcgcatcgtcgcctatgcggatcagcccgaggcggctttcgaagcgttcctgaatgccaacggtatcgataccatccgcaagccttttgatgctcgccaggtcgagggcgccgttctcgtcttcgcggcaacgggcgatgcggctttcgacaggatcatcgtggccgcggcgcgggaacggaaaatccccgcaaatgccgtcgaccagccggactactgcgattttctgacgcccgcactcgtcaaccgcgcgcctgtggccgttgcgatcggcacggaaggggcggggccggttctggcgcagatgattcgcgcgcagatcgatcagttgctctcgccgtcgctgggcatcgttgcttcattggcggcaagctatcgcgacgccgtcgatcgcctcgttccgcgcggtgtcgcacgccgagtcttctggcggcgcttcttctccggtccggtggccgatcacgtcgcacttggcgatcttgcatccgcacgccgcgaggcctcgaagcttctggatgcggccggtggcgtacgcggtcatgtctggctcgtcggcgccggtcccggtgcggaagacctactgacgctcagagcccagcgcgttatgatggaagcggacgcgatcgtctatgatgcgctggtgccgcaggcgatcgtcgacatgggccgccgcgacgccgagcggctgtcggtcggcaagcgcaagggctgccacaccaagtcgcaggatgagatcaatcatttgctggtgaggctcgccggcgagggcaagcgtgtcgttcggctgaaatcgggggatcctctcgtttacggtcgggccggtgaggaaatggcggcgatgcgcgaggcgggcatcagctacgaggtggtgccggggatcacgtccgcctttgctgcggccgccgatttcgagttgccgctgacactgcgcggcgtggcgtcgtcactggttttcacgaccgggcacgacttgaccggcagcgtccttcccgattgggcgcggctggcggtttccggcgcgacgatcgcggtctatatggggcgcactgttgcggcgtccgtcgcttcgcgactcatgcaggcgggcctgccgcaggacacgaccgtcgcggtcatcgaaaatgcgagccgcgccgagcgacgcctacttcacggaaccttgcgtgatctccctgacctcgagacccgcacggaactggacgggccggtcatggtgatcatcggcgaagcggtcgcgggcgcgaatttcgaacggtccgagccgctggcggcggcccggggcaatggcagcggtgccgtcgaggcttcggcgaaacgcgaaacgatttggaattga

SEQ ID NO: 2567 - DNA, 1428 bp, Ochrobactrum anthropi ATCC 49188
gtgtctctatcgcaaaagcgtttactggctgattttcctgccttcttccgggtctcggaagaggtggttgtcgtcgttggcggcggcgaggaagctttgaacaaggcgcgcctcgtggcgcagacttcggcgcgacttcgcatcgttgctgaagaaacagaacatcatctggccgatttcattgcaaaccatggcgcggagcatgtggctgtaccttttgcgcccgaacacgttgaaggcgcaaagcttgttttcgtggcgactggcgatgaggcgcaggatcgcgccattgccgctgtggtcaaggcgcaaaaaattccggtcaatgtggttgaccgtcccgcactttgcgatttcctgacacccgccattgtcaatcgtgcgccgctgacgattgcgattggttcggaagggacggccccggttctggcgcagatggtgcgcgcgcgtatcgatgccgcgttctcgccgcgtctgggtgagcttgcgcattttgccgaaagctggcgtccgctggtcgagcgcgccttgccgaaggggctggcgcgccgcagcttctggcgcgggttcttttcgggccgcgtcgcccatgccatcgagaatggcgaccgggaggaagcacagaaagccgcgagcgacctgatcaagcagcgcgacaatgccgccggttatgtctggctggtcggtgccggtccgggtgccgaagacctgctgaccctgcgcgcccatcgcgccttgatggaagccgatgtgattgtgcatgatgcgctggtgccggaaggtgtcatcgccatgggtcgccgcgatgccgagcgtcttgccgtcggcaagcgcaaaggctgccattccaagagccaggaagagatcaaccgcctgctggtaacgctcgggcgggaaggcaagcgcgttgtgcggctgaaatccggcgatccgctggtgttcggacgcgcaggtgaagaaatggccgcactgcgtgccgccggtatcgggttcgaaatcgtgcccggcatcacttctgcctttgccgccgcagccgacatggaactgccgctgacgctgcgcggtgtcgcctcgtcgctggtgttcaccaccggccatgacatgaccggcgacgtgctaccgggctggacgaagctcgccgtctccggcgcaaccattgccgtctatatgggctcgaccgtcgcggcatcggttgccgcgcggctgattggtgcgggcctgcacgaagataccgccgtggcggtggtggaaaatgcgagccggcaggacaagcgcctgttccacggcacgctgaaagatttgccggatctggaaagccgcaaggaactttccggtccggtcatggtgatcattggcgatgcggtcgccggtgccgccatcgacaaagccgaagcgctggccctcaggccggtttccgtcgcagcctaa

SEQ ID NO: 2568 - DNA, 954 bp, Caulobacter K31
atggctcggcccacggtccgatccgactcccggcagccctctcgtttggggggcggtctcgtcgccctcggcggcgggacgagcgtccgcgcgccgggtcgcgtgaccctggtgggcgccggtccgggcgatcccgagctgctgaccatcaaggccctcaaggcgctgcaggccgccgacgtgatcgtccatgacggcctggtctccgacgagatcctcgacctggcgcccgtcgcggcgcggcggatcaatgtcgccaagcgcaagtcgcgccacaccctgccgcaggacgacatcaaccaactgctggtggctttggccctggacggcctgaccgtcgtgcggctgaagggcggcgacccgttcctgttcggtcgcggcggcgaggaactgagcgcctgccgcgcggccggcgtcgactgcaccgtcgtgcccggcgtcaccgccgccctggcagcctcggccagcgcgggcgcgcccctgacccatcgtggcagcgcccaggccgtgaccttcgtcaccggccatgccgcgccccaaaacggagaaatgggcgagccggatctggactggaccgcactgtcgcggcccaaccagaccgtcgtcgtctatatgggcgtcagcaccgccggcctgatcgccgaccgcctgaccgccgctggccgcgccggctcgaccccggccctgatcgtcgagaacgccagtcgcgccgacgaacgccgtatcctgaccaccctggccgacctggcgctcgccgccgaggggctgaaaggcccggcgctgctgatggtcggcgagtccatggccatggcggttgacgccgtgccggacaacctcgtccttcgacaagctcaggatgaggttgtctcgggcgccgcagtagacctcatcctgagcctgtcgaaggacgaggtcgcatcccccgccgatcaacgcgtgagctccgcccgatga

SEQ ID NO: 2569 - DNA, 1437 bp, Rhodopseudomonas palustris TIE 1
atgcgatttcttccagtctttctggatctggcgacggggccagtggtgctggttggtgccggcgagatggcgcgcgccaagctgcggctgctgctcggcgccggcgcgtcggtccgctggtacgtcaccgacggcgaccgcgatctggccggcctgaccgagccggagcggtcgcgcatcagctttccggaaggcgatccgctgcacgccgatcttaccggcgcgatcgcgctgctgtgcgccggggccggcgacgttgccgctccgctcgccgcgaaggcgcgcgcgctcggcgtgccggtcaatgtcatggacgagctgtcgcattcgaccttcatctttccggcgatcgtcgatcgcggcgatgtggtggtggcgatcggcaccggcgggtcttcgccggtggtggcgcgccgccttcgcgaactgatcgagaccgtggtgccggcgcggatcggcgaactggcagcgctgatcggccgctggcgcacgccgatcaaggcacggattcctgaattcccgctgcgccgccggttctgggagcgcgtcgtcgacggcccgatcggccgcgcggtgctcgaggggcggctgacggatgccgagaccgaactgaagacaatcgacgatgccactgactacgcgcggcattcgctcggccgccgcgccgatggtcacgtcagcatcgtcggcgccggtcccggtgatcctgatctactcaccttgaaggcgctgcgggctctgtcggacgccgacgtggtgttctacgacgagttggtttcgcccgagatcctcgaccgcatccggcgcgacgccaaacgcgtgccggtcggccgccgcgtcggccagccgggaatcggtcaggacgcgatcaacaagctgctgatcgaaactgcacgctccggtcagcgcgccgtacggctgaagggcggcgatccgttcgtgttcggccgcggcggcgaagaggtcgaagcgctgcgcgaggctggcgtgtcctattcggtggtgccgggcatcagcgcggcgctcggcgcggcatcgcaattcgaggtgccgctgacctatcgccacgaggcgctacgcatcaccttcctcaccgcccacaaggccaaggacgctgaagccgtcgactggtcggcgctgaccgatcagaagatgaccgtcgtggtctatatgggcatgagcgccgcaccgacgatccgtgacgggctgctcgccgccggccgcgcggccgatacgccggtcggcgtgttcgcgcgggtgacgcggccggacgctgtctcggctgtcggcaccctcgataacctgccggcgctggtcgagcaggtcgacggcggaccggcactgctggtgatcggcgacgtcgtcgcgcattcggcgccgtggcgccaacaacaactcctgcaactcgtctcgacctatcagatggccgccgaatga

SEQ ID NO: 2570 - DNA, 1437 bp, Rhizobium leguminosarum bv  trifolii WSM2304
atgtctcccaagactgagcagctttcggtatttccagccttctttcgcgtggaaggccagaagacggctgtcttcggcaatggtgacgaggctttcgccaaggtgcggctgctgctcaacacgcgggcgcggatcgtcgcctatgccgacaggccggaagccgattatcatgctttcctgattgccaaccgcatcgagactgtgcgcgccggcttttccgccgagcaggtcgcgggttcggcactggtctttgccgccaccggcgatgaggccgatgatcgcgagatcgtcgatgccgcccgtgctgctagaattccggccaatgccgtcgatcagccggattactgcgatttctttaccccggcgctggtcaatcgcgcgcccgtcgccgtggcgatcggcaccgaaggggcagggccggttctggcgcagatgatccgggcgcagatcgatcaactgctttccccctcgctcgggcggcttgccggcctggcgacgagctatcgcaaatcagtcgagcagctggtgccccgtggcgtttcccgccgcgtcttctggcgccgcttcttctccggcgccgttgccgatgcggtcgccaacggcaacctgccgcaggcccgccacgccgccgaccggctgctgggctcgatggacaaggtcgccggccatatctggctggtcggcgccggcccaggcgccgaggatctgctgacgctgcgcgcccagcgcgtgatgatggaagccgatgtcatcgtctatgacgcgctcgtgccgcaggcgatcgtcgatatgggtcgccgcgatgccgagcggctttcggtcggcaagcgcaagggctgccattcgaaatcgcaggaagagatcaacgacctcctggtcgatctcggccgccagggcaaacgcgtcgtccgcctgaaatcaggcgatccgctggtctatggccgggcaggggaagagatggcggcgttgcgcgctgccggcatcacctatgaggtcgtgcccggcatcacctcggccttcgccgccgccgccgatttcgagctgccgctgacgctgcgcggcgtcgcttcgtcacttgttttcaccaccggccatgatctcaccggcgacgtactgcccgattgggcaagccttgccgtctccggcgcgacgatcgccgtctatatgggccgcacggttgccgcctcggtcgccgagcggctgatgcaggccggcattccctccgagaccacggtcgccgtcatcgaaaatgccagccgcgcggagcgccgcctgctgcatggcacgcttgccgatctgcccgatctgcagcatcgcgacgagttgaccggcccggttatggtcattatcggcgatgcggtcgccggcgccaatttcgaactgtccgagccgctggtgcgtgcgaacgcccggctcgaggaacttgcaaggagctga

SEQ ID NO: 2571 - DNA, 1458 bp, Agrobacterium vitis S4
ttgagcatcgagtctgacaagctggcggtttttccggcgttttttcgcgtttccggcgcgaaattggctgtgttcggcgatggcgacgaggcgtttgccaaggctagactgatcgccaatacgtccgcgaccatcattgccttcactcgggatccagcccctgcatatgcagcctttctgaagcgtaaaaccatcgagatcgatccatcgccgttttctcctgatctgctggcggggatgaaaatggtttttgccgcgaccggtgatggtgcggcggatcggatgattgttgaagcggctaggctgcaaaaaattccggccaatgccgtcgatcagccggattattgcgatttttatacgccggcgttggtcaatcgtgcgccgattgcggtggcaattggcacggaaggtgtggggccagtgctggcccagatgatccgcgctggaattgacaggcaattgccgaggtcgctgggcaagttgggccgtttggccaacagctaccgtcatgccgttgaccggctgttgccgcgcggtgtggcacgccgtctgttctggcgttctttctttcaaggcgacgtggccgatgcaatggaaggtggggatgtgaaggctgctcgtcgccgggcgacaaagctgcttaagtcggcggccaataccgtgccggaaggtaggatctttctggtcggggcagggccgggggcggaagacctgctgaccctgcgcgcccatcgactgatgatggaagctgacgcgattgtttatgatgctttggtgccacaggccgttgtcgatatgggccggcgtgatgcggaccgtattccagtcggcaagcgcaagggctgtcattccaagtcgcagagcgagatcaatgatctcctcgtggcgctcggtcaggctggcaagcgtgtcgtgcggctgaaatccggtgatcccttgatcttcggtcgggcaggcgaggaaatggcggcgctgcgcgatgccggtatcgcctatgagatcgtgcccggcgtcacttcggcgctggcggcagccgcagattttgaattgccgctgacgttgcgcggcgtatcttcttcgctggtctttaccacaggccatgacctgaccggcgatgttctgcccgactgggcgcggctggcgctatcaggcgcaaccgttgccgtctatatgggccgcacggtggcggcttccgtcgccgaacggctgattgccggtggattggcgcaagacacgacggttgccgtggtggaaaatgctggacgcggcgaccgccgcctgctgcatggcacgctgcgggaattgccgggtctggaagccatgacggaactgacagggccggtgatggtcattatcggcgatgcggtggcgggtgcgaatttcgagcggtcgatgccgttggcgcaggcgcgtcttggcctggcgaatgtcgatcaacagcagatgacgagggtttga

SEQ ID NO: 2572 - DNA, 1437 bp, Rhizobium leguminosarum bv  trifolii WSM1325
atgccttccaagactgaacagctttcggtatttcccgccttctttcgcgtggaaggccagaagacggctgtcttcggcaatggcgacgaagcgttcgccaaggtgcggctgctgctcaacacgcgggcgcggattatcgcctatgccgaccggccggaagccgattaccacgctttcctgatcgccaaccggatcgagaccgtacgcgctgccttcgcagccgaacaggtcgagggttcggcgctcgtcttcgccgcaaccggcgatgaagctgacgaccgcagcatcgtcgatgctgcacgtgccgccagaattccggccaatgccgtcgatcaacccgattactgcgatttcttcacgccggcgctggtcaaccgcgcccccgtcgccgtggcgatcggcacggaaggggcagggccggttttggcgcagatgatccgcgcgcagatcgaccagcttctttcgccctcgctcggccgtcttgccgggctggcgacgagctaccgcaagtccgtcgaacaactgattcccagaggcgtctcccgccgggtcttctggcgccgtttcttctccggcgccgttgccgatgcggtcgccaacggcaacctgccgcaggcccgccatgccgccgaccggctgctgcacgcgatggacaaggtcgccggccacgtctggctggtcggcgccggtccgggtgccgaggatctgctgacgctgcgcgcccagcgcgtgatgatggaagccgacgtcatcgtctatgacgcgctggtgccgcaggcgatcgtcgatatgggccgccgcgatgccgagcggctttccgtcggcaagcgcaagggctgccattcgaagtcccaggaagagatcaacgacctgctggtcgatctcggccgccagggcaagcgtgtcgtccgtctgaaatccggcgatcccctggtctatggccgggctggcgaagagatggcggcactgcgcgccgccggcgtcacctatgagatcgtgcccggcatcacctcggctttcgccgccgctgccgatttcgagctgccgctgacgctgcgcggcgtcgcctcctcgctggtcttcacgaccggccatgatctcaccggcgacgtgctgcccgattgggcaagccttgccgtttccggcgcgacgatcgccgtctatatgggtcgcacggttgccgcctccgtcgccgagcggctgatgcaggcgggcattccgtctgagactaccgttgccgtcatcgaaaatgccagccgcgccgatcgccgcctgctgcatggcacgctcgccgatctgcccgatctgcagcaccgcgacgaattaacagggcccgtcatggtcatcatcggcgatgcggtcgccggtgccaatttcgaactgtccgagcccttggtgcgcgcaaacgcccggctcgaggaacttgcaaggagctga

SEQ ID NO: 2573 - DNA, 1128 bp, Jannaschia CCS1
ttggatgcccttcctgcgcagacccgcgaagagacgggctttgacgggcgcgcctatgcgctggctttggcgtctgtgcggatgctggatgcgctggggatctggaatcaggtcgaggatcacgcacagccgatgttggagattaaagcctccgacgggcgggccggtgaaggggccgcgccgtttttcctgcacttcgatcatgccgagatcgaggaaggcccgatgggtcacatgctggaggaccgctacctgcggcgcgcattgatggccgcgatggaggcgtcatcactggtcgcgcaccgcgcagcatcgcgtgttttgtcgcaagataccaatgggatggcatccgtcacgttggacggcggagaggtcctgcgcgggcggcttctgatcggcgctgatggcaaacgatccggcgtggcggagcgagctggcatcaggcggatgggctgggattacaaccaaacggcattggtctgcgccgtcgaccatgaccgtccccacaacggcattgcgcatcagttcttcatgccgggtggaccgctggcaatcttgccgctgccgggcaacagatcctccatcgtctggtcagaatctgagccgcgcgccagcgagttggcggcagcggatgatgacacgttcatggatgcgctgcgccccgcgtttggggacttcctaggcaatatttcattgacaggacaacgacatagctacccgctgtcgctgtccctcgcgcaggcctttgtggccgaaaaactggcccttgtgggtgatgccgcccatggtgtgcacccgattgccgggcaaggtctgaaccttggtctacgagacgtcagtgcccttgcggagaccctcgccgatgccaaacggcgcggagaagatttcgcgcggcgcgacgtgctggatcgctatcagcaatggcggcgcttcgatacggcggggcttgcggtcgcgaccgatagcgtgaaccgcctgttctccaacgacaatccggccgtgcgggcgatccgggatatcggtatgggggccatcggcgcgctgccaaccttgcgccgccgtttcattcgggaggctgccggcttgaccggagacctcccgcgtttgatgcaaggtcggaccctgtag

SEQ ID NO: 2574 - DNA, 1221 bp, Rhodopseudomonas palustris BisB18
atgacggcacagcgcggcattgtcatcggaggcggcgcgttcgccggactggcgctggccctggcgttgcgccaggggctcggccccgacgttccggtgatcgtcgccgatccggcgctttcgctgcggccgtcgcgcgatccgcgtgccaccgcgatcgtcgccgcctgccgccggctgttcgacacgctcggcgtgtggcaggcggtggcgccgcatgcgcagccgatcctcgacatggtggtgacggattccgcgctggaagacgccacccggccggtgttcctgaccttcgccggccagatcgagcccggcgagccgttcgcccatatggtggaaaaccgccatctgatcgacgccttggccgagcgcgccgaggccgccggcgtcgaactgcgcgccaccgcggtgacgggttacgaatcccggctggaggccaccagcgtgacgctcggcgatggcagcgtgatcgacgccgcgctgctggtcgccgccgacggcgcccgttccaagctgcgcgagcgcgccggcatcagcacctatggctgggattacgaccaggccggcatcgtggtcaccgtcgaacatgagcgcgaccacaacggctgcgccgaagagcatttcctccccgccgggccgttcgcaatcctgccgctcgtcggcaagcgctcctcgctggtgtggaccgagagccgcgccgaagccgcgcggatcgtcgcgctgtccgacgccgagtttcatcgcgagctggaacagcggttcgggctgcggctcggcgaggtcaaggcgctggacaagccgaaatcgtttccgctcggctatttcgttgcgcaatccttcatcggcgagcggctggcgctgatcggcgacgccgcccatgtgatccacccgatcgccgggcaaggcctcaatatggggctgaaggacgtcgcagccttggccgaggtgatcgtcgacgcggcgcggctcggcatcgatttcggccaggccgacgtgctcgatcgctaccaggtgtggcggcggttcgacaccatggcgatgggggtggcgaccaattcgctgaacctgttgttctccaacaagtcgacgctgctgcgcagcgtccgcgacatcgggctcggcgtggtcgaccggctgccgccgctcaaggaactgttcatccgccaggccgccggcctcggcggcgaagtgccgcggctgttgaagggcgaggcgctgtaa

SEQ ID NO: 2575 - DNA, 1320 bp, Rhodopseudomonas palustris BisB5
atgtctggtagaaccgcagcggtaatcaccacggctgttccagcctgtttcgcccagctccggcatgggcgcaagaactctggcgcaagagcgagaaaaatgacggcaccgcgaagcattgtcatcggaggcggcgcattcgccgggctggcgctggcgctggcgctgcgccaggggctcggccccgaggtcccggtgatcgtcgccgatccggcgctggcgctgcggccgtcgcgcgatccgcgcgccaccgcgatcgtcgccgcctgccggcggctgttcgaggcgctcggcgtctgggacgaggtcgcgccgacggcgcagccgatcatcgacatggtggtgacggattcggcgctcgaggacgcgacgcggccggtgttcctgaccttcgccggcgaggtgcagcccggcgagccgttcgcccatatggtcgagaacaaatatctgatcgaggcgttggccaagcgcgccgaggccgagggcgtcgaattgcgcgccacgccggtgacttcataccagtcgcgcgccgaggccacgatggtgacgctcggcgacggcagcgtgatcgaggcgagcctgctggtcgccgccgacggcgccaagtcgaagctgcgcgaacgcgccggcatcagcacctatggctgggactacgaccagaccggcatcgttgtcaccgtcgcgcacgagcgcgaccacaatggctgcgccgaggagcacttcctgccggcggggccgttcgcgatcctgccgctgaccggcaaacgctcctcgctggtgtggtccgagagccgcgccgacgctgcgaagatcatggcgctgcccgacgcgcagttccaggccgagctggagaagcggttcggactgcggctcggcgaggtcaagccgctcgacaagccgaaggcgtttccgctcggttacttcgtcgcgcaatccttcatcgcgccgcgtctggcgctgatcggcgacgccgcccatgtgatccacccgatcgccggccagggcctcaatatgggtttgaaggacgtcgcggcgctggccgaagtggtggtcgatgcggcgcggctcgggatcgatcccggccaggtcgacgtgctggagcgctaccagcgctggcggcggttcgacaccatggcgatgggcgtcgccaccaacgggctgaacctgctgttctccaacaagtcgccgctgctgcgcagcgtccgcgacatcgggctcggcatcgtggaccgtctgccgccgctgaaagaggtcttcatccgccaggccgccggtctcggcggcgaaaccccgcggctgctgaagggcgaggcgctgtag

SEQ ID NO: 2576 - DNA, 1227 bp, Ruegeria sp. TM1040
atgactgatacgcgtgatatcctgattgtgggcggaggcctgaatggtccgtcgcttgctcttgcgctggcacaggctggccattctgtgaccctgatcgacgcgcttccggcgcccctgcgcgaggacgccgaatttgacggccgttcctatgctctggcgcttgcctcgacgcggctcctgcaacagatcgggatctgggcagttatcgaggatcacgctcaaccgatgaacgagatcaaggttagcgacggcgttgccggtcgcggcccttcgccgcttttcctgcattttgaggaaagcgacctcgacgagggccccatgggctacatggtcgaagatcgctacctgcgccgcgcccttctgaaagcactcgaggccgagccaaaaatcacccagatctcgggccagcctgtgatcgcacagaccgtgagtgcggatgccatcaccgtcactctcgaagatggcacacagctctcgggtgcgcttttggtcggcgcggatggacgtcaaagcggcaccgccgcgcgcgccggcatcaagcgcaccgggtgggattacggccagaccgcactggtctgcgctatctcacatgcgcaacctcacaacggcattgcccatcagttctttatgccgccggggccgcttgcaattctgccgttgccgggcaatcgcagctctattgtctggagtgagactcatgccgaggctgcgcgcattcaggcactttcggatcaggactacctctcggtgctgcgcccccggtttgggtctttcctcggagagatcgatttggaaggcaagcgcttcagctatccgctgaaattgagccttgccaatgccttttatggcgagcgactggccttggtgggcgatgcggcgcatgggctgcacccgatcgcgggccagggactcaatgcggggctgcgcgacatcgccagccttgcagaagttctgaccgatgcagcgcggcgcggtgaggatctcgccagccccttggttctggcgcgctatcaacagtggcgccggttcgacaccacctctctcgcgctagcgacagatgtgttcaacaagctgttttcaaacgacaatcctatcctgcgcgccacccgagatctggggcttggcctcacaaatgcactgcctggcctacgccgaggttttgtgcgcgaagcggcaggactttcgggagatttgccgcgcctgttgcgcgggcgcccgctctga

SEQ ID NO: 2577 - DNA, 1230 bp, Rhodobacter sphaeroides 2 4 1
atgacccaagctgccgacatcctgatcgccggaggcgggctgaacggccccgccctcgccctcgcgctggcgcgcaacggcttttccgtcacggtcgtggacgggcgccccgcgccgcagcgcgcagagcctggcttcgacggccgcgcctatgcgctggcgctggcctcgaagcggctgctcgcggcgctcggcctctgggacgggctcgcatcgcaggcccagccgatcctccgggtggtgaccgccgacggcaccaccgcaggcggcccctcgcccttcgtgctggccttcgaccatgccgagatcgaggagggtccgatgggctacctgctcgaggaccgcttcctctatgcggccttcctcgcggcactcgaagccgagccgcgcatacggctcgtctcgggcaccaccgtcgaggcgcaggaggtgggccctcagggcgtcaccgtcacgctctcgaccggggcgcagctctcgggccgtctcctcgtcggctgcgacggccggcagagcggcacggcgcgccgcgcggggatccggcgcagcggctggggctacggacaaaccgccctcgtcacggccatcgagcacgagcgcccgcacgagggcaccgcctggcaatatttcctgcccggcggcccgctcgcgatcctgccgctgccgggcggtcaccgctcctccatcgtctggagcgagagcgacgccgccgcggccgggatccagcgcctgcccgacgccgactatctcggcgccctccgcccgcggttcggcgatttcctgggctcgatccggctcgcgggcgaccgcttcacctatcctctctcgctctcgctcgcccacagcttcgtggcgccgcgggtggcgctggtgggcgatgcggcgcatggcgtccatccgatcgcgggccagggtctgaacctcgggctgagggacgtggcggcgctggccgaagtgctgacgctcgccgcccgccgcggcgaggatgtgggcagcccgctcgtcctcgaccgctaccagcagtggcgccgcttcgacgcgacggcgctcgccctcggcatggacatggtcaaccgcctgttctcgaacgacaacccggtgatgcgcgcggggcgcgacctcagcatggggatcgtgaacgccctgcccggcctgcgccgcggcttcatccggcaggcggccggcctctcgggcgacctgccgcggctgctgcagggccgcccgatctga

SEQ ID NO: 2578 - DNA, 1230 bp, Rhodobacter sphaeroides ATCC 17029
atgacccaagctgccgacatcctgatcgccggaggcgggctgaacggccccgccctcgcccttgcgctggcgcgcaacggcttttccgtcacggtcgtggacgggcgccccgcgccgcagcgcgcagagcctggcttcgacggccgcgcctatgcgctggcgctggcctcgaagcggctgctcgcggcgctcggcctctgggacgggctcgcatcgcaggcccagccgatcctccgggtggtgaccgccgacggcaccaccgcaggcggcccctcgcccttcgtgctggccttcgaccatgccgagatcgaggagggtccgatgggctacctgctcgaggaccgcttcctctatgcggccttcctcgcggccctcgaagccgagccccggatccggctcgtctcgggcaccaccgtcgaggcgcaggaggtgggccctcagggcgtcaccgtcacgctctcgaccggggcgcagctctcgggccgtctcctcgtcggctgcgacggccggcagagcggcacggcgcgccgcgcggggatccggcgcagcggctggggctacggccagaccgccctcgtcacggccatcgagcacgagcgcccgcacgagggcaccgcctggcaatatttcctgcccgcaggcccgctcgcgatcctgccgctgccgggcggtcaccgctcctccatcgtctggagcgagagcgacgccgccgcggccgggatccagcgcctgcccgacgccgactatctcggcgccctccgcccgcggttcggcgatttcctgggctcgatccggctcgcgggcgaccgcttcacctatccgctctcgctctcgctcgcccacagcttcgtggcgccgcgggtggcgctggtgggcgatgcggcgcatggcgtccatccgatcgcgggccagggcctgaatctcgggctcagggacgtggcggcgctggccgaagtgctgacgctcgccgcccgccgcggcgaggatgtgggcagcccgctcgtcctcgaccgctaccagcagtggcgccgcttcgacgcgacggcgctcgccctcggcatggacatggtcaaccgcctgttctcgaacgacaacccgatgctgcgcgcggggcgcgacctcggcatggggatcgtgaacgccctgcccggcctgcgccgcggcttcatccggcaggcggccggcctctcgggcgacctgccgcggctgctgcagggccgcccgatctga

SEQ ID NO: 2579 - DNA, 1227 bp, Rhodobacter sphaeroides ATCC 17025
atgacccaagatgccgacatcctcatcgccggaggcgggctgaacggccccgctctggccctcgcgctggcgcggaacggattttccgtgacggtggtggatgggcggcccgctcccctgcgcgccgagcccggcttcgacgggcgcgcctacgcgctggcactggcttcgcagcggctgcttgcggcgctcggcctctgggacgggcttgcgccccgcgcccagccgatcctgcgggtcgtgacctcggacggcaccaccgccaccggcccttcgcccttcgtgctggccttcgaccatgccgagatcgaggaggggccgatgggctacctgcttgaggaccgttttctctacgccgccttcctcgccgcgatggaggccgagccgcgcatccgcctgatctcgggcgccacggtcgaggcgcaggaggtgggtgcgagcggcgtcaccatcaccctctcgaccggagcgcacctctcgggacggctgctcgtgggctgcgacggacggcagagcggcacggcgcgccgcgccggcatccgccgcagcggctggggctacggccagaccgccctcgtcaccgcgatcgagcacgagcgcccgcacgagggcaccgcctggcagtatttcctcccctcgggtccgctggccatccttccgctgcccggcaaccgctcctcgatcgtctggagcgagagcgacgccgccgcggccgagatccagcgcctgccggacgcggactatctcaccgctctccggccgcggttcggcgactttctgggcgccatctccctcgccggcgagcggttcacctatccgctctcgctgtcgcttgcccacagcttcgtggcgccgcgcgtggcgctggtgggcgacgccgcccacggcgtccacccgatcgcgggccaggggctgaacctcggcctgcgcgatgtggcggccctggccgaagtgctgaccctcgccgcccgccgcggagaagacgtcggctctccgctcgtccttgaccgctaccaacaatggcgccgcttcgacgccaccgcgctcgcgctgggaatggacatggtcaacaggctgttctcgaacgacaatccgatcctgagggcggggcgtgacctcggcatgggaatcgtgaacgccgttccgggcctgcgccgcggcttcatccggcaggccgccggtctcacgggggatctcccccggctgctccagggccgcccgatctga

SEQ ID NO: 2580 - DNA, 1269 bp, Sphingomonas wittichii RW1
atggttaggtggtggcatgtccgccgccgacgtcctaaagcggtccgcatggaacggcaggacgtcatcatcctcggcgggggcctggtcggcctcaccctcggcatcgcgctcgcgcggcacggcatcatggcggcggtgatcgatcccgccgatcccgacaggatgctggcgagcggcttcgacggccgcgcctcggcggtggcgagcgcgccgtggcggatgctcgacgcgatcggggtcggcgcgtatctccagggccgcggctgcccgatcgacgcgatccgggtgcaggacggcctcagccccgaaagcctgatgttcgagccgtcggccgacgacggcgcgctcggctatatgttcgagaatcgcgacctgcgcatcgcgctcgacaccacggcgcgcgccgccgacggactgaccctgctgcgccccgcccgcccggtcgacgtccgtcgcgacctcgacggggtccgcgtcacgctggccgacgggcgcgaagtggcgggatcgctgctgatcggcgccgaggggcgccagtcgccgacccgcgaggcggccggcatcacctgcgcccgctggagctacgaccatgtcgcgatgatcgcctcgatcgcgcatgagaagccgcacggcaatgtcgcctatgagatcttctataccgccggtcccttcgcgatcctgccgctggtcgacgacgccgaggggcgccaccgctcggcgctggtctggacggtcgacaagaagcacgccccggcgatgctgggcctgcccgaccgcgcctatcaggccgaggccgagaagcggatgggcgggatgctcggcgcggtgtcgctgatctcgccgcgctcctcctatccgctcggcttccaccatgccgcgcggatcaccgacacccgcctcgcccttgtcggtgacgcggcgcacggcatccacccgatcgccggccagggcgtcaacctcggctatcgcgacgtcgcggcgctgaccgaggtgctggtcgaggggatgcggctcggcctcgatccgggcgacgcccagcttctcgaccgctaccagcgctggcgcagcctcgacagcttcatggtcgcggcctcgaccgacggcctgacccgcctgttcggcatccccggccgcaccgcccgcaccgtgcgtcgcatcggcctcggcgcggtccagcggctcggcccgctcaagggccgcttcatggccgaggcgcgcggcgagacggggaaattgccgagattgttgcagggcatggcgatctga

SEQ ID NO: 2581 - DNA, 1215 bp, Sinorhizobium medicae WSM419
atgatcgatgtattgattgccgggggcggttatgtcggcctctcgcttgcggtatcgctgaaaaaggcggcaccccatctcgatgtcatggttgtcgatgccgcgccggaaggcgcctggaagaaggacgagcgggcgtcggccatcgcgtcggccgccgagcggatgctcgagatcctcggcgtgtggcaggcgatcgcgccggaagcggagccgatcctgaggatggtgatcaccgattcgaagacggcggatcccgtgcgcccggtcttcctcacattcgagggcgatggcggtgacggccggcccttcgcccacatggtaccgaacacggccctcgtcggtgcgcttcgccgcgcctgtgacgaactcggcgtttcggtccggcagtcgaccctggtggagagtttcaagaccggagatcattccgttgccgttacgctcgctggaggggaggcggtcgagtcgcggctgctggtcgcctgcgacggcgttcgctccaggctgcgcgaggcggcgggcatcaaggtcgttgaattcgattacggccagtcgggcatcgtcacgaccgtcgagcacgagcggccgcacggcggaacggcggaggagcatttcctgccggccggccctttcgcgacgctgccgctcaaggataatcgctcctcgctcgtctggacggagagcacctatgatgcagagcgcctggtcaaggaagatgatttcatcttcgaggaggagttggagcgtcgcttcggccataagcttggccgcctcaaggtggtgggcggacggcgcgccttcccgctcggcctcacgcttgcgcgggatttcgtcgcgtcgcgtttcgcgctcgccggggatgccgcacatgggatacacccgatttccggacaggggctcaacctcggcttcaaggacgtcgcggctcttgccgaaacgatcgtcgaagcggaccgcctcggcctcgatatcggctcactcgccgttctcgagcgttatcagacgtggaggcgtttcgataccttccggatgggcgttacgacggacgtcctcaacaggctcttctccaacgacatcatgccggtgcgggtcgcgcgcgatttcggactcggcgtcgtggaccgcatgccgtcgctcaagaaattcttcatccgccaggcggcgggtgcgcccggcagaaacgatccgcggttgctcgccggcgagccgatttga

SEQ ID NO: 2582 - DNA, 1293 bp, Xanthobacter autotrophicus Py2
atgaccgggctgaccatgtccgagcctcaggccgagatgccgcacgccggagccggctttgccgccaccgcggccgcgccgcgtgcggacgtggccatcgtcggtggcgggctcgccggcctcagccttgcgctcgccctgcgccaggggctggggcctgatgccgacatcgtgctgttcgacccctatttgtcccacgccacggtggatgacggccgctgctcggccatcgccgccggtgcgcggcgcatgctcaccaccctcggtgtgtggcagcacgtgggtgccaaggcccagcccatccaggccatggtggtcaccgacagccgcaccaaggacgtggcgcgccccaccttcctgaccttcgacggcgatgtggagccgggcgaggccttcgcccacatggtgcccaacgccgacctgcagtacgccctcatcgatgcggcgcgctccgccggcatcgacctgcgcgcccagtccgtggacgatttcaccgccgaccgttccggcgtgagcctttccgccgccggggcgccgacgcttcgggcccagcttctggtggcttgcgatggcgccaagtcgcgcatccgcggcatggccggcatcgccaatgtggcctggggctatggccagagcggcatcaccttcgcggtggagcacgaacggccccacgagggccgggcggaagagcattttttgccccccggcccgttcgccatcctgcccttgccaggcaaccgctcctccatcgtgtggaccgagcgcacggaggatgccgagcgcatcgtgggactgccgtccatcgtcttccaggaagagctggagcagcgattcggccaccggctcggctgggtgaagccggtgaccaagccgcgtgcctatcctttgggcttcgccatggcgcgcagcttcatcggcgagcgcctcgctttggtgggggatgcggcccatctcatccaccccattgccgggcaggggctcaacatgggcctgcgcgacgtggcggcactggccgaggcggtgacggacgccgcgcgggtgggcctcgatttcgccgggccggcggtgctggagcgctatcagcgctggcggcggttcgacaccttggccatgggcgtcgcgacagacgggctcaaccggctgttctcgaaccgctccgacgccctgcgcgcggtgcgcgacctcgggctcggcctcgtggaccggatgccgcgcctcaagggcctgttcatccgcgacgcagcgggcctcaccgggcaggtgccgaagctgctgcggggcgaggcgctttag

SEQ ID NO: 2583 - DNA, 1251 bp, Caulobacter K31
atgcgcgaccacgacgccgacgtcatcatcgccggagccggcatggccggaactaccctggcgctcgccctggcctcagccggggtcacggccgtgctggtcgatccccagccgttcgacgcccagctggccgagagcttcgacgggcgctcgtcggcgatcgcctattcttcgtttcgccagtggcgggcgatcggggccggcgaggccctggagccccacgcccagcggatcgagcagatcctggtcaccgacggcaagacgccgggtcccgcctcgggcggaccctcgccgttcttcctgcgctttgattccagcgagatcgccgaccgctccgagggcgaacccctgggctacctgatcgagaaccgccagatccgcacggccttggccaagaccgtgatcgacaaggggatcacggtgctggccccggtcgccgccaaggcgctggaggtcacggcggccgccgcgaccctgaccctgaccgacggccgcacgctgtcggcccctctggtggtcagcgccgagggccggggcagcgtgctgcgcaaggccgccggcatcggcgacatcggctggagctacggccagagcggagtggtggccaccgtccgcatgcagcatccgcaccagggcgtggcccacgaatatttcctgcccagcggcccgttcgccatccttccgctcacggacaatcgcgccagcctggtgtggaccgagagcacgctgcgcgccgaggccctgcgcaacgcgtcgccggaagcgttccacagccacctgatgcggcggttcggcgagttcctgggcaaggtcgagatggccggcccgaccttcgtctatccgctgtcgctgtcgctggccgagcgactggtcgccccacgcctggccctgatcggtgacgccgcccacggggtgcacccgatcgccggccaggggctgaacctgggcctcaaggacgccgccgccctggccgaggtggtggccgaggccctgcgcaacggcgaggacatcggggccgagtcgaccctggagcgctacgcccgctggcggcggttcgacaatgtcaccaacgccctggccttcgacggcttcgtgcgcctgttctccaacgacaacccgctgctgcgcctggcgcgcggcgtgggcctggcggcggtcaaccgcatcgcccccgcgcggcggttcttcatgcatgaagccggcggcggggtgggagatctgccaaagctgctgcggggcgtggggatttag

SEQ ID NO: 2584 - DNA, 1221 bp, Rhodopseudomonas palustris TIE 1
atgacggcaccgcgaagcattgtgattgggggcggggcgttcgccggtttggcgctggcgctggcgttgcgccaggggctcggccccgaggtgccggtgatcgtcgccgatccggcgctcgcgctgcgaccgagccgcgacccgcgcgccaccgcgatcgtcgcggcgtgccggcggttgttcgaggcgctcggggtctgggacgaggtggcgccgaccgcgcagccgatcatcgacatgatcgtcaccgacagccatcttgaagacgcgacgcggccggtattcctgaccttcgcgggcgaagtgcagcccggcgagccgttcgcccacatggtcgaaaacagatatctggtcgaggcgctggccaaacgcgccgaggccgaaggcgtcgagctgcgcgccaccccggtcacctcctacgacgcgcgcaccgaagcgatcggcgtcacgctcggcgacggcagcgtgatcgacgccagcctgctggtggcggccgacggcgccaagtcgaaactgcgccagcgtgccggtatcgccacctatggctgggattacgaccagtcgggcatcgtcgtcacggtcgagcacgagcgcgaccacaatggctgcgccgaagaacacttcctgcccgctggtccgttcgcgatcctgccgctcaccggccggcgctcgtcgctggtgtggagcgagagccgccgcgatgccgagcggatcgtcgcgctgccggagaaggaattccagcgcgagttggagaagcggttcgggctgcggctcggcgacgtcaagccgctcgacaagccgaagtcgtttccgctcggctatttcgtcgcgcagtcgttcatcgcgccgcggctcgcactgatcggcgacgctgcgcacgtgatccatccgatcgccgggcagggcctcaatatgggcctgcgcgacgtcgcggctctggccgaggtggtggtcgatgcggcgcggctcggaatcgatcccggtcaggtcgacgtgttggagggctatcagcgctggcggcggttcgacaccatggcgatgggcgtcgccaccaacgggctcaacttcctgttctccaacaactcgccgctgctgcgcgggattcgcgacatcggcctcggtctggtcgaccgcctgccgccgctgaagggtgccttcatccgccaggccgccggcctcaccggcgagacgccgcggctgctgaagggcgaagcgctgtaa

SEQ ID NO: 2585 - DNA, 1215 bp, Rhizobium leguminosarum bv  trifolii WSM2304
atgctggatatgctggttgtgggcgggggttatgtcggcctttccgccgctgtcgcggtcaagcaggcagcaccgcatctcaacgtcgcggtcgtcgaggcggcccccgaacatgtttggaaaaacgacacgcgcgcttcggccgtcattgcggcggcggcaaagatgctggaaatcttcggcatctggaacgagatcgagccggaggctcagccgatcaccaagatgatcgtcaccgattccaaaacctccgatccggtccgcccggtttttctgaccttcgacggcgaagtggccgaaggccggcctttcgcccacatgatcccgaatgtggcgatggtcgcagccctgcgcggcgtctgcgaacgcctcggcatcgacatccgccatgggctcggcgccaccgagctaaagaccgaagacagccatgtgactgtcacgctttcggacggcagcacgttggagagccggctgctggtcgcctgcgacggcgtgcgctcgaaactgcgcgacctcgccggcatcaagaccgtcacctgggactacggccagtcgggcatcgttgcgacggtcgaacatgagcggccgcatgagggctgcgcagaagagcatttcctgccggccggcccctttgccatcctgccgctccgcaacaaccgctcctcgctggtctggacggagcggacgcatgatgcggaccggctggttggcgccgacgatctggtcttcgaggaggaattggagcgccgcttcggccacaagctcggggcactgaaggtcatcggcgacaaacgcgcctttccgctcggcctgacactggcgcgcgccttcgttgcaccgcgttttgcgctggccggcgacgccgcccatggcattcacccgatttcgggacagggcctcaatctcggtttcaaggatgtggcggcacttgccgaaacgatcgtcgaggccgatcgcctcggcctcgatatcggctcgatcaacattctcgagcgctaccagacctggcgccgcttcgacacgttccggatgggaatgacgacagacgtgctgaaccggctattctccaacgacgcaacgccgatccgcatcgcccgcgacatcggcctcggcctcgtcgaccggctgccgcgcctcaagtccttcttcatcggccaggcggccggaacgacggcaaaggacaatccgcggctgctggccggccaagcgatctaa

SEQ ID NO: 2586 - DNA, 1137 bp, Agrobacterium vitis S4
ctggacgtgacggtaatcgaagcagcccccgaaggccagtggcgcaaggacccacgggcctcggcggtgattgcggcagccaccaaaatgctggaggttttcggcgtctggagcacgatcgaaccgcaatctcagccgatcaacaggatgatcgttaccgattcgcgcaccagcgatccggtccggcccgtctacctgacctttgacggcgaagtcgaggaaggcaagcccttcgcctatatggtgcccaatgtcgccatggtcggcgcgcttctcgatgctgccggtgcggcgggaatttccatccgccatggcgtgaaagccgcaggcttttccgtgaaaggccataaggccgaagtcgcgctttccgatggcacaacccttgactgccgtctggttgttgcctgtgacggcgtgcgctcgcgcgtcagggacatggcggggatcaagaccgtcacctgggcctatggccagtccgggattgtcaccacggtcgaacacgagcgtccgcatgaaggggtagcagaggaacatttcctgccagccggacccttcgctatcctgccgttgaccggcaatcgctcatcgctggtctggaccgagcgcagcgaggatgcggaccggctggtcgccgaggacgatctgatgttcgaaaccgaactggagcgccgtttcggccacaaactcggcgcaatccgtgccaccggcgaccgccgcgcctttccgctgggactgacgctggcccgctcgtttatcggaccaaggctggcgctggcaggcgacgccgcccatggtattcatccgatttccggccagggcctcaatcttggtttcaaggatgtggcggcgctggcagaaacaatcgtcgatgccgatcgcctcggcctcgatatcggcgacctcacggttctggaacgctaccagacctggcggcgcttcgacacattccggatgggcgtcaccaccgacgtgctgaaccggctgttttccaacgatattacgccgttaagaatcgcgcgggatttcgggctgggcctggtggagcggctaccaaagctgaaaagctatttcatttccgaggctgccggaacatcggtgaagggcggcccgaaacttctgaccggtcagtcgatctga

SEQ ID NO: 2587 - DNA, 1215 bp, Rhizobium leguminosarum bv  trifolii WSM1325
atgttggacatgctggttgtgggcgggggttatgtcggcctttccgccgctgtagcggtcaaacaggcagcaccccatctgaatgtcgccgtcgtcgaggcggcccccgagcatgtctggaaaaacgatacgcgcgcttccgccgtcatcgcggcggcggcaaagatgctcgaggtcttcggcatctggaacgagatcgagccggaagcccagccgatcaccaagatgatcgtcaccgactccaagacctccgatccggtgcgtccggtttttctgaccttcgacggccaagtctccgaaggccggcccttcgcccacatgatcccgaatgttgccatggtcgcagccctgcgcggcgcctgcgagcggctcggcatcgatatccgccatgggctcggcgccacggagctgaaaacccacgacactcatgtcaccgtcacgctttcggacggtggtacgctggaaaccaagctattggttgcctgcgacggcgtgcgctcgaaactgcgcgatctcgccggcatcaggaccgtcacctgggactacggccagtccggcatcgttgcaaccgtcgaacacgagcggccgcatgacggctgcgccgaggaacactttttgccggccggccccttcgccatcctgccgctcaagaacaaccgctcctcgctcgtctggacggagcgcacgccggatgccaaccggctggtcgccgccgacgacctgatcttcgaggaagagctcgaacgccgcttcggccacaagcttgggagcctgaaagtgatcggcgacaagcgtgccttcccgctcggcctgacgctcgcccgctccttcgtcgcgccgcgtttcgcgctggctggcgacgccgcccatggtatccacccgatttcggggcagggcctcaatctcggcttcaaagatgtggcggcacttgccgaaaccatcgtggatgccgatcgcctcggcctcgatatcggctcgatcaatatcctagagcgctaccaaacctggcgccgcttcgacactttccgtatgggggtgacgaccgacgtgctgaaccggctcttctccaacgacgcaacgccgatccgcatcgcccgcgacgtcggactcggcatcgtcgaccggctgccacgcctcaaatccttcttcatcggccaggcggccggaacgacggcaaaggacaatccgcggctgcttgccggagagacgatttaa

SEQ ID NO: 2588 - DNA, 537 bp, Pelobacter carbinolicus
atgtccgcattgaaaggaaccaaaaccgaaaagaatctgttggaagcttttgccggcgagtccatggctcgtaacaagtacagctactttgcgtcggtagccaaaaaagaaggttatcagcagatcgctgctatttttcaggaaaccgcagacaacgaaaaagagcatgctaaactgcattttaaagcgttgcaggggatcggcagcaccatggataatctgaaggccgccgctgccggcgaaaacgaagaatggaccgagatgtatccgcgtatggccgaggaggctcgagaggaagggttcgacgatctggcgcgtatgtttgaaaatatcgccagcatcgaaaaagctcaccaggagcgttatgagcggattgtcaaggctattgaagccggcacggtctttacccgcgacagtgagcagttgtggaaatgtcgcaattgcggtcacttgctgaccgccaaagcggcttccaatatctgtccggtctgcgaccatcctcaggccttctttgaaatcgaggtcaacaccttctga

SEQ ID NO: 2589 - DNA, 501 bp, Chlorobium luteolum DSM 273
atgcctacgacccacgaaaacctcaagagtgcatttggcggagagagccaggcgttcatgaaatatgtgaccttcgccaagaaggcagagaaagacggattcaagaacatcgccaggctgttcaggaccacggcagaagccgagcggatccatgctgaagcccacctcatggctgatgatgcagtcggctctactgccgagaaccttgaaaccgccatcggtggcgagacctatgagcacaacgagatgtatccgccgatgtatgagcaggccgttagcgagggccacaaggcaaagcgtatgttcggattcgccgttgaggctgaaaaggtgcatgccgcactctaccgccatgcgctcgagtctgtaaagaacggacaggatattgtagagaccgccgtgtggctctgccctgtctgcgggcacatcgagctcgtgacgcctcctgaaaaatgcccgatctgcaacgtgaaggctgaagtctacgtgcaggtagcctga

SEQ ID NO: 2590 - DNA, 441 bp, Frankia CcI3
atgccgaagcttgacggcaccaagacccacgagaacctcaaggaggcatttgccggcgagagccaggcgaaccggcgttacctctactttgcccgccgggccgacatcgaggggctgaccgacgcctcgtcgctgttccgcgacaccgcggagggcgagaccggtcacgccttcgggcacctggacttcctcgcggaggtcggcgacccggcgacgggcgagcccctcggtacgaccacgaagaacctggccagcgccgtcgccggcgagacctacgagttcaccgcaatgtacccgggcttcgccaagaccgcccgcgaggagggcttcgaggagatcgcggactggttctcgaccctcgcccgggcggagaagacccacgccggtcggttcaagaaggccctcgacgcgctgtcggccgaggagacggccgacgcctga

SEQ ID NO: 2591 - DNA, 576 bp, Pelobacter propionicus DSM 2379
atgccgagtatcaagggaaccaagaccgaacagaacctgctaaaatcgtttgccggagagagccaggcccgcaaccgctacacctacttcgcaagcgtggcccgcaaggaagggtacgtgcagatcgccgatatcttcgaggagaccgcttcccaggagaaggagcatgccaagcgtttctttaagttcatggaggggggcgatgtggagatcaccgcctgtttccccgccggcaggatcggcacgacgactgagaacctcctggccgcagcgaacggcgagcatgaagagcacagcgagctctaccccggcttcgccgatgtggccgcccaggaggggttcaacgaaatcgcccaggcctggcgggccatctccgtggccgagaagcagcatgaaaaacgctaccgcgatcttctggccaatatcgaggccggccgcgtgttcaagcgcgaaatcgaggtaacctggcgctgtcgcaactgcggctacctgcacacgggcacggtagccccggaactctgccccgcctgcatccatccccgggatcacttcgaactgctgggtgaaaactggtag

SEQ ID NO: 2592 - DNA, 576 bp, Desulfovibrio vulgaris DP4
atgaaatcgctcaagggctcacgcaccgaaaagaacattctcaccgcgttcgccggtgaatcccaggctcgcaaccgctacaactacttcggcggtcaggccaagaaggacggcttcgtccagatttccgacatcttcgcggaaacggccgaccaggagcgcgaacacgccaagcgtctcttcaagttcctcgaaggtggcgaccttgaaatcgtagccgcattccctgcgggcatcatcgctgacacccatgcgaacctcatcgcctcggctgcgggtgagcatcacgagtacacggagatgtacccctcgttcgcccgcatcgcacgcgaagagggctacgaggaaatcgcccgcgtcttcgccagcatcgccgtcgctgaagaattccacgagaagcgcttcctcgatttcgcacgcaacatcaaggaaggaagagtgttcctgcgcgaacaggccaccaaatggcgctgccgcaactgtggctatgtgcacgagggcaccggggctcctgaactgtgccccgcctgtgcgcaccccaaggcgcacttcgaactcctcggcatcaactggtaa

SEQ ID NO: 2593 - DNA, 504 bp, Fervidobacterium nodosum Rt17-B1
atgagggagatgacaaagaagtttttagaagatgcatttgcgggtgaatcgatggctcacatgaagtatcttatattcgccgacgaagctgagaaaaaaggactcaaaaaattagcgaatgcttttagagcaatagcttacgctgaatttgtacacgcaagaaaccacttcagagctcttaagaaactcggtgatacgcctgataacattaaatcgtgcatagctggtgaaacatttgaaattgaagagatgtacccagtttataaagaaacagctaagcttcaagaagaaaaagaagcgcagataagcacacattatgcacttgaagctgaaaagatccacgcagagatgtacaaaaaagcattgaaccttgtaaatgaagggcaagattacgatgctgaaaagatttacatttgtccagtttgtggttatacggcagaagatgtcgcaccagaaaaatgtccagtttgcggtgctccaaaatctgctttcgttgaattttaa

SEQ ID NO: 2594 - DNA, 441 bp, Frankia EAN1pec
atgccgaagcttgacggcaccaagacccacgagaacctcaaggaggcgttcgccggcgagagccaggccaaccgtcgttacctgtacttcgcccgccgtgcggacatcgagggcctgaccgacgcggcctccctgttccgcgacaccgccgagggcgagaccggccacgcgttcgggcacatggacttcctcgccgaggtcggcgacccggcgacgggcgagccggtcggcaacacgtcgaagaacctcgccagcgccgtggccggcgagacctacgagttcaccgcgatgtacccgggcttcgcgaagaccgcccgcgaggagggcttcgaggagatcgccgactggttctcgacgctggcccgcgccgagaagacccacgccggtcgcttcaagaaggccctcgacgcggtggtcgccgaggagaccgccgacgcctga

SEQ ID NO: 2595 - DNA, 471 bp, Caldivirga maquilingensis IC-167
atggcgaataaaatccctaagggtacgaaaacgtatgaaaacctgaaggccgcattccaaggtgaatcaatggcaaatagaagatacctatattacgctaggctagctaggcagaaggggcttaatgatatcgccgaggtctttgagaaaacagctaatgctgaaaccgggcatgcgtttggtcacttaatgtacctaggtgtggatccagtggctgagattgagataaacaccattgaagatgccttaaaggcatcaatatatggtgaaacctacgagtggactcaaatgtacccggctttcgctaaggttgccagggaggagggattcctagaggttgctgagtggcttgaggctgtggctaaggttgagagattccacgcaaacaggtttaatgaggcacttgagaagtactataagtcagctggagttaaaactgaggtagaggacgaaacattaggtagactgtaa

SEQ ID NO: 2596 - DNA, 540 bp, Elusimicrobium minutum Pei191
atgaaattaaaaggtacaaaaacagaaaaaaaccttcaaatagcttttgctggagaatcccaggcgaggatgaagtacggctactatgctaaaaaagccaaagaagaaggatatatacaaataagtaaaatctttaaagaaaccgctaaaaatgagcgtgaacacgcaaaactatggtttaaatttcttcatgaaggcaacattccttcaacgttagagaatttagaagacgctgccaaaggcgaaaactatgaatggacagatatgtatgccaacatggccaaagacgctgaagaagaaggttttaaagatatagcttttttatttaaaaaagtagctgaaattgaaaaacagcatgaagaaagatatagaaaactttttgccaacattgaaggcgacaaggtgtttaagcaggacgaaaaagttgtatggcagtgtattaactgcggttttacctgcgaaaataaagacgctccggaagtatgccctgtttgcaaatatgcaaaagcatactttgaaatcaggaagattaattattaa

SEQ ID NO: 2597 - DNA, 576 bp, Desulfovibrio vulgaris  Miyazaki F
atgaaagccctgaaaggcaccaagaccgaacgcaacatcctgaccgcctttgccggcgaatcgcaggcccgcaaccgctacgactatttcggcgcccgcgccaagaaggacggtttcgtccagattgccgacatctttgccgaaaccgccagccaggaaaaggaacacgccaagcgcctgttcaagttccttgaaggcggcgaagtggagatcgtggccgccttcccggcaggcatcatcggcgatacccacgccaacctcatcagctcggcggcgggcgaaaaccacgagtacaccgaaatgtacccctcgttcgcgcgcattgcccgcgaggaaggctttgacgagatcgccaaggtgttcatgagcatcgccgtggccgaagaattccacgagcgccgctttctgggctttgccaagaacgtcaaggaagcccgcgtgttcgtgcgcgaatcgtctgttgtgtggcgctgtcgcaactgcggattcctgcacgagggcaacgaggccccgcacctgtgccccgcctgtgcccatccgcaggcccacttcgaactgctgggcatcaactggtaa

SEQ ID NO: 2598 - DNA, 441 bp, Thiobacillus denitrificans ATCC 25259
atgagcgacgaccccttgctggacaagatggacgccctcctcaagaaacatcgcggcgccggcgagtcggctcatctcggcccgccggcagccgcgcccgctcccggccagcccccggcctggcttcccgtcctcaccgacgtgatcgaacgcggaacgccgcccgcggcgaccgaggccgcgccgcagccgcccgcgcccgccgtagaaagcgatgcgccgcaagccccggcggccagcgatgcgctcgccgaacaactgatgagcgaactcgcgccgcgcctgtcggaagtgatggagaagcaggtcgctgccgagctgcgcaagaacatcgacgagacggtcaccaatctgttgtctcagctcgacgtcaacatgcgcgagatcgtgcgcgaagcggtcgccgaaaaactaaagcaaccgcgcaagccggcgagctga

SEQ ID NO: 2599 - DNA, 303 bp, Rhodoferax ferrireducens T118
atgaacacaataccccgaaatttgcctcgttttgtacccaccctgacggaggtggtagaaccagcttcattggtcaggacagcgccgtcgacaggccgggacgttgatgaaatcatccagtccgtgatgcagcgggtcgatcgggtgcttgattgtcgtttgcgcgaggacgccgacgccatgcttcgcaacctggtgacggaacaacttcacaccttgcagttgagtcttcgggcagaactggcgcttgtcgtgcaacaagccgtggctgaggcgatggcgttgcgagaagatgatcattag

SEQ ID NO: 2600 - DNA, 330 bp, Polaromonas JS666
atgaggagctcatcgacgccgccgcgattcgtgccaacgctgaccgaggtggttcgccccacggcgccagcgggcacctccagcgagccggtagcccccgcagcgcctccgctggattcgtccggcctcgaagagcgggtggtgctacgcgtcatgcagcgggttgacctgattctggaaagacgcttgcgggaagttgtcggccaactgatcctggagcagacccagacgctggccccccgcctgcgcggcgaaatcgaattggtcttgcgtgaaaccgtgagccaggcgttggcacaggaagcctcaaaaacaccgggccggccctag

SEQ ID NO: 2601 - DNA, 537 bp, Acidovorax avenae citrulli AAC00-1
atggctgcgactccgcccaaggggcctcccaaattcgtgccgaccctcaccgatgtggtgcaggtctcgggtgatgcggtgcccggcgcagcccatggcgacgcggcgccgtccgggacggagccgccgcccgccggcgacgcccggccggccgtccccgcgggcacgccattcccggctccggttccggcttccgccgcgcctgccgctaccgaggcgtcggcggaaggcgtcccgatcgccgccgtccccgtgctcgccgctgcgccacccgctgcacccgtggagccctccgtgccgccgctcaccgccgcggatttttccggcatcgaggagatggtgatccaccgcatcatccagcgcgtggacgtggtgctggaccagcgcctgcgcgaggccatcgccacggtggtccaggagcagacccgctccatggtgccgcgcctgcgggaagaggtcgagtccgtcgtgcgccacgccgtgtacgaagccgtggcggacgaactggcctcgcccggcggccctgcgcaacgctga

SEQ ID NO: 2602 - DNA, 432 bp, Acidovorax sp. JS42
atgacaacacccaccaagaaacctcccagattcgtgcccacgctcaccgacgtggtgcagatgcccgaagccgaagggagctcggcgcgtccgtcgccgcctccggtgacacggcctgcgaccaccgctgcgtcgctctctgtgcctttgccagcggctccgcattcaccaccgcccctcgcagttcccgcgccggttgcgccgctgcctgcagggctgccctacgggtttgaggagtacgtggtgcatcgcgtgatgcagcgcgtggacgtcgtgctcgaccaacgtttgcgcgaggcgatcgcagtggtggtacaggagcagacacggtccatggtgcctcgtctgcgagaggaagtggaatcggtagtgcggcaggccgtctatgaagccgtggccgaggaactggcaggcgagcgcagcggccattga

SEQ ID NO: 2603 - DNA, 348 bp, Polaromonas naphthalenivorans CJ2
atgagccgcctgacagggccgccggctgacgtgcccacgctgaccgaaatcgtccatccggttgttgctggcggagctgcatccggcggcgccgtgggtgtggccccggcttcggctgaaatgcaggagctgatggtccggcgcgtgctgcagcgcatcgacctggtgctggagcggcgtttgcacgaggccatcgagcaactgatcctggagcatgccgacggcctcttgccgcgtcttcgggaggagattgaactggtcgtgcgtgaatccgtgagccaggcgtttgggcaggaatcggaggcctttgcggctcggccgcaaagccggcaacaggatgtgctctga

SEQ ID NO: 2604 - DNA, 336 bp, Verminephrobacter eiseniae EF01-2
atggtgctgccgcccaaaacgccgccgcgcttcgtgcccacactcaccgaagtggtgccgcagaccgacgctgcgccggccgcagccccggcccgcccattgcccgaggacaggcaagagcagctgttgcagcgcgtgctgcagcatgtggacaaactgctggaacagcgcctgcgcgaaacgctcgccgacacggtgctacccgggctgcgcgcagagatcgaagccatggtccgcgaggcggtggccgatgggcgggccgctggcgccgcaggactcagtggcgccagcggcgccatgggcacccgtggtgcatcccctgatgccaaggggtga

SEQ ID NO: 2605 - DNA, 450 bp, Leptothrix cholodnii SP 6
atgcgtccgcctcctgacatcgtcccgacgctcaccgaggtggtcggcttctccgagaccgcgccggtcgccgccgaccaggccagcccggccgccggtgcccgcggcgcgaatgtcatgcccttgaatgtggtgcccctgcattcgctcgaggtcgacctgccggtggacctgtcgaacgaccgttgcgggcccggtgcggcagatggcagcctgacggtgggtgcgttcccgatcgacgaagacgaactcacgcagcgggtcctgctcgacgtccagcgccagatcgatcgcatgttcgagttccgggtgcgtgaaagcgtcggcccggcattcgcacgcctgatggagtcgttcatcgaacagacccgcgacgaactcgccgccaccttgcgagacgtcgtccggcgggccgtggctcaggaactggcgcgacaccggtcgcgctga

SEQ ID NO: 2606 - DNA, 432 bp, Diaphorobacter TPSY uid29975
atgacaacacccaccaaaaaacctcccagattcgtgcccacgctcaccgacgtggtgcagatgcccgaagccgaagggagctcggcgcgtccgtcgccgcctccggtgacacggcctgcgaccaccgctgcgtcgctctctgtgcctttgccagcggctccgcattcaccaccgcccctcgcagttcccgcgccggttgcgccgctgcctgcagggctgccctacgggtttgaggagtacgtggtgcatcgcgtgatgcagcgcgtggacgtcgtgctcgaccaacgtttgcgcgaggcgatcgcagtggtggtacaggagcagacacggtccatggtgcctcgcctgcgagaggaggtggaatcggtagtgcggcaggccgtctacgaagccgtggccgaggaactggcgggcgagcgcagcggccattga

SEQ ID NO: 2607 - DNA, 408 bp, Variovorax paradoxus S110
atggccagcacgctgcgcacgccgccccggttcgttcccacgctgaccacggtgctcgacctccccgccgagccgcctgccgccgaggcggcaacgcccgccagcgcgccgccaccaccggcggtcgaccccgccgaagccgtggcattgcctccggccgagcagcgttccgaggccgaaatcgtccgcctcgaagagcagcttctgcaccgcgtgctgcagcgcgtcgacctgtctttggaagagcgcctgagcgacacggtctcggccgccgtgcagcagcagctcgatgcgatggtgccccggctgcgggaggaaatcgaggccgtgctgcgtgccttggtgatcgaagccatggccgccgagctctctgaaaacacagggtctacgccagcttccggcgcataa

SEQ ID NO: 2608 - DNA, 381 bp, Frankia CcI3
atgcgccatctgagctacctcgcggtcctggcgggatgcctgctcggaacggcgccgcttgaggtgtttctgggcacccgggtgtacgcccggccggttcggctgctgctgaccctcgcccccgtcatcgtgatcttcgttgtctgggacctgttcgccgtctccgcggggcactggagcttcgaccggcgccgcatcaccgggatcctgcttccggggggccttcccctggaggagctgctgttcttcgccgtggtgccgatgtgcgcgatcctgacgctggaggccgtgcgcgcggtgcggggctgggacgtcggcgacgagcccgcccatccgagcgcgacgcgttccgatgggactcccgatggtgatcggccgtga

SEQ ID NO: 2609 - DNA, 345 bp, Mycobacterium MCS
atggatcgattccactacctgctggtcctgggcgcctgtctgctggtcaccctgccgctggaggtcttcggcgccggggtgtaccgccaggccaggcgggccgccgcggcgatcctgccgatcgccgcggtgttcgtggtgtgggatctgatcgcgatcttcgccgacgtctggggctacaacccgcggttcgtcaccggcatcgggttcccgggcgtgccgatcgaggaactgctgttcttcatcgtgatcccgctgtgcgggctgttcacctacaacgcggtcgacaccatcctcacctacctcaaacggcggctgcgcgcgcgatcggcgcagtcctcatga

SEQ ID NO: 2610 - DNA, 345 bp, Mycobacterium KMS; identical to SEQ ID NO: 2609

SEQ ID NO: 2611 - DNA, 345 bp, Mycobacterium JLS
atggatcgtttccactacctgctggtcctgggcgcctgtctgctggtcaccctgccgctggaggtcttcggcgccggggtgtaccgccaggccaggcgggccgctgcggcgatcctgccgatcgccgcggtgttcgtcgtgtgggatctgatcgcgatcttcgccgacgtctggggctacaacccgcggttcgtcaccggcatcgggttcccgggcgtgccgatcgaggaactgctgttcttcatcgtgatcccgctctgcgggctgttcacctacaacgcggtcgacaccatcctcacctacctcaaacgccggctgcgcgcgcgatcggcgcagtcctcatga

SEQ ID NO: 2612 - DNA, 441 bp, Frankia EAN1pec
gtgagccgcctcggtcacttcggcggtctgggccacttcagctacctcgcggtgctgctggggtgcctggtggcgacggcgccgctggagatcctgctgcggacgagggtgtatgcgcgcccccgccgcctcctgctgtcggtggcgccggtgctggtcgtcttcgtcgggtgggatctgtacgcgatcgcgcgcggccactgggagttcgacccgcggcgcaccaccggggtgctgctgcccggcggcctcccgctcgacgaggtcctcttcttcgtcgtggtccccgtgtgtgccgtgctcgcgctggaggccgtgcgtgccgtcaccggctggcaggcgggcgacgagcgggctggcgccgaacaggtggacggcgagcaggtggacggcgagcgtgccggcgacaggccggcggacggggcccgcgggccgggatga

SEQ ID NO: 2613 - DNA, 327 bp, Acidimicrobium ferrooxidans DSM 10331
gtggggcactggttctacctcgaggtccttggcctgtgcatactggtgacgctgccgctcgaggtcctcggggcgcgggtgtggcgccagccgcgtcggctcgctctcagcgtcggcatcgtcgccgtctgcttcagcctgatcgacgccgtcgaggtgtaccagcgcctgtggcactacaaccctcgctacgtgaccggtctgcgcatcggtgatctgccgatcgaggaggtcgcgttcttcgtcgtgatcccgatctgttccctcctcacctacgagaccgtgcgacgacgccacgagctcgtcgcgcggtggcgccggcggtga

SEQ ID NO: 2614 - DNA, 348 bp, Actinosynnema mirum DSM 43827
atggaggaccgctggcactacctgctcgtcctgctcacctgcctgctggtcaccgcgcccctggaagcgctgggccggggcgtgtaccgcagggcgggcgacctggtccgggcgatctgcccggtcgtcgtggtgttcggggtctgggacctggtcgccatcgcgcgcggccactgggacttcaacacccgcttcaccaccggcgtcgtcctgcccggcggggtgccggtggaagagctgctgttcttcgtcgtcatcccgctctgctccgtgctcacctacgaggcggtgcggggcacggccgccctgctcggcgggcggcggcgcgagctggaggcggtgcggtga

SEQ ID NO: 2615 - DNA, 333 bp, Saccharomonospora viridis DSM 43017
atggatcggtggcactacctgctcgtactggcggcgtgtctggcggtgacgtcgccgctggagttgctgggcgcgcgggtctatcgacgaccggtgcgcgccgttcgggcgatcctcccggcggccggggtcttcttggcgtgggatgtgctcgcgaccgcggccggggtgtgggacttcaacggccgttacctcgtcggtgtcgaactgccgttcgggcttccgctggaggaactgttgttcttcctggtggtcccgttgtgcgggctgctcacctacgggtgtgtccaggccatgctcgccaagctgcgcgcgaacgggacggagcgatga

SEQ ID NO: 2616 - DNA, 348 bp, Nakamurella multipartita DSM 44233
gtgcagcacctgacgtacctggcggtgttgctggcctgcctgctgctcaccgcgccgctggagctcgtgctgcgggcccgcgtctacggccgctggcggcgggccgccgccgcgatcctgccggtcgccgccgtcttcgtgctctgggactacctggccaccgccgccggctggtggtggttcgacgagcagttcgtgacgggcgtgttcatcgggatcctgccgtgggaggagttgatgttcttcctggtcgtgccgatctgcgcgctgctgaccttcgaggcggtgcgccggctccggccgggctgggcggacgcggccgcaccggacctggaggcgcggcggtga

SEQ ID NO: 2617 - DNA, 1863 bp, Anaeromyxobacter dehalogenans 2CP-C
atggccgacacgaagctctggacgaggatcgccgtggcgctcgcggcggtgggggcgctggcgctggccgtgggctgcccgcccagcaagccgaagggctcgaagcgcccggccgcggcgtcggacatcgcggtggcggccgagaagacctacgtgccgccgggagatctcgacgagtactacatgttctcgtccggcgggcactccgggcaggtcttcgtctacggcatcccgtcgatgcgccacatcaccaccatcccggtgttctccccgtactcgggcacgggctacggctacgacgacgagacgaaggccatgctcggcaagctcacctggggtgacgtgcaccacccggcgctctccgagaccggcggcgactacgacgggcgctggctgttcgtgaacgagatgaacgggcgggtggcgcgcatcgacctgcgcgacttcaagacccggcagatcctcgggccggtgccgaacatctccggcaaccacgggtccaccttcatcaccccgaacagcgagtacatcctcatgtcctcgcggttctccatccccatcccgaaggggcgggcggtgtccatcgaccgctacgccagcgagtacaagggcgtcgcggccggcatcaaggtcgatccgaagaccggcgagatgtccctgggctggcaggtgctgctgccgcccttcgactgggacctcggcgacgcgggcaagaagctgtccgagggctggttcttcctcacctgctacaactcggagcgcgccaccggcaagctcgaggtcaccgcctcgcagcgcgaccgcgactacatcgcggccatcgactggcgcctcgcggagaaggccgcggcggaggggaagggcgagctcatcggcggcgtgaaggtgctcgacccgaagaacgtccccggcctcgtgtacctgatgccctgcgggaagtcgccgcacggcgtggacgtctcgcccgacggcaagtacgtggtcggctcgggcaagctccagggcgtcaccaccgccttcaacttcgagaaggtcctcaccgccatcaagaacaaggacttcgccggcgaggaggacggcatcccggtcctgaagtacgagtcgatcaaggacgcggaggtgccggtcggcctcgggccgctccacacgcagttcgggccggacgggatggcgtacacctcgctgttcgtggacagcgcgctggcgaagtggaagctcgggacgtgggaggtgctggacaaggtcccgatgtcctactcgaccggccacctcgccgcggccgagggcgacacggtgtcgccggacgggaagtggctggtgggcctcaacaagctgtcgcacggccggcacctctcggtcggcccgtcgcagcccgagtcctcgcagctcgtggacatctcgggcgacaagatgaagctggtctacgacgcgttcaccgagcccgagccgcactacgcgcagatcatcaaggcggacaagctgaagccgatcgaggtctaccccaaggaggagaacaagcacccgctggcgatctgggacgtgaaggacgccggggtgacgcgcaaggggaccgaggtgctggcgaaggtggtggtggtgcgctccagcatgacgccggcgctcatcgaggtgaacgagggcgacacggtgaaggtggcgctcaccaacatcgagcagaccaccgacgagctccacggcttcggcctgctcgactacaacatcaacatcgtcctcgatcccggcgagaccaagaccgtcacgttcaaggccgacaagccgggcgtgttcccctactactgcacgaacttctgctccgcgctccaccaggagatgcagggctacctcgtggtgaagccgaagtga

SEQ ID NO: 2618 - DNA, 1944 bp, Anaeromyxobacter sp. Fw109-5
atgtcgtcctcgaagagcgtctcgaagccactcgcgatcgccgcggtcctggtcgcggcggccgcggtcgcggtgcgctgtgcgcccagggagccgaagggagcgaggcgggaggccgccaagtcggacgtctcggtcgcggcgcagaagacgtacgtcgccccgggggatctcgacgagtactacatgttctcctccggcggtcactccggtcaggtgttcatctatggcctcccgtcgatgcgccacctcgcgaccatcccggtgttcgcgccgtaccccgccacgggctacggcttcgacgacgagacgaaggagatgctcgggaagctcacctggggcgacgtgcaccacccggcgctctccgagaccaagggcgactacgacggccgctggctgttcgtgaacgagatgaacggccggatcgcgcgcatcgatctgcgcgacttcaagacgcggcagatcatcgggccggtcccgaacgtctccgggaaccacggctcggcgttcgtcacccccaacaccgagtacgccatgatgtcctcccggttctcgatccccatccccaaggggacggccgtctcgatcgacaagtacgcgagcgagtacaagggcatcgtcgcagggatcaagatcgacccggagtccgggaagatgtcgctcggctggcaggtggcgctcccgccgttcgactgggatctgggcgacgccggcaagctcgtctccgacgggtggatgttcctcacctgctacaactccgagcgcggcaccggcaagctcgaggtcaccgcgtcgcagcgcgaccgggactacatcgcggcgatcaactggcgcgaggcggagaaggccgctgccgaggggaagggcgacctcatcggcggggtgaaggtgctcgacccgcgcaaggtgcccgggctcgtgtacctcatgccctgcgggaagtcgccgcacggcgtggacgtctcgccggacggcaagtacatcatcggctcagggaagctgcagggcgtcaccaccgccttcaacttcgagaaggtcctcaccgcgatcaagaacaaggacttcaccggcgaggaggacggcatcccggtcctcaagtacgagtcgatcaaggacgccgaggtgccggtggggctcgggccccttcacacgcagttcggcccggacggctgggcgtacacctcgctcttcgtcgacagcgcgctcgcgaagtggaagctcgggacctgggaggtcgtggacaaggtccccatgtcgtactcgaccggccacctctccgccgccgagggtgacaccgtgtcgcccgacgggaagtggctcgtgggcctgaacaagctctcccacgggcgccacctgtcggtggggccgtcgcagcccgagtcctcgcagctggtggacatctccgaggacaagatgaagctcgtgtacgacgccttcaccgagccggagccgcactacgcgcagatcatcaaggcggacaaggtgaagccgatcgaggtctacaagaaggaggagaacaagaacccgctcgcggtgtgggacgtgaaggacacgggcgcgagccgcaagggaaacgaggtggtggtgaagatgaccgcggtgcgctccaccttcacgccgcagctcatcgaggtgaaccagggcgacacggtgaaggtggcggtgacgaacatcgagcagacgacggacgagctgcacggcttcgggctgctcgactacaacatcaacctcgtcgtcgatcccggcgagacgaaggtcgtcacgttcaaggccgacaagccgggcgtgttcccctactactgcacgaacttctgctccgcgctccaccaggagatgcagggctacctcgtggtccggcccgcgcgtgccgcggcgccggccgaaggcgacgagggcggtggcgcgcgggccggccgggaggagaccaggaggggaccgcgatga

SEQ ID NO: 2619 - DNA, 2589 bp, Campylobacter concisus 13826
atgcaaaagttattttgtgtcgcaagtgctgcactgcttgggctatctttaactgctgcttgtgctgctagtagtgaccttgaaaaagtcatgaaagagcgcgggctaagcgaaaaagatgtccttgcagctgctaagacttaccagccaagcggtaaaaaagatgatttcatcgtcttttcatctggcgggcagagtggtcaagtgctagtttatggcgttccgtcgatgagaatttacaaatacatcggcgttttcaccccagagccttggcaaggatatggctatgacaatgagtcaaaagccgttttaaaacaaggcaacatcaggggcaaagagataacttggggcgatacacaccacccaaatttcactgagaaaaatggtgagtatgttggtgattatctatttatcaacgacaaggcaaacccaaggatcgctgttataaatttaaaagactttgagacaactcaaatggtcgtaaaccctatcatgaagagtgagcacggcggtagcttcatcactccaaacagcgagtacgtcatcgaagctagccagtacgcagctccacttgatgataactaccactcaatggacgactacgaagccgtttatagaggcgctgtgacattttggaaatttgactatccaaaaggtaagatcgacgagaaagcatctttctctcttgagcttcctccatactggcaagacctaagcgacgctggtaagggcgagagctacggctggggctttacaaactcaataaacactgagatgtatacaggtggtatcgaaaaaggtcttcctccatttgaggcgggtgctagtagaaatgacaccgacttcttacatgtttataactggcaaattttagaaaaacttgcacaagacaagaaaaactacaaagttataaatggtcatagagtgattacaatagaagctgctgttaaagctggagcactatttttgatcccagagtcaaagagcccacacggttgtgacgtaacaccagatggtagatacatcatcgttggcggtaagcttgatactcacgcatcagtttatgactttaaaaagatcaaagagctaatcgacaaaaaagagttcgctggcactgacccatacggcatacctatcctagatagagaaaagtcaatgcacggacaagtcgaacttggccttggaccactgcacacatcatttgactcacaagatggcatactttatacttcactttacgttgatagccaaatcgtaaaatgggactacaaaaatttaaaagtgcttgataaggtaaatgttcattacaacatcggtcaccttgatacaatggagggcaaatcagcaaaacctaagggcaaatacgcaatcgcacttgataaactttcaatcgatcgctttaacccagttggcccacttcatccacaaaaccaccagttaatagacatcactggtgcaaaaatggatctaatctatgatatgcctatcccacttggtgaaccacacgacgttgtctcaatcgctgctagcaaactaactccagcgcttacttacaacatgggtacaaactcaagaacaggcgaggctagcccatacgcaaccctagctggtcaagaaagagttgagagaaacggcaaaaacgtaactgtctatgcgacaatgatcagaagccacatcaacccagagcacatcgaggtaaataaaggcgataacgtaacaattcacctaacaaacctagagcgcgctcaagatgagactcacggctttggcatcgacctttacaacatccacgcttcacttgagcctggcaaaactgcttcagtaaatttcgtagctgatatggaaggtgtcttcccatactactgcaccgagttttgttcagcacttcacctagagatgatgggttacttacttgttaaagatccaaataaaaaatatgaatctgcaaaaaatagcaagctaaaaactctaagtccagaggctctaaaagctgagtacgacaaagtaatcgcaactaacaaagctactgatgatgttatccaagaggttgttaaatacctaaaagagaaacattatgagaaatatccaaaagtaaaagctttggttgatgacgcacttgatcaatacggccacatcaaagaggtaaaagctaaagctgacgaggcttacaaaaaaggcgacgtaaatggcgctatcctttgggagtaccaagtatggcaatacatggtaaaaactgccgacgttggtctaagagctaaaaacaacctagctaaagagatcgcaactccgatgagcccagctgctgcaaaaggcgaagaagcttatctaaaaggcggatgtaatggctgccacgttatcggtcaagtaagctcaggtccagacctaactggtgtcttgctaagacatgaaaacggcgaaaaatgggtagcagactttataaaagatcctgctaaattctataacgatgactacgttaaagcgatgattgacttctttaaacttagaatgccaaatcagcacatgagtgacgaagagatcaaaaatatcatccagtatctaaaatggatagacgaaaacgcaggtatgtag

SEQ ID NO: 2620 - DNA, 1947 bp, Opitutus terrae PB90 1
atgaaacgatccctgcataccccgctcgctctctccctgctctcgttgaccgtgctcctcggcggctgcggccgacccggaggcgatggcgcgggcaacggcaagtccggcaaagccgacgccaactccgccgcggtgaaaacctatgtcgcgccgggccagaaggacgagttctacctgttctactcgggtggtcactcgggtcagatcttcgtggccgggattccgtcgatgcggcacctgatcacgattcccgtgttcacgcccagcccgggcactggctacggcttcgatgaggaaacgaagaagatgctcggcggctacacctggggcgacgttcatcaccccgggctctcgcagacggacggtaaatacgacggtcgctggctgttcgtgaacgacaacgccaacaaccgcatcgcgcgcgtcgacctgcgggatttcaaaaccaagcagattctcgggccgattcccaattccagcggcaatcacggttcctcgttcgtgaccgagaacaccgaaaacgtcctcgtcgcgacgcgcttttccgtcccgttgccgaaaggccgctacgccgagctgaacgactacgagaaggagttcaacggcatggtcagcggcatcaaggtcgatccgcagagcggcgagatgtcggtcggctggcagattctcacgccgccgtttgattgggatctcggctcgaccggcaagggcccgagctcgggctgggcgttctggacctcttacaacacggagatggcgcacgatcagctcgaggtgaacgcctcgcagcgcgagcgcgactacgctgctgtggtgaactggaaagccgccgaagccgccgtacgcgagggcaagggcaccgacatggacggcgtgccggtaatcgatccggcgaaggtgcctggcgtcctctacttcctgccggtgcccaagtctccccacggcattgatgtcgatccgtcgggccgctggatcgcagctggcggcaagctgcagccgaccgcctcggtgttcgatttcgagaagatccgcgtcgcgatcgagaagagggatttcgagggcgagttccgcggggttccgatcctgcggttcgaatccgtgctcgagggcgaagtgccggtcgggctcggtccgctgcacacgcagtatgacggcaagggcaatgcctacacctcgctgttcatcgagtcggtggtcacgaagtggaagctgccgccgtggaccgacgagcagaagaaggatctctccaaggccgtcatcgacaagatcccggtgcatttcaacatcggtcacctggtgatcggcggttcggatacgaaggagccttacggtcgttatctggtcgccggcaacaagctctcgaaggggcggcacctcagcacgggtccgtcgcagcccgagagcagccagttgatcgacatcaccggcgaaaagatggccatgctctacgagacgttcacggatccggagccgcacttcatgcagatcctgaaggccgacgtcatcaagccgatcgaggtttatccgaaggcggagaacaagaacccgaacgccgtctgggacgcgaaggacacgagcgtcacgcgcagcggcaacaccgtcgaggtgaaggcgcttgcgatccggagtcatttcgcgccggagcggatcgatgcgcaggtgggcgacgaggtcgtggtgcacctgaccaatgtcgagcagacgcccgacatgatccatggctggggcctggccgagcacgacatcaacatcatcgtggatccaggcgaaaccaagacggtgcgtttcaaggtgacgaagccgggcgtgtttccgttctactgcacgaacttctgctcggcgctgcaccaggagatgcaggggtacctggcggtgaaacccgccagcacggcgagcaccgcgccggtgccgacgggcgctggcgccgtggccgcgatgccatga

SEQ ID NO: 2621 - DNA, 1973 bp, Sulfurihydrogenibium YO3AOP1
atgagaaaattattatttggtgcagggataatttccctgtcttcattgttaatttttggatgcccctcgaaggagcaagtaaaatcaacaggtggtgctggtggttttgaagatgctgcgaaaaaagtttatgttcctcctggacagtatgatgaattttacgctttcctatcaggaggatttaatggacaattaagcgtgtatggattaccttctggtcggttgcttaagataatacctgttttttcacaatttcctgaaaacggttatggatatactccagagacaaaacccatgcttatgacctcatacggttttgtaccctgggacgatagcgccaccaccctgagctatctcaaactaacggtgcaccagacggaagatggattttcataaatgcaaacaacactccaagaatagcaaaaatttctttaactacttttgaaacaacagaaattatcgagattccaaatgcagctggaaaccatgcttcatcttttattacagaaaattctgagtatcttactgcatctacaagatttagcgtaccaattccacagaaggatgtggaaatcaaatcttatgctcaaaattttaaaggaacgataagttttattaaacttgatcccaaggacggaaaaatgtcattagcatttcaactccttgtccctggatataattacgatttagctcactgtggtaaaggaccatctcacgattggtgtttctttacatcatacaatacagaacaagcccacaccctattagaaattaatgcatcaaagaatgataaggattatatcgcagctgtcaattggaaaaaattagaacaatgtgttgcagaaggtaaaggaaaagatgttcctacagaatactatcataacattttagatgaaactaaacatatggctacatccgaagttattaaatcagtaaaaatgttaacacctcaagattgccctgggtcaatatactatctcccaacaccaaaatctcctcatggtgttgacgtagatcctacaggagaatatataattgggggaggaaagcttgcaacagtaattcctatccattccttctctaagatgttaaaagcgatagaaggtaaacagtttgaaaaagaagtcgatggtattcccgttattaaatacgaagcagtaaatcattgtgaagttcccaaaccatgtcttggaccattacacactgagtttgatggaaaaggaaatgcttacacttcatgctttgtatcttcggaggttgttaaatatgattacaaaacttgcaaggtccttgatagaattccggtttattattcaataggacatttaatgatccctggtggagattctgctaaaccttggggtaaatatttgttagcaatgaataaaataacaaaagatagatatttaccaactggaccagaattagcacaatctgctcagctaatagatattagtggtgataaaatgaagatgttattggatttcccaactgtaggagagccacattatgctcaaggaattgctgcaagtgtaattaaagacagagtagcaaaaatttacgacttaaaatcaaatgcacaccctgatgctattaaatcagaagctgacgcaaaagttgtaagaaagggcaatgaagttcatatttatttaacaatgataagatctcactttacacctgacaatattgagggagttaaagttggagacaaagtttacttccacattacaaaccttgaacaagactgggatatacctcatggttttgcagttttgggcatgaataactcagaagttttagtaatgccaggacaaacaaaaacactcgtgtgggaacctaaaaaagaaggtgtttatccattctattgtactgatttttgctctgcattacaccaagaaatgcagggatatgtaagagtctctcctgctggttcaaatcctcaaataaaatacggaacaaataaggatctttaa

SEQ ID NO: 2622 - DNA, 1863 bp, Anaeromyxobacter sp. K
atggccgacacgaagctctggacgaggatcgccgtggcgctcgcggcggcgggggcgctggcgctcgtggtgggctgcccgcccagcaagccgaagggctcgaagcgtcccgccgccgcgtcggacatcgcggtggcggcggagaagacctacgtcccgcccggcgacctcgacgagtactacatgttctcgtccggcggtcactccgggcaggtctacgtctacggcatcccgtcgatgcgccacatcaccaccataccggtgttcgcgccgtactcgggcaccggctacggcttcgacgacgagtcgaaggccatgctcggcaacctgacctggggtgacgtgcaccacccggcgctctccgagaccggcggcgactacgacgggcgctggctgttcgtgaacgagatgaacgggcgcgtggcgcgcatcgacctgcgcgacttcaagacgcggcagatcatcgggccggtgccgaacatctcgggcaaccacgggtccaccttcatcacgccgaacagcgagtacatcctcatgtcctcgcggttctccatccccatccccaaggggaaggcggtgtcgatcgaccggtacgccagcgagtacaagggcgtcgcggccgggatcaaggtcgacccgaagtccggccagatgtcgctgggctggcaggtgctcctgccgccgttcgactgggacctcggggacgccggcaagaagctgtcggagggctggttcttcctcacctgctacaactccgagcgcgccaccgggaagctcgaggtcaccgcctcgcagcgcgaccgcgactacatcgcggccatcgactggcgcctggccgagaaggcggcggcggaggggaagggcgagctgatcggcggcgtgaaggtgctcgatccgaagaccgtccccgggctcgtgtacctgctgccctgcgggaagtcgccgcacggcgtggacgtctcgcccgacggcaagtacgtggtcggctccggcaagctccagggcgtcaccaccgccttcaacttcgagaaggtcctcaccgccatcaagaacaaggacttcgccggcgaggaggacggcatcccggtcctcaagtacgagtccatcaaggacgcggaggtgccggtggggctcgggccgctgcacacgcagttcgggcccgacgggatggcgtacacctcgctgttcgtggacagcgcgctcgcgaagtggaagctcgggacctgggaggtcctggacaaggtcccgatgtcctactcgaccggccacctcgccgcggccgagggcgacaccgtctcgccggacgggaagtggctggtgggcctcaacaagctgtcccacgggcggcacctccccgtcggaccctcgcagcccgagtcctcgcagctcgtggacatctcgggcgacaagatgaagctcgtctacgacgcgttcaccgagcccgagccgcactacgcgcagatcatcaaggcggacaagctgaagccgatcgaggtctaccccaaggaggagaacaagcacccgctggcgatctgggacgtgaaggacgcgggggtgacgcgcaagggcaacgaggtgctggcgaaggtggtggtggtgcggtccagcatgacgccggcgctcatcgaggtgaacgagggcgacacggtcaaggtcgcgctcaccaacatcgagcagaccaccgacgagctccacggcttcgggctgctcgactacaacatcaacgtcgtcctcgatcccggcgagaccaagaccgtcaccttcaaggccgacaagccgggcgtcttcccctactactgcacgaacttctgctccgcgctgcaccaggagatgcagggttatctcgtggtgaagccgaagtag

SEQ ID NO: 2623 - DNA, 1899 bp, Desulfitobacterium hafniense DCB 2
gtggaaaaaggactgtttaagaagattgtattgtccctggcagggctgctggttggcctggtcatagctgtttacttatccgcccagcttaatcccgaggcggaggcggctgctgccttcggcgggaaaaatatatctgtggacggagtgcctgacgatgtggtgcaggcggctctgaaaacctatgtgccacccggtcagctggatgagtattatatgtttgcctcagggggccattccggtaatgtcttcgtctatggtgtgccatccatgcggcggattagaacaattccggtatttacccccgagtccgccgtggggtatggctggacgacggaatccaaggaaatgcttggcgaatggagctggggggatgtccatcatcctgctttgagcgagaccaagggagattatgacgggcgctggctttttgtcaatgataatgccaacagcagggccgcccggatcgatctggattccttcaggactagtcaaattttggatattcctaatatttatggaccccacagcgctgtatttatgacacctaactccgaatactttatgctggggtcccgctttgccggaccgataccctatgggacctattctcccattgagaatttatcaaaagattataattgtgttttagcagcagtagctatcgaccccaataatggtgagatgagcgtggggtgggaagtgctgatgcccccctggtccttcgatttatcggatgccggtaagctggacagtgagggctgggcctttctgacgacctataatactgaggaggcctatgagctgctggaggtcaatgcctcccagcgggaaatggattatgtggtcgctttaaattggaaaatgcttgaacaggcggccaatgaaggaaaatacaaaatagttgatggcgtcaaaatgattgatcccctggatgtaccgggctccgtctacttggtcccggctatgaagagcccccatggtgtggatgtcacaccggatggaaagtattttattgctaacggaaaagtggctccggtagctaccgtattcagctttgagaaattcaaggaatgcattgacaacaaagacttccagggcgaggaacgaggtttcccggttgtcaattacgagaaagtaagagtggcggaagtgccggtgggcttaggaccattgcatactcaatttgacggcaacggttatgcctataccaccttattcatcgacagtactattgccaaatggagtctggacacctttgaggttgtcgacgttactccggtacattattgcccgggtcatctgtgtgctgctgagggagacactgtctctccggacggcaagtatctggtctccttaaataagctggccaaggataagttcttgtccgttgggccatcccatcccgaaagcgcccagctgattgatttaaccacggataagatgaaaatcttaatggatgttcccacagatcctgagcctcacttcgctcagatgattaaagccgataagattacgacctgggaagtttttgagaaggatcccagtcagccgggtgctgtctatgagaaagaaaatgcccgcattgaacgggatggcaacaatgtcacagtctatcaaatgggcttccgcagccgctattacccggatcatgtggaggtcaatgaaggggatcatgtgacctggtatttaaccaatacggatttcgatgaggatatcacccatggctttggtatttgtctgtatgaccttaatgcggaagcacaaccgggtgagacgataaaatttgaatttgtcgccgataaagcgggagtctatcctttctattgcaccaacttctgctcggccctccatcaggaaatgcagggctggtttattgtcaaaccaaaaggcctataa

SEQ ID NO: 2624 - DNA, 1863 bp, Anaeromyxobacter dehalogenans 2CP 1
atggccgacacgaagctctggacgaggatcgccgtggcgctcgcggcggtgggggcgctggcgctcgtggtgggctgcccgcccagcaagccgaagggctcgaagcgccccgccgccgcgtcggacatcgcggtggcggcggagaagacctacgtcccgcccggcgacctcgacgagtactacatgttctcgtccggcggtcactccgggcaggtctacgtctacggcatcccgtcgatgcgccacatcaccaccatcccggtgttcgcgccgtactcgggcacgggctacggcttcgacgacgagtcgaaggcgatgctcggcaacctgacctggggtgacgtgcaccacccggcgctctccgagaccggcggcgactacgacgggcgctggctgttcgtcaacgagatgaacgggcgggtggcgcgcatcgacctgcgcgacttcaagacgcggcagatcatcgggccggtgccgaacatctcgggcaaccacgggtccaccttcatcacgccgaacagcgagtacatcctcatgtcctcgcggttctccatccccatccccaaggggaaggcggtgtcgatcgaccggtacgccagcgagtacaagggcgtcgcggccgggatcaaggtcgacccgaagaccggccagatgtcgctgggctggcaggtgctcctgccgccgttcgactgggacctcggcgacgccggcaagaagctgtcggagggctggttcttcctcacctgctacaactccgagcgcgccaccgggaagctcgaggtcaccgcctcgcagcgcgaccgcgactacatcgcggccatcgactggcgcctggccgagaaggcggcggcggaggggaagggcgagctcgtcggcggcgtgaaggtgctcgatccgaagaccgtccccgggctcgtgtacctgcttccctgcgggaagtcgccgcacggcgtggacgtctcgcccgacggcaagtacgtggtcggctccggcaagctccagggcgtcaccaccgccttcaacttcgagaaggtcctcaccgccatcaagaacaaggacttcgccggcgaggaggacggcatcccggtcctcaagtacgagtccatcaaggacgcggaggtgccggtggggctcgggcctctccacacgcagttcgggcccgacggcatggcgtacacctcgctgttcgtggacagcgcgctcgcgaagtggaagctcgggacctgggaggtcctggacaaggtcccgatgtcctactcgaccggccacctcgccgcggccgagggcgacaccgtctcgccggacgggaagtggctggtgggcctcaacaagctctcccacgggcggcacctccccgtcggcccgtcgcagcccgagtcctcgcagctcgtggacatctcgggcgacaagatgaagctcgtctacgacgcgttcaccgagcccgagccgcactacgcgcagatcatcaaggccgacaagctgaagccgatcgaggtctacccgagggaggagaacaagcacccgctcgcgatctgggacgtgaaggacgcgggggtgacgcgcaagggcaacgaggtgctggcgaaggtggtggtggtgcggtccagcatgacgccggcgctcatcgaggtgaacgagggcgacacggtcaaggtcgcgctcaccaacatcgagcagaccaccgacgagctccacggcttcgggctgctcgactacaacatcaacgtcgtcctcgatcccggcgagaccaagaccgtcaccttcaaggccgacaagccgggcgtcttcccctactactgcaccaacttctgctccgcgctgcaccaggagatgcagggttatctcgtggtgaagccgaggtag

SEQ ID NO: 2625 - DNA, 2100 bp, Halorubrum lacusprofundi ATCC 49239
atgactacagatccgaacgcgagcgacgagcggacggcacggaccgacgaacaacgcgacgagcagtcggcgaacgcgaatgcgggcgacgcgaagacagcgggatcggccgcggacggcaccgagacggcggacgacggtccggagatcgtcgacggccggacgatcgaacacttgttgaccgatcacgaacgcgacatcgccgccaccgcggaggggaccgaggccaccgcggcgaagcggccgagcctcgatctgccgcggttggagctcggacgccgcgacttcatgaaggccggcgccgccgtcggggccatgagcggtctcgccggttgtacgagcatcctcgccgacgaggagagcaacgactcgggcgacgcggccgccagcggcgagcactcggtggctccgggcgagcacgacgagtactacgggttcctctccggcggccacaccggcgagatccgcgtcgtcgggctcccgtcgatgcgggagctgatgcggatcccggtgttccaagcggagagcgcccgcggcttcggccacgacgcgaagtcgagccagatgctggaagaggagggcggcggctacacgtggggcgacacccaccacccgcgcgtctcccagaccgacaacgactacgacggccgctggctgttcgtcaacgataaggcgaacgggcggatggcccgggtcgacttggagtacttcgagaccgacgcgatcacgaacgtcccgaactgtcagggcgtccacggggcatgcatgcagctacctgacacgcagctggtcttcggcgtcggcgagttccgcgtcccgatgccgaacgacggccgcgacgtgcagagccccgacgagtacggctccgtcctcagcgccatcaaccccgagacgatggacgtcgagtggcaagtcgaggtcgacggcaacatggacaacggggacggcgggaaggaggggcgctggttcttcgcgaccggctacaacagcgaggagggcgtcacggagtccgagatggcccggtcggaccgcgactacgtgaaggcgttcgacatccccgcgatctgggacgccgtcgaggccgggaactacgaggagatcagcggcgtgcccgtcgtcgacgggacgatggacagctcgctcaacgagggcgaccgtccgatcgtccggtacgtcgccacaccgaagagcccgcacgggatcagcgtgacgcccgacgggaactacgccatcgcctccggcaagctcgatccgagctgtacggtcatcgacatcgacgcgatcgccgaggtcgacgacccgcaggagtccatcgtcgggcagccccggatcgggatgggaccgctccacaccgcctacgacgggcgggggcacgcgtacacgaccctgttcatcgactcgcaggttgccaagtgggactacgaggccgccgtcgaggccgaggccggctccgaggagccggtgatcgagaagcacgacgtacactacaatcccggccacctcatcgcctcggagtcgtacacggcgtcgccgcagggcgactacctcgtctcgctgaacaagctctcgaaagaccggttcctccccgtcggaccgatccatccggagaacgatcagctgttccacatcggcgacgacgacgccgggatggagctgatcaaggacaagccgtcgtaccccgagccgcacgacgccagtatcgtccacaaggacaagatcgagccggcgaagacgtgggacaccgacgactacgagatcgactacgtcgccgagggcgaggagtccttcgaacgggtcgacgacagcaccgtcgagatcgagatgtgggcgcgccgcaacgagtacgccttcccggaggtcacgctgcaggagggcgacgaggtgacgctccggatctccaacgtcgagaccacgagcgacgtgatccactcgatcgcgatcccggagtacgacatcaacctcgcgttagcgccccaggacacccgtgaggtgacgttcaccgcggaccagcccggcgtgttctgggcgtactgcgcgtacttctgtagcgcgctccacctagagatgcgctcgcggatcctcgtcgaaccggacgaatag

SEQ ID NO: 2626 - DNA, 615 bp, Dechloromonas aromatica RCB
atgaataccaaacgcattctggtcttgggtatcggcaacatcctgtgggccgatgaaggcttcggggtacgctgcgtcgaagcgctgaacgacggctgggagtttccgccgcaagtgacactgatggatggcggcacgcagggcctttacctgctgccctacgtgcaggaagccgattgcctgctggtcttcgatgccgtcgattacggcgatccggccggcaagctgcgcgaagtcgtcggcgatcaggtaccgcgcttcatgggcgccaagaagatgagcctgcaccagaccggctttcaggaagtgctgatggcggccgagctgaccaacaaattgccggccgaactggtgctgatcggtgtccagccggaagaacttgaagactacggtggcagtctgcgcgacatcgtcaaggcgcagatggtgccgtccttgaatctggcgctcgactggctggagcgctggggcgtggtcggtcgtgtccgtgaaggcaaggccgaaagcctgaccgatgcggcgctggccatggacgtttacgaaggggaacggccgccggccgatcaggcttatcgcctgggcgatgcccgtttcctgaatatggaagctgcctga

SEQ ID NO: 2627 - DNA, 666 bp, Cupriavidus metallidurans CH34 uid250
atgcgcaccactccgaccgaatccacctgtcaccccggtggtgacactctgccggcccgcatcgtcgtgctgggcatcggcaacctgctctgggccgacgaaggctttggcgtgcgctgcatcgaagccctgcagcgccgctgggagttcgccgaccacgtgcagctgatcgacggcggcacccagggcctgtacctgatccagcacgtgcaggaggccgaccgcctgctcatcttcgacgccatcgactacggcctggcgcccggcaccttgaagctggtgcgagacgacgacgtgccgcgcttcatgggcgccaagaagatgagcctgcaccagaccggtttccaggaagtgctgtcgctggccacgctgaccggcaagtacccgcagcaggtgctgctgatcggctgccagccgcaggagctggaagactacggcggcagcctgcgcccggtcgtcaaggccgcgatggaggacgcactggcgctgggcgtggccgaactcgaacgctggggcgcacgccccgtcgaacgccggaccccgttggccccgcgcgaggccgtgacgttggacgagctggcgctgaccgcctacgaagcgcagcgacccgccgcggaagaagcctgccgcatcggcgacgaccggctcctggtgaaggacctctga

SEQ ID NO: 2628 - DNA, 621 bp, Rhodobacter sphaeroides 2 4 1
atgccagcatctccacccgcaagggtgctcattctcggtatcggcaacgtgctgtgggcagacgagggattcggcccccgctgcatcgagatccttgccgagagccacgccttcccctcgcaggtcaagctgctcgacggcggcacgcagggcctctacctgctgcccttcctcgaagaggccgacgccctcctcgtgttcgacgcggtcgattacggtctcgtgcccggcacgctgatgatcgcgcgcgacgacgaagtgcccgccttcatgggcgccaagaagatgagcctgcaccagaccggctttcaggacgtgctggccacggcccagcttctcgggcgctgcccggcgcggctgacgctgatcggctgccagcccgaggagctggaggattacggcggctcgctgcgcccggtcgtggcggcccagatcgcaccggcgatcggcctcgcgctggccgagctcgcccactggggcgtgaccccgctgcccggccgcagcccggccgaagggctcgccgatccgtcgctgcgccgggacgcctacgagacgggccgccccggccccgacgaggcctgccgcacgggcgacgcccgcttcttcccggaaccctgctga

SEQ ID NO: 2629 - DNA, 627 bp, Alkalilimnicola ehrlichei MLHE-1
atgggacaggaaccagacattctcgtgttgggcatcggcaacctgctctgggcggatgagggtttcggtgtgcgtgccgcagaggcgctggcggcggagtatgacctgccggaggatcgggtacggctcctcgatggcggcacccaggggttgtatctgctggagtacgtgacggccgcacaccgcctgctcgtattcgatgcggtggattacgccttgccgccgggcaccctcaaggtggttcgtggtgcggatgttccgaagttcatgggcgccaagaaaatgagccttcatcagacaggctttcaagaggtcctcgcaacggcggacctcttgggtcaactgcctgaggccctcgtattgatcggggttcaacccgaggagctggaggattacggcggtagccttcgggcgagtgtcaaggcccgggtgccggaggcactggcgattgcgttggattgccttcgcgaatggggggtatcgcccgcgccgcgctgccggtccgccaggccgcggctgaacgattccgctctggatatggcccgctacgaggcggatcggccggatgagggggcagcctgccgctatggtgatccgcgtgttctggccgttagggggcaagcctga

SEQ ID NO: 2630 - DNA, 669 bp, Paracoccus denitrificans PD1222
atgaccgcaccgcctgccagcaatgcttcggggagttcggggagggggcagatgccagcggaagcgcctgcaaatatccttgttctggggatcggcaatgtgctttgggccgatgagggcttcggggtgcgctgcgtcgaagagatggccgcgcgccatgccttgcccgaacgggtgaggctgcttgatggcggcacgcaggggctgtatctgctgccctttctggaagaagccgacgcgctgatcgtctttgacgcggtggattacggactgccccccggcacgctgaagctggtcgaaggggccgaggttccggcctttctgggcgccaaaaaaatgagcctgcaccagaccggctttcaagaggtgatcgcgaccgcccagctgctggggcgttgtccggcgcagctgatgctgatcggctgccagccggtcgaactggaggattacggaggaggactccgccccgaagtggctgcacagatcgggcctgccatcgagattgcgctggcgaagctggccgaatggtgcgttcaggccggcgagggcgcgacctcgggtcagcttgcggatccggcgatccggcgcgaggcctatgagacgggccgccccgccgcctctgatgcctgccgcgagggcgatgcgcgctttttcccgggggccggctga

SEQ ID NO: 2631 - DNA, 672 bp, Polaromonas naphthalenivorans CJ2
atgcgcaaaaatccgcccgaaaacgcctgccacggagatggtgaccagcccgaaaccatctgcgtgatgggcattggcaatgtcctgtgggccgacgaaggctttggcgtgcgctgcatcgaggccttgcagcagcgctacgagttcgccccccatgtcagcctgatcgatggcggcacgcaggggctgtacctgatccagcatgtgcaggaggcgacgcgcctgctgatcttcgatgccgtcgattacggcctggcgcccggcaccctgaagctggtcgaggacgacgaggtgccgcgcttcatgggcgccaagaaaatgagcctgcaccagaccggctttcaggaggtgctgtccctggccatgctgaccgaaaaataccccaggtcggtgctgctgatcggctgccagcccgagtacctggaagattacggcggcagcctgcggccccgggtcaaactcgcgctcgaagacgccctggcccacggactggccaccctgcgcgagtggggcgccaggccgacgctgcgcacccagcccctgagcatgcacgacgccgtcaccttttgcgaactggacctgctgcgctatgaggacgagcgcccgtccgaaaccgaagcctgccgctcgggcgatgaccgttttttccccgccaccccgcaaaccgcctga

SEQ ID NO: 2632 - DNA, 675 bp, Methylibium petroleiphilum PM1
atgagcgctcgtccgtctgctggcgactgtcacgacctaggtggcaaccctgaggcggaggtaatctgcgtcctcggcattggcaacgtcctgtgggccgatgaaggcttcggcgtgcgttgcatcgaggccttgcagcgccgctacgagttcgcgcctcacgtgcaattgatcgacggcggcacccaggggctctacctcatccagcacgtgcaggctgcgacgcgcctgctgatcttcgatgccatcgactacgggctgacgccaggcacgctgaagctggtcgagaacgacgacgtgccgcgcttcatgggggcgaagaagatgagccttcaccagaccggcttccaggaggtgctgatgctggcgctgctgacggagcagtacccgaagcaggtgctgctgatcggttgccagcctgaagagctggaggactacggcggcagcctgcggccgcgcgtcaagcaggcgctggaggacgcgctcgcgcatggggtcgacacgctgcgccaatggggcgcgaggcccgtgccgcgcaccgcgccgctgggcgagcacgagtcggtgaccttctcggagctcgatatcggccgctacgaagagcagcgcccaccggaagaacttgcgtgccgagtcggcgacgaacgcttcttcccgccagtcgctcagaactga

SEQ ID NO: 2633 - DNA, 621 bp, Rhodobacter sphaeroides ATCC 17029
atgccagcatctccacccgcaagggtgcttattctcggtatcggcaacgtgctgtgggcagacgagggattcggcccccgctgcatcgagatcctcgccgagagccacgccttccctgccgaggtgaagctgctcgacggcggcacgcagggcctctacctgctgcccttcctcgaagaggccgacgccctcctcgtgtttgacgcggtcgattacggtctcgtgcccggcacgctgatgatcgcgcgcgacgacgaagtgcccgccttcatgggcgccaagaagatgagcctgcaccagaccggctttcaggacgtgctggccacggcgcagcttctcgggcgctgcccggcgcggctgacgctgatcggctgccagcccgaggagctggaggattacggcggctcgctgcgcccggtcgtggcggcccagatcgcaccggcgatcggcctcgcgctggccgaactcgcccactggggcgtgaccccgctgcccgggcggagcgccgccgaagggcttgcggatccgtcgctgcgccgggacgcctacgagacgggccgccctagccccgatgaggcctgccgcacgggcgacgcccgcttcttcccggaaccctgctga

SEQ ID NO: 2634 - DNA, 621 bp, Rhodobacter sphaeroides ATCC 17025
atgccagcatcgctcccggacagggttctcattctcgggatcgggaacatcctgtgggccgacgagggcttcggcccgcgctgcatcgaggcgctggccgaacgccatgccttcccgagccgcgtccggctgctcgacggcgggacgcagggtctctacctgctgccgttcctcgaagaggccgacgcccttctggtcttcgacgcggtggattacgggctcgcacccggcacgctgctgaccgtgcgggacgatgaggtgcccgccttcatgggcgccaagaagatgagcctgcaccagaccggctttcaggacgtgcttgccaccgcgcagcttctgggccgctgccccgcgcgcctgaccctgatcggctgccagcccgaggaactcgaggattacggcggcagcctccgacccgccgtcgccgcccgcatcgcacccgccctgcaagtggcgctggaggaactggcggcatggggcgtcacgcccctgcccggccaaagccacgtcgagggcctcgccgacccctcgctgcgccgcgacgcctacgagtccggccgcccgtccgagatggaggcctgccgcagcggcgacgaccgcttcttcccggagggcgcctga

SEQ ID NO: 2635 - DNA, 627 bp, Xanthobacter autotrophicus Py2
atggacgacgatcggcaagttgcgcgcattctggtgctcggcatcggcaacatcttgtgggctgacgagggcttcggcgtccgcgtgctggaagcgctcgacgcttcccatgtctttcccgacaccgtcaccctgctcgatggcggcacccagggcctctatctgctcccctatctggaagaggcggacggcgtcgtcatcgtggatgcggtggattacggcctcgttccgggcacgctccatatcctcgccgatggtgaggtgcccgccgtgctcgccgcccgcaaggtgagcctgcaccagaccggcttccaggaaatcctcggcctgctcgctttgcgcggcaagacgcccgcgcgcatcgtgctggtgggcgtgcagcccgagctgctggacgattacgggggcggcctcaccgccaccatcgccgcgcaggtggagccggcggcgcgcaaggtgctcgacatcctgaaggacgagttcggcgtgatgcccgcgccccgcgcgggagagggcagcctcgtcaccgccgccgtcggccggcagtcctacgaaagcgagcgcccgagcgcggaggcggcgtgccgcatcggcgatccccgcgtcctcgccacctcccggagctga

SEQ ID NO: 2636 - DNA, 657 bp, Beijerinckia indica ATCC 9039
atgaatacagaaccgctaacaggagacgaacagaacgaggccacgatcctcgttctgggcattggcaatattctttgggccgatgagggatttggtgtccgtgtcgtggaatatctggcggagaattacaccttcccggccaaagtgcggctgatggatggcggtacgcaggggctgtttcttctctcctatctcgaaaatctggagggactggtgatcgtcgatgcgatcgatttcggcctgccgcccgcgacgctgcatgaagtgcagggtgacgatgtgccggcgaccatcggcgcacggaaaatgagcctgcatcagaccggctttcaagaagtgttggcgctcttggatttgcgtggctgcgcgcctcgtcgcctgtcgctgatcggcgtgcagccggtcaccctggacgattatggcggtggcctgacgccggaggttgcggcgcaggtggaacccgtcgcgcgacgtgtcttggagtgcttgcgcgacgattatgggcttgagaccctgagcaagacggtcgaaccgagtcaaggcgagcgtttcatggctccggctgtggcgcggacgccttacgaaacggagcggccggatgccgagatggcgtgtcgccacggcgatgacaggctgctcgcgcggttgaagggctga

SEQ ID NO: 2637 - DNA, 645 bp, Burkholderia phymatum STM815
atggcaacaacgacggcacacaccctgccccatatcgtcgtgctcggcatcggcaacgtgctgtgggcggacgaaggcttcggtgttcgggcggtggaacgactcaacgcgcgttggcaatggccggagcatgtggacctggtggatggcggtacgcaggggctcgcgttattgccgttcgttgaatcggcggaccggctcatcgtgtttgatgcagttgatttcggtctgaagccgggcacgctcgccgtgcgggaaggcgacgcggtacccgcctgcctgagcgcccgcaagttgagtttgcatcaggccggcttttcggatgtgctcgcctgcgcgcagctcagaggcaattaccccgacaatgtggtgctgatcggtgttcagccggtcgaactagatgatttcggcggcagtctgcgtccagccgtccgtgcccagatcgagcccgccattgcggtagcgtgcgaatggctgcggcggtggggtgcatcccccgttacacacgctgactgcgatgcgctagtttcgtcgttgaacgccaacggtcttgcgctgtcccgctatgagggcgaacgtccatcgccgcatagcgcgaaccggcacggcgacacgcgcttctggcatccttcggaaccgtgctga

SEQ ID NO: 2638 - DNA, 609 bp, Salmonella enterica serovar Newport SL254
atggcagaagtaacaatcttagggcttggcaacctgctttgggcagatgaagggttcggcgtcagagcggcggaaaagctgtttgaacagtatgccgataacgagaaagttgacgttgttgatggcggtacgcaggggctggcgctgctgccctggctgcaacaaaccgaaaaactgttaatcatggatgctatcgattttggtatggcgccaggttcgctggcgatgtttcgtgatgaacaggttcccgcttatctgacggcgaaaaaactcagtttacatcagaccagtttttctgaagtgctggcattgctgcaattaaccggcggccagttatcggagattgtgctgattggcgtgcagccggaatgtctggatgactatggcgggagtcttacgccgcaggtaaaggcgcaactgatgcctgcggtctatctcgcgcaggaagtgctggcgcaatggggtatcaccgcctcttcagcggccttgcccactgaaagactcaatcattacagcctgtgtatggaacgctacgaagatgaacgcccagatgcgcaaagcgcttgccgggtcggcgatattcgggtgctacagagagagaaatcataa

SEQ ID NO: 2639 - DNA, 609 bp, Salmonella enterica serovar Heidelberg SL476
atggcagaagtaacaatcttagggcttggcaacctgctttgggcagatgaagggtttggtgtcagagcggcggaaaagctgtttgaacagtatgccgataacgagaaagttgacgttgttgatggcggtacgcaggggctggcactgctgccctggctgcaacagaccgaaaaactgttaatcatggatgctatcgattttggtatggcgccaggttcgctggcgatgtttcgtgatgaacaggttcccgcctatctgacggcgaaaaaactcagtttacatcagaccagtttttctgaagtgctggcattgctgcaattaaccggcggccagttatcggagattgtgctgattggcgtgcagccgaaatgtctggatgactatggcgggagtcttacgccgcaggtaaaggcgcaactgatgcctgcggtctatctcgcgcaggaagtgctggcgcaatggggtatcaccgcctcttcagcggccttgcccactgaaagactcaatcattacagcctgtgtatggaacgctacgaagatgaacgcccagatgcgcaaagcgcttgccgggtcggcgatattcgggtgctacagagagagaaatcataa

SEQ ID NO: 2640 - DNA, 609 bp, Salmonella enterica serovar Schwarzengrund CVM19633
atggcagaagtaacaatcttagggcttggcaacctgctttgggcagatgaagggttcggcgtcagagcggcggaaaagctgtttgaacagtatgccgataacgagaaagttgacgttgttgatggcggtacgcagggactggcgctgctgccctggctgcaacagaccgaaaaactgttaatcatggatgctatcgattttggtatggcgccaggttcgctggcgatgtttcgtgatgaacaggttcccgcctatctgacggcgaaaaaactcagtttacatcagaccagtttttctgaagtgctggcattgctgcaattaaccggcggccagttatcggagattgtgctgattggcgtgcagccggaatgtctggatgactatggcgggagtcttacgccgcaggtaaaggcgcaactgatgcctgcggtctatctcgcgcaggaagtgctggcgcaatggggtatcaccgcctcttcagcggccttgcccactgagagactcaatcattacagcctgtgtatggaacgctacgaagatgaacggccagatgcgcaaagcgcttgccgggtcggcgatattcgggtgctacagagagagaaatcataa

SEQ ID NO: 2641 - DNA, 609 bp, Salmonella enterica serovar Agona SL483
atggcagaagtaacgatcttagggcttggcaacctgctttgggcagatgaagggtttggcgtcagagcggcggaaaagctgtttgaacagtatgccgataacgagaaagttgacgttgttgatggcggtacgcaggggctggcactgctgccctggctgcaacagaccgaaaaactgttaatcatggatgctatcgattttggtatggcgccaggttcgctggcgatgtttcgtgatgaacaggttcccgcctatctgacggcgaaaaaactcagtttacatcagaccagtttttctgaagtgctggcattgctgcaattaaccggcggccagttatcggagattgtgctgattggcgtgcagccggaatgtctggatgactatggcgggagtcttacgccgcaggtaaaggcgcaactgatgcctgcggtctgtctcgcgcaggaagtgctggcgcaatggggtatcaccgcctcttcagcggccttgcccactgaaagactcaatcattacagcctgtgtatggaacgctacgaagatgaacggccagatgcgcaaagcgcttgccgggtcggcgatattcgggtgctacagagagagaaatcataa

SEQ ID NO: 2642 - DNA, 609 bp, Salmonella enterica serovar Dublin CT 02021853
atggcagaagtaacaatcttagggcttggcaacctgctttgggcagatgaagggttcggcgtcagagcggcggaaaagctgtttgaacagtatgccgataacgagaaagttgacgttgttgatggcggtacgcaggggctggcgctgctgccctggctgcaacagaccgaaaaactgttaatcatggatgctatcgattttggtatggcgccaggttcgctggcgatgtttcgtgatgaacaagttcccgcctatctgacggcgaaaaaactcagtttacatcagaccagtttttctgaagtgctggcattgctgcaattaaccggcggccagttatcggagattgtgctgattggcgtgcagccggaatgtctggatgactatggcgggagtcttacgccgcaggtaaaggcgcaactgatgcctgcggtctatctcgcgcaggaagtgctggcgcaatggggtatcaccgcctcttcagcggccttgcccactgaaagactcaatcattacagcctgtgtatggaacgctacgaagatgaacgcccagatgcgcaaagcgcttgccgggtcggcgatattcgggtgctacagagagagaaatcataa

SEQ ID NO: 2643 - DNA, 624 bp, Azotobacter vinelandii DJ
atgacagcccccaacatcctcattctcggtatcggcaacctgctctgggcggacgaaggcttcggcgtgcgttgcgtggagctgctcaacgagcgctatcgcttccccgacggggtgcgactgatggacggcggcacccagggcatctacctggtgcagcacgtccagcaggccgactgcctgatcgtcttcgacgccgtcgactacggcctggcgcccggcaccctgaagatcgtgcgcgacgacgaggtgccccgcttcatgggcgccaagcgcatgagcctgcaccagaccggcttccaggacgtgctggcgctggccgcgttcagcggcgcctacccgcgcgagctgctgctgatcggcgtgcagcccgaggaactggaagacttcggcggcagcctgcgcgagccggtgcgcgcccagctggagccggcgctgcgggtcgccctggaattcctcgccgagcgcggggtggtcgccgcagcgcgcgacggcgacgccgagcgcctggctccggcgccactggccctgggccgctacgaggccggccgcccggccgaggaactggcctaccgccacggcgatatccgcttcatcccgcagcagcctctggaggacgactga

SEQ ID NO: 2644 - DNA, 459 bp, Methylococcus capsulatus Bath
atggcggaagtccccgcctcgccgatggagtcggcgttcatcaaggagctggtcaaacagtggcgagcccaggattcgtacggaacctgggagggcaagagcgacgaacagttgctcgatccgtacatcttggacaaggagaagcgcgcgtcgattcccatcatcggcgatcccgatccggaaaccttgtggcggctggagctgttttacaacgccgtgggcctttcgatcgagcgtgccaccaaggtgatggtcaccccgatgatgaagatgtcccatgaaggtttcggccgcatggtcctgatcgctggtcggctgatcgtggtcaacaagcagctgcgggacgtgcaccgctttggcttcccttccatggagaagctggccgaggagggcgaaaagctggtgaatgccggtgtcgaaatgatccgccgctatcccgatgtggcgaattacagttga

SEQ ID NO: 2645 - DNA, 477 bp, Anabaena variabilis ATCC 29413
atgaccccagaaaataacgtcaacggcactgctactagtgtcgtctctacctccccatttttgaaagcattagtcttacaaattcgcggacaagatgcttatggagtatatcgtagctggtctgatgatttactcctcaaaggctttgttgttaccaaacaaaagaaacgggaaatttccgtgcaaggagaagttgaccccgtaaccatatcacggattatgtccttctttaaggcgatcgccgccagaattgaacaagaaacaggcttaatctcccaagttgtacttgacttaagccatgaaggttttggctgggcgttagttttttctggtcgtctaatactcacagttaaaaccttaagagatgctcatcgttttggttttgactctttggagaaactggcggaagaaggagatagatatgttgcaaaaggagttgatttagctaatcgctataaagaagtaagtaagttgtaa

SEQ ID NO: 2646 - DNA, 477 bp, Anabaena variabilis ATCC 29413
atgagttcaactgaaattgttaatcaacctgttagtagcaaagctttaaattctccatttgttgaagaattggtaagacaaattcgcgctcaggattcttatggattttatcgcaattggtcggatgaattaattctgaaaccttatattgtcagcaagcaagctaaacgccaaatctctgtagagggtgatgttgagtccgctaccaaagccagaattatgtcattctatcgggcgatcgcctcccaaatcgaacagaaaactggctcactatcccaggtggttctcgatttgagtcatgaaggttttggttgggtgttggtattctctggtcggctgttgttagttgctagaactttacgcgatgctcaacgttttggctttgattcgatagaaaagttagcagcagagggtgagaaactgacactaaaggggattgagttggcggagaaatatactgaggttactaagttgtaa

SEQ ID NO: 2647 - DNA, 444 bp, Frankia CcI3
atgaccgcgaagaccggtttcctcggcgacctggtcgaccagctgcgcgccggggacacctacggccaactggaacggttctccgacgaggacctgctccgcccgttcatcgtcacgcgggagcagcgccgcgagatcgcggtgaactgcgacatcgacgccgccgtagagggccgggtgcgctccttttaccaggcggtcgcggcggccaccgagaaggcgaccggggcgttcaccaccaccgtgctcgacctcagccacgaggggttcgggcgcgtgatcatttgtgccgggcggctcgtcgtcctctccgacgcgctgcgggacgtgcagcggttcggcttcggctccatggacgagctctccgcccggggcgagtcgctggtgaccggcgcgaccaagcagatcgaacgatggaacgaggtggcccgcgatgactcctga

SEQ ID NO: 2648 - DNA, 465 bp, Rhodopseudomonas palustris HaA2
atgaccgaagtagcaaccacggccgacgcggcgatcgactcgctgttcgtcaaggagctggtcaagcagctccgcgcccaggacacccacggcgtctgggagaacaaatccgatctcaagctgctcgagccctacatcatcgacaaggccaagcgccgcgagatcccgctgatgggcgatccggatcccgagacgctgtggcggctcgagctgttctacaacgcggtggcgctgtcgatcgagcgcgagaccaagatcatggtgtcgccgatgatgaagatgcatcacgagggcttcggccggatgatcctcagcgccggccgcctgatcgtcgtcaacaagcacatgcgcgacgtccaccgcttcggcttcgacaatctcggcaagctcgccgaggagggcgacaagctggtcgatgccggcgtcgagatgatccgcaaattccccgacgtcgcggcgctgtga

SEQ ID NO: 2649 - DNA, 468 bp, Rhodopseudomonas palustris BisB18
atggttgaggcatcggtcgccgaacgcgatcccgcgctggactcggtcttcgtcaaggaactgatcaagcagtggcgcgcccaggacacccacggcgcctgggagggcaagagtgacttcaccctgatcgagccctacatcatcaccaaggagatgcgccgcgagattccgatcgtcggcgatccggatccggaaacgctgtggcggctggagctgttctacaacgcggtgtgcctggcgatcgaacgcgagaccggcctgatggtgtcgccgatgatgaagatgcaccacgagggctttggccggatgatcctcgccgccgggcggctgatcgtcgtcaacaagcagctgcgcgacgtgcatcgtttcggcttcgacagcctcgccaagttggccgaggagggcgacaaattcgtcacttccggcatcgagatgatccgcaaatatcccgaagtcgccgcgtattga

SEQ ID NO: 2650 - DNA, 498 bp, Burkholderia xenovorans LB400
atggctgaagccaccgctgaatcatccgtagttccgggcacggccagcgacgaaacgctgctggcgacgccgttcgtgcaacatctggtcaagcagttgcgtgcgcaggacacgcacggcgcgtgggacggcaagtccgacctgcaactgctcaagccgtacattcacacggcggaggaacgccgcgcgattccgatcatgggcgaccccgatcccgaaacgctgtggcggctcgaaattttctacagcgcgatcgcggtggcgatcgagcgtcagaccggccagatggtctcgccgatgatgaagatgagccacgagggctttggccgcatggtgttgatcgccggtcggctggttgtcgtcaacaagcagttgcgcgacgtgcaccggtttggcttcgcgtcgctgcagaagctcgccgaggcgggcggcaagtttctcgacgaagcggtcgggatgatcaggacgtatcctgccgtcgcacagtacggcgcctga

SEQ ID NO: 2651 - DNA, 468 bp, Rhodopseudomonas palustris BisB5
atgaccgacgcaacggcaaccgccagtgacgctacgatcgactcgctgttcgtcaaggagttggtcaagcagctccgcgcccaggacacccacggcgtctgggagagcaagtccgatctcaagctgctcgagccgttcatcatcgacaaggcgaagcgtcgagagatcccgctgatgggcgatcctgatcccgagacgctgtggcggctcgagctgttctacaacgcggtggcgctgtcgatcgagcgcgagaccaggatcatggtgtcgccgatgatgaagatgcatcacgaaggcttcggccggatgatcctcagcgccggccggctgatcgtcgtcaacaagcacatgcgcgacgtccatcgcttcggcttcgacaatctcggcaagctcgccgaggacggcgacagactggtgaacgccggcgtcgagatgatccgcaagtttcccgaggtcgcggcgctctga

SEQ ID NO: 2652 - DNA, 513 bp, Polaromonas naphthalenivorans CJ2
atgaccgaacaagccagcattgaaactcccgtgacgcccgtaacgcctgcgtcccccgccagcgacgaggccctgatgggcaccgccttcgtgcagcaactggtcaagcagctgcgcgcgcaggacatccacggcacctgggaaggcaagaccgacctggaattgctcaagccctacatccacacggccgaagagcgccgcgcattgccaattttgggcgacccggaccccgagacgctgtggcatctggagattttctacaacgccattgccgtggccgtcgagcgcgaaaccggccagatggtctcgccgatgatgaagatgagccacgaaggctttggccgcatggtgctgatcgccggccgcctggtggtggtcaacaagcagctgcgcgacgtgcatcgcttcggtttcccgtcgctggccaagctggcggacgcgggcggcaagttctttgacgaagccgtcgccatgatccgcgcctacccggccgtggcccagtacggagcctga

SEQ ID NO: 2653 - DNA, 471 bp, Bradyrhizobium BTAi1
atgtcagataccgcagtcgtcgcagaagtcgtcccggccgagcagcggcccttcgtcaaggaactgatcaaggtctggcgcgcccaggacacccatggcgcctgggagggcaagaaggacatcgacctgctcgagccctatatcctggacaaggagaagcggcgggcgctgccgatcatcggcgatcccgatccggagacgatctggcggctcgagctgttcttcaacgcggtcgcgctgtcgatcgagaaggccaccggcgtgatgatctcgccgatgctgaagatgagccatgagggtttcggccgcatggtgctgatcggcggccggctgatcgtggtcaacaagcagctccgcgacgtgcaccgtttcggtttcgacaatctcggcaagctggccgatgagggcgacaaattcgtcaacgccggcgtcgagatgatcgagaagttcaaggacgtcgcaaactactaa

SEQ ID NO: 2654 - DNA, 471 bp, Xanthobacter autotrophicus Py2
atgtccgaagcagcgcaagtgatcgagccggtatcggccgaagacaatcccttcatcaagcaactcatcaaggtctggcgtgcccaggacacccatggtgcttgggaaggcaaggcggacctggatctcatcgccgactatatcgtcgacaaggaggcgcggcgcgccctgcccatcatcggtgatcccgatcccgagaccatctggcgcatggagctgttcttcaacgccgtatgcctgctgatcgagcgggagaccaaggtgatgatcacccccatgctgaagatgagccacgagggcttcggccgcatggtgcttatcggcggtcggctgatcgtggtcaacaagcagctgcgcgacgttcaccgctatggtttcgacaatctcggcaagcttgccgaggaggggacgaagttcgtgtcctcgggtgtcgagatgatccggaagtttccggaagtggccaactactga

SEQ ID NO: 2655 - DNA, 468 bp, Frankia EAN1pec
atgaccgcaccggcccccaccgcaggcggccagttcgaggggttcctgcgggatctcgtcgaccagctccgcgccggcgacacctacggcaacctcgaccgactgcccgacgcgcagctgatcagcccgttcattctgacccgcgagcagcggcggcagatcgcctccaactgcgacatcgacgccgtcatcgaggggcgcgtgcgctccttctaccaggccgtcgccgcctcggtggagaagacgaccggggtcatcaccaccaccgtgctcgacctcaaccacgagggcttcggccgggtgatcgtgttcggtgggcggctggtggtgctctccgacgtcctgcgcgacgtccagcgcttcggcttcaactcgctcgaggatctcgccgcccgtggcgaggccatggtcaccgccgccgccaagctcgtcgaccagtggagggaggtcgcccgcgatgactcctga

SEQ ID NO: 2656 - DNA, 480 bp, Leptothrix cholodnii SP 6
atgaccgaagcgaccgcagttgaagcccccagcgaagaagcgctgctcaaggatccgttcatcgtggagctgatcaagcagatccgcgcccaggacacccacggcacctgggaaggcaagagcgacgccaagctgctcgagccctacatcctcaccgccgaacagcgccgcgcgctgccgatgatgggcgacccggatcccgacacgctgtggcgcctggacctgttccacaacgccatcggcctgtcgatcgaacgcgccaccggctgcatggtcagcccgatgatgaagatgagccacgagggcttcggccgcgccgtgttgaccgcgggccggctgatcgtcgtcaaccgccatctgcgcgacgtgcaccgcttcggctacgccagcctggccaagctcgccgaggccggcaccaggctggtcaacgaaggcgtgggcatggtcgagaagtacaaggaagtggccacctacggctga

SEQ ID NO: 2657 - DNA, 471 bp, Beijerinckia indica ATCC 9039
atgtctgaagcggcagtagcaacgcctgatttggcggcgatggatacggtttttgttaaggaactcgtcaagcagtggcgcgctcaggatatgcatggcacctgggagggcaagagcgattttgatctgatcgagccttatatcgtggacaaggtgaagcggaaagaaattccgatggttggcgatccggatcctgagacgatctggcgccttgaactcttctacaatgcgatcggtttgaccatcgagcgcgaaaccggttgcatggtttcgccgatgattaaaatgtcgcatgaaggctttggccgcatcattctcatggccggccgtttgattgtcgtaaacaagatgctgcgtgacgtgcatcgctatggttacgacaatctgaataaattggctgatgagggagcaaaggcggtcgccgcgggtgttgcgatgatcgaaaagttcccggaagtcgcgaaatactaa

SEQ ID NO: 2658 - DNA, 465 bp, Rhodopseudomonas palustris TIE 1
atgaccgaagccaccactgctccagacgccgcgctcgactcgctgttcgtcaaggaattggtcaagcagctccgcgcccaggacactcacggtgtctgggagggcaagtccgatctcaagctgctggagccgttcatcgtcgacaaggccaagcgccgcgagatcccgatcatgggcgatccggatccggagacgctgtggcggctggagctgttctacaacgcggtcgccctgtcgatcgaacgcgagaccaggatcatggtgtcgccgatgatgaagatgcaccacgagggcttcggccggctgatcctcagcgccgggcggttgatcgtcatcaacaaacacatgcgcgacgtccatcgcttcggcttcgacaacctcggcaagctggccgaggagggcgacaagctggtcgccgccggcagcgagatgatccgcaaataccccgacgtcgccaacctctga

SEQ ID NO: 2659 - DNA, 468 bp, Acidithiobacillus ferrooxidans ATCC 53993
atgcctgagaatactgcaatggcggcgcttttgccggaagagtccctgttttttcgcgaactggtcaagcagtggcgggcacaggatagctatggtacctgggaaaaaaagtccgacatggagctgctggcaccctacgtgctggataaggagcagcgccgggcaatacccatcattggtgaccccgatcccgaaatactttggcgggtggaacttttttataacgccgtggggctggctacggagcgtgcttccggagtcatggtgtcccccatgatgaaaatgagtcatgaaggctttggccgcatggtgctgattgccggacgtttgatcgtggtcaacaaacagttgcgcgatgtgcatcgttttggtttccccagcatggaaaaactggccgaagaaggtgacaaactggtggcaggtgccctggaaatgatcgagaaatttccggaggtggcccgcttttga

SEQ ID NO: 2660 - DNA, 477 bp, Methylobacterium sp. 4-46
atgtccgagaccgccaccctggagcgcgcccccgaggaggccgccctcgccacccccttcctcaccgccctggtgcggctgctgcgcgcccaggacagctacggcgcctgggagaagaagccggacgcccagctcctgcgggacttcatcgtctcgaaggagcagcgccgccagatcccgatcatgggcgatcccgacccggacgtgctgtggcgggtcgagctgttctacacggcggtgggcctcgccgtggaggcgcgcgccgggctgatcgccagcccgatgatgaagatgagccacgagggtttcggccgcgtgctgctcacggcgggccggctcatcgtcctcaacaagtacctgcgcgacgtgcaccgcttcggcttcgagagcctcgccaagctcgccgaggccggcggcagggcgatcgacgaggcggccgccatgatcgcggcccatcccgacgtcgcccgcatctga

SEQ ID NO: 2661 - DNA, 462 bp, Gluconacetobacter diazotrophicus PAl 5 JGI
atgtcgcaagccggtgtgattgacgatccgatggcgacctcgttcatgaaggcgctggtcgggcggatccgtgccgaggacatgtacggggcctgggaacgcaagacgaatgaaatgctccttgacgattatatcgtcagcaaggaggagcggcggaccatgccgatgatcagcgaccccgatcccgacacgctggcgcgggtcgagacgttcttccaggccgtcggcctcgccatcgagcaggagacggggctgatcgcctcgccgatgatgaagatgagccatgagggattcggtcgcgtcatcctgacgaccgggcggctggtcgtcttcatgaagaccctgcgcgacgtgcatcgcttcggtttcgacagcctgtccgccctggcggcggaaggggcgaaggccgtgaatgcggcggtggccgaaatcaaccggtttcccgaagtggcccgggcgtga

SEQ ID NO: 2662 - DNA, 468 bp, Methylocella silvestris BL2
atggttgagaccgtagacgtcgcggaagtccccgcagtcgactccccgttcgtcaaggagttgatcaaacagtggcgcgcgcaggacacgcatggaagctgggacaacaagagcgatcttgatctcatcgcgccctatatcgtcgacaaggaagcgcgcaagcagctcccgatcatcggcgatcccgacccggaaattctgtggcgggtggagcttttcttcaacgccgtcggcctcgccatcgagcgcgccaccggctgcatggtctcgccgatgatgaagatgagccatgaaggcttcggccgtcaggtgctcatggccgggcggctcatcgtcgtcaacaagcagctgcgcgacgtgcatcgcttcggcttcctcacacttgaaaagcttgccgaggaaggcacgaaatatgtgcagcagggcgtcgagatgatcgaaaaatttccggaagtcgcaaaatactga

SEQ ID NO: 2663 - DNA, 480 bp, Cyanothece PCC 7424
atgacaacaaccaccacaactaatccagaagcagacgctatttttatcgctgagaatgagtttctaaaagaactggtacagcaaatccgatcgcaagatcattatggagtttttcgcaattgggaagatagattagttctggctaactttattgtttccaaaaagaaaaagcgggaaattgctgttactggagaagttgatccagcaactcaattaagaattttatcgttctatcgagcgatcgctgctagaattgaaaaaagcactggaaaattatgtcaagttgtcctagatttaagtcatgaagggtttggctggagtttaatttggagtggtcggttaatggtgacttgtcggacgttaagagatgctcatcggttcgggtttgaatcctatgaaaagttagcggctgatggagaaaaactggtcaacacaggaatcgaattgattgagaaatttcctgaagtggctaatatttaa

SEQ ID NO: 2664 - DNA, 471 bp, Cyanothece PCC 8801
atgactacaaccgccttagaaaatccagcccaatttgtagctgagaatgaatttttacaagaagtcgtcagacaaattcgtgcctacgatagctacggcttttatcgcagttggagcgatgaattagtcctctctccttttgtagtttctaagaagaaaaaacgggaaatttcaacagaaggagatattgaccccgctaccaaattaagaatcctttgtttttaccgaggaattgctagtttgattgaaaaagaaacggggcaactatgccaagttattgtcgatctaaatcatgaaggatttgggtgggcattagtttggagtggacgcttactctcggtttcccgtacccttagagatgcccatcgtttcggatttgaatccttagaaaagttggcagaagaaggagaaaaactgagtaaagctggtattgaattaagccagcgtttccctgaagttgctcgcctctaa

SEQ ID NO: 2665 - DNA, 468 bp, Acidithiobacillus ferrooxidans ATCC 23270; identical to SEQ ID NO: 2659

SEQ ID NO: 2666 - DNA, 474 bp, Cyanothece PCC 7425
atgaccaccagcacccccaccccagccgtagatcctgacgttttaagccatcccctgctcaaggcgatcgtggctcaaattcgcgccaatgatccctatggcacctaccgcaactggtccgatgaattgttgctcaaaccctatatcgtcagcaaggcccagaaacgggaaatttccgtcgaaggcgaggttgatccgatcaccaaagggcgaattatggccttttaccgggcgatcgcccatcagattgaagtgtccacaggcatgctctcccaggtggtgatcgatctgagtcatgaagggtttggctgggctttagtcttttctgggcggctgttactggtctctaaaaccctgcgagatgcccaacggtttggatttgattcctttgaaaaaatggttgccgaaggagacaaattgattcagtccggtattgccctggcccaacgcttccctgaagccagccattactag

SEQ ID NO: 2667 - DNA, 483 bp, Methylobacterium nodulans ORS 2060
atgtccgagaccgacaccctggagcgggcgcaggcggccgacgcggccgcgttggcgacgcccttcgtcaccgccctggtgcgcctgcttcgcgcccaggacagctacggcgcctgggagaagaagccggacgcagtgctcttgaaggatttcatcgtctccaaggatcagcggcggcagatcccgatcatgggcgatcccgacccggacgtcctgtggcgggtcgaaatgttcttcacggcggtcggtctcgccgtggaggagcggacgcagctcatcgcaagcccaatgatgaagatgagccacgagggcttcggccgcgtgctgcttaccgccgggcgcctcatcgtcctgaacaagtacctgcgggacgtgcaccgcttcggcttcgagagcctgaccacgctcgccgaggccgggaccaaggccgccgacgaggcggcggccctgatcgaagcccatcccgacgtcgcccggagctga

SEQ ID NO: 2668 - DNA, 471 bp, Cyanothece PCC 8802
atgactacaaccgccttagaaaatccagcccaatttgtggctgagaatgaatttttacaagaagtcgtcagacaaattcgtgcctacgatagctacggcttttatcgcagttggactgatgaattagtcctctctccttttgtggtttccaaaaagaaaaaacgggaaatttcaaccgaaggagatattgaccccgctaccaaattaagaatcctttgtttttaccgaggaattgctagtttgatcgaaaaagaaacaggtcaattatgtcaagttattgtcgatctaaatcatgaaggatttgggtgggcattggtctggagtggacgcttactctcggtttcccgtacccttagagatgcccatcgtttcggatttgaatccttagaaaagttggcagaagaaggagaaaaactgagtaaagctggtattgaattaagccagcgttttcctgaagttgctcgcctctaa

SEQ ID NO: 2669 - DNA, 645 bp, Brucella suis 1330
atgcgcaaggctggaaccatacaatgtgacgggcagcgcatcgcgctttctgcaatgggacgcaagcgtcctaaagagcagaaaaagcccacgctaaccgccgcctctgtccgtgagacatacgagatagagccgggcgaaaaggtggagatcaatccggcggaatccccacttgccatgctttatcggcgccggaacgccgatggccgcgcctttatttcggaggatgaattccgtgcgggcgagcgcctgcgcgctgatttcacgcgggggtcgctcatgccttccgttacgtcgcgctgggatgtccaggccgggtcgggcgggcattatggggcaggcggcatggctgaactgaccgatatcgcccttgcaagccggataagggtggagcgtgcgctggaagctgtcgggccggaactgagcggcattttgatagacgtttgctgctttttgaaaggactggaaacagtcgagcgtgagcgtcaatggccggttcgttctgccaaggtgctgctgaaagcggggcttgccatgctgcatcgccattataatcctccgcgcgaaggcgaaaggcgaaggggggcagtcctgcattggggggcggaggattatcgccctgagattcgaccgcggagtgtgtga

SEQ ID NO: 2670 - DNA, 642 bp, Rhodopseudomonas palustris BisB18
atgacggaccgcaaccgcaagcccgcgcgccacgccgccgaggccgcgcggtccgctgcgacagcggaggccggcgaggcgatcgacggctttcgcgcccggcatctggaactggcgcgccgcgaggtgatgaccgcagcggggttgtccaaggtgacggtgaacgacggcgagagcccgctggcctggctcgcccgccgcaagggccgcgacggccgcgccatgatcacgccgacgcaattcatcgccggcgaaaagctgcgcgccgatttcacccgcgggcaattgacgccgcgggtgacatcgaactgggatgcgccgagcggacggcagcgtgccgcgggcggcggcggcggcgagatgaccgatgtggtgatcgcgtcgcggcagcggctgcgcgcggcgctgcaggcttgcgggccggaattcgccgggctgctgatggacgtgtgctgttttctgcgcggcctcgaagaggtcgagagccaacgtggctggccgtcgcgctcagccaaggtggtgctgcaactggcgctggatcggctggcgcggcactacggcctcgacgaccaggccaccggcgccgccgcggcgcggctgcgcagttggatggccgacgacgccggtttcagcgccggctga

SEQ ID NO: 2671 - DNA, 819 bp, Mesorhizobium BNC1
atgaagcggccgacgaccaaaaaaagcctgccggaaaaggagaggcggcgcgtcctgcgctttctggccggcggagaggcgcagatacgatccgcggccaaagaaggcatgctgctgctggacgcaggtgagcgcggaatgatcgccgccagcccgcccgtcctttccaaccttgtcacagagaggctcgtggtccgagcggacgcgcggctttccctttccgccgagggacgagcggcattgcggcgcgacgcgcatccggacgcgccatttcgcgctcagcatatggagcttgaaacggagattgccgtcgtgggcaatggcgagcagatcatctgcaaaaatctggcagaatccccgctcgcccagcttgcccgccgccggacgcgcggcggtgagccattcctggccccgagcgagtttcgggcaggcgaaaggctgcgggccgactacacgagggggcaaatcatgcccaagatcagcgccaactggagccaagcggtcgcagatgcgaggcgcgggagcaacgagaacgggattgctgaactgacggatgcggcgctcgccgcccggcaaagggttgaaaacgcgttgacggcggtggggccggaactggccggtgtgctggtcgatatctgctgtttcctgaagggacttgagcaggtggaaatggaacgcggctggccggtacgctccgccaaggttgtgctgaaggccgctcttgcggcgctcagccgtcactacgaaccaccatgccctagacgcggctcgaaggtgcttcactggggtgcggaagggtatcgcccggtgctgcggtag

SEQ ID NO: 2672 - DNA, 714 bp, Maricaulis maris MCS10
atgagcgcgccgcgctggatgcgcgccctggcccggccgggcgcccgcatggtgccgcccggggatatcgaggcgagggcggtggtgctgccgcaaggagatcgccgccgccgcccgacctcacgcctgtcgcccagccgtttcgaggaggcgatgcgctgtggctggctggccaggcgggacaatggcctggtcctgtccgccgacggtcaagcggccctgaaagctggtacacgcggagaagaccccgacccggccagtcgacatcgtgagatggaggaacggccggtgatggaccgggaaggtcacgtctcaacagccagggccaatcgccgggaaggcccgctcggtccctggctcgatggcctcgagcctcatcagcgccaggccggcgagcgctttatcgccgactatcaccgatcaaccctgatgagcccggtcacccgcaactggtcccccaccgcccagcgccgcagcgagggccgccgtcatggtcccgaggacgcagcggtaagcgccctggccgccaaggagcgggtgatgaatgcgctggacgccctcggccccgccttcgcccgcgtcatcgaagccgccctggtccacgaagacagcgccgcagcgctggagcgccgtttcggctgggcggcaaggtccgggcggaccgtgctcggcctggcgctgacacggctggcggagatctatcggctggtttga

SEQ ID NO: 2673 - DNA, 795 bp, Brucella ovis
atgacgaggcagatttcggcagcggaaacgcgcattatccgttttttgaagcagggcggttgcgagcttcaggattcggttcgcgaaacgcacgctttgctggttggcgaacaggggactattgcggcttcgcgccttgaaatcgaacggatgcgcaaggctggaaccatacaatgtgacgggcagcgcatcgcgctttctgcaatgggacgcaagcgtcctaaagagcagaaaaagcccacgctaaccgccgcctctgtccgtgagacatacgagatagagccgggcgaaaaggtggagatcaatccggcggaatccccacttgccatgctttatcggcgccggaacgccgatggccgcgcctttatttcggaggatgaattccgtgcgggcgagcgcctgcgcgctgatttcacgcgggggtcgctcatgccttccgttacgtcgcgctgggatgtccaggccgggtcgggcgggcattatggggcaggcggcatggctgaactgaccgatatcgcccttgcaagccggataagggtggagcgtgcgctggaagctgttgggccggaactgagcggcattttgatagacgtttgctgctttttgaaaggactggaaacagtcgagcgtgagcgtcaatggccggttcgttctgccaaggtgctgctgaaagcggggcttgccatgctgcatcgccattataatcctccgcgcgaaggcgaaaggcgaaggggggcagtcctgcattggggggcggaggattatcgccctgagattcgaccgcggagtgtgtga

SEQ ID NO: 2674 - DNA, 792 bp, Ochrobactrum anthropi ATCC 49188
atgaccacccaattgttagcgtccgaagcgagaattatgcgctttctgaaaaatggcggctgcgaggttcaggattccattcgcgcttcgcatgtcttgcttgcaacggatcaggggaccatcgctgcttcccgcgccgaattggaggccatgcagaaaaagggattgctgtattggaatgaggaacggcttgtttcatcgcagcccactatcaagcgcgcaaaggaaggcggcaagccgttgcgcaacccggcaagaaccttgcagacgattgactatgagcagggcgaaaagattgagatcaatccagaggaatcgcctcttgcgatgctctacaggcgcaagaatgcgaatggttcttcctttatctcggagagcgagttccttgccggtgaaaggctgcgggccgacttcacacgcggatcgctgatgccgtccgtcaccatgcgctgggacaccagtgttggcggcgggcgcagcgggccgggcggcatggcagagctgaccgatatcgcgctggccagccgcatccgcgtcgagcgggcgctggaagcagtcgggccggaactgaacggcgttctggttgatgtctgctgcttcctgaaagggcttgaaaccgtggaacgtgagcggcaatggcccgttcgttctgccaagatgctgctcaaggtcggtctggccgcgctgcaccggcactacaatcctcaactcgaaaaggagcggggcagaggcgctgtcctgcattggggagcagacgactaccggccgcaaatgcgtccgcagaatatgtga

SEQ ID NO: 2675 - DNA, 807 bp, Parvibaculum lavamentivorans DS-1
gtgagcgcctcaaggcgggaccgcgccttcgagcgcgaggtgcggcgcgtcttccgccatttcctggagccgggcgcccgcgcgggcacgctgccggatggcggcatcggcctctacgggccgcgaggaggaaagcccgcgataaagacggaacagacattctggtcgctctgcgaggcccgcgacctggtgacggccgggacgggagacgacaaaggtttctggaggccaagcgaggcaggccgtgccttttatcgccggctggtggcagaggcggaccctttcggggagcagcaccggctgatgggcacgagggtgctgcgcgatgcgggcggcggcgaggcgcggctgccggtcaacgaagctgaatcgccgctcgcctggctgcgccaccgcaagggcgcggacggacagcacctgatcgacgcaacccaattcgaggcgggcgaacggctgcgcgccgacttcaccgtcggacaactgacgccgcgcgtgacggcggactggtcggcggtgacggcgagcggcaagcgggcgcgcgatcccgccgaaatcgccgatcacgcgctggcggcgcggcaacgcgtgaaccgggcgctggtggcggtgggcccgcgcctctccgatattctgctggcggtctgttgccatctggaagggctggaagcggcggagcggagcttcggctggccgaaacgctcggccaagctcgtgctgcagatcgcgctcgaccggctggcggcgcattacggcatgacgaaggcgagtgatcaggcggtggcggcgacggcgcgcgcgtccgactga

SEQ ID NO: 2676 - DNA, 543 bp, Xanthobacter autotrophicus Py2
atggcgccccgcaagacgtcctcccccaaggtccagccccgccgcgccgccccggcggatgccgccgcgccgcagatgaacctcgcggaaagccccctcgcctggctggcccggcgcaccggcaaggatggccgcgccctggtggacccgacccagcttatcgccggcgagcggctgcgggcggacttcacccgcgcccagctcaccccgcgcatcaccagccgctggagcgaggtgtccggcgccggcacgccggaggccttcaccgacatggtgctggccgccaagctgcgcgtcgcccgcgccatgacggcggtgggaccggaactgtccggcgtgctgctggacgtgtgctgcttcctgaaggggctggaggcggtggagcgcgagcggttgtggccggcacgcaccgccaaggtggtgctgggcctcgcactcgaccggctcgccgtccattacggcctcagcggatcgacccagggccgcgcccgcgccccggtgcgcagctggcacgccgcaccggagacgcccgcgcaggggtga

SEQ ID NO: 2677 - DNA, 714 bp, Caulobacter K31
atgagcggggtgttcgaacaggccctggaggccgaacacctggccgcccgcgccgagcgcctgctgcggcggccgggggcgctgatcgaggtcaagggcctgggctatgtggtgcgcttcgggccgcgccgtcgggccatgctgacggtggacgaggcggccttccgggtgctggcccgcgacggggcgctggcgtcgcgccgcgagggcggttggcggctggtcaagccggcggcgccgcccacgccgccgcccggacgtccgggcgtgatcgagggtgaacgcgtggtgatcgagggcagcaacgagcacgtggtgctcaaggccaatctcggggagtcgcccctggcctggctggcccggcgcggcgggctcgagccggtggaggccgcggccggcgagcggctgcgcgaggacttccagcgcgcggggtcgctgggtcgcctgaccatggattgggacgcccagccgcgttcgacgggcggcagcggtccgcgcctggacccggcgttgcgcgcccgagcggccaaggaccggatcgccgcggccctggcggcggtggggccgggcctgcgcgagatcctggaacgggtgtgcctggcggagacggccctgcaggtggcggagcgagagctggggttgccgaggcgggctgggaagacagtgctgaagttggcgctgcaacggctggcgacgcactaccggatggggtga

SEQ ID NO: 2678 - DNA, 852 bp, Agrobacterium vitis S4
atgggcgcgatgcgtaagcccacagctcattcgccgcaaaatccggcatccgccatcaagccgctgctgcggctgttgcggctggcaagccgcggtgtgttgttggagccagccggtcccggcgaaaccgcgctgctgcggccccaggatggcgtactgctgggccgcgtacccgatgcgctgttgcacaaggcgctggcggatggtctggttcggcgcaaaggcaatgcgctcgccgcgaccggcgaggcggaaagcttcctcaaacgagccatggccgagcgtgaagacgagatctttgcaggccagcatggggagagggcgaccgagaccctggtggagtcggatggcagccgctccaccgtccggcgcaatcttgatgaccagcctttttcgacggtggcccggctgcgggaccggactggcaagccctatctgccaccggaagcggttgccgccggggagcggctggcagcggatttcgagcgcggtcatttacagccacgcatcaccgcatcctttgagccgcgcctggcgcaaaagcacaaaggcgcccggccatccgggccggatctgaccgacagcgcgcttgccgcacggctgcgggtcggtgaggcactgacggctttagggccggagttgtcaggcgtcgctcttgatatctgctgttttgccaagggtcttgaagccgtagagcgagagcgccaatggccggcccgctcggccaaactgatgttgcggacagcacttctggcgctggcccgtcactatacaccaccaccggcaaggacagcgtccggccttcgccattgggggcaaagcgattatcgtccgcctatctcaaggccttaa

SEQ ID NO: 2679 - DNA, 513 bp, Enterobacter sp. 638
gtgagctcaatcattaaaaaatgcagtgtggccgccgtgctggcgctggccgcactgatgcctgactttcgtctgctgaacacctcgccagaggggctggcgctactcgctgacctcgaaggatgtcgcctgacaccttaccagtgcagcgcgggcgtgtggacgtcgggcatcggccacactgccggtgtcgtcccgaaaggggatatcaccgagcgtgaggcggcggcgaatcttgtcgcggatgtgctcaataccgagcaacggctcgcggtctgcgtgccggtgaagatgccgccacgcgtctatgacacgctggtcagtttctcattcaacgtgggaaccggagcggcctgtcgctcgacgctggtctcgtttatcaaacgtcagcagtggtggcaggcgtgcgaccagcttacccgctgggtgtatgtgaacggtgttaaaaacaaagggcttgagaaccgccgcgcgcgggaacgggcttactgcatgaaaggagtacctcaatga

SEQ ID NO: 2680 - DNA, 513 bp, Escherichia coli HS
atgaatccatcaatcgttaaacgctgccttgtcggggccgtgctggctattgctgccacgctgccgggttttcagcagcttcacacctccgtggaggggctgaaactgattgccgattacgaaggttgtcgtctgcagccgtatcagtgcagcgcgggtgtctggaccgacggcattggtaatacgtcaggcgtcattcccggcaaaaccattacggagcgacaggcagcagaagggctgatctccaacgtgctgcgtgtggagcgggcgctggaaaggtgtgtgaagcaacagccgccgcagaaggtgtatgacgccgcggtgtcgtttgccttcaacgtgggaacgggcaatgcctgcagttccacgctggtgaaattactcaatcagcggcgctgggcagatgcgtgccgacagttgccgcgctgggtttatgtgaaaggtgtttttaatcaggggctggataaccgccgtgcgcgggagatggcctggtgtttacagggagcaaactga

SEQ ID NO: 2681 - DNA, 513 bp, Serratia proteamaculans 568
atgagctcactcgctaaacgctgcagcgtggcggctattctggccctcgccgccctgctgccacagttcaataccctacacacctctgaacagggattgcgcctgattgccgatttcgaaggctgcagactctccccctaccagtgcagtgccgggatatggaccaacggcatcggccataccgccggtgtgaaatccggctccgtcatcaacgaacgtcaggcagcggccaatctgatcgaggatgtccgcaccgtcgaacacggcatcgcacgctgcatggccgtagagatgccgcagccggtttacgacgcagtcagcgcctttgccttcaacgttggcgtcagcgctgcctgcaattccacattggccacctttatcaaacgccaacaatggcaggcggcttgcgatcagctaccgcgctggatctatgtcaagggcgttaaaagccaggggctggagcgccgtcgtcatgccgaacgtgctctgtgcctgcagggtattcagcgctga

SEQ ID NO: 2682 - DNA, 516 bp, Escherichia coli C ATCC 8739
atgaatccatcaatcattaaacgctgccttgtcggggccgtgctggctattgctgccacgttgccgggttttcagcagcttcacacctccgtggaggggctgaaactgattgccgattacgaaggctgtcgtctgcagccgtatcagtgcagcgcgggtgtctggaccgatggcattggtaatacatcgggcgtcattcccggcaaaaccatcacggaacgacaggcagcggaagggctgatctccaacgtgctgcgtgtggagcgggcgttggaaaggtgtgtgaagcaacagccgccgcagaaggtgtatgacgctacggtgtcgtttgccttcaacgtggggacgggcaatgcctgtagttccacgctggtgaaattgctcaatcagcggcgctgggcggatgcgtgccgacagttgccgcgctgggtttatgtgaaaggtgtttttaatcaggggctggataaccgccgtgcgcgggagatggcctggtgccttaaaggagctggactatga

SEQ ID NO: 2683 - DNA, 510 bp, Salmonella enterica serovar Newport SL254
gtgggctcattcgttaaacgttgcagtgtggccgtcgtgctggcgctggcggcactggtgcctgattttcgtttgcttcacacctcgccggaggggctcgcgctgattgccgacctcgaggggtgccggttgcgcccttaccagtgcagcgcgggcgtgtggacgtcaggcatcggccacactgccggggtggtaccgaaacgggatatcaccgagaaggaagccgccgcgaatctggtcgccgacgtgctgaatgttgagaaacgactcgcggtctgtgtgccggtggatatgccacccgccgtctatgacgcgctggtcagcttcgcttttaacgtcggcaccggcgcggcctgtcgctcaacactggtgtatcacctgaaacaccggcaatggtggcaagcctgtgaccagctcacccgctgggtgtttgtgaatggtgagcgtaataccgggctcgaaaatcgccgctttcgcgagcgcacttactgcctgaagggggcgaaatga

SEQ ID NO: 2684 - DNA, 510 bp, Salmonella enterica serovar Agona SL483
atgaatccttcaatcgttaagcgctgccttgtcggggcggtgctggctatcgcagccacgctgcccggatttcagtcgcttcatacctccgttgaggggctgaaactgatcgccgattacgagggatgccgcctgcagccttatcagtgcagcgcgggcgtctggactgacgggatcggcaatacgtccggtgtggtgcctggaaaaaccatcacggaacggcaggcggcgcagggacttatcaccaacgtgctgcgcgtggagcgagcactggataaatgtgtggtgcagccgatgccgcaaaaggtctatgacgcagtggtgtcgtttgctttcaacgtgggcaccggcaacgcctgcagctccacgctggttaagttgctgaaccagcggcgctgggcggatgcctgccatcagctgccgcgctgggtatatgtcaaaggtgtgtttaatcaggggctggacaaccgccgcgcgcgggaaatggcctggtgcttaaaaggagcataa

SEQ ID NO: 2685 - DNA, 513 bp, Salmonella enterica serovar Dublin CT 02021853
atgaatccatcaatcgttaaacgctgccttgtcggggccgtgctggctattgctgccacgctgccggggtttcagcagcttcacacctccgtggaggggctgaaactgattgccgattacgaaggctgtcgtctgcagccgtatcagtgcagcgcgggtgtctggaccgacggcattggtaatacatcgggcgtcattcccggcaaaacaatcacggaacgacaggcagcagaagggctgatctccaacgtgctgcgtgtggagcgggcactggaaaggtgtgtgaagcaacagccaccacagaaggtgtatgacgctacggtgtcgtttgccttcaacgtggggacgggcaatgcctgcagctccacgctggtgaaattgctcaatcagcggcgctgggcggatgcgtgccgacagttgccgcgctgggtttatgtaaaaggtgtgtttaatcaggggctggataaccgccgtgcgcgggagatggcctggtgcttacagggagcaaactga

SEQ ID NO: 2686 - DNA, 510 bp, Pectobacterium carotovorum PC1
atgaaatcactcgttaaacgctgcgttatcgcaacggtgttagcgctggccgcgttagtgccagatttttccttgctgaaaacgtcacaggaggggctggcgctgattgctgaccttgaggggtgccgcttaagtccctatcagtgcagcgcgaacttgtggacaaacgggatcggacacaccgcaggcgtggtgccggggaaaaccatcaccgagcgtgaggcagcggtcaatcttgtggccgatgtgttacgggtagaaaaggcactggcgcgttgtatggccgtgaacatgccgcaggccgtctatgatgccattgtgagctttgcgtttaatgtcggtgtcggtgcggcgtgtcgctctacgctggcgtttttcatcaacaaaggccagtggcgcaacgcctgtgaccagttgctgcgctgggtgtatgtcaacggcgaggtatcacgcggtattgaaacccgtcgccagcgtgagcgcgccgtctgtcttaagggggcagcatga

SEQ ID NO: 2687 - DNA, 1203 bp, Nitrobacter winogradskyi Nb-255
atgctcgaccgacgggacatgatgaaacgcatcggcgcgggactggcgctcggcgtcggcctggctcctcttaaagtcctggcgctcgaccgcgtgacgatgcctttcgacaatggcgaacgcccgctggtcaaatatccccagaagcgcccgatgatcgggatcaccagccggccaccccagctcgaaacaccgttcccggttttcaacgaaggccccatcacgccgaacgacgccttctttgtccgctatcatcttgccgacatcccgctcgacatcgatcccgccaccttcacgctcgagatcaagggcaaggtggatcacccgctcaggctgtcgctcgaggacatcaaagcgatggcccagacggagatcgtcgcggtcaatcagtgctcgggcaacagccgcgggttcgtcgatccccgggtcgccggtggccagctcggacacggcgcgatgggtaacgcacgctggcgcggcgtttcactcaagaccgtgctcgatcgggccggcgtgcagcacggcgcgaagcaggtggttttcggaggcatggacggccccgtcagcgacacgacgccggatttcgccaaggcgctcgacgtggatcacgcgcgcgacggcgaggtcatgctggcccatctgatgaacggaagagacctgccgtttctgaacggctttccgcttcggctcgtcgttcccggatactacggcacctactggatcaagcacctcaatgagatcaccgtcatcgacaacacctatgacaatttctggatgaagaaggcctatcgcattcccgacaatgcctgcgcctgcgtcgagccgggcacgacgccgacagcgacggtgcccatcggcaggctcaatgtccgttccttcatcaccaacattcccgagggcgcgcaactcaggcgcggtggaaagatcttgaaggggatcgcgttcgatggcggcacaggtatcagaaatgtcgaggtttcggtcgacggcggcaagacctggaaaggcacacggctcggacgggactatgggcgatacgcgttccgtgaatggaagaccccggtcaggcttgctcccgggccgcatgaattgaaggtgcgcgccaccagcaatggcggcgacgtgcagccggctgaggccaggtggaatccggccggttacatgcgcaatgtcatcgagaccgtccgcgtgaccgtctcttga

SEQ ID NO: 2688 - DNA, 1209 bp, Nitrobacter hamburgensis X14
atgctcgacagacgagagatgctgaaacgcgtcggcgccggactggcgctcggcgccgccgccagcctgccccctttcaaggccttcgcgctcgacaacgtgaccctgccgttcgacaacggcgagcgcccgctggtgaagtatccgcagaagcgcatgatgatcggccagaccagccggccgccgcagctcgaaacgccgttttcggtctttaacgagagcgtgattactccgaacgacgccttcttcgtccgctatcatctggccgacctcccgctcaacatcgatcccgccacgttcacgctcgagatcaagggcaaggtcgaccgtccgctcaagctgtcactcaaggacatcaggaagatgaaggcgaccgaggtcgtcgccgtcaatcagtgctcgggcaacagccgtggattttccagtccgcgtgtcgccggcggacagtccggcaacggcgcgatgggtaacgcgcgctggcgcggcgtgccgctgaaggccgtactcgatcaggccggcgtgcagcggggtgcgaagcaggtggtttttgacggcatggacggccccgtcagcgacaagacgccggatttcgccaaggcgctcgacatcgaccactcgcgggacggcgaagtgatgctggcctatctcatgaacgagcgggatttgccgtttttgaacggctttccgctccggctcgtcgttcccggatattacggcacctactgggtcaagcacctcaacgagatcaccgtcatcgacagcgtctatgacaatttctggatgaagacggcctatcgcattccggacaatgcctgtgcctgcgtcgaaccgggcacggcgccgaaggcgacggtccctatcaacaggttcaacgtccgctccttcatcaccaatgtcgccgatggcgcgaaactcgcgaccggcggcaagctcctgaaggggatcgcgttcgatggcggcaccggaatcaaggaggtcgccgtgtcgatcgacggcggcaagacctggaaggccgcgcggctcggccggaactacggcaaatactcgttccgcgaatggaaggttcccgtcaagctcaccgccggtccgcatgaactgaaggtgcgcgcgaccagcaatggcggccaggtgcagccggccgaagccctgtggaatccggccggctacatgcgcaacgtcatcgagaccgtccgcgtgacggcggcttga

SEQ ID NO: 2689 - DNA, 1281 bp, Deinococcus geothermalis DSM 11300
atggatgatcagctcgccctctcccgccgcgccgccctgagcctgcttgggggtgccggtgctgccctggctctcgggcgcggcgctctggcccaggcggccgttcccaccacgcctgctcccaccttcagtggtcctgggccgctcgagtcctggaacggcctaggaccgctgatcgccctgccgcagaaggtgccgctcattcggctggtggaccgccccccgctctacgagacgccccgcgcgtactttcaaagtccgcttacccccgccgccgccttctttgtccgctctaacctggcgctcttccccgccagtatcgacctcaccacctggcggctgaaggtcgagggcaacgtccgcaggccgcggtcgttcagtctggcggcgctgcttcgcgacttcgagccggtcagtgtgactgccgtcatgcagtgcaccggcaacagccgttcgcgttttcaaccccgccgccctggcggacagtggggcaacggggcgatgggctgcgccacctggaccggcgtgcggctgcgcgacctgctggaccgtgcaggcatccagagcggcggcgtgcaggtgcagtttcaggggctggaccagggagcgggggcaccggggagcggcggggccgagtacaagaagagccttgacctcgatgacccggtgctggacgagtgcattgtcgcctatgccatgaatggccagccgctgccactcttgaacggcttcccggtgcggctggtggtgcctggatacttcgccacgtactggatgaagaccctgagttttatccgcgtgctcaccgaacccgataccaatttctggatggccagtgcgtaccttcagcccgacaatccccgtggcacaacgacaccgcaggcggtcaaggacaagaaggtcaagttccggcccgtgggcagcatgccggtacgctcctttatcatgacgcctgacgagaccgtcaaggtcccggcgggcttgccgatcaccgtgcagggcctggccctaagtgggcggggggccgtcaccaaggtcgaagtgtccaccgatggcggcaaaacctggcggaacgctcaattgggtcaggatctcgggaaatacgccttccggccctggagctttgcgtggacgccaaagcaaccggggcagtacaccctggccgtccgcgccaccgatgcgagcggggccacccagacagatcagcccatctggaatccgtccggttacctctggaacaccatcgagcgccagacggtcactgtcgggcagaccgggtaa

SEQ ID NO: 2690 - DNA, 1227 bp, Polaromonas naphthalenivorans CJ2
atgaaccgtagcaatcaccacgacaccggcagacggcagtttttacggcatgccggcctgggcgcggccagccttggagccctgccgctgcgcagcctggcggcaggcattgaaaacctgccctttggcaacggcgcccgcgagctggtggcctatccgcaaaagcggcccctgctgcgcatcaccacacggccgccgcatctggaaacccccttcagtgtttttggcgaagggatcatcacgcccaacgacgctttttttgtgcgctatcacctggccaatttcccgaccacgattgacgcgcaagcctatcggctcaaggtcggtggccatgtgaagcagccgctgtcactttcgctggcggaactcaaagcgctggccgagccggcggaggtggtggcggtcaatcagtgctcgggcaacagccgggcatttgcgcagccgcgcgtattcggcgcgcagctgggcaacggatcaatgggcaatgcgcgctgggtgggcgtgccgctcagggcggtgcttgaaaaagcgggcgtcctggccggcgcccggcaggtggcattcaacgggctggatgcgccggtgcttgcggcaacgccggatttcgtcaaggcgctgaacatcgacctggcgctcagtcccgagccgttgattgcgtggaccatgaacgggacggacattccctttctgaacggctaccccctcaaactgatcgtgccgggctatttcgggacttactgggtcaagcacctgagcgagatcgaggtgctggaccacgactttgacggtttcttcatgtcaacggcctatcgcgtgccggacaacgcctgcatgtgcgtgcccgcaggcaccgcgcccacggcgacacggcccatcaccagcctgccggtgcgttccttcatgaccagcctggccgacggcgcgcatgttccggccgggcgcgccctgctgctcaagggcatcgcttttgacggcggcagcggcattcaaaaggtggaagtgtccgaggacggccagccgtggcgggaggccgcactgggtaaagacctcgggcggttttcgtttcgcgaatggcgcctgccgctgacgccttccagaaaaggaccgatgacgctgagcgtgagggccaccaataggcaaggtgatgagcagcccgcgaccgccagctggaaccccggcggttatgcgcgcaatgtgattgaaacgacccgcatcgttgcggtttag

SEQ ID NO: 2691 - DNA, 1221 bp, Polynucleobacter necessarius asymbioticus QLW P1DMWA 1
atgaattcagaaaactttacaaatagacgtaaggtcataacggctgctcttgcaggtggcgtaagttctttattgccatcttgggcaagtagcgcagagatgattaatatgccaatggcttacggggaaagagaattagtagcattcccaggaaaaaagccaatgattgttttaacatctcggccgcctcaactggagacaccatttaagtattacgatcaacatgtgatcacgccaaatgatgaattttttgtgcgatatcacatggctggcatccccacttcaattgatccaaacacatacaaattaaaggtaggtggaaatgtagagaagcctttagaaatttccctctctgagcttaagaagaattttccttcacagcgaattgttgcggtaaatcaatgctctggtaatagtcgtggtttatttgagccaagagtaaatggcggacaacttggtaatggcgcgatgggtaatgctgcttgggttggcatctcattaaaagatatcttgaatgctgcaaatccaggaaagggatcaaagcaagtgacctttaatggcctggatcagccagtgctgcctagtgattctgattttgtaaaaggcttggatatcgaccatgcaatggatggcaatgtcatggttgcgtatcaaatgaatggaacagatattccatttctcaatggatacccaattaagttaattgttcctggctattatggaacttactgggtaaagcacctgagtgaaattcaggtggtcaatgacgtctacaacggttattggatgaatccagcgtaccgaattccagataacgactgtaattgcgtggagccaggaacagcgccatcaaagacgatccccatcaaccaattcaccattcgctctttcattactaactttactaacagcagtatcgtcactgttggtaaaccagtccaagccaggggggttgcttttgatgctggttatggcattaaaaaggtattgttctcacaagataatgggcagaattgggttgaggctagattggggcaagatttaggacgcttttcatttagagaatggcgcgttgaatttactccaaaacaacaaggtgttctggacttaagggttcgcgcatttaatcacgcaggacaagtgcagccgatgacggctacatggatgccagcgggctatatgcgtaatgtggttgagacagttcagatcaatgcggtgtga

SEQ ID NO: 2692 - DNA, 1251 bp, Acidiphilium cryptum JF-5
atgaaacaaagcttttccagcgagggcggcgccacgcgtcgtgcgaccctgctgggcaccgcctcgatcgccggacttgcgcttgcctcgcgcgccggcgcggcggcgccgcagaccgtcaccctgcccttcgccaatggcgagcggcccatcgtgccggcgggaacgtttccgcaaaaaggcgagatgatcctgcagcggacccgcgcgccgctgctggaaacgccgttcgaggtgttccgggacaacctgttcacaccgaacgaccgcgccttcgtgcgctggcacatggccgacttcccggaaagcatcgacacggcgaaataccggatcagggtttcgggcctcgtcaacaagccggtcgagatcacgctcgacgagctgatgcacggctttccgatccgcaagatcgctgcggtgaaccagtgctcgggcaacagccggggcttcatcgaaccgcgggtgcccggcgcgcaatgggcgcatggcgccatgtacaatgcaatgtggaccggcgtgccgctcaggcatctgctggcccgcgccggagtgaaggccggggcgacgcatgttgcgttccgcagcctcgagcagggcggcgggctgtatccggcggatgtcagattcgagaaggccattccgctgtcacgcgccaatgacggcgaggtgatgatcgccttccagatgaacggcgcgaatctgccgctgctcaatggctacccggtccgcctcatcgtgccgggatggtattcgacctattgggtgaagatgctcaccgagatcgaggtgatggatcacccctcgaccgatttctggatggcaaccgcctacaagatccctgacacgccgaccggatcgatgacacccggtgagccggggatcaagatggtgccgatcaacgagatgaagccgcgcagcttcttcggcagcgtcaccaacggcgcgcggctgcccgccggcagacccgtcgtggttcgcggctttgccttcggcggcggcagcgccctgaagtccgttgccgtgtcgatcgacggcggggcgagctggcgcccggccaggctcgggcaaaaccatggtgcctatggcttccgggactggcaaattccggtgcgcttcccgaaaccgggggcctatcggctgatggtccgggccaccaacgcggcagggcacgtgcagcccgcgaaggcaggctggaatccgggcgggttcctctacaacgccatcgaacatgtcgacgtcacggtcgcctga

SEQ ID NO: 2693 - DNA, 1239 bp, Sphingomonas wittichii RW1
atggatcggttcgatatgatgatgagggcgccgctcgaccgtcggcagatgctggcgggcgcggcggcgatgctggcggcggtgccggccggcgcgcaggggctggtcgacctgcgcctgccgggcgggccgtcgcggcggccgctggcgggcggcttccccggcaagggggagatgatcgtccagcgcatccatccgccgctgctcgaaaccccgatggaggtgttcgacggcgacgtcttcacccccaatgaccgcttcttcgtgcgctggcactggtccgatttccccacctcggtcgatgccggggcgttccgcctggccgtccacggacgggtgcggcggccgctgtcgatcagcctcgcccagttgctgcggatgccgcgcgtcgagctggcggcggtgaaccaatgctcgggcaattcgcgcggcctgttcgaaccccgcgtccccggcgcgcaatgggcgcatggcgcgatgggcaatgcgcgctggaccggcgtgcggctgcgcgacctgctcgaccgggcgggggtgctcgccgatgccgtcgcggtccgcttcgccgggctcgacgggacgacggtggagggcgcgccgcgctatgagaaggcgctcgccatcgaccatgcccgcgacggcgaggtgatgatcgccttcgcgatgaacggggagcagctgccgctgctcaacggctttccgatccggctgatcgtgcccggctattattcgacctactggatcaagatgctgtccgacatcgaggtgctggccgcgcccgacgatggctactggatggccaaggcttaccggataccgacgacgccgggcgcggacatcgcgccggggaccaaggatttcccgacggtgccgatcggccggatggtgccgcgctccttcgtcaccagcctgcgcgaggggcaggcggttccgcttcgcccggtgctgccggtcggcgggatcgcgctgggcggcgaccggggcgtcgcccgggtcgagctgtcggccgacggcgggcggagctggctgccgacccggctcggccccgaccatggccgctacagcttccgtcgctgggatgccgatctgccgctggcgggaccggggcggctgacgctgatggtccgctgcaccaacgatgcgggggaggggcagccgatgaagccggtctggaacccgagcggcttcatgcgcggcaatgtcgaggcggtgtcgatcgaggtgcgggccgatgcgtga

SEQ ID NO: 2694 - DNA, 1221 bp, Xanthobacter autotrophicus Py2
atggtcacgagacggcaggcattgaggtcggtcggcggcatggtcctggggtatggcgcctccctcgtggcgggctcccgggtcgcggccgccgcggcggagaccatcacccttcccttcgccaacggcgagcggccgcttgtgacctatcccggcaagcgggcactgatcggcctgacatcgcgtccgccgcagctcgaaaccccgttttcggtgttcaacgagggcatcctgacgccgaacgatgcgtttttcgtgcgctatcacctggccgacatcccgctggagatcgacccggccgccttccggctggaggtgaagggcaaggtctcgacaccgctttcgctttcgctcgacgagctgaagacgaagttcgatccggtcgaatatgtcgccgtgcatcaatgctccggcaacagccggggctttttcgatccgcgcgtgggcggcgggcaggccggcaacggcttgatgggaaatgcccggtggaagggcgtgcccctgaaagcggtgctggaaaaggccggcatcgccagcggggcggtggaagtttacttcaccgggctcgacaatcccgtcatcccggagacgccgcgcttcgccaagtcgctgaagctggaccatgcgctcgatggcgaggtcatgctggcgtaccagatgaacggcgaggacctgccctggctgaacggcttcccgctgcgcctcgtggtccccggctacttcggcacctactgggtcaagcacctcaaccagatcgccgttctcgacaagccgctcgacaatttctggatgagcacggcctatcgcatcccggacaacgactgcgcctgcgtgcccgcgggcggcaagcccgagaagaccgtgcccatcggccgcttcgccgtccgctcgttcctcaccaacgtgcttgacggcgcgaaggtggcggcgggcaagcctttggcgttgcgcgggatcgccttcgacggcggatccggaatcgcacgggtcgaggtttccgccgatgggggcaagaccttcatgcccgccgcgctcggcgcggatctcggtaaatactcgttccgcgaatggacggcgaacatgacgctgcccgccggcccgcacgcgctcaaggtgcgagccaccaacgcgctcggccagacccagcccatggaggcccgatggaacccatccggctacatgcgcagcgtcgtcgagaccaccaacgtcgtggccgggtga

SEQ ID NO: 2695 - DNA, 1218 bp, Xanthobacter autotrophicus Py2
atgttgaacagacggcagatgctgaaatctgcgggcggtacggccttaggaatcggtgcggggcttgccgtgggggcacgactcacggcgttcgccgcggaaaccgtgactctgcccttcgccaacggcgaccgtgagctcgtcgcctatccgggcaagcggcctctgatcaggctgacgacccggccgcctcagctcgagacgcccttcagcgtctacaatgacggcttgatcacgccaaacgatgccttcttcgtgcgctaccatcttgcggatatcccgaccgaaatcgatccggagagcttccgtgtcgaggtcaagggcaaggtcgataagccgctgtccttgtcgctgatggacctcaaatcccgctttgacgcggtcgagctggtcgctgtccaccaatgctcgggcaacagccgcgggttcttcgagccccgcgttggcggcggacaagccggcaacgggctgatgggaaatgcgcgatggaagggggtacctctcaaggccgtgctggacaaggccggcgtgcaagcgggcgcggttcaggtttcgttcggcggtctcgatggtcccgtcgtgccggatacgccggatttcgcgaaggcgctcgatatcgaccacgcgcgggatggcgaggtcatgctcgcctatgagatgaacggcgccgaattgccttggctcaacggctatcccctgcgcctcgtggtgcccggtttctatggcacctactgggtgaagcacctcaacgaaatcacggtgctcgacaagccgttccaaagcttctggatggacaccgcctatcgcatccccgcgaatgcatgcgcctgtacggagcccggcaaggcacccactgcgacagtcccgatcaatcgcttcgacgtgcgcagcttcatcacgagcgttcaggacggggcgaaattgaaggcgggcgagcttgctttgcgcggaatcgctttcgatggcggctacggcgtcagcgacgtcgaggtctcggcagacggtggaaaatcctggcaggccgcgtcgctcggcgaagacctcggcaagtactccttccgtgagtggaaaatgacgatacctctccaaaagggcgctcacactctgatggtccgcgcggtcaaccggatcggccagtcgcaaccgatggagccgctatggaatccggcaggctacatgcgcaacgtcgtcgaacacacacgcatcgttgcagcatag

SEQ ID NO: 2696 - DNA, 1209 bp, Methylobacterium radiotolerans JCM 2831
atgaccgatccggcacggcgggccttcctgaagagcgccgccctcggcgccctggcggcgggaagcggcctgcggccggcccgcgccgacgaggcggcgcagctgcccttcggcaacggcgagcgcccgctcgtggcctatccgggcaagcggccgctgctgcagaccaccgcccggccgccccagctggagacgccgttcgcggtcttcgacgcgggcgcgatcacgccgaacgacgccttcttcgtccgctaccacctcgccgacatccccctggagatcgatcccgaggcgttccggctgaacgtcggcggccacgtcgagcggccggcctcgttcagcctcgcggagctgaaggcgctgcccggcgggaccgagatcgtcgcggtcaaccagtgctcgggcaattcccgcggcttcttcgagccgcgcatggccggcggccagctcgccaacggcgccatgggctgcgcccgctggaccggcgtgccgctgaggaccgtgctggatcgggccggcgtgaaggccggggccgtgcaggtcgccttcaacgggctcgaccgcccggtcctgccggagacgccggacttcgccaaggcgctgaccctcgaccaggccggcgacgggcaggtgctgctcgcctggggcatgaacggcgcggatctgccatggctcaacggctacccgctccgcctcgtcgtgcccggctattacgggacctactgggtcaagcacctcgacacggtcacggtgctggacaagcccttcgagggcttcttcatgaagaccgcctaccgcatccccgacaatgcctgcgcctgcaccgagcccggtcaggcggccgccgccacggtgccgatcgggcgcctcaatgtccggtcgttcctgacgaacctgaccgacggcgcgcaggtgaaggccggtccggtcgccctgcgcggcatcgccttcgacggcggctcgggcatcagggaggtcgcggtctcgaccgacgacggcgccacctggactcgggccgcgctgggcggggatctcggcccctacgcgttccggacctggtcgctcgcgaccgcgctcacgcccggcgcccacgcgatccgggtgcgggccaccgccaacgacggcagcacccagccgacgacgtcgcgctggaacccgtccggctacatgcgcaacggcgtcgagaccacccgggtgcgggcggcgtga

SEQ ID NO: 2697 - DNA, 1224 bp, Methylobacterium radiotolerans JCM 2831
atgcacggattggacagaccgatgaaccgccgcctcctgttgggcgggctcgggctcggcagccttgccgccgcgatgccggcctgggccgcgggctcggtgaagctgccgctacccggcggcccggatgtgcgggatctcacgacggcctttcccggcaagggcgagatgatcctccagcgtacccatccgccgctgctggagacgccgtttgcggtgttcgatgagggcgtgttcacccccaacgaccgcttctacgtgcgctggcactgggcctcgatcccaaccgaggttgatgccggcaccttccgtctcaaggtccacggtcatgtcgagaaggaactctcgctctccctcgatgccatcgccggcctgccgcgcttcgagatcgccgcggtcaaccagtgctcgggcaactcccgcgggctgttcgagccgcgggttcccggcgcgcaatgggccaacggctcgatgggcaacgcccgctggaccggggtacggctgaaggacgtgctcgaaagggccggggtgaaggccggtgccgtgcaggtgcgtttcagcggcctcgacgagccggtggtcgacgacgcgccggacttcaagaagtcgctcgatctcgaccacgccaacaatggtgaggtgatgatcgcgtacgcgatgaacggcgaacagctgccgttgctcaacggcttcccgcttcgtctcgtggtgccgggctggtactcgacctactgggtcaagatgctgtccgacatcgaggtgctggacaagcccgacgatcagtactggatgaagaccgcctaccgtatcccggacgtgccgggcgccaacatcaagcccggccagaccggcttcaagacggtaccgatcaacaggatggtgccgcgctccttcgtcaccaacctgaccgacggcgccaaggtggcggccggaacgccggtggccatccgcggtatcgccttcggcggcgattgtggggtgaaggcggtggacttctccggagacggcggggcgacgtggttcccggcgcaactcggcaaggacgagggcccctacagcttccgccgcttcgagggcagcctgccggcactggcctccggaacccacacggtcagggtccgctgcaccaacaccaacggcgtggcgcagggcatggaccgggtctggaacgccaacggattcatgcagaacggcatcgagaccgtgtccttccaggccgcttga

SEQ ID NO: 2698 - DNA, 1245 bp, Burkholderia ambifaria MC40 6
atgagccaacacgattacgatcccgtctcgctgcaccggcgccgcctgttggccggcctcggcgcgctgggtgcggcggcattcatgatgcccacgctcgcgcgcggcacgcagagtggcaccatcgagctgccgttcgagaacggcagccggccgctcacgtcggacctgccgcaaaaatccaatgtgatcctgcagcgcacgcgtccaccgctgctcgaaacaccgttcgatgtcttcgaccaaggcgtgttcacgccgaacgaccgcttctacgtgcgctggcacctcgccaacattccgaactccatcgatccggccacgtaccgcgttgctgttcacggcgccgtcaagcggacgctgaatctttcgctcgacgacctgatgcgcaggttcccgcgctacgagatcgccgcggtcaatcaatgctcgggcaactcgcgcggcttcttcagccctcgtgtgccgggcggccagtggggcaacggcgcgatgggcaatgcgctatggaaaggcgttcgcctgaaggacgtgctcgaccatgcgggcgtgcgcgccaatgccgtttgcgttcgcttcaacgggctcgattcaggcgtgatcccgcaaacgccgaagttcctcaagtccgtgaagatcgaccatgcacgcgacggcgaggtgatgctcgcgtacgcgatgaacggcgagccgctgccgctgctcaacgggtacccgctacggctcgtcgtaccggggtggtatgcgacgtactgggtgaagatggtgaccgacatcgaagtgctggacacacctgacgacaacttctggaccgccaaggcatacaaggtgccggccaaccacttcgccaacgtgcggcccggtgagaccgacgtgccgcagattcccatcaaccggatgctgccgcgctcgttcttcaccaacatgagcaccggcgacaaagtgggcgccggtcaaccggtgctcgtccgcggtattgcgttcggcggcatcaacgcactggcgcgcgtgcagttgtcgacagatggcggtcgaagctgggccgatacgcaactaggacacgactacggcaaatacagcttccgccagtggcagacgaacgtgcgcttcgctcaacgcggcccgcagatgctgatggtgcgcgccatcgactcgacggggcaggcccagccggccacaccgaactggaacggtgcaggtttcatgcgcaacgtcatcgaatcgattcagctcgacgtggcttga

SEQ ID NO: 2699 - DNA, 1239 bp, Sulfurihydrogenibium YO3AOP1
atgaacagacgagaattattgaaaaaaggactgcttatgacagcaaccggtttactccttccaaaggaactgtttgctcaagttgataaatctctcttaggacctgcggcagatttacttctggatggaacgattaaagagcaaattttagaagctttacccggaaaaaaacctttgataaaaaaggccttcagagctccaaactacgagactccatttaaatactttgatgaaatctttactccaaatgatgttttctttgttagataccatcttgcaaatataccacaagatattgatgaaaaaacttggaagctcaaaatcactggagatgctgtagaaaaaactttagaacttacaatggaagacttaaaaacaaaatttgaacaagttgagattgtagcccttaaagcatgttctggaaatatgagaggtttatttaatcctcatgtacccggagtacaatggggatacggagctatgggaaatgctaaatggaaaggtgtaagattaaaagatatcttaaataaagccggattaaaggctaacgctcttgaagttgcctttaatggtgctgagtctggtcttatgccaacaactcctgattttgtaaaaagtattcctgtttggaaagctacgcaagaagaggtattggttgcctatgagatgaacgatgagccgattccatatttaaatggatatcctctcgtgcttgtagttcctggctggacagcgacttattggattaagcatttaaccgatataacggtaatctctactcctttagataatttctggatgaaaaacgcttacagggtttctgtcgacaaatttccaataagggaaagatttttatctcagatgaactcggaagatatgcctataacagaggtaacaataaactccattatcacaaacatagaaaaagggcaagtattcaaattaggtcagccaatagaagtaaaaggtttaacatgggatggtggttatggaattaaaatggtagaagtttctgtagatggtggaaaaacatgggtagaggcacaattagataaagattatggcaagttttcatggagacagtttagttatgtgtttaagcctaataaaaaaggaaactacacaatcatggtaaaggctacaaacagcatcggacaaacacagccaataaaagcaatatgggagcctcatggatatggttataacgctattcaaaaaataaatataaaagtcatttaa

SEQ ID NO: 2700 - DNA, 1206 bp, Methylobacterium sp. 4-46
atggttgaccgcgaccgacgggcctttctgcagcgcggcgtcctcgccggcgcggcgctcgcgagcgccccctggcgcgccgcggccgaggagatcgcgacgctgcccttcggcaacggcgagcgccccctcgtcgcctatccgggcaagcgcccgctcctgcagatgacgagccgcccgccgcagctggagaccccgttccgggtcttcgacgagggcgtgatcaccccgaacgacgcgttcttcgtgcgctaccacctcgccgacataccggtcgccatcgaccccgagcgctaccgcctggaggtgaagggccatgtcgagacgccgctcgccctgtcgctcgccgagatccgggcgctgccggccagcgagatcgtcgcggtcaaccagtgctcggggaattcgcggggcttcttcgcgccgcgggtcgcgggcgggcagctcgccaacggcgccatgggcaatgcccgctggaccggcgttccgctgcggaccgtcctcgacaaggcgggcctgcggcgcggggccgtgcaggtcgccttcgacgggctcgacgggccggtgatcccggagacgcccgacttcgtgaaggcgctcaccctcgaccacgcccgggacggcgaggtgatgctggcctacgccatgaacggcgaggacctgccctggctcaacggctacccgctgcgcctcgtcgtgccgggctattacggcacctactgggtcaagcacctgagcgcgatcacggtcctggacaagcccttcgaggggttctggatgacctccgcctaccggatcccggccaattcctgcgcctgcacggagccgggcgaggccccgaaggcgacggtgccgatcggccgcttcaccgtccgctcgttcgtcaccaacctcgccgacggggcgaccctgccggcgggcgagacgccgctgcgcggcatcgccttcgacggcggcgagggcatcgccgaggtggcggtctccaccgatgacgggcggacctggacccgcgccgaactcggcgaggatctcggccgctactccttccgcccctggaccttgcgggtcgacctcaccccgggggcgcacgccgtgcgggtgcgcgccaccaaccgggccgggcagtcgcaacccctcgacccgctgtggaatccggccggctacctgcgcaacgtcgtcgagacggtccgcgtgcgcgccgcctga

SEQ ID NO: 2701 - DNA, 1212 bp, Methylobacterium chloromethanicum CM4
atgctcgacagacgggatctcatcaggcgcgcgggcctgagcacattggcgagccttgggggaggcagcctcgcccctctgcgcgttctggccggcgacgcggtcatgcttcccttcggcaatggcgagcggcctctgatcgcctatccgggcaagcgcccgctcctgcagatgactgcccgcccgccccaactggagacgccgttctccgtcttcgacgaggggccgatcacccccaacgacgccttcttcgtccgctaccacctcgccgacatcccgaccgagatcgatcccgagacctaccgcctcgcgatcaagggccgtgtcgagaaggagatctcgctctcgctcgccgacctcaaggcgatgcccaccaccgagatcgtcgccgtcaatcaatgctcgggcaattcccgcggcttcttcgagccacgcatggccggcggccaactcgccaacggggccatgggctgcgcccgctggaccggcgtgccgctgaaggccgtgctcgacaaggccggcgtgaaggcgggcgcggtggaggtcgccttcgccgggctcgacggcccggtgatcccggagacgccggacttcgccaagtcgctcaagctcgaccacgcccgcgacgggcaggtgatgctcgcctggggcatgaacgggcaggacctgccctggctcaacggctatcccctacgcctcgtcgtgccgggcttctacggcacctactgggtcaagcacctggagagcatcagcgtgctcgacaaacccttcgacggcttctggatgcagaaggcctatcgcatccccgacaacgactgcgcctgcacggagccgggcaaggccgcggacaagaccgtgccgatcagccgtttcaccgtccgctccttcctcaccaacctgaccgatggagcggatgtaaaagccgggcgcacagatctgcgcggcatcgccttcgatggcggctcggggatcaaggcggtggcggtctcgaccgacgacgggaagacgtggaccgatgcgcagctcgggcaggatctcggcccctacgccttccggccctggaccctgagcgtgaacctgtcgcctggcgcgcacgcgatccgggtgcgggcaacggccaatgacggcgggagccagccaatggaggcgcgctggaacccggccgggtacctgcgcaacgtggtcgagatcacccgcgtgcgggcggcctga

SEQ ID NO: 2702 - DNA, 1212 bp, Methylobacterium nodulans ORS 2060
ttgcttgacaggcgagagctcttgagacgcgccgggctaggcgccgttgtgtttagcggcaccacgctcgtatcgccgctgcgcgggctagcggacgaactggcgcggctgccgttcggcaacggcgagcgcccgctcgtcgcctatccgggcaagcgcccgctcttggagatgaccagccggccgccgcagctcgagacccccttcggcatcttcgacgagggcgtgatcacccccaacgacgccttcttcgtgcgctaccacctcgccgacctcccgaccgccatcgaccccgacagcttccgcctggaggtcacgggccatgtcgagaccccgctctcgctctcgctggccgagctgcgggcgctgccgggcagcgaggtcgtcgcggtcaaccagtgctcgggcaattcgcgcggcttcgtcgcgccgcgggtcgccggcggccagctcgccaacggcgccatgggcaatgcccgctgggccggcgtgccgctgcgcagcgtgctcgacaaggccggcctgcgccgcggcgccgtgcaggtcgccttcgagggcctcgacgggccggtgctcccggccacacccgactacgccaaggcgctcgacctcgaccacgcccgcgacggcgaggtgctgctggcctatgcgatgaacggcgcggagctgccctggctcaacggctatcccttgcgcctggtggtgccgggctattacggcacctactgggtcaagcacctgaaccgcatcacggtgctcgatcagccgttcgagagcttctggatgaagtcggcctaccggattccggccaatgcgtgcgcctgcacggagccgggccaggcgcccacggccacggtgccgatcgggcgctacaacgtccgctccttcgtcaccaacctcgccgacggggcgcgggtgcccgcgggcgagaccctgttgcgcggcatcgccttcgacggcggctccggcgtgacggaggtcgcggtctcgaccgatgacggccgcacctggaggcgggcggcgctcggtgaggatctcgggcgctactccttccggccctggagcctgcgggtcgatctggcgccgggggcgcatgcgatccgggtgcgcgcgacgaaccggatcgggcagacgcagccgctcgaccctctgtggaacccggccggctacatgcgcaacgtcgtcgagaccacccgggtgcaggcggcgtga

SEQ ID NO: 2703 - DNA, 1206 bp, Methylobacterium nodulans ORS 2060
atgctgcaacgacgcgatgtcctgcgcggcgccgctatgctggccacggccggcccgtttgccacgctggcccgcgcggcggccccagagagcgtgaccctgcctttcgggaatggcaagcaccctctcgtcgcctatccgggcaagcgtcctcttattcagatgacgagccggccgccacaactggagacgcccttctccgtcttcgacgagggcgtgatcacgcccaacgacgccttcttcgtgcgctaccacctcgccggccttcccaacgagatcgatcctgagagcttccgcctggagatcaagggcaaggtcgacaggccgttctcgctatcacttaccgaactgaagaccctcgagacggtcgaggtcacggccgtcaaccagtgctctggcaattcgcgcggcttctttgagccccgcgtcgccggcgggcagctcgctaacggcgccatgggatgcgcgcggtggcgtggcgtgccactcaagaccgtgctcgaccgggcgggcgtccaggctagcgcgacgcaggtgatgtttgaggggctcgacgggccggtgctcccggccacacccgacttcgccaaggcgctcgacctcgaccacgcccgcgacggcgaggtgctgctggcctatgcgatgaacggcgaggatctgccctggctcaacggctacccgctgcgcctcgtggttccgggctattacggcacctactgggtcaagcacctgaaccgcatcacggtgctcgatacaaggctacagaatttctggatgaaggcggcttaccggatccccgacaatacctgcgcctgcaccaagccaggggaaagtccagccgggacagtaccgatcaaccgcttcaccgtgcgctcctttatcacaaatctacttgacggcgatcgcgtgagggcggatgctgagactacgctgcgcggcattgccttcgacggcggctacggtatctccgacgtgctggtttcaggcgacgacgggcggagttggactgcggcgaagctcggcgaggatcacggccgctacgcgtttcgtggctggcaggcgagcctgaggctgccgaccggcgagcacaagcttcgcgtgcgggcgatgaaccggatcggtcagtcgcagccgctcgatccgctctggaatccggccggttacatgcgcaatgtcgtcgagacgacgcgtgtcacggcgcgctga

SEQ ID NO: 2704 - DNA, 1209 bp, Methylobacterium nodulans ORS 2060
atgatacagagacgagagatcctcagattcgccgggctaggtgcgctcgccgttggtggtgcatctctgaagcccgtgcgggccttcgcggacgaactggcgcggctgccgttcggcaacggcgagcgcccgctcgtcgcctatccgggcaagcgcccgctcttggagatgaccagccggccgccgcagctcgagacccccttcggcatcttcgacgagggcgtgatcacccccaacgacgccttcttcgtgcgctaccacctcgccgacctcccgaccgccatcgaccccgacagcttccgcctggaggtcacgggccatgtcgagaccccgctctcgctctcgctggccgagctgcgggcgctgccgggcagcgaggtcgtcgcggtcaaccagtgctcgggcaattcgcgcggcttcgtcgcgccgcgggtcgccggcggccagctcgccaacggcgccatgggcaatgcccgctgggccggcgtgccgctgcgcagcgtgctcgacaaggccggcctgcgccgcggcgccgtgcaggtcgccttcgagggcctcgacgggccggtgctcccggccacacccgactacgccaaggcgctcgacctcgaccacgcccgcgacggcgaggtgctgctggcctatgcgatgaacggcgcggagctgccctggctcaacggctatcccttgcgcctggtggtgccgggctattacggcacctactgggtcaagcacctgaaccgcatcacggtgctcgatcagccgttcgagagcttctggatgaagtcggcctaccggattccggccaatgcgtgcgcctgcacggagccgggccaggcgcccacggccacggtgccgatcgggcgctacaacgtccgctccttcgtcaccaacctcgccgacggggcgcgggtgcccgcgggcgagaccctgttgcgcggcatcgccttcgacggcggctccggcgtgacggaggtcgcggtctcgaccgatgacggccgcacctggaggcgggcggcgctcggtgaggatctcgggcgctactccttccggccctggagcctgcgggtcgatctggcgccgggggcgcatgcgatccgggtgcgcgcgacgaaccggatcgggcagacgcagccgctcgaccctctgtggaacccggccggctacatgcgcaacgtcgtcgagaccacccgggtgcaggcggcgtga

SEQ ID NO: 2705 - DNA, 912 bp, Brucella suis 1330
atgaaacgcgaagacatccctgcgatcatcccggccgatatcgaagaaaagaaaaaggcggcgcaaagctggttcgaggagttgcgcgaccgcatctgcgcaagttacgagcaactggaagacgaattgcagggcccgctttcggatcgtgaaccgggccgtttcgtacgcacgccctggcagaaggatgacggcaatggcggcggtgtgatgtcgatcatgcatggccgcgtctttgaaaaagtgggggttcacgtttcgactgtccatggcgagttctcaccggaattccgcaagcagattcccggagccgaggaggacccgcgctattgggcaagcggcatttcgctcatcgcccatccgcaaaatcccaacgtgccagccgttcatatgaacacacgcatgatcgtgactacccgccagtggttcgcgggcggggcggacctgacgcccgttctcgaccgccgccgcacacaggaagaccccgatacgctcgcctttcacaaagcgttccgcttcatttgcgaaaagcacaaggatatcgtcgattatcaacgcctgaaggagtggtgcgacgaatatttcttcctgccgcaccgcgacgaaccgcgcggtattggcggcattttctatgactggctgcattcaccggaagaaaaaggcggatgggatagcgacttcgcctttacgcgcgatgtcgggcgcggcttctccgtggtttatccgcatctggtgcgccagaacttcaacaaggactggaccgaagccgaccgtgacgaacagctcatccgccgtggccgttatgtcgaattcaacctgctttatgatcgcggcacaatcttcggcctcaagaccggcgggaatatgaatgccatcctgtcttccatgccgcccgtggtgaaatggccctga

SEQ ID NO: 2706 - DNA, 915 bp, Mesorhizobium BNC1
atggaacaaccccatatcccggcgggactgcccgaagacgtcgaaaacaagaaggaagcggcgcgggcgtggttcgaaacgctgcgcgacaaaatctgcgccgcgctggaaggattggaggacgagctttccggccctcattcgtcctatgctcccggacgcttcgagcaaacgccctggctgcgccaggagggcgcgggcgggggcggcgtaatgtccatcatgcatggccgcgtgtttgagaaagtgggcgtgcacacctcaaccgtgcatggggagttttcgcccgaattccgccggcagattccgggagcggaggaggatccgcgcttctgggcctccggtatttccgttatcgcccacccgcaaaatcctcatgtccccacagtgcatatgaacacgcgcatggtggtgacaacccggcaatggtttggaggcggggccgacctcacgccgatgctcaaccgccggcgcagccaggaggacccggacgcaattgcctttcacaaggcaatgcgtttcgtctgcgaacggcacgcagcggtggccgactacgagaaattcaaaaactggtgcgaggaatatttcttcctgccgcacaggaacgagccacgcgggatcggcggcattttttacgattggctcaagagcccggaagagaatggagggtgggatgcggatttcgccttcacccaggatgtcgggcgcgcctttgtgatggtctatcagcacatcgtgcggaagaacttcaacaccaactggaccgaggccgaccgggaagaacagctcattcgccgcgggcgctatgtcgaattcaacctgctctacgaccgcggcacgattttcgggctcaagaccggcgggaatgtcaactctatcctgtccagcctgccgcccgtggtgaagtggccgtag

SEQ ID NO: 2707 - DNA, 912 bp, Brucella ovis
atgaaacgcgaagacatccctgcgatcatcccggccgatatcgaagaaaagaaaaaggcggcgcaaagctggttcgaggagttgcgcgaccgcatctgcgcaagttacgagcaactggaagacgaattgcagggcccgctttcggatcgtgaaccgggccgtttcgtacgcacgccctggcagaaggatgacggcaatggcggcggtgtgatgtcgatcatgcatggccgcgtctttgaaaaagtgggggttcacgtttcgactgtccatggcgagttctcaccggaattccgcaagcagattcccggagccgaggaggacccgcgctattgggcaggcggcatttcgctcatcgcccatccgcaaaatcccaacgtgccagccgttcatatgaacacacgcatgatcgtgactacccgccagtggttcgcgggcggggcggacctgacgcccgttctcgaccgccgccgcacacaggaagaccccgatacgctcgcctttcacaaagcgttccgcttcatttgcgaaaagcacaaggatatcgtcgattatcaacgcctgaaggagtggtgctacgaatatttcttcctgccgcaccgcgacgaaccgcgcggtattggcggcattttctatgactggctgcattcaccggaagaaaaaggcggatgggatagcgacttcgcctttacgcgcgatgtcgggcgcggcttctccgtggtttatccgcatctggtgcgccagaacttcaacaaggactggaccgaagccgaccgtgacgaacagctcatccgccgtggccgttatgtcgaattcaacctgctttatgatcgcggcacaatcttcggcctcaagaccggcgggaatatgaatgccatcctgtcttccatgccgcccgtggtgaaatggccctga

SEQ ID NO: 2708 - DNA, 912 bp, Sinorhizobium medicae WSM419
atggaaagaccgcaattgccacagggcctgccggccgacatcgaacgcaagaaagcagaggcgaaagcttggttcgaaagcctccgcgacacgatctgtgctgacttcgaggcgatcgaggatgatttggctggccctctgtcggatcgtccggcaggccgtttcgtcgccaaggactggctgcgagacgaaggtaacggcggcggcggtcgcatgtccatgatggaggggcgcgtcttcgaaaaggtgggtgtccacacctcgaccgtctttggcgagttctcacccgagttccgcgaccagattcccggcgcgagcgaagatcctcgcttctgggcctccggcatttcgctgatcgctcacccggtcaaccccaatgtacctgccgtgcacatgaacacgcgcatggtcgtgacaaccagcaactggttcggcggcggtgcggatcttacgccggtcctcgatcgcaggcgcatcccgaccgatgcggacaccgttctcttccatcgcgcgatggagatcgcctgcaataggcacaaggtcgcggattatccgaaattcaagcaatggtgcgacgagtacttctatctgaaacaccggaacgagccgcgcggcaccggcggcatcttctatgactggctgcgctctgacgaggaaattggcggctgggaagcggatttcgccttcacgcgcgatgtcggcaaagccttcgcgatcgtctatccgagaatcgtccgcaccaatttcaacatgccctggaccgaacaggaccgcagcgaacagctcgtgcgccgtggccgctacgtcgaattcaacctcctatacgaccgtggcacgatcttcggactcaagaccggcggcaacgtcgagtcgatcctctcctccctgcccccgctcgtgcgctggccctga

SEQ ID NO: 2709 - DNA, 915 bp, Ochrobactrum anthropi ATCC 49188
atgcaacgcgacgaaattccagcaatcatccccacagacatcgaagagaagaaacaggcggcacagcgctggttcgaggaactgcgcgaccgtatctgtgcaagctacgaacaacttgaagatgaattgcagggcccactttcggatcgcgaacccggacgcttcgtccgcacgccctggcagaaggacgaaggccgtggcggcggtggcgtcatgtcgatcatgcatggccgtgtcttcgaaaaggtcggggtgcatgtctcgacggtctatggcgagttctcgccggaattccgcaagcagattcccggagcagaggaagacccgcgttattgggcgagcggcatttcgctcatcgcccatccgcaaaacccgaatgtgcctgccgtccacatgaacacgcgcatggtcgtgaccacgcgccagtggttcggcggcggtgccgacctgacgccggttctggacaaccgccgcacgcaggacgatcccgatacactcgccttccacaaggctttccgtttcatctgcgagaagcacaaggacatcgtcgactatcagcgcgtgaaggactggtgcgacgagtatttcttcctgccgcaccgcaatgaagcgcgcggcaccggcggcatcttctatgattggctgcattcgccggacgaaaaaggcggttgggatgcggattttgcctatacgcgcgacgtgggacgcggtttctcggtcgtctatccgcatctcgtgcgccagaacttcaacaaggactggaccgacgcggatcgcaacgaacagctcatccgtcgtggccgctatgtcgagttcaacctgctttacgatcgcggcacgatcttcggcctcaagaccggtggcaatgtgaattccatcctgtcttccatgccgcccgtggtgaagtggccttaa

SEQ ID NO: 2710 - DNA, 912 bp, Rhizobium leguminosarum bv  trifolii WSM2304
atggaaagaccggaactgccgatcggcttgcctgaggacatcgaagagaagaaggccgccgcccgcagctggttcgaaggactgcgcgatacgatctgcgcctcctttgaagccctcgaagacgagttggagggcccgctctccgatcaggagcccggccgtttcgtcgccaaggactggtcgcgcgaaaacggcgccggcggcggtggccgcatgtcgatgatggaaggccgggtcttcgagaaggtcggcgtccacacctccaccgtccatggcgaattctccccggacttccgggcgcagatacccggcgccaaggacgatccgcgcttctgggcctcgggcatttcgctgatcgcccatcccgtcaaccccaacgtccccgccgtgcatatgaacacccgcatggtggtcacatcaagccgctggttcggcggtggcgccgacctgacgccggtgctgtcgcgccgccgcacccaggaggacgaggacagccagctcttccacaaggcgatggagatcgcctgccgcaatcatgccgtcgccgattacgatgcctacaaagcctggtgcgacgactatttcttcctgaagcaccgcaacgaggcccgcggcattggcggcattttctatgactggctgcattcgaacgaggatgccggcggctgggacgccgatttcgccttcactcgcgatgtcggccgggccttttccatggtctatccgaaaatcgtccgatccaacttcaataagttgtggacagaggccgatcgcgacgaacaattgatccgccgaggccgctacgtcgaattcaatttgctgtatgatcgcggtacgatcttcggcctgaagaccggcggcaacgttgaatccattctttcgtccctgccccctgtcgtccgctggccatga

SEQ ID NO: 2711 - DNA, 915 bp, Agrobacterium vitis S4
atgcaacggcccattctgcccaaaggcttgcctgacgatatcgaggtaaagaaggccaccgcccgcgcctggttcgaaagccttcgtgaccagatctgccggtccttcgaggcgctggaagacgaattgaccggccccttgagcgatcgtgcgcccggacgcttcacgcctaaggattggcagcgtgaagaagggcttggcggtggcggacgcatgtcgatgatgaatggccgggtgttcgagaaggtcggcgttcatacctccacggtgcatggcgaattttcgccggaatttcgcaagcagatgccgggtgccgaggaagacccacggttctgggcctcgggcatctcgctcatcgcccattcctgcaatccgcatgttccggcggtgcatatgaacacccgcatggtggtcaccaccagccaatggttcggcggcggggcggatctgaccccggtgctggatcgacgcagaacgcaggacgatgccgataccgttgcctttcatgccgctctcgaagccgcctgtgcggcccatcctgacgtcgccgattatccccattacaaagcatggtgcgaggaatatttctttctgccgcatcgccaggaaccgcgtggcatcggcggaattttcttcgactggctgcatgccggggaaaaattcgacctctgggccgccaatttcgccttcgtgcaggatgtcggacgccagttcgctgccgtctatcccgatctggtccggcgcaacttcaacacaccatggaccgaagaagaccgggaagaacagctggtgcgccgtggccgttatgtggagttcaacctgctctatgatcgcggcacgatttttggcctgaagaccggcggcaatgtcgaatcgattttgtcgtcgcttccgcccctcgtccgctggccttga

SEQ ID NO: 2712 - DNA, 912 bp, Rhizobium leguminosarum bv  trifolii WSM1325
atggaaagaccggaactgccgatcggcttgcctgacgatatcgaagagaagaaggccgcagcccgcaattggttcgagggattgcgcgatacgatctgcgcctccttcgaggccctcgaggacgagttggaagggccgctatccgaccaggagcccggccgcttcgtcgccaaggactggtcacgcgaaaatggtgctggcggcggtggccggatgtcgatgatggaaggccgcgtcttcgaaaaggtcggcgtccatacctccactgtctacggcgaattcgccccggatttccgcgcccagatacccggcgccaaggacgatccgcgtttctgggcctccggcatctcgctgatcgcccatcccgtgaacccacacgttccggcggtgcacatgaacacccgcatggtcgtcaccaccagccgctggttcggcggcggggccgacctgacgccggtgctgtcgcgccgccgcacgcaggaggacgaggacagccagctcttccacaaagccatggagatcgcgtgccgcaatcatgccgtcgccgattatgatgcgtacaaagcctggtgcgacgaatatttcttcctgaaacaccgcaacgaggcccgcggcatcggcggcatcttctacgactggctgcattcaagcgaggaagccggcggctgggacgccgatttcgccttcacgcgtgatgtcggccgggctttcgccatggtctatccaaaaatcgtccgctccaacttcaataaattgtggacagaggccgatcgcgacgaacaattgatccgccggggccgctacgtcgaatttaatctgctgtatgatcgcggcacgatcttcggcctgaagaccggcggcaacgttgaatccattctctcttcgttgccccccgtcgtccgctggccatga

SEQ ID NO: 2713 - DNA, 420 bp, Syntrophomonas wolfei Goettingen
atgtccaatctgcgaaattgctccaagtgcgggagggtttttccctatatgggccggaacatatgtcccaggtgtttggaaaaagaggaagatgaatatcaggtggtacgaagatatgttcgcgaccatcccggggctggggtaattgaggtagtagaagaaaccggagtagaggaagacaagattctgcaatttttaagggatggcaggctgcaggccaagggactaacagccagtttgcgctgtgaaagatgtggacaaagcataaactctggtcgcttttgcgaaagctgtattaatgaggttaacgctgagattcaggggcatctgccccaaaaagccaagagtgaagagccgaaaagaccaccccgcggcaaggtaaaagataagatgcatatcaaagatagaggttttttctag

SEQ ID NO: 2714 - DNA, 444 bp, Clostridium thermocellum ATCC 27405
atgccggatataagaaactgcaaacgatgcggaagacttttcaactatatcggaggacgccccatttgccaggattgcaagaaacaggatgaagaagaatttaaaagagtgaaagaatacctttatgagcatcccaaagcttccattattgaggtgtcgaatgcgctggatatcagtgttcagaagataaagagctatctgagggaaggtagacttgaaattgtcggaaccgaagggaatgtagtgcttgaatgtgaaaaatgcggcaagtccataaatacaggaaggttttgcaatgagtgttcccgcgaacttaccgaggggtttaaagccaccgcgcaggaaataagcaagtcagtatccggtgataccgacaagaaaaagacatcgggaatgggaatgaaatacttgaacagatatgaaagatggaattcggataaatga

SEQ ID NO: 2715 - DNA, 417 bp, Thermoanaerobacter sp. X514
atggaaataagaaattgtaaaaggtgcggaaggctttacacgtacacaggaattgacctatgtccagtgtgctatagacaggatgaagaagattttatgaaagtgagggattatttagatacacatccctcggctaccatgctggaaatatctcaaaatacacaggtttctacaaagaaaataatggattttttaaaggaaggcaggcttattttaacctctaataacgtcaatataggtcttaggtgcgaaagatgtggtaaaccaatacttacaggtaggttttgtgacgagtgcaaaaccaaattagctaaggaattaatgaaaggctattcgattcaatccgatgacaaagaagaagaaaaacaaacaggagaaagactgtacgtttatgagaatcaaaaaaagaaaaaatga

SEQ ID NO: 2716 - DNA, 417 bp, Natranaerobius thermophilus JW NM WN LF
atgcaaaacctcaaaaactgtaagcggtgcggaaagttatttttaaaaacgacccgagatatttgccctgattgtcatcaaaaggaagaagatgattttttgaaggtgaaacagtatctggataagaatcctggtgcgacaattgttgaagtttccgaagaaacagaagtatctcaaaaacagatcagaaagttcattgaagagggtagattactgacctcaaaatacgaagccctgacaattgagtgtaagcgctgtggtaaggagatttctcaaggtaaatattgtgaaagctgtcaaggagaactttcccagcaatttgaatccgtcaaaggagagcccaaacaaacagatgatgaaactaaagaaacaggcaaagtacatattaaggatcgtgtggacaagcgcagaagataa

SEQ ID NO: 2717 - DNA, 435 bp, Halothermothrix orenii H 168
atgaacttaaagaattgccccaaatgcgggaagttatttgcagtccagggtagtgaaaaaatatgtccggtctgtaaaaaagaagaagaagatgactttcaaaaggtaaaggaatacctatgggacaaccccggggctactattgaagaagttcatgaagaaacaggggtagaacgggaaaccattattaaatttgttaaagaagaccggttgattgctgaaggactggatttagaaatccttctggagtgtgaacgttgtggtgatcctataacccacgggcggttctgtgaaaagtgtcagcaggagctggttgagggtttaagccctacccccaggaagaaaaagaaacccagaaaaaaaacaaagcggaccagggacaaaatgtttattgctgaccgtgttgttaagagaaagaagaatactgaccaatag

SEQ ID NO: 2718 - DNA, 414 bp, Clostridium cellulolyticum H10
atgcctgatttaagaaactgcagaagatgcggcagaatgtataattttattggcggggctcctatttgccaggactgtaagaatgccgatgaggaagtttttaaaaaggttaaggattatttatatgataatcctggtgccacactgtcacaggtagccatggagcttgatgtgagtgtggaaaaaataaagatgtttttaaaagaaggacgtctggaaattaccgatgaatcaaacataattctggaatgcgaaagatgcgggaaatctataaagacgggtagattttgcagggaatgtcagaacgaggttagtgttgatctggagaagactacaaaaacaattcatcttgataattcagaccaaaacaggtcgaatggcattggaatgaggtatttaaataaaaagttataa

SEQ ID NO: 2719 - DNA, 441 bp, Anaerocellum thermophilum DSM 6725
atggatgtcagaaactgtcgaagatgtggtaaaatttatctttatgatggaagtcctatttgtcctcaatgcagaaaagaggaagaagaggatttcaaaaaagtgaaagagtatctttatgatcatcccggtgcaaccttgccagaagtatcaaacgcaacaggcgtgtcacctgaaaagattttaaggtttttaaaagaggaaagacttgagattgtgggtgagagcaatatcattttagaatgtgaaagatgtgggaaggcaattaaaacaggaaggctttgtgatgagtgtaaaaaagaggttggaacaaggtttttgagttatcttgacgacaaaaagcttcaagaatcgaaaaagaaaaatgaagagtttgcaaaaagaaaagaagcaggttacaggtatctttcgaaggagttaaaagaagatgagaacaagtga

SEQ ID NO: 2720 - DNA, 408 bp, Geobacillus WCH70
atgggagagcttacaaactgtccgagatgcgggcggctttttgtcaaacattccattcgtgatgtttgcgaacagtgctataaagaagaagaggcattgtttgaaaaagtgtatcaatttctccgtaaacgcgaaaaccgcactgccacgatggcgcaagtcgtcgaggcgacgggagtaagcgaatcgctcattacgaaatggattaaaatagggcggcttcagctcgttcattttccaaatctcggctatccttgcgaatcgtgcggcacgatgatccgcgaaggacaactttgtccgaaatgtagaacaaggtttcaaacacaattaaagcagcttgagaaagaaaaacagcgacaacgacaaagaatggtaacttattatgtccaaaaagatgaggagcattaa

SEQ ID NO: 2721 - DNA, 573 bp, Rhodospirillum rubrum ATCC 11170
atgatcgagcagatcggcagcgtcgaagaagccgacgcaggaaaagtcctggagagccttgttctcagcttttcacccagcttgttgcccctgcgccagcgctggcgcaacaacgggctctcggcggatttcctgggcgactacgtgaccaccttctttcccggggcgggcgatgacacgacgacggccgatcgccagaagcacgccaaggcggcggtcagctatatcgccaatgaactgcttgaaaacgccatgaaatacagcgcggccgaatccacccggccgatcaccatcacgctgagcctggaagccgagcgcatcaccttcatcgagaccaatccggtcagccgggcccgcgccgcgacgttccacagctacgccaccgagctgatcgccagcgatccgatggagatgtacctgcgtatccttgaagaggaacgtagcgacgatgacggatccgggcttggtttgataacaatgatcaacgattataacgcgagcctgtcctggcgattcgaggatccgggagaggacaccgtaatggtctcgaccatcgtccaaatccccgtttga

SEQ ID NO: 2722 - DNA, 558 bp, Sinorhizobium medicae WSM419
atgacgaccttgtatggactggaggatctcgccgtcgggccgggcgagaatgtgacgaaactccgtctcttcgacggcccgctcgatctcgggtggaaacattgcgcgatgacctccgattttgtggccgagttcgctgccctgcgctacaaaacgtctcgcgtcgtctacaaggaggtgcgtcacaatgtcggctatctgaccaatgagctgatagagaatgctgtgaaattccgcgctggcggggaaatcgtcgtggaggcatcgatcgcctccaacacatttcggacaaaagtttccaatctcgtggacaaaggaacagccgacacgttccgccacatcctttcggaaataacgataggagatccatccgaccttctgatacagcggatagaggcaaatgcaacaggttcgggatcgggttccgggcttggacttctcaccctcatgagcgattatggtgctcacttcgcgtgggtttttggatccggcgaagaggatggcaagatcccgctggagacctatgcctcaatcgcaattcccgacctctcgaattga

SEQ ID NO: 2723 - DNA, 540 bp, Anaeromyxobacter sp. Fw109-5
atgagcacccccaccgtcctcggcgcgttccccgaggtcacccccccgccgctcagcgcgatcgagctggaggtcttcccgatagacctcgtgaccgagtggcgacgttgcggcatgatcgccgacttcatggccgactacatggggcaaggcttcgagcggcccgacacggcgcgcagcgtcctctccaccgtgatgaacgagctcgtggagaacgccgccaagttcagcgcggacgctcgcgcgccggcccgcgcctcgatccgccaccacggtgaggtggtgcacctcgagatccaaaacgaggccaccgagcagcacctccagagcctgcgggacctgctccccgcgctcgcccggggcgacgcggccgacgtgttccaccggcgggtacaggatcggcgcgggctcggcatcgccctgctcgctaaggattacggcgcgaccgtgggggccacggtcctgcccgcccaggcgggcggaagggtgacggtctgcctgcgcgtggagctcagcgcggcggaggtcgagcagcgatga

SEQ ID NO: 2724 - DNA, 561 bp, Rhizobium leguminosarum bv  trifolii WSM2304
atgacgccaacggtatttggcatcgaatctctgaccgacataagcctggattcgggcacgcgccttacattgaccgatggaccgcttcagcttggatggaagcactccggcatgacggccgacttcatcgctgaggtcatggcgctaccctttttacgttcgaaaaaagactacatgcaggcgcatcatgacatcggctacctcagcaacgagctgatcgaaaacgccgtcaagtttcgccagcctggcgagatcctcattgaagccggcatatccgaggggagctttttgatacgggtgaggaataccatcgacggcgcgacagcctcacgctttcagcaactgctgcagcgcctgcaatcgaaggatcccggggaacttcttcttgagcaaatcgaaaccaacgccatatcgtctgcaagcggttccggcttgggcttgctgacccttttgagtgattacgacgcaaaaatggcatgggcattcgaagagaatactgatgagcgtattatcctgacgaccactgcagccgtggcgatgccgccctcctccaatccgtga

SEQ ID NO: 2725 - DNA, 582 bp, Cyanothece PCC 7424
atgagccaaatttttggggattttaggcaagatttacccgaaagcgaacagtgtttaatgattagcttttctccttgttctgttcccttacaacaacgttggtgtaataatgggttatcagcagattttgtggctaattatttggcgactttttttccctgtaataaagatgatcccaatagtcttaaacgacaagctcatctcaaaagcactgttagttatattgctaacgaattattagaaaatgcaactaagtttcatgatgagaataccactgcttctattcagttgggaacttatttaatccaaaatttagtcattttattggctactaattgtagttctattagagtagctaatcagttagagttagtgattgaaaaattaattaattctgaaccagaggagttatatattcaacatttagaaatgttggctgaagatgaaaattatcttgggtctggattaggatttctaacgattatacacgattattttgctaaaattggctggaaaattgaacccctcccatctgaggtaaatttagtcagggttactactatggttcaagttagggtataa

SEQ ID NO: 2726 - DNA, 588 bp, Cyanothece PCC 8801
atgaaaacctctgagatttatggagattttgacgataatctacccgataacgatcagtttttagtgattagtttttcgccttcttcaattcccttaaaacagcgatggcgcaataatggtttatcagcagattttatggccgattatctaactaccttttttcccattgatgaaaatgatgttaagaccatcgctcgtcaaaaggaactcaaagcgggggtgagttatattgccaatgaactgctagaaaatgctatgaagtttcacgatgacagaaccgaagacccgatcagatttggcatccgtctcctagaagatacggtggtgttgttttcctctaattgtgtctctctagagacgtggttaaagtttcagccgattgttaacgatttgattacttgcgatctcgaagaattgtatgttactcaactcgaaaaactggccgaagatgacgaaagcagagcgtctgggttaggattgattaccattatgaatgactacggggctaccctaggctggaaaattgataaaacccaagaaaaagatgatttaataaccatcaataccatggcacaactgaagatttaa

SEQ ID NO: 2727 - DNA, 597 bp, Cyanothece PCC 7425
atgaacacagtggacaaatcaacaataaaaatttttggagattttgttgaggatattcccgccacccaggagtacctgacgatcggcttttctcctcggggcggagcctggcgacaacgctggtccaccaatggcatctcagccgattttttaggagactattttgccacatttttccctggagatgaattgttggagggccgcgatcgccaggaaaccgttaaagcgtctgttagctatctagcgaatgaactgctagaaaatgccatgaaatatggctccacggagtatccggtcagtatttctctatatctttatgtcaaagaaattatttttgtggtctctaatagtgccacggctgaagttgcccaaaagtatcaagcttttattgaacaagttcaaaccacagatatcaatgaactctatttgaaacaattagagctggcggcgagtggaggcggagggtcaggaatgggtattctcaccttaatcaatgactatgctgcccgctttagctggaaatttgaattgctacccaactcctccctgaccagagtgactgtaatggcccatttagatctggaagcgatgacataa

SEQ ID NO: 2728 - DNA, 573 bp, Thioalkalivibrio HL EbGR7
atgactcaggatcacgggcagatcagggaaatccggcacgaccgtaacacggaatccctcgacctgtcgttctggcccggttcccttccgctcaagcagcgctggcgcaacaacggcctgtccgccgattttctgggcgattacgtcaccaccttctttcccctggacgagacggacccgtccacccgggcccgccagagcgagatccgcggggcggtcagcttcatcgccaatgagcttctggaaaatgccatgaagttccacgatgaatcgctcccggaacccatcaccatgcggttgtgtctgttcccggaggagatcgtgttccagcagggtaatgccacgggcagcgaggctgcggacagctttcgtgccttcgtggagcgcttgcgcgactcggatcccaacgaactctacatccagcagttggaggaaggcgcagtctcggagggcagcgcgggactcggctacctgaccatgatcaacgactacggggctgagcttgcctggagattcgagcccctggtatcccatggctttcgcgtcaccacccaggtgaccataaaaatctga

SEQ ID NO: 2729 - DNA, 561 bp, Rhizobium leguminosarum bv  trifolii WSM1325
atgacgccaacggtatatggtatcgaatctctggcgggcataagcctggattcaagcactcgcctcaagttaagcgacggaccgcttcagcttggttggaagcactccggaatgacttcggactttatagcggaagtcatggctctgcggtattcacgttcaaggaaagactacgtgcaggcgcatcatgacatcggatatctcagcaatgagttgatcgaaaatgccgtcaagtttcgacagcctggggagatcctcattgaagccggcatattcgacggtacttttttaataagggtgaaaaacacgatcgatggcgtgacatcctctcgctttcagcaactgctgcatcgccttcaatcgagggaccccggggaacttcttattgagcaaatcgaaaccaatgccatatcggcagaaagcggttcgggcttggggttgttgacccttctgagcgattacgatgcaaaaatggcatgggcattcgaagggaaagataaccagcgtatcatactgacgacgactgcagccgtggcgatgccgccctcctccaatctgtga

SEQ ID NO: 2730 - DNA, 588 bp, Cyanothece PCC 8802; identical to SEQ ID NO: 2726

SEQ ID NO: 2731 - DNA, 1749 bp, Shewanella sp. MR-7
atgagcttaccgcagccgttaatgttcactgttggactaatagaccaaatcaccaagccgattgccaaaataacccaatcgctaggcggtcttgcctccaactaccaaaccggaaccatgcaaatggcctccggcattggtggcattgcggccagcggttatgccttgcaacaagcattaatgccagccattgaaatggaccgcgcactaggtgaagttaaatcattaggcgtacaagacgacgccttaaaaatgctggctaataactcttacgactacgcgctgcaatacggtaaatcggccacagactttgtgcgctcaagctacgatattcaatcggctattgctggcctaaacgccgccgatttatcccgttttaccatgtcatctaacgtactggccgccgccacaaaagccgatgccgccaccgtgaccagctacatgggcaccatgtacggcatctttaaaaacgatgccatgcaaatgggcgaaggcgcatgggtagagcgcttaacaggcatgacagcaacagccgtacaagcctttaaaaccgacggtaaaaaaatggctgacgcctttggtgccttaggtgcatcggcagacaaaacaccgcttgaagaacaaatggcgatcatgggcaccttgcaagccaccatgcagggcagcgaatccgccaccaaatacaaatcgtttttagccggagtgggtaaagcccaagacgcgctcaaccttaaatttaccgactcacacggcgcaatgctgccgattgttgacatcctcaacaaaattaaaggcaagtacggcgacgtgatcagcgtggcagaaggcgacgaactcgccaaagcgttcggctcgcaagaggccgtgtccatggtcaagttactgttaaacgacattaacggcctaagcggctcaatcaacatgctcggcaaagtcaaaggcatggaacaagccgaaaaaatggccgcagcgatgaccgaccaaagcgaacgcctcgctcaaagctggtatgtgatccgcgccgccgtgggcaccgcgatactgccagcctttaacagctttatcggcaaagtcgccgatgcaggcaaagaggtcatttggtttaccaatatgttccccaacatcacccgttggctgggctatgtggctatcggctttaccttagccgtggccgctggcggcttattcacgttgatgatgggcacgggcaaaatggcaatgaccacctacggtcttgcggtaatggcatggacgggcgccaacgccttatttaccagtggccttgccaccatgcgcgccatgttgctggccgttaacatcgctatgtacgccaacccaatcggcttgattgtcgcgggtattgccgccgccattgccgtagtcggtgcgctgatttactactgggacgaccttaaggccaccatgggcgaatggggatgggtgcaggcgattgtcggaatctttaacaccgtttggggcggggtaaaatccatctttaacgacaccatcaattggattatcgaaaagctaaatttaatcccaggtgtcgacattagcaccaacgtaagcgcgggcagtatgccaagcgttgacgccatttcacctgtgcaagccaacctcacacgcggcggcattagccagcaaatcgccaacgccaacaacagcaaatcgaccaccgtcggcaacatcaatatttatccgcaaaaggttgataccaactttgctaactatgtggagatgcactcatga

SEQ ID NO: 2732 - DNA, 2196 bp, Marinomonas MWYL1
atgagcgcattacaacgactcgattttatcgtcagtttaatggaccgagtttctggcccagcaaacaagatgatgaaaacgatggacacagtgacaagcaacatccaaaccggttaccaaaaaattggttatggtgtggctggcttgttttctgtgggatatgcgttcgatcaaatgctagaaccggcaaaagagatgcgcaccgcgctgggtactatctccagtttgggtgttgaaaatgcggcgttagaaaacttgcgtaaaacaagtatggccacggctgttcaatatggaacggatgccacagagatcgtgaatgcgtcgtacaagttacaaagtgcgatttctggcttgactggaaacgaactgagcatgttggcgaacaaatccgccatgctggcgactgccaccaaaggcggcttggaatcgaccaacgcctatgtggggcagatgtttaatattcatgctgtggaagccgacgcgatcggtaaaaccgcgttcatggataagttgattagcaaaaccgctaaagccgttcagcttttcaatactgatggtagtcagatgggcgaggccatgaagaatattggtaagcaagcgacggcgatgaaggttccgctcgaagaacaactggccgtgatgggattcttacaaaacacaatggtcgagggtggccgatccggtaacgcctattcgtcttttttggcgaatataagtaaagctgaaaccacgctagggatgaaatttactgactcgcaaaataaagccctgccgatgatagacatcattaccaagttgcaggataagtttggtgatttgagtaaagccggcgatcaacaaatgttgcaaaaagcctttggtaaacgagggcaacaagtgctcgcggcgatggctggcagcttagacacgtttaaaggaaatttagaaagcatcaaagcggtaaaaggcttggacgatgtgaccgccatggcgatggcgattgccgatccttgggaccaatccgccgccgctgttaaaaactttcgaatggaatttggcgagcgcttattgaaagtgttctcgcctgtttataccgccattaccgacaccatgaccactctcacaaaatggatggatatgtttccacacctaacaggctgggtgattaaaggcgtggtgggtattggtgttttagtgggcagtttatccgccctatccgtcgcggttggcttgagtaaatttgtcatggttggttggtctgtggttgcgaccagcgttggctttatttggggaacacttgggaaggtaattagtatttctcgcgctacttggtttgctatgaatctacaagttgcgctttctggcggcctaatgaacatgctgaaaattaacatgctcaccacttgggcaaccatggccgccggcaccattcaaaccaccgcgatgacattggccacaggtttttggagtaaatccatgatggtggcctctataggatcaaaagggttaaccgctggcttggctttaatgaagtttggcttcctttcttctattaccgctgtgtgggcgtttagcgcggcactgtgggcaaaccctattacatggattgtagtgggcgttgtcgcactaaccgctgccgtggtagccgctgtggtctattgggatgaatggacaggcaaactcgttgaatggggcaccgcgtttcttgattttatcggcgtgtttgattttgtcgatggcgtgttggccgtatgggacaagattccacaatggtggaactcgctcatgggctggtttggttcattcgatgtaggttcgttgtttagcagttttttaagtggctttggcttagtcgatggcgtgttagccctttggaacaaacttccagagtggtgggcgtctttcaaaaattatttaagcgggatgaatgtcttttcgtttgttggtgactcgattgattggctaatcgacaaaataaatatgatcccgggcatcaatatcgacacagcgaaagacatgcccaaacccgtggctgcacctgcgagcttatccaaccaagcgccaaaaatggcaggcggtggtttggtcaatcaaatcagtaacgcgacatcaaacaacaataactcccgcaacgtgggtgacgttcatatcaacaactacggccaagccatggatggacgaacatttgccaacgaactagcgtttgcggcggggtag

SEQ ID NO: 2733 - DNA, 1977 bp, Yersinia pseudotuberculosis YPIII
atgaaaagtctcgattttaccttaagcatgattgataaaatcacacggccattaaaatccgtgcaagcctctgtaaaaggatttgcggaaagttctcaggcggctttcggtaaaattgccattggcggggccgcgctgttcggtgtcgtacagggaatgaagggcgcactgggacccgcagctgaatttgccggcgcgcttaatgaggccagcgccaagggcgtgagtgatagcgccttgcaaaagatgagcgctgacgccctgaaattcagtatgcagtatggccgcagcgccgtggatgttgtgcgttcaagtgcagacgtgcgcagtgcaatcggtacgctgtcggaccgggatttgccccgcttcaccctggccaccaatgtgttggccgctggcatgaaaaccactggcagcgaagccgccgcctacatggggcaaatgtataaccaatttgacagctacgccgcccgcataggtaaagtgaagtttgccgaagaggtggccggtaaaacggcatatatggcgcagtcatttggcgtcagtatgcagactatggctgacttgatggccggttcaaaaggggttggcgctaactacggtgtcggcattgatgagcaatttgccgtattgggtcagttacaaaaaaccttaggaaccgaagccagcggcagttatgaaaactttatgaagggggccgcagacggtgcaaaaacgctggggttgagctttgtgaatgcctccggtcagatgctgaccatgccggaaatgctggataagttacaaggccgctacggtaaaaccattgagggcaatttaaaggcacaggccgagctggataaagcctttggtgatggtgccaatgttattaaacagctatacggcaatgtcgatttactgaaacgcaatatcggtgagctgggcagtaatgacgggatgaaacgggccggtgagatggccaagaaaatggccgacccatgggaacggctgatggctatctggacgggaatgcgggtaattttgggcttaaccctgttacctgtgctgtatcccatcatgaaccgcgtgtctgaaatcggcgagaggttcgcccgctggatgcagttattccccaatatcgcgcggctgatcggttatgccatgctggcgttgctgagttttgccgctgccggggccatcgccaatatggtgatggggatcagcatgtttatctggatggggttaaaactgctgtggggcgcattgtgtgcggtgacaaaaatccacacggcggctatttggttatataacacggcaatcatcgctgttaacgccaccatgcggattatgcgcggcgtgttactggcggtacgtatggcggcaatatcggcgggcatttcctttagtttcatgacatggcctatcctgcttatcattgtggccattgctgcgttggcggcaggtatttattacttgattacctactgggatgagattaaagcggccattgctgacactgcggctttccagtggttatccggggtagtgaccgcagttggggccgtatttagtgttgtatggaaaggtattgttgctgggtgggagtggctggtatcggctatcaccgggttatcaccactggccggtatcagtgccatggctgataccattggcaatgtgttcagtggattatgggactggctgaaaagtacctttgccgaaacttacaattggatcatcgataaactgaattatatccccggtgtaaatattgaggcgaaaagtatcccttcacaggaaagtagcccaatcagttcagccaataatttattaaccggtggccagatccaaaatattgaaaagggcgggattaataaagaaatcagcaataacgccaaaacggtgaccgataacagtaagcggtttgagaacgtgaatattaatatgcagggtggcatgacgccagagcagctaatggaatggcaggaattaaattaa

SEQ ID NO: 2734 - DNA, 1971 bp, Salmonella enterica serovar Newport SL254
atgaaacagttagattttacattaagcctgattgataagctgtcccgcccgttaaaacaggcacagagcagcgtcaccggctttgcggaaaaatcaaaagcggcctttatgcagattggcggtggtgtgctggctttagcgggtacaggaatggccatacggggtgcgttatcaccggcaattgaaatgtatgatgcgctgaatgatgcagcatcaaaagggattgatgatcaggcattaaaagccgtacagcgggatgccctgcgcttcagtacaacttatggcgccagtgcggtggaatttgttcagtccactgaaagtattaattccgccattgccgggctgaccggtaatgaactgccgaaagtgacaaaagttgctaataccctggcgtttgcactgaaatccaccgccgcagaaacggcggaatttatggggcagatgtttggtaatttttccgccgatgcggagcgtctgggcaaggttcagttcgctgaacagctggccggaaaaatggtgtatatgcgtaaaacgttcggtactgaaatggcgacgattaaggatttgatggaaggtgcacgcggcgtggggactaactacggtgtcggactggatgaacagctggcggtactggggcaattgaaccgcacgctgggaacggaagccagcagcgcctatgagggctttatgacgggggcagttgaaggggcaaaaaaactgggtctgtcctttactgacgccaccggaaaaatgctgtccatgcctgagatgctgattaaattgcagggcaaatacggcaagagcctggaagggaatctgaaagcccaggcggaactggatgcggcattcggtgacagttcggctgtggtcaaacacctttacggtaatgtggcgcttctccagaggaacatcaccgaactgggcggatctgacggtctgaaacgtacgcaggagatggccagtaaactggtgaaaccgtgggatcggtttgtacaaatcctgaaagccattcagaccgtaatagggctgacactaatcccggtattgtatccggtgctgaatcgtctggcggatatgggacagacatttgccagatggatgcagctatttcccaacattgcccgtgttattggctatgccgctatggctttgctggggtttgcggcagtgggtgcggttgccaatatcgtcatgggagtttcaaagttcatcatgatgggttggaagggggtatggaagttactcacagcggttaccaaaatcgatacggcctggacgtggcttaacacaaaagcaaagctggcgtgggctaatgtcatgaaatcattgcgaggcattcttcttgcactccgtatgcaagctattatgacaggcactgccattaattttatgagctggccggtcttgcttgtgatcggggcgatagcattgcttgcggcgggttgctggttgctgattaaacactgggatacggtgaaagcagctgttatggaaacatccgcgtttcaggcgtgtgccagggtggtggcgtggctggccggggtgttttccacagcgtggcaatttatcagtgaaggctggaacagttttattgcgctattaacagggttttcaccctcacaggcattaagtggactggcgtcgggtattgtatccatgtttgataatgtctggcagtccgttaaaggtggttttctgaaatcgtggaactggattgttgagaagctgaataaaatacccggcgttgatatctcaatggctaatgaaacctcttcgccaccattaacagtaaataatttatctacaggtggtgagctaaaaggaattgataaaggtggtatcagtaaatctgtcagtaataactcaaggtctgtgacggataacagccggaaaattaatactgtcaatatctatccaaaagaaatgataacgccggggcagttaatggagtttcaggagctgggcgtatga

SEQ ID NO: 2735 - DNA, 1971 bp, Salmonella enterica serovar Heidelberg SL476
atgaaacagttagattttacattaagcctgattgataagttgtcccgcccgttaaaacaggcacagagcagcgtcaccggctttgcggaaaaatcaaaagcggcctttatgcagattggcggtggtgtgctggctttagcgggtacaggaatggccatacggggtgcgttatcaccggcaattgaaatgtatgatgcgctgaatgatgcagcatcaaaagggattgatgatcaggcattaaaggccgtacagcgggatgcgctgcgcttcagtacaacttatggcgccagtgcggtggaatttgttcagtccactgaaagtattaattccgccattgccgggctgaccggtaatgaactgccgaaagtgacaaaagttgctaataccctggcgtttgccctgaaatccaccgccgcagaaacggcggaatttatggggcagatgtttggtaatttttccgccgatgcggagcgtctgggcaaggttcagttcgctgagcagctggccggaaaaatggtgtatatgcgcaaggtcttcggtactgaaatgggcactatcaaagacctgatggaaggggcgcggggcgtcggtaccaactacggcgtcggactggatgaacagctggccgtactggggcagcttaaccgcacgctgggaacggaagccagcagcgcttacgaaggcttcatgaccggagccattgagggcggtaaaaagctggggctgtcctttacggatgccaccggcaaaatgctgtccatgcctgagatgctgattaaattgcagggcaaatacggcaagagcctggaagggaacctgaaagcccaggaggaactggatgcggcattcggtgacagttcggctgtggtcaaacacctttacggtaatgtggcgcttctccagaggaacatcaccgaactgggcggatctgacggtctgaaacgtacgcaggagatggccagtaaactggtgaaaccgtgggatcggtttgtacaaatcctgaaagctattcagaccgtaatagggctgacactaatcccggtattgtatccggtgctgaatcgtctggcggatatgggacagacatttgccagatggatgcagctatttcccaacattgcccgtgttatcggctacgcagctatggcgttgctggggtttgcggcagtgggcgcggttgccaatattgtgatgggcgcttctaagttcatcatggcaggtttacgcgggatctgggttgccatgaccgccgtcacgaaagcatatacggcaatggtatggttggcacaaattgctgttatcgcctggaatgcgacgcttaaatttttgcgcggagcgttgctggccgttcgtatggcggcaatcatggccggaatcggtattaatcttatgagctggccggtcttgcttgtgatcggggcgatagcgttgcttgcggcgggttgctggttgctgattaaacactgggatacggtgaaagcggctgttatggaaacatccgcgtttcaggcatgtgccaggggggtggcgtggctggccggggtgttttccacagcatggcaatttatcagtgaaggctggaacagttttattgcgctattaacagagttttcaccctcacaggcattaagtggactagcgtcgggtattgtatccatgtttgataatgtctggcagtccgttaaaggtggttttctgaaatcgtggaactggattgttgagaagctgaataaaatacccggcgttgatatctcaatggctaatgaaacctcttcgccaccattaacagtaaataatttatctacaggtggcgagctaaaaggaattgataaaggtggtatcagtaaatctgtcagtaataactcaaggtctgtgacggataacagccggaaaattaatactgtcaatatctatccaaaagaaatgataacgccggggcagttaatggagtttcaggagttgggcgtatga

SEQ ID NO: 2736 - DNA, 1968 bp, Salmonella enterica serovar Agona SL483
atgaaacagttagattttacattaagcctgattgataaactgacgcgcccgttaaagcaggtgcagagcagtgtcacaggctttgcggaaaaatcgaaagcggcctttacgcagattgggggcggtgcgctggctttagccggcacagggatggccatcaaaggggcgttatcgccggctattgagatgtatgacgcactgaatgacgctgcggcaaaagggattgatgatcaggctttaaaggctgtccagcgtgatgcgctgcggttcagtatgacctacggtgccagcgcggtggagtttgttaagtccacagaaaatattaatgcctccattgccggcctcgccggtaatgagctgccgaaagtgacaaaagttgctaataccctggcatttgccctgagatccacatctgccgaaacggcggaatttatggggcagatgttcggtaacttttccgctgatgcggagcgtctgggcaaggttcagttcgctgagcagctggccggaaaaatggtgtatatgcgcaaggtcttcggtaccgaaatgggcactatcaaagacctgatggaaggggcgcggggcgttggtaccaactacggcgtcggactggatgaacagctggccgtactggggcagcttaaccgcacgctgggaacggaagccagcagcgcttacgaaggcttcatgaccggagccattgagggcggtaaaaagctggggctgtcctttacggatgccaccggcaaaatgctgtccatgcctgaaatgctgatcaagttacagggcaagtatggcaaaagtctggaagggaacctgaaagcacaggcggagctggatgcggcatttggtgacagttcggcggtggtgaaacacctgtacggcaatgtggccttactgcaacgtaacatcactgagctgggcggttctgacgggctgaagcgtacacaggagatggccggcaaactggtgaaaccgtgggatcgctttgtacagatccttaagtctgttcagaccgtcattggactgacgttgatccccgttctgtatccggtgctgaaccgcctggctgatatgggacagacctttgcccgctggatgcagttgtttcccaacattgcgcgtgttatcggttatgcggctatggcgttgttggggtttgctgctgccggcgcaatagctaacatcgttctgggcgtctcaaaacttattaagctgggtgcgattgctctctggaagacactgacttcagtcacgaagatatacaccgccaccgtctggattgcctcaaaagctgtagcggcatggaatctgacgcttaaatttctgcgtggtacgcttcttgcggttcgtatggcggcaattatggccggaattggcataaatctgatgagctggccggttctgctggttattggtgcgattggcctgctggcagcagggtgttatctgctgattaaacactgggacgatgtacaggcggcggtgatgaatacggcagcgtttaccgctgtggctggcgttgtcgaatggcttgccggtgtgttctcgacggcatggcaatggattaaggacggctggaacggctttattaatctgctgacgggattttcaccttcacaggcattaagcgggatggccggtggtattgtatccatgtttgataatatctggcagtccgttaaaggtagcttcctgaaatcatggaactggattgtagaaaagttgaataaaatacccggtgtcaatatttcgctggctaacgagtcacctccggcactgacaacaaatacgctttctactggtggagaattaaaaggaattgataaaggtggtattagtaaatctgttagtaataactcaagggttgtgacggataacagtcggaaaattaatactgtcaatatctatccaaaagaaatgataacgccggggcagttaatggagtttcaggagctgggcgtatga

SEQ ID NO: 2737 - DNA, 2115 bp, Aliivibrio salmonicida LFI1238
atgagtgcccacctagacaaattgatgatgcaagttgcattgattgatagtgtcaccaaaccgctaaaagggatccagaatacggtgaccgaaacagcggatgttggccgttcaggttgggaaaaaatggcaggtggtacggctggcgtgattgcagcaggttttgctgttcaacaggcgttaatgccagccattgaaatggatagggtgcttggtgaagttaaatcgcttggtgtggttgatgaagatttacagcaacttcaaaaaaccgcattagccttttcggttgagtatggaaagtcagcacaagaagtggttggtgcggcctatgacatcaaatcggctttcggggatattactggaccagagttatctgatattaccaaaagctctgccgttcttgctgcagcaactaaagcggatacagcaaccataactgattatatgggcaccatgtatggggtgtttaagaatcaggccaatgacatgggtgtgggcatttggtcaaagaacgtagcaggcatgacggctcaatctgtggagatgtttaaaacaacgggtaaaggcatgagtgatgcgtttaccagtgttggagcaaacgcaaccgctgcaggtatcaagatgaatgagcagatggctattcttggtacgttgcaatccacgatgtcaggcagtgaagccggtactaaatataaatcgttcttgactggtgttggtggcgcacaagacaaactgaacatgaagtttgttgatagccagggcgcaatgctgccaatggtggatattctcaataaattaaaaggtcagtttggcgacacgcttgatgtggcagaaagtgacgcattaaagaaagcatttggctcagatgaggccgtcagcatgatcaagttattgatggctgatactaacggattagcaagtagcattaactctcttggtaatgtgaaaggcatgagcaaagccgagaatatggctggtgctatgactgaccaatggcaacgacttgaagccgcatggtttgcgatccgtgccggagcgtttgggttaattcttccatctattaatgctattgctggttcaatggccgatggttttaatgtgctgcttggttggactcaagagcttcctgtattaacgcaataccttggttatttcgccttaacaatagtggctggtgctgggttaattgcggcatggaatatggttgtcggtttggcatctttgatgagtgccggatggtctagcgccacgttattactcacaacagtcatgaaaggctttaatttagtgatgagaatggcacgttttgcagctcttggatttgcgatggctgcagcagtggcacaagttccattactgcccttaattcttggtattggtgccgtggttgcggcagtcggtgcggtgatttatttctgggatgatttaaaagcggcgtggagcgatttttcattcattgaatctctaggctcaatggtggattggttaattgagaaaattaacttaataccaggcataaatattggcggtgaaagttcgggcattcctcaaatggatacgcttgaattaagcacagcaacaccaacgcattacgcctcaaaagcagcagtgccggattacagttatgggtatcaagcgccagtgactcaagaggtcgcagttactccaaatgttacagagcctgtgatcccgaaagtgtctgaacaaagtgttaactatggctctcaatattcagggttgaataccgtaccaagctatcaaggtaatgtgtattaccagaatcaaataccagtacaaccagagtcatctgatctgattataggctcggtggttgctcagccagaggttccagaagtgaatggtattgttacttatgacggagctattccaccattaactgatacggataagagtaaagagatgtcggcaccaatttcagcttacatcggtggaaatgcagaaggtaaagctaatgtgtctcagcaattaaaacagatgtctgcaggcagtaccgataatagccgaacgcagcatgttggcgatgtgtatatcactcaagagcaagcctttacgccagaagatttatcagcatggaatgagatgagtaccccatga

SEQ ID NO: 2738 - DNA, 1224 bp, Rhodopseudomonas palustris HaA2
atgaccgccaccgatgacacgccgacgccgtggctgtccatcgtcggaatcggcgaggatggcgtcgcgggcctgtcggacaaagcacgcgcgctactggcgaacgccgatctcgtgatcggcggcgagcggcacctcgcgatggttgccgcgctcggcaggccgaccctgccctggcgggtgccgttcgccgtgtcgctgccggacgtgctggcgcagcgcggccgcagtgtcgtcgtgctgtgctcgggcgatccgttctggcacggcgccggcgctgtgctcgccgatcacctcgcgccgagcgaatggaccgccctgccggcgccgtcgacgttctcctgggcggcggcaaggctcggctggcggctggaagagacgatcacgctcggcctccacgcccgccccatcaccatgctgcggccgcatctgcagcccggttctcggctcatcgtgctggtgcgcgatggtgccgcggtggcgcagatcgcggcctatctgacggcgacgggttttggaccgtccagcctcaccgtgctcgaagcgctcggcggcccgcgcgagcgcattctccgcgcagcagcggcgaactatacactcaccgacgtcgcagcaccggtcgcgatcggcatcgacgtggtcgcgcaacccgattccgccatcatcccacacgcaagcggcctgccggacgagctgttccagaccgacggccaactcaccaagcgcgcgatccgcgcggtgacgctgtcgagcctcgccccacggggcggcgaattgttgtgggatatcggcgccggctcgggctcgatcggcatcgaatggttgctggcggcgcgcagcaaccgcgcgatcggaatcgaagcgcggcccgatcggctggcttgcgcccgcggcaatgccgacgcactcggcgtgccgcatttcgatctccgccttgggcaagcgccggaagcgctcgccgacctgccgactccggacgcggtgttcatcggcggcggcgccggcaatccgggcgtgctggacgcggtgtggcaggcgcttccacccggcggacggctggtggtcaatgccgtgacgctggaaaccgaggcgctgctgatcgcctgtcacggccgccacggcggcgagttgctgcggctcggcgtcgaacgcgccgcgccggtcggcgggctcaccgcctggcgcgccgcgatcccggtggtgcaatggagcgtccgcaaatga

SEQ ID NO: 2739 - DNA, 1200 bp, Novosphingobium aromaticivorans DSM 12444
atggctcctgaagcgtggttgacgatcatcggcattggcgaggacgggccggacggcctttccgccgccgcccgcacggcgctggcgcaggccggactggtcatgggaccggcacggcacctgtcgctgctgcccgcgattacctgtaccatgatcgaatggccagtaccctttgccgatggcattgccctgctgatgcaacatcgcgggcagcgggtggtgatgctggcatcgggcgatccgttctggttcggggcgggaagcagtgtggcgcgcctgcttgatccgggcgaatgggtggcgatccccgcgccttccactttcacgctggcggttgcgcggctgggctggccggttcaggatgtggcctgtcttggtctccatgccgcgccgttagatcggctcaagccccacctggcaccagggcggcgcgtcattgcactgttgcgcgatggcgcggcggtggccgcgctggcggactatctgaccggccaaggctttggcgcgtcagcgttgcatgtgatggaagcgctgggcgggccgcgcgaacgggttcgcaccgcgcgcgccgaggggctgtctttcaccgacatcgcccatccggtagcggccgggatcgagtgtgccgggcatggcccgtccttgccgctgacggcgggccgaccggaccactggtttgcgtccgacgggcagttgaccaagcgtccggtacgcgcgctgacgctatcggcgctggccccgtgtgcgggtgagctgctgtgggatattggcgcgggatcgggatcgatcgggatcgaatggctgctggcccacctggccaaccgggcctgtgcgatagaggcggatccggtgcgcgcggaccgtgtgcgggccaacgccgctgcgctgggcgttgatcggctgaaagttgtcgtcgggattgcgccggatgccctgccaccgggaccattgcccgatgcggtgttcatcggcggtggtttatcggaagccttgctggacacgctatgggcacgtttgcccgccggaacgcggctggtgaccaatgcggtgacgctggaatcagaagcgctgctagcccggtggcatggccagaagggcgggagcctcctgcgcatcgaactggccgacgccgcaccgctgggcaaccggcacggctggcgcgcgcgctatccggtggtgcaatggagcgtgacgctgtga

SEQ ID NO: 2740 - DNA, 1200 bp, Jannaschia CCS1
atggctaaccttccgtggatcacgatcatcgggctcggcgaagatggaccggaggggctgccgcctgcaagccgggacgcgctggcggcggcggaaatcatcatgggcccggcgcgccacctggccttgatcggcccgaccaatgcgcagcaggttgaatggcctgtgccctttgccgacgggatcgacgtgttgcgtgggcacggaggccgcccggtggctgtgttggtctcaggcgatccattctggtacggggcagggcgtgcgatgtccaaggcttttggtcgcgatgcctggcgcgcgatcccggtgccgtcggtattttcgctggtgtcgtcccggatggggtggccgattgaagacacgctctgcatcggattgcacgcgcgccctttcgagcaattgcgggccaaactggcgccgggcaggcggatcatcgcgaccctgcgggacggccccgccgtgtcaggcgtcgcacacttcctgcgcgataccgggttcggcggatcgaccctgacggtatgcgaagcggttggaggcccccgggaggtcgtcacgcaggtgtccgtcgcggaggcgctgaagggcggcttcagccatcccgtcaccgtcgcggtggagcttcacgggacgggggaggtcatcccgctggcgagcggcagacctgatgcgctgtttcagaccgacggcgtcatgaccaaacgcccggtccgcgccctgacgctgtctgcactggcccctcgcgcgggcgagcacctgtgggatatcggcggtggctcaggttccatcgccgtggaatgggccttggcagatcggacctgcacagcgacggtcgttgagacccgggctgatcgtgtcgccctgatccgcgccaacgttgagagctttgggctgacggatcaagtcacggtgctggaaggaatggcccccggggccatggccgatgcgccgcccgccaatgccgtgttcatcggcggtggattgtcgcccgagatgctgcaattcgtgacggctctgcccaagggaacccgggtcgtggccaacgccgtcaccctggaggccgaggcgcatctggcgcaggcgcaaggatccttcggaggagacttgatgcgcatagagatcgcccacgcgcagccgctggggccaaaacgcggctggacctcagcctatccggtcgtgcaatggagcgtcacgctatga

SEQ ID NO: 2741 - DNA, 1113 bp, Rhodopseudomonas palustris BisB18
ttgatcgtcggcggcccgcggcatctggcgctggtggcggcgttggcgaagcccacgcaggcgtgggaaattcccttcgcggcctcattgccgaagctgttggcgcagcgcggcaagcgcgtggtcgcgctgtgctccggcgatccattctggtacggcgcgggctcggtgatcgcggacagcgtgccggccgccgagacacttgcgctgccggcgccatcgagcttcgccttcgccgcggcgcggctgcgctggcggctcgaagagaccaccacgctcggcctgcacgcccggccgctcgacttgctgcggccgcatttgcataacgccgcacgtttgatcgtgctggcgcgcgacggtgccgcgccggccaagatcgcggcctatctgaccggcttgggattcggtccgtcgcggctgaccgtgctggaagcgctcggcggtgcgcgcgagcgggttcgcgcaaccaccgccgacgactttgcgctcgatgatatccagtcgcccgtcgccgttgcgatcgaagcgatcgccacccccggcgcgatcatcatgccgcgcatcgccggcctgcccgacgacttgttccagcacgacggccaactgactaaaagggaaattcgcgcgataacgctgtcgacgctggcgccgcgcggcggcgaattgctgtgggacatcggcgcgggctcgggatcgatcggcatcgaatggctgctggcccacccaactaatcgcgcgatcggcatcgagccgcgcgaggatcgcctcgccaatgcgcgagccaacgcggcttcgctcggcgtgccgcatttcgatctgcggctcggctcggcgcccgaggcgttgcaggatttgccgacgcccgacgcggtgtttgtcggcggcggcgccagccgcgacggcgtgctcgacgcggtatggcaggcgctgccccgcggcggacggctggtggtcaacgcggtgacgctggaaaccgaggccgagctgatcgcgcagcaggcgcggcacggcggcagcttgctgcggcttgcggtggaacgcgccggcgccgtcggcggcatgaccggctggcgcgcggcgatgccggtggtgcaatggagcgcggtgaaatga

SEQ ID NO: 2742 - DNA, 1110 bp, Rhodopseudomonas palustris BisB5
gtggtcggcggcgaccgccatctcgcgctggtggccgcgctgaacaagccgtcgctaccctggcgcgtgccgttctccgcctcgctgcccgaggtgttggcgcagcggggacgaaatgtcgtcgtgctgtgctccggcgatccgttctggcacggcgcgggcgccgtgctcgccgaccacctgccgccgcaggaatggagcgccctgcccgcgccatcgacgttttcatgggccgcagccaagctcggctggcggctggaggatgtggtcccgctcggcctgcacgcgcggccgatcgcgacgctgcggccgcatcttcgcgacggcgcgcagctactcgtgctgctgcgcgacggcgcagcggtcgcggatgtcgccgcttatctcacgacctccggtttcggcgcctccgacatcgtcgtgctcgaagcgctcggcggcccgcacgagcgcatccggcgcacgaccgcgagcaactacgcctatgcggacgtcgccgcgccggtcgcactcggcatcgtcgctgtcgccgaacccggcgcgacgatcatcccgtgcaccagcggcctgccggacgatctgttccagcacgacggccaattgaccaagcgcgaggtccgcgcggtgacgctgtcgacgctggcgccgcgcggccacgaactactctgggacatcggcgccggctcgggctcgatcgggatcgaatggctgctggcggcgcgaagcaatcgcgcgatcgggatcgaggcgcggccggaccggctcgccaccgcccgcgccaatgcagaagcgctcggcgtgccgcatttcgatctgcggctcggccaggctcccgacgcgctcaccgcgcttcctccgcccgatgcggtgttcatcggcggcggcgccagccgtcccggggtgatggagacggtgtggcagtcgttgcccgccggtggccgactggtggtcaacgcggtgacgctcgagaccgaagccttgctgatcgactggcacggccgccatggcggcgagctgctgcggctcgcggtcgaacgcgcatcgcctgtcggcgggctgaccggatggcgcgccgcgatgccggtggtgcaatggagcgttcgcaaatga

SEQ ID NO: 2743 - DNA, 1164 bp, Rhodobacter sphaeroides 2 4 1
atggctgatccctggctctcgatcatcggtctcggcgaagatggaccggcgggacttccggatgcaagccgggccgcgctggaagcggccgaggtcgtggtgggcgggccgcggcatctggcgctggtggatgcccgggcgcgcgggatggaatggccggtgcccttcgatcccgcccctgtgctggccctgcgcggacgccccgtcgccgtgctcgcctcgggcgatccgttctggcatggcgcgggcggcagcctcgccgcggcgctgtcgcccggcgaatggcgcgcctatcccgcgcccggcgtggtcgcgctggccgcggcccggctcggctggcggcaggaggagctgctggcgctgggccttcacgccgcgcccttcgagcggctgctgcccgagctggcccccggccgccgcggggtctgcacgctccgcgacgggcctgccgccggggcgctggccgccttccttgcggcggagggctggggcgagagccggctctgggtgatggaggctctgggcgggccgcgcgagcgggtgcgcgccaccaccgcgggcgctttctctctgacggatgtcgcggccccggtgacggtggccttcgaggccgagggcgggcgggcgcagccgcgcagcgcgggcctccccgacagcctcttcgcccatgacgggcagatcaccaaggctccggtccgggcgctgacgctcgcggccctcgcgccgcggcggggcgagatactgtgggatctgggtgcgggctctggctcggtctcggtcgaatggtgcctcgcgggcggccgggccgttgctgtggaactccgccccgagcgcgcggccaacatccgcgccaatgccgcccgcttcgccctgccgctggaggtggtcgaggggcgcgcgctggacaatctgcccgcgttgcccgcgccggatgcgatcttcgtgggcggcggcttcgacgaggcgctgttcgcggcgctgccgcccacggcccggctcgtggtcaatgcggtgacgctcgaaaccgaggcgctgctcgcggcccttcaggcccgccacggcggcgagctcctgcggatcgagctggcgcgcgcggccccgctcgggcggatgcgcggctgggaggccgcccggcccgtggtgcaatggagcctcgtgcgatga

SEQ ID NO: 2744 - DNA, 1173 bp, Paracoccus denitrificans PD1222
atggctgatccctggctttccatcatcggtattcaggaggatggccttgccggcctgccgcctgcaagccgcgatgcgctggatcgggcggaaatcgtcttcggcgccccccggcatctggaactggcggggatcggcgggcagcggggccgggcatggccggtgcctttcggtcttgatccgctgctggccttgcgcggggaaagcgtggcggcgctggtttcgggcgatccgttctggcatggcgccggcggcagcatcgccgccgtgctgcaaacgggcgaatggcgggcctttcccgcgcccggcaccttttcgctggccgccgcaaggctgggctggcggctggaggagaccgcctgcctcggcctgcatgccgcgccctttgcccggctgcgcccggtgatggcgcggggggcgcgggcgatctgcctgctgcgcgacggcaccgcccccgcccagcttgccgaatggctggtggcgcaggggctgggcccgacgcgcatggtggtgatggaggcgcttggcggcccgcgcgaacgcatccgcgaggcacgggcgcagggtttcgcgctggactgcatcgcgccggtcgcggtggcgctggacggggcggatctgccatcgggcgccggcctgccgcgcggcttcggcctgcccgacgacagcttcgcccatgacggccagatcacccgtcgcgccatccgggcggtgacgctggcggcacttggcccgcggacgggagagatgctgtgggacatcggcggcggctcgggctcggtcagcgtcgaatggtgcctgaacggcggccgggcggtgacgctggagccccgcaccgaccgcatcgccaatatcgccgcgaatatcaaggcgttcgggctggcggatcggatgcgcgccgtccaaggcgcggcacccgatttcctccacgatcttccggcacccgatgcgatctttatcggcggcggcgcttcggccacgctgatcgacgccctgccccccgcccgtctggtcgcgaacgcggtgacgctggagaccgaggcgctgctgatcggcctgcacgcgcaacgcggcggcagcctgacccgcatcgcgctggaggaagccgtcccgctgggccggatgcgcggctggaccccggcgcgcagcgtgacgcaatggagctggccatga

SEQ ID NO: 2745 - DNA, 1164 bp, Rhodobacter sphaeroides ATCC 17029
atggctgatccctggctctcgatcatcggtctcggcgaagatggaccggcgggcctttccgatgcaagccggaccgcgctggaagcggcggaggtcgtggtgggcgggccgcggcatctggcgctggtggaggccggggcgcgcgggatggaatggccggtgcccttcgaccccgcccccgtgctggccctgcgcggacgccccctcgccgttctcgcctcgggcgatccgttctggcatggcgcgggcggcagcctcgccgcggcgctgtcgcccggcgaatggcgcgcctatcccgcacccggcgtggtcgcgctggccgcggcccggctcggctggcggcaggaggagctgctggccatgggccttcatgccgcgcccttcgagcggctgctgcccgagctggcccccggccgccgcggcgtctgcacgctccgcgacgggcctgccgccggagcgctggccgcctttcttgcggcggagggctggggcgacagccggctctgggtgatggaagccctgggcgggccgcgcgagcgggtgcgcgccaccaccgcgggcgccttcgcgctggcggatgtcgcggccccggtgacggtggccttcgaggccgagggcgggcgggcgctgccgcgcagcgcgggcctccccgacagcctcttcgcccatgacgggcagatcaccaaggcgccgatccgggcactgacgctcgcggccctcgcgcctcggcggggcgagatactgtgggatctgggtgcgggctctggctcggtctcggtcgaatggtgcctcgcgggcggccgggccgttgccgtcgagctccgccccgagcgcgcggccaacatccgcgccaatgccgcccgcttcgccctgccgctggaggtggtcgagggccgcgcgctggacaatctgcgcgcgctgcccgcgccggacgcgatcttcgtgggcggcggcttcgacgaggccctgttcgcggcgctgccgcccacggcccggctcgtggtcaatgcggtgacgctcgaaaccgaggcgttgctcgcggccctccaggcccgccacggcggcgacctcctgcggatcgagctggcgcgcgcggcgccgctcgggcggatgcgcggctgggaggccgcccggccggtggtgcaatggagcctcgtgcgatga

SEQ ID NO: 2746 - DNA, 1224 bp, Rhodopseudomonas palustris TIE 1
atgatcagtagcgatgacacagcgcagccctggctgtccatcgtcggaatcggcgaggacggtctcgacgggatatcggcccgcgcgcgggcactcctggacgcagccgagctggtcgttggcggtgatcgccacctcgccctcgtcgccgctctgcacaagccctccttgccgtggcgcgtgccgttcgcagcctcgttgcccaacgtgttggcgcggcgcggccgccgcgtcgtcgtgctgtgctccggcgacccgttctggcacggcgccggcgcggtgctggccgatcacctcgcggcgaacgaatggaccgcggtcccggcgccatcgacctttgcttgggcggcggcgcggatcggctggcgcctggaagacacagcgacgctcggcctgcatgcacggccggttgcaacgctgcgcccgcatctccgtccccaggcgcggctgatcgtgctggtgcgcgatggtgcagccgtggtcgaaatcgccgcgtatctggcggcgaatggcttcggcgcatccgagctcaccgtgctcgaagcgctcggcggcccgcgcgagcgcgtgcggcggaccaccgcgtcgatcttcgccttccccgacgtcaccgcgccggtcgcactcggcatcgccgtcgttgcagagccaaatgccatcattatgccgtgcatcagcggcctgccggatgagctgtttcagcacgacggccagctcaccaagcgcgagatccgcgccgtcacgctgtcgacgctggcgccgcgcggacatgagctgctctgggacataggcgccggtgccggctcgatcgggatcgaatggctgctggcggcgcgcagcaatcacgcgatcgggatcgagacgcggcccgaccggctcgccaccgcgcgcgccaatgccgaggcgctcggcgtgccacaattcgatctgcggctcggctcggcgcccgacgcgctcgccggactgcccacgccgaacgcggtgttcatcggcggcggcgccggtcgtccaggcgtgatggatgcagtgtggcaggcgctgcccgccggcggccggctggtcgtgaatgcggtgacgctggagaccgaagcgctgctgatcgactggcatcaccgccacggcggcgagctgctgcggctcggcgtcgagcgcgcctccccggtcggcggcctcaccggatggcgcgcggcgatgccggtggtgcaatggagcgtccacaaatga

SEQ ID NO: 2747 - DNA, 1242 bp, Methylobacterium chloromethanicum CM4
gtgtcgagcggggacgcggcgcgcgacgccgcgaccggcgccccctggctcgccatcgtgggcatcggggaggacggccgcgccggcctctcgcccgcggccgccgcggccctcgcgggggcccgggtcgtctatggcgggcgccgccacctcgccctggcgggttccctcgcggcggaggcccgggcctggccgagcccgatcacggacgcctatccggagatcctggccctgcgcggtgagccgacctgcatcctcgccacgggcgaccccttccactacggcatcggggccgagatcgcgcgcctcgtgccggccgccgagatccgggcctatccccagccctccgccttcagcctcacctgcgcccgcctcggctggccgctcgccgagtgcgcctgcctcaccctgcacggccgcgcgctcgcccggatcgtgcccaatctccagcccggcgcccgcctcctcgtcctctcttgggacgaaaccacccccgcggccgtcgcgaccctgatgacgaagcggggcttcggcggctcgcgcctaacggttctggaggcgatgggcggaccgcgcgagcgggtgcgcacggccgctgcggccgctttcgacctcggggacatcgacccactcaacaccctggcgatcgacgtcctggccgagcccagggcccgcgcggtgcccctcgcccccggcctcgacgacgcctggttcgagaatgacgggcagctcaccaaggcggagatccgggccgtgacgctggcggccctcgcgccgcgccgcggccagcgcctctgggacatcggcggcggcgccggctcggtctcgatcgagtggatgctgcgccatcccgcccagcgcgccgtcgcgatcgaggctcggcccgagcgggccgcgcaaatccggcgcaacgccgaggcgcttggggtgccggacctcgcggtggtggagggcgaggcgccggccgccctcgccgggctgccgccgccggacgcggtcttcgtcggcggcggcgtcggcgcgcccggcctcctgcccgccgccatcgcggcgctgggcgcgggcggccgcctcgtcgccaactcggtgacgctcgaggccgaggcggtgctgctcgcggccttcacggagcggggcggcagcctgcggcggctctcagtcgcccgggccgatccggtaggcgggctgcacggctggcgccccgccatgcccgtcacccagtgggtctggaccaagccgtga

SEQ ID NO: 2748 - DNA, 2646 bp, Frankia CcI3; identical to SEQ ID NO: 2236

SEQ ID NO: 2749 - DNA, 2679 bp, Arthrobacter FB24; identical to SEQ ID NO: 2239

SEQ ID NO: 2750 - DNA, 2661 bp, Acidothermus cellulolyticus 11B; identical to SEQ ID NO: 2240

SEQ ID NO: 2751 - DNA, 2691 bp, Nocardioides JS614; identical to SEQ ID NO: 2241

SEQ ID NO: 2752 - DNA, 2679 bp, Salinispora tropica CNB-440; identical to SEQ ID NO: 2246

SEQ ID NO: 2753 - DNA, 2679 bp, Frankia EAN1pec; identical to SEQ ID NO: 2249

SEQ ID NO: 2754 - DNA, 2679 bp, Salinispora arenicola CNS-205; identical to SEQ ID NO: 2250

SEQ ID NO: 2755 - DNA, 2697 bp, Arthrobacter chlorophenolicus A6; identical to SEQ ID NO: 2255

SEQ ID NO: 2756 - DNA, 2673 bp, Actinosynnema mirum DSM 43827; identical to SEQ ID NO: 2257

SEQ ID NO: 2757 - DNA, 2691 bp, Beutenbergia cavernae DSM 12333; identical to SEQ ID NO: 2258

SEQ ID NO: 2758 - DNA, 2670 bp, Catenulispora acidiphila DSM 44928; identical to SEQ ID NO: 2263

SEQ ID NO: 2759 - DNA, 2667 bp, Saccharomonospora viridis DSM 43017; identical to SEQ ID NO: 2265

SEQ ID NO: 2760 - DNA, 2688 bp, Jonesia denitrificans DSM 20603; identical to SEQ ID NO: 2266

SEQ ID NO: 2761 - DNA, 2676 bp, Nakamurella multipartita DSM 44233; identical to SEQ ID NO: 2269

SEQ ID NO: 2762 - DNA, 351 bp, Ralstonia eutropha JMP134
atgttccgcttcgacgaagggctgaaggtctacctgcaccgggaagccgtggatttccgcaagagtatcaatggtctgtcggcgctggtcgagcagtcgctggggctcgatccgttcgcacgagcggtctacgtgtttcgcaatcgacgagccgataggatcaagctgcttggctgggaccggaacggatattggctttttttgaaacgacttgaggcagaccgttttgcctggccgcgtgggacggcagtggcgacgctctcggtcgagcaacttcactggctgctggacggcatcgacatcagtgccgtccagcggcatccacagcgacattaccaacgggccgtgtga

SEQ ID NO: 2763 - DNA, 354 bp, Ralstonia eutropha JMP134
atgttccgattcgacgccggcttgcaggtctaccttcaccgcaatgcggtggatttccgcctcgggatcaacggtttgattgcgctggtcgagcagtcgatgcagcttgatccctttgcccgcgccgtctacgccttccataaccgtcggcgcaaccgcgtcaagctgttgctgtgggatcgcaacgggttctggttgctgctcaagcgcctggaggaagaccgcttcgtgtggccacggcgtgagcagacggtgatcgagctaacgaccgagcagttgcactggctactggacggtatcgacgtggacgcggtgcagcggcacccgccgcgccaatatcagcacacggcttga

SEQ ID NO: 2764 - DNA, 354 bp, Burkholderia xenovorans LB400
atgttccgcttcgacaacgacctgcggatctacctgcatcgcgagccgatcgacttccgggctggactgaatacgctggtgacgatggtcgaacagtcgatgcagctcgatccgctcgcacgagccgtcttcggattccacaaccggaaacgggatcgggtaaagctgttgctctatgaccgtgccggcttctggctgatgttgaaacggctcgaggtggatcgtttcgcgtggccccgtcgtcagcaggccgtgatcgaactcacggtcgaccagctccatctgctgctcgacggcgtcgatctcgacgcgctgcgtccacatcccgcacgacagtactgcttcacgagttga

SEQ ID NO: 2765 - DNA, 354 bp, Burkholderia xenovorans LB400
atgtttcgcttcgaagctgatttgaaggtgttcctgcaccgcgagccaatcgacttccgggcaggcatcaacagtctggtgacgctggtcgagcaatccatgcaactggacccgtttgcgcgtgccgtgtacgccttccacaaccgcagacgcaaccggatcaagctgctactttacgagcgcaacggtttctggctgatgttgcggcgtctggaagaagatcacttcatctggccgcgtcggcaacaggcggtgatcgaactgacgaccgagcagctacgctggctgctcgagggtatcgacatcgaggcaatgtgccgtcatccggcgcggcggtaccgccacgccagctaa

SEQ ID NO: 2766 - DNA, 294 bp, Polaromonas JS666
atgcgctgcggctttgacagcctggccgccaggatccagaccgccctgaccgagaatcccttctcgggccacatctttgtctaccgtggccgccgcggtgacctcatcaagctgctgtggtgggatggcgacggcctgtgcctgctggccaagcgcctggagcgcggccgcttcatctggccccaggccgaatccggcgtgatctcactcacatcagcccagctgtccatgctgctcgaaggcatcgactggcgccgtcccgagcgcacctgggtgccgcagcgggccgtctga

SEQ ID NO: 2767 - DNA, 354 bp, Nitrobacter hamburgensis X14
atgttcagactgggcgctgacctgaaagtctacctgcaccgcgagccgatcgacttccgggccggcatcaacagccttgcggttctggtccaagagacgatggcgctcgatccgtttgctccggcggtttttgcgttctgcaatcgccgtcgcgaccggatgaagctcctgttcttcgatcggtcgggctttgtgctggtgctgaagcggctgaccgaggacaagttccggtggccgcgccgcgaggcagcggtggtcaggcttacgaccgagcaattgcactggattctggacggcatcgatatcgatgcgatggtccgccatccactgcggcaatatcaggttgccggttga

SEQ ID NO: 2768 - DNA, 351 bp, Burkholderia cenocepacia HI2424
atgttccggctaagcgatgagctgaaggtctatgtgcaccgggacgccgttgacttccgtaagagcatcaacggtcttgcagccatagtcgagcagtcgatgaagctcgatccattcgagcaggccgtgtacgtattcagcaatcagcgccgcgatcgcatcaagatgctgctgtgggaccgtaacggcttctggctgttgatgaagcggctcgagcaggatcgtttcgtttggccgcgtaaggaagcggtgctcaagctcagaaccgagcaactgcattggctgctcgacggcatcgatattgaagcgatgcgggcgcacccgacacgctattatcagcgcgtgacgtga

SEQ ID NO: 2769 - DNA, 354 bp, Sinorhizobium medicae WSM419
atgttcagactgggcgctgatctcaaggtctacctgcaccgcgaaccgatcgactttcgggcgggcatcaacagccttgcggttctggtccaggagacgatggcgctcgatccgtttgctccagcggtttttgccttctgcaatcgccgtcgtgaccggatgaagctcctattcttcgaccgatcgggctttgtgctggtcctgaagcggttgacagaggacaagttccgatggccccgccgtgaggtggcggtggtcacgctgacgaccgagcaactgcattggatcctcgacggcatcgatatcgatgcgatggtccgccacccggtgcggcaataccaggtcgccggctga

SEQ ID NO: 2770 - DNA, 348 bp, Xanthobacter autotrophicus Py2
atgatcccggtcccgagcggcgtgaaggtgtggcttgcgacgggccacaccgatatgcgcaagggcttcgccgggctttcgctgcaggtccaggaggttcttcggcatgatccccatggcgggcacctgttcgtgttccgcggtcggcgcggtgacctcatcaaggtgatctggcatgacggccagggcgcctgcctgttctcgaagcggctggagcggggccgcttcctgtggccctcgccggctgatggggtggtgacgatcactccggcccagctcggctatctcctggagggcatcgattggcggcatccgcagcaggcgtggagaccgggcgcgtcggggtga

SEQ ID NO: 2771 - DNA, 354 bp, Burkholderia phymatum STM815
atgtttcggttcgatgcagacctgagggtcttcctgcatcgggagccgatcgacttccgggctggcatcaacagcttggtgatgctggtcgagcagtccatgcaactcgatccatttgcacgtgccgcatttgccttccacaaccgcagacgcaaccgggtcaaattgctgttctacgaacgcaccggtttctggttgatgttgcggcgcctcgaggaagatcacttcgtctggccaagccgacaacaggcggtgatcgagctgacgaccgagcagctccactggctgctcgatggcatcgatattgatgccatgcaccgccatccggcacggcgctaccgtcacgcgagctga

SEQ ID NO: 2772 - DNA, 351 bp, Burkholderia phytofirmans PsJN
atgttccgcctggacgatgaactgaaggtctatgtgcatcgtgacgccgttgacttccgcaagagcatcaacggtctcgcagccatcgtcgagcagtcaatgaagctcgatccattcgcgcgtgcggtttatgtgttcagcaatcagcggcgcgaccgcatcaagatgctgctgtgggaccgtaacggcttctggcttctcatgaaacgcctcgagcaggaccgcttcgtatggccgcgcaaggaagcggtgctcatgctgcgaacagagcaacttcactggctactggagggcatcgacatcgaagcgatgcgcgcgcatccgaggcgctattatcagcgcgtgacctga

SEQ ID NO: 2773 - protein, 322 aa, Acidithiobacillus ferrooxidans ATCC 53993
MNKEDFAQYVDVAMRGDGLGFLRPVVEKELLHYEIFSALDEEGLLKDLVFQGGTSLRLCYGSERFSEDLDFAGGKNFSARSMAAVKGCIVGKIGKRFDLDITVREPRDAPFDGTVRVDKWMVTIQTSPDRPDVPRQKIKLEIANVPAYSRDILPLRINYSVLEGRSQPLVAVESRDEILADKLIALPASISRMIGQEMELTPSRIRHRDIWDIAWLSGQGAQLDTQLVRRKISDYGLDEFPQFLDRAIAAIPVIAGGEGFRAQMARFLPQTQHDRVFGKEGYEKYFENTVSGLLSSLRKDLEFDLKKVQQVLPGKKKRGPKL

SEQ ID NO: 2774 - protein, 288 aa, Ammonifex degensii KC4
MQWEEITRKAYTLGTTPEFVFREETQKAVLSFLSRKSFFREGVFQGGTALRLFYGAPRFSEDLDFVFVAKNSGTWQNTGRLLQGLEAYLLGVFPFPLEVTAKKQKESETLKRFSLRATGGPLSRKVVVNIEFANVPSYMHRVAHLEFPPFNPMIRVEAPEEILADKVVACALRAYIKGRDLWDIRYLTLEKGLILPVKLVAQKARDYGSTARELAEKLKKAAEKVREEGRESILNEMPRFLAKHEAELLPAQASEAAIGVASLLEEAAKKVAFHADDGVVPPFPGEQL

SEQ ID NO: 2775 - protein, 48 aa, Bifidobacterium longum DJO10A
MTGTDEPFKYKAMAAQIVSAEGMGNLLPVVEKELLHYRICLFIRSSRC

SEQ ID NO: 2776 - protein, 318 aa, Bifidobacterium longum longum ATCC 55813
MMTGADGTYDYKAMAAGIVLAGGEGMGNLLPVVEKELLHYRILDAMMREGFFSSLVFQGGTSLRLCHGSPRYSEDLDFAGGTSFDMDTLKGLGSCISDSLSGMGDDVTVRVKEPRPDADGLTRRWRIAIRTAGQRKDLPSQTIKLEVASIPAYEPQHRPALVNYPMFPALSGQIILDVESPTEILADKLLSYACASHLRRRDLWDMCWLASRGDVDSRRAMELAELKSSDYGEEGLWADRADRVAGVADVIGSDAFADEMRRFLPAGLMTSTVESPRWSAWAIEQIGTLYGTPGTPSSADAVPGFPIFGASNDSSPTR

SEQ ID NO: 2777 - protein, 318 aa, Bifidobacterium longum longum F8
MMTGADGTYDYKAMAAGIVLAGGEGMGNLLPVVEKELLHYRILDAMMREGFFSSLVFQGGTSLRLCHGSPRYSEDLDFAGGTSFDMDTLKGLGSCISDSLSGMGDDVTVRVKEPRPDADGLTRRWRIAIRTAGQRKDLPSQTIKLEVASIPAYEPQHRPALVNYPMFPALSGQIILDAESPTEILADKLLSYACASHLRRRDLWDMCWLASRGDVDSRRAMELAELKSSDYGEEGLWADRADRAAGVADVIGSDAFADEMRRFLPAGLMTSTVESPRWSAWAIEQIGTLYGTPGTPSSADAVPGFPIFGASNDSSPTR

SEQ ID NO: 2778 - protein, 317 aa, Bifidobacterium longum
MTGADGTYDYKAMAAGIVLAGGEGMGNLLPVVEKELLHYRILDAMMREGFFSSLVFQGGTSLRLCHGSPRYSEDLDFAGGTSFDMDTLKGLGSCISDSLSGMGDDVTVRVKEPRPDADGLTRRWRIAIRTAGQRKDLPSQTIKLEVASIPAYEPQHRPALVNYPMFPALSGQIILDVESPTEILADKLLSYACASHLRRRDLWDMCWLASRGDVDSRRAMELAELKSSDYGEEGLWADRADRVAGVADVIGSDAFADEMRRFLPAGLMTSTVESPRWSAWAIEQIGTLYGTPGTPSSADAVPGFPIFGASNDSSPTR

SEQ ID NO: 2779 - protein, 172 aa, Bifidobacterium sp. 12 1 47BFAA
MASIPAYEPQHRPALVNYPMFPALSGQIILDVESPTEILADKLLSYACASHLRRRDLWDMCWLASRGDVDSRRAMELAELKSSDYGEEGLWADRADRVAGVADVIGSDAFADEMRRFLPAGLMTSTVESPRWSAWAIEQIGTLYGTPGTPSSADAVPGFPIFGASNDSSPTR

SEQ ID NO: 2780 - protein, 306 aa, Cellvibrio japonicus Ueda107
MKITEDDFTQLVNKAMQDNNVTHMRPVIEKELLHYDILFCLEDSGLLDNLVFQGGTSLRLCRGGNRFSEDLDFAGGKDFSSGMLSKMKNCLQDYLGKRYGLEVLIKEPSTLKESAEYAELNIDKWQISIITAPDRKEVPRQRIKIEVANVPAYTKEAVPLKVNYDFLPDGYEDTLIFTETLDEVMADKLVSLPATQRYVRYRDIWDLSWLKQQGAVVQPELVQRKITDYRLTDYPDRLELMINKIPDIVASTDFKNEMKRFLPTDVYDRTLGKEKFEGFLVNTVTGLFKELKKALSGQQVEPEFRL

SEQ ID NO: 2781 - protein, 296 aa, delta proteobacterium sp. MLMS-1
MNLIEQLATEALRNHPELSLLRSAVEKELLHHDILRLLNDAGLLAGLTFIGGTCLRACYGAERLSEDLDFSGGHDFRREGMAGLKAALETGLHAKYGLEVEVKEPVRETGNTDTWKIRIITRPARRAMPAQRINIDICAVPSHDRRPMMLRNHYGVEMGTSGLILQAESREEILADKLLALALRPNRVKNRDLWDIAWLKRHNINLSAALLSRKIADRRLVPEDFFKRLERRQQMLADGPEPRRDFIHEMTRFLAVATVEQTVAREEFWPYLLDTIADQCQQARTLLDSYPYRKSR

SEQ ID NO: 2782 - protein, 296 aa, delta proteobacterium sp. MLMS-1
MNLIEQLATEALRNHPELSVLRSAVEKELLHHDILRLLNDAGLLAGLTFIGGTCLRACYGAERLSEDLDFSGGHDFRRESMAGLKAALETGLHAKYGLEVEVKEPVRETGNTDTWKIRIITRPARRAMPDQRINIDICAVPSHDHRPMMLRNHYGVDMGTSGLILQAESREEILADKLLALALRPNRVKNRDLWDIAWLKRHNITLSAALLSRKIADRRLAPEDFLKSLERRQQQLSDGPEPRRDFIHEMSRFLAVATVEQTVAREEFWLYLLDIIADQCQQARTLLDSYPYRKSR

SEQ ID NO: 2783 - protein, 292 aa, delta proteobacterium sp. MLMS-1
MTESANFAALVDKAMTFSGQGHMRPVIEKELLHYDILFILDKEGLLDLLTFQGGTSLRLCYGATRFSEDLDFVGGRNFDRRQLVSMRDCLEHYIGKRYGFEVIVKEPRELRNEPEYEGLNVERWQIAVVTAPGQRHLPRQRIKIEVVNVPAYSRIPRSLQTHYDFLPDGYGDTLVLTETLAEIMADKLVSLVNSRRYVRHRDIWDLRWLKQNGAVINHDWVKNKIIDYRIADYELKLESLWQELPVIVHGDAFKSEMARFLPYEVQERTFRKGKFCDFLVGEIREMLDNVRS

SEQ ID NO: 2784 - protein, 292 aa, delta proteobacterium sp. MLMS-1; identical to SEQ ID NO: 2783

SEQ ID NO: 2785 - protein, 301 aa, Desulfurivibrio alkaliphilus AHT2 uid49487
MNLLEQLAGEALRHRPELSLLRPAVEKELLHHDILRLLNEAGLLSGLTFIGGTCLRACYGAERLSEDLDFSGGHDFRRESMAGLKAALENGLGAKYGLEVEVKEPVREAGNTDTWKIRIITRPARRNLPAQRINIDICAVPSHDRRPLMLRNHYGVEMGTSGLILQAESREEILVDKLLALALRPNRVKNRDLWDIVWLKRHNINLSAALLARKIADRRLAPEDFLNYLEQRQQLLAGGPDPRRDFIHEMTRFLAAATVEQTVAREDFWSYLLDSIADECRQARTLLENLPQADNGVPRDS

SEQ ID NO: 2786 - protein, 328 aa, Eggerthella lenta DSM 2243
MLIDLEEVASDIASKVDGVRLTPVIEKEIIHYEIIRSLGRNGLLRDITFQGGTSLRLCYGSQRYSEDLDFVAGDSFDSLPLDDFSKTLRSDLLKSYDTEVSVREPKVVNDFDGVGMRRWTVSVNTNIARPDLPKQRIKLEIASVPAHTSTIRRVAVNYPELAGMYDDLTIRCQTLEEILADKLISFSATDSHIRHRDLWDIPWIVRAQEIDFPAVAAFVAAKHDDYRCPASLASMIATGTQRARVCYVDGSFTGQMQRFLSPAVLNRTHDFDNHCDALNTIVEKCFDRVAASLGISDEVEHSRRKLAIEISSGSISAAALPKRTLDLS

SEQ ID NO: 2787 - protein, 292 aa, Helicobacter canadensis MIT 98-5491, ATCC 700968
MSDLENIADSYAFELGNTKDAVIKEILHYDILQSLSQSDIANDIVFQGGTSLRLCYGNNRHSEDLDFALKDEKVDFDEALLKEFEKIFVSTIRNKYNLEAELSYSKENEDFVKKWTAKVFLPISHRKAKINIEICDVPSYDNKVMNVINHYSLKNNDDLIIRVKSLEEILADKILALGCRKYIKYRDIWDIKWILDKNTSINLEWINNKICDYHASNFPIKLAQKLEELQENKEAHNNGFINEMSRFVKPVLFEKYKKLDFFAETIDEVLENGENVLELLKEQEYTKYLRKS

SEQ ID NO: 2788 - protein, 302 aa, Marinobacter sp. ELB17
MTLFDTLVSEAIRNQRELIALRPVVIKEILHHDILRELSHADLLKKLTFIGGTCLRACYGSSRLSEDLDFTGGAGFNKDELDKLKVTLEVRLTEKYELPISVTEPKAEKQGNVDTWKLQVNTQPERPDMPAQRIHLDICAVPSYQITPRTLQNHYGINLGTESLIIKAQTREEIFADKLLAFAMRPGRIKYRDVWDIGWLAQNGIEPALDLLNAKLADHGELEDDFLIRSDERLGQLVNDEQQHRDFVFEMTRFIPPDRLDQTLRQEGFWTYLSNTVIEKVRQAQNRVESDATHDTGPSFLM

SEQ ID NO: 2789 - protein, 296 aa, Marinomonas MWYL1
MLKEVIKQIVNTNAEYAGITPVIEKEILHHDIMAVMVKQGVMQSLTFIGGTSLRLCHNSSRLSEDLDFNGGHDFKPDDFDGLEVEIQKYIQKKYETEVWVNKPNKDKQGDTSSWKISIEKEANRPDLPRQKMHIDICAIPSFDIERRPLINHYDVVVPTEGLLIPVQSLEETLADKFIALAYRSRRIKPRDVWDILWIKQRGIDVSIELIYKKLAAREKTKAHFIESLTLQVEKLLNKEEVKADFNNEMSRFIPSQIKQRTIDNPEYWQYVQLEIKSMTDPILKPDLQTKKFDMGF

SEQ ID NO: 2790 - protein, 305 aa, Pantoea sp. At-9b
MNQKVNFAVLVSQAMESAELEGLRSVVEKELLHYDILYCLDNAGLLQDLTFQGGTSLRLCYGGNRFSEDLDFAGGTEFSGSHLKNMKTCIEDYLGTRYGLEVSVKEPNELRREPGYEDIRIDKWQVSVTTSPERRDMPKQRIKIEIANIPAYTRVPMGLSRNYTVLPDGYADTLVMCETLDEVMSDKLISLVATTKYVRYRDIWDLPWLLQQNAAYDIELIRRKIQDYRIPNYRELLKLRLESIDQTVSDGRFEAEMRRFLPQTVFDRTLGRAEFTGYLSNRLKTLLSSLQKELEGEGRGNPFLM

SEQ ID NO: 2791 - protein, 94 aa, Parascardovia denticolens DSM 10105
MDVSHAVGLRSLKEEDHRERSVYRDQYPLVFDRIHHALSDSTAFTTEMSRFLPSAVRERTMAAEYGSKPWNPPAPTFSAHSHQTIRLWIKYPIR

SEQ ID NO: 2792 - protein, 305 aa, Pectobacterium wasabiae WPP163
MNQKVNFAELVSKVVESAELEGLRNVVEKELLHYDILYCLDNAGLLEQLTFQGGTSLRLCHGANRFSEDLDFAGGVAFSGADLKNMKACIEDYLGNRYGLEVNVKEPNELRNEPGYEEVRIDKWQVSVTTAPEKRDMPRQRIKIEIANIPAYTRTPMTLKRNYEVLPDGYSDTLVMCETLNEVMCDKLVSLVATTKYIRYRDVWDLPWLIQQNATYDIDLIRKKIQDYRISNYDDLLAQRIQSIDQVVGDGRFSAEMRRFLPQAVFDRTLGREAFSHYLSGELKALLSALQQALKGEGGKAPFVM

SEQ ID NO: 2793 - protein, 306 aa, Photorhabdus luminescens
MSSHVNFNAIVDEVIEQDRLANLRPVVEKELLHYDILFCLSKDGLLKEITFQGGTSLRLCYGSNRFSEDLDFAGGRGFCSADLSRIKECIEKYLGVRYGLEVTVKEPNELRNKPEYAEVKVDKWQISVTTAPERKDLPKQRIKIEIANIPAYTNTPRSLIRNYSVLPDGYADLLVSVETLPEIMADKLIAFPATTSQIRYRDMWDLLWLSQQNTTPDIELIKRKVSDYQLDNFEELLQARIDSIEIIVASGHFHNEMRRFIPAPIYDRSVGQEAFSTYLTTSLKELLTTVKKSLYSSGDNSIPFKL

SEQ ID NO: 2794 - protein, 306 aa, Photorhabdus luminescens
MVNKANFAQLIELAMQVPGRSHMRPVIEKELLHYDILYCLDTNGLLDQLTFQGGTSLRLCHGAPRFSEDLDFSGGVNFNRNQLQAMKKCLEHYIGKRYGFEVSVKEPADLRNEPEYAGLNIDKWQVSIVTAPERKDLPKQRIKIEIANIPSYSQEPKALMTNYNFLPDGYADTLVLTKSLDEVMADKLVSLVNTQHYVRHRDIWDLRWLKQKGATLRMDWVNNKIIDYRISGYSDKLANILTRLPAIIKGDAFRNEMQRFIPQDVQERTLHKEKFFTFLTTEIADMLQRVQNSLNSCSTSENEFNM

SEQ ID NO: 2795 - protein, 309 aa, Proteus mirabilis ATCC 29906
MSDFVNFNELVDSIVIEKDYGANRPVVEKELLHYDILYALSATGLLKHITFQGGTSLRLCYGSNRFSEDLDFAGGRDFCSAQLLEIKACIEKYVGERYGLEVVVKEPKELRKEPDYADVKVDKWQISVTTNPGKKDLPKQKIKVEIANIPAYTNTLRTLVKNYEQLPSGYSDLIIRVEELTEVMADKLVSFPATTSRIRYRDMWDLVWLHQKGVKPDAELVMKKVADYKLNEHFEEWLQARIESLPALVASEKFKGEMKRFLPVSVVDRTLLHPDFLEFLQITLHELLVTIQTDIYGSKDPKPVKKFEM

SEQ ID NO: 2796 - protein, 309 aa, Proteus mirabilis; identical to SEQ ID NO: 2795

SEQ ID NO: 2797 - protein, 306 aa, Proteus mirabilis
MKIDQENFALLVNKAMQVGNVSHMRSVIEKELLHYDILFALEKGGLLNKLTFQGGTSLRLCYGGNRFSEDLDFAGGKDFSSAMLADMKHCIEKYIGERYGLEVTVKEPKDLKQDPKYSELSIDKWQIAVVTSPERKDLPKQKIKVEVANIPAYTREPQPLQINYDFLPDGYSDMLILTESLDEIMADKIISLPATTRYVRHRDIWDLAWLQQQGATLNMDLVKNKVSDYKLEHFNKMLENFLERLPSIVSSEAFIAEMKRFLPTDVFDRTLAQDKFQVYLQNTLAKLFKTVSNELLGKVTNSEFRM

SEQ ID NO: 2798 - protein, 295 aa, Shewanella denitrificans OS217
MLKQQIRQIVQANPDYAAVTPVIEKEILHHDIMDVLIKQGVMQRLTFIGGTSLRMCYNSSRLSEDLDFNGGHDFKPSEFDGLESEIQTYIQNKYETEVWVNKPSGEQQGDTVSWKISIIKEANRPDLPRQKMHIDVCAIPSFDIEKRPLLNHYDIVVPTEGILVPVQSLQETLADKLIALAYRARRIKPRDIWDIVWIKQRGINLSKTLVEKKLVARQKQTEDFRQALSVQLGKLMTEDEVRNDFNMEMSRFIPKQIKERTLDNPEYWAYVQAEVNAIASELLNDGTAKNPFDMG

SEQ ID NO: 2799 - protein, 337 aa, Verminephrobacter eiseniae EF01-2
MNRQDFNAMVELAMRDDQLSAMRPVVEKELLHHEIFQALDDAGLLKHLVFQGGTSLRLCRGSDRFSEDLDFAGGRDFTADKMQGIEECIEKHIGLRFGLNVTVKEPKEPKGRAVGRSGVALDRWWISIETAPENAAMPRQKIKLEIANIPAYQVELVPLRQNYEFLGGMKEILVNVESVSEILADKIVAFPTSLVDNQGAPLPPTAAKIRYRDLWDIAWLLKKRAELDPRMVASKIRDYGIPNFPELLDRAIEMIPAVVKSAAFQDQMRRFIDAGTVKRTLGDERYLDYLASTVGGQFQEAKAHLQHAAALEAAKAVAAPGQGSTPKKSASPASSAD

SEQ ID NO: 2800 - protein, 306 aa, Xenorhabdus nematophila ATCC 19061 uid49133
MPDKTDFNILVDEIVTQNGFTDIRPVVEKELLHYDILHCLAKNGLLKKLTFQGGTSLRLCYSSNRFSEDLDFAGGRDFCSADLGRIKESVENYLGARYGLEVTVKEPNELRKEPEYANVKIDKWQISVTTAPERKDLPKQRIKIEIANIPAYTKNPRPLTRNYPVLPDGYSETIVLVEELTEIMADKLVSFPATTKHIRYRDMWDLVWLKQQGVEPDTDLIKRKLSDYCLTDFGEQLQARLDSIENLIASGTFQEEMKRFIPAPVYNRTIGQTDFMRYLETTLKALLTTVQKELYSPATNPVPFKM

SEQ ID NO: 2801 - protein, 326 aa, Bifidobacterium longum longum CCUG 52486
MDGSDMAFDYKAVAAGIARSEGMGALLPVVEKELLHYRILSAMQDGGFFGPIVFQGGTSLRLCHGSPRYSEDLDFAGGTGFGVDDLRGLGECVRSSLAGMSPDVQVKVREPVRDEGLVRRWRISIRTAAQRRDLPSQSIKLEVASVPAHEPQTRPVRVNYPSVSAIAGDIILAVESPTEILADKLLSFACSSHIRRRDLWDMCWLSSRADVDASRAFRMATLKAGEYGEVGEWEARAGRLREIPSVLSSDAFLDEMRRFLPARMLVATVESLSWREYASQAVTGLYDPSGPAWASPYGSPGFGRPMPEPDQSSAVPMWRDGGPALS

SEQ ID NO: 2802 - protein, 317 aa, Bifidobacterium longum longum CCUG 52486; identical to SEQ ID NO: 2778

SEQ ID NO: 2803 - protein, 292 aa, Helicobacter canadensis MIT 98-5491, ATCC 700968; identical to SEQ ID NO: 2787

SEQ ID NO: 2804 - protein, 296 aa, Providencia rustigianii DSM 4541
MLKQQIRQIIQVNPDYAAITPVIEKEILHHDIMDVLIRQGAMQRLTFIGGTSLRMCYNSSRLSEDLDFNGGHDFKPTEFDGLEFEIQKYIQNKYETDVWVNKPSEEKQGDTVSWKISIVKEANRPDLPRQKMHIDVCAIPSFDIEKRPLLNHYDIVVPTEGILVPVQSLQETLADKLIALAYRARRIKPRDIWDIVWIKQRGISLSKTLVEKKLIARNKEIDDFHHAIAIQLNKLMQEDDLRNDFNAEMSRFIPKQIKERTVDNPEYWAYVQIEVNDIVTELLNNIKPKNPFDMGL

SEQ ID NO: 2805 - protein, 300 aa, Acidovorax delafieldii 2AN
MTSNLSASILARLLTLAKQRGDDYNLLLNRFGMERLLTRVSLSPHADRFLLKGALLFALWYDTPHRPTKDADLLGFGPDDEANLIATFREIAAMDLGDGILFDADSVKADAIREDNTYGGTRITLVARIGSARCALQVDVGFGDAVTPRPQTVAYPTLLGDFPAPTLRVYPVYTVIAEKYQAMVMLGQANSRMKDFFDLAVIARRTELDGATLAAAIAATFARRQTALPTERPLALTKQFSEDATKLRQWQAFLNKNRIEAASLGDTVALLDDLLWPPTEVAAAGGQATAIWHPETLRWV

SEQ ID NO: 2806 - protein, 300 aa, Acidovorax sp. JS42
MTGNLSASILARLLTLAKQRGDDYNLLLNRYGMERLLARVSTSPHADRFLLKGALLFALWYDTPHRPTRDADLLGFGPDDEANLIATFRDIAAMDLGDGIVFDPESVKADAIREDNTYGGTRITLVARIGSARCALQIDVGFGDAVTPGPQTVAYPTLLGDFPAPTLRVYPVYTVIAEKYQAMVMLGQANSRMKDFFDLAVIARRTELDGATLAAAIAATFARRQTALPTGRPLALTQQFSEDAAKLRQWQAFLNKNRIEAASLGETVALLDDLLWPPTQVATASSQATATWRPEALRWV

SEQ ID NO: 2807 - protein, 290 aa, Agreia sp. PHSC20C1
MTPEQTFSALQRIARQEGRAVQELLTLYVLERFLARLVESPYADSFVLKGGVLLAGYGLRRPTRDVDMQAIDFVLDEEHCGKVVAAVATAEADDGVAFDAIPTRIEQIRDEEEYSGLRVHVRAQLHRSPIALKLDISTGDPISPHAQLVTMPRILGGEFTVMGHPPETVIAEKAVTILQRGATSTRWRDYMDLRSLALSRSFSAATLGKAIEEVAKHRTVELSAPSGSLNGHDEVAQQKWAAWRKKTDVEDITLPVLEDQLTEVCGFLDPIFTDEVEPAAAWDPTSKTWH

SEQ ID NO: 2808 - protein, 291 aa, Asticcacaulis excentricus CB 48
MDKLKANRAASVKDKLLRLAKAQGQPFDVMLVRYGLERLLYRLSISRYRNRFILKGGLLVTLWVDDAMRVTRDVDLLGQGEDNQDLLKGTFSEILSIEVDDGLIFDSANLIAEAIREDIKYGGTRLKTLAFLERTRISITIDIGFGDAVTPAPMDIDFPNLLDNEVSNVRAYPPTTVIAEKFQAMVNLGLINGRMKDYYDLWAIPQSLSIDQNALDAAIEATFSRRGTAVPTETPPGLSDAMYTSPDKLRQWDAYARSIAFDGPPFREIVQTIWELVGSACSRINANAIRN

SEQ ID NO: 2809 - protein, 374 aa, Bradyrhizobium japonicum
MSTFLSRIRRGQLSIAFATEPRSALTSRWRGCAKASAVADASRINSGITLARRGSGRSCVPTSKQWCPMAREPRNIGASVRARLLDRARAERSDFQILLTRYALERLLYRLSASPHRDRFILKGAMLFVTWIADPFRPTRDLDLLGHGDRDTEAIAETFRAICAQPVVDDGVTFDVAALMATPIREELEYGGVRVRTTATIAGARIPIQVDIGFGDAITPAAVEIDYPTLLDAPTPHLRAYPVETVVAEKFAALVTLGVANSRLKDFYDLWVISRTFELRRAALAEAIQRTFERRGTVLPSVVPVGLTDEFAETWAAQWRAFLERDRMAAAPDAFAVTVADLRLFLMPLVVGLKEERIWPPSGPWSPGAAIDEA

SEQ ID NO: 2810 - protein, 242 aa, Brevibacterium mcbrellneri ATCC 49030
MTPAPNRNTRAGQVYNDLRNIARAHRRDPAEYFTLYALEGFLVRLVASKVSNDFVLKGGVLMTAFAVRRPTRDIDLAATGFPNDILDVEARVREIIVQQPDDGLVFELGSVSGESILDDAVYTGVRVKLNVRLATARIALHVDVNFGDPIWPAPVEQELPCLLGGTLRLRGYPDHMVFAEKIVTALDRGEVNTRWRDFVDIAWIVGTRRTRAGPQSNGHDLGSAVAVLGKPPVALLQADLSG

SEQ ID NO: 2811 - protein, 307 aa, Candidatus Accumulibacter phosphatis clade IIA UW 1
MSVRNIGAAIRNRLLNKARAENLDYNLLLTRYALERMLYRLSISEQRDQLVLKGALLFDLWFDVPHRPTHDADLLGFGPAEIPHIEQVFRSMCSIEVEDGIVFQPDSVKATEIRKEASYSGLRVTLVGMLDSARCPVQIDIGFGDAVVPGPDEVHYPVILSEMAGPQLRAYPRYTVVAEKLEALTSLGMLNSRMKDFFDLWVLARHSDFDGPILSRAVAATFERRRTPIPHGAPIGLSDEFINDAQKNKQWQAFLRKNALDPMPLAKVIADLREFLLPVLASVEASGSHDMAWWCREGWRQLTEHGT

SEQ ID NO: 2812 - protein, 289 aa, Parachlamydia sp UWE25
MYDMTTDLEKSFKAKLRTIAKEKNRDPADLWQSLTLERFLVRLARSKYRDQFVLKGGILLSRYLEIGRETTDLDFLAKKISNQVLSLRVVFEEIAEIDINDGFIFKEVKASELTHPHMGYPGVEISIMAYFGRTRFKVAIDIGFGDIVEPIEYKIRLTNYSKGDLFEDSVELACYPKEFIFAEKLETIIHRGSFNSRMKDFHDIYSMILSSALLSFKSLENVIRIVFKHRETELLLPISFQEDEIIRMQSFWSEYLKSLREENVEGLPSLFSDLVTKINQWLKLNTKFI

SEQ ID NO: 2813 - protein, 306 aa, Chlorobium limicola DSM 245
MSAKAIKNIGASVRQRLLNKARQDHRPFQELLQYYAMERFLYRLSVSSFADRFILKGALLLRVWQAPLARPTMDIDMLGRTANAPEKITTIIHQVLAVEEQEDGIIFDPDSITVEPITEDADYEGLRVRFRGHCDAARLTIQLDIGFGDKVFPEPLQESLPSLLNFPPAEMYCYSRESMIAEKFEVMAKLGILNSRLKDFYDIWMLSRQYNFEGGRLAEAIKQTFEQRGTILVQPQEIISLKFIDEKQVQWTAFRKRIGLEFLPEDFNQIVQQLELFLTPIVKALIEKESYGDSWIAPDTWQRNQR

SEQ ID NO: 2814 - protein, 312 aa, Chlorobium phaeobacteroides DSM 266
MSAKEIKNIGASVRQRLLNKARQENRPFQELLQYYAMERFLYRLSVSSFADRFILKGALLLRVWHAPLARPTMDIDMLGKTGNAPESITTIISQVLAVEKQGDGIVFDPESITVEPITEDADYEGLRIRFRGDLDAARLTIQLDIGFGDKVYPDPVKESLPSLLNFPQAELYCYSRESMIAEKFEVMAKLGILNSRMKDFYDIWMLSRQYDFEGVSLAEAIRQTFAQRGTTLVQMKEIFSGEFIDEKQVQWNAFRKRIGLEYLPASFADVVQQVQVFLSPAVEALRANRLFQDNWIAQDSWRSSHEKPEVGA

SEQ ID NO: 2815 - protein, 220 aa, Prosthecochloris vibrioformis DSM 265
MKKKPVKDTSASVRARLLNLARSTGRDFQELTVRYTVERFLSRLAESEHRERFILKGAMLYIPWKLDNKRTTMDLDLLGFGSPDMENLKTVFQEICGTAIEDDGLVFNKDTVTVTGIREASVYDGVRIIVRVNLGAMPIRLQVDVGFGDQIVPAPQSAEFPALLAEHGPIIRSYSPEMVIAEKFNAMIVLGMANSRMKDYFDIWMLSRNFTIEADVLPRC

SEQ ID NO: 2816 - protein, 303 aa, Conexibacter woesei DSM 14684 uid43467
MTAQPPVDQAAAAAFKALRVKARAEHRGNTQPLLVVYAVESFLRRLAISDYADRMVLKGGMLMAANSIRRMTRDADLSTHGLPNDERRVHEAVTRICALEPDPHDGVVIDPSSIRTEVMREGDEYQSVRCKQLAILGRARIPFALDFSFGDPGQSTVIDLESAIDRPAVRLAAYPLTLNLAEKIVTAMQRRESSTRDRDFADLWVTSRRHRLDATELRQHILAVASHRQQPVIPMAEALAHMPDRQQPYAAMVARMSYQSPPPQRWSDLIVGVIGLVDPLLAATSESLSHWNPATLSWTTATR

SEQ ID NO: 2817 - protein, 305 aa, Corynebacterium glutamicum R
MSKKSQEPRNYRTGRASATAGAGIFSTINKADRVAFYDRSIVLSRIFANDPNSWVLKGGTALIWRDTTARSTRDIDLFNSAAEDINEALHALRNSLETISTAPSDVHLVIDSAKIDVSAQGNRQQAALQVRLQSASGMPLSNTPVKIDLVVGCHVTGEVDAHPTDGLEKVLQSHVPHIRLYPIVDHLADKVAATMQSYPSSDGDSPSSRVHDLIDIAHIAVTEEINGTQLLVAIESERIQRGLPPYEQGFQCPPHWAELYRKRKGSKGSAPQSFDEAVDIAKRLIDSAIFGKSLGMTWKDGSWHA

SEQ ID NO: 2818 - protein, 281 aa, Delftia acidovorans SPH-1
MSRDIAASIRARLKQCADARRQDFNLTLTHYGLERLLYRLSISPHADSYLLKGALLFAIWYEQPHRPTRDADLLGFGLDDVDSAVSAFREICGIAVDDGIAFDAASVRGTTIRKEAGYGEVRIDLRATLDGARITLQVDIGFGDAVTPSPQAIRYPVLLDGLPAPQLRSYPKYTVVAEKLHAICLLGMANTRMKDYFDLWVLMTEGTLDPAELRRAMKATFERRQLALPAGLPAGLSDGFSSDAAKQAQWAAFLKKNRLEALELAPVVARLREEFQQCGIF

SEQ ID NO: 2819 - protein, 305 aa, Candidatus Desulfococcus oleovorans Hxd3
MTKKQVKNISASIRQKLLNKSRTDARPFQELVQYYAMERFLYRLAQSRHANRFILKGALMLRIWQAPETRSTMDIDLLGKTDNNVSALISNITEILSVDVDPDGLSFFPENIMGEHITEDAEYKGVRICFPAKLDTMKLNMQIDIGFGDIIHPAPERSEIPTILECPAPQLLCYSRESSIAEKFEAMLKRRELNSRMKDFCDIWLLSRYFDFDGKIVSEAIRLTLEQRGTELPGNINIVAFSHEFIIAKQVQWNAFMKKLRQDHVPAEFETIVMQVKGFISPIISALIARKTPPSKWTAPGPWAF

SEQ ID NO: 2820 - protein, 300 aa, Desulfomicrobium baculatum DSM 4028
MTSGKNISASVRQRLLNRAHHDDRPFNELLQYYAMERFLYRLSRSAHADRFVLKGALMLRVWRSPQFRPTMDIDMLGRTNREETLILRQIRDIMMMDVGMDGLSFDPDSLRTERITEDAEYEGIRVRFLGTLGTARINMQIDIGFGDIVHPGPEMAEMPTMLDFPAPRLLCYSRESAIAEKFEAMVSLGALNSRMKDFYDIWLLSRQFDFNGKDLVEAVRLTFKQRGTVLPEQIEAFRRDFAEVKQTQWAAFRKRLQQEHVPVSFQEVTTALGIFLGPIATSISEESKIPEAWAASGPWS

SEQ ID NO: 2821 - protein, 319 aa, Eggerthella lenta DSM 2243
MMVCKTPAALEMAIKAAAKASPLETGRAVSGFYFHRLLCRVFSKPDSPFMLKGGQSMLARTMDARATRDIDLLSEEADLDAALAELRALAEADLGDFVVFEFVGAVPIKVEDEYRSGLKVAFVPLLGGKRLQEVSIDLVADRVACGEPEIVTPADRIDVAGVPMFDYRVYPLANSLADKLCAMVETHDGKPSSRIKDLVDVAIYATTVDIDGGELCRRVRSEAGARGIVLPDRFSVPDEWKQLYEGAFKKLVSRTGLSSELSDIAAAEALAASLFDPVLARKAGDLHWDHESLSWEGLVLEHGEDGRRTSELLRLLHDC

SEQ ID NO: 2822 - protein, 319 aa, Eggerthella sp. 1 3 56FAA; identical to SEQ ID NO: 2821

SEQ ID NO: 2823 - protein, 214 aa, Sinorhizobium medicae WSM419
MPREPRSIGASVRARLLDRARVERSDFQILLTRYALERLLYRLSASPHRDRFILKGAMLFVTWVGDPFRPTRDLDLLGHGDSGAEAIADTFRAICVQPVADDGVTFDAAALIAAAIREEIEYGGVRVRTTATIAGARIPIQVDIGFGDAVTPAAVEIDYPTLLDAPTPHLRAYPVETVVAEKFEALVTLGVANSRLKQLHQMLSPLPLPISASS

SEQ ID NO: 2824 - protein, 289 aa, Sinorhizobium medicae WSM419
MAKEIRNVGASVRARLLQLAKASGQSFDVVLTRFALERLLFRLSRSPHAGRFVLKGAMLMMSWFDDPHRGTRDLDLLGFGNPEPDPMLATFREILAQEVDDGVMFDADTLRVDRIREELEYGGLRLRAVASISGARINLTIDIGFGDALEPGAEMLDYPSMLDFPAPRLRAYARETVIAEKFQAMVMLGRVNSRMKDFYDIWILSRSFDFDDDRLARAIAATFERRETPIPEDLPDALTDAFAKDEQKQRQWRAFVEGVAHNPGDLTNVIAEIASFLMPHAIAAAKLGK

SEQ ID NO: 2825 - protein, 214 aa, Sinorhizobium medicae WSM419; identical to SEQ ID NO: 2823

SEQ ID NO: 2826 - protein, 257 aa, Gemmata obscuriglobus UQM 2246
MQLKFVIERLLARLFAGENPPWLLKGGFAMDLRFRPRARTTKDVDLSVSLITGGGDARSAGLRDRLQEALDVDLGDYLTFRLGTPKRELTNAPGGGAQFPCEAVLVGKTYAAFHIDVGVGDALIGTPERLVGEDLLEFVGVPPAAVLAIPKPQQFAEKVHAYTFPWVGRLNSRTKDLVDLVLLIERGAPAVAEIRAALVTTFTTRSTHPLPAALAPPPPSWKEDFVGMAAQAGISTTDYLEAFTLLERFWSTNALAG

SEQ ID NO: 2827 - protein, 67 aa, Gloeobacter violaceus
MKDMAASVRDRLYAEHRRRGEEFQFLVTRYALERVLYRLGRSRHVESFVLKGAMLFAIWADEPHRAT

SEQ ID NO: 2828 - protein, 343 aa, Gordonia bronchialis DSM 43247
MAYASEDAFRAGLKARLVREARDSRFSRDELARAFTLHLFTARLFRSSDAKHWILTGGTALQFRAPQQARPTADADLATRLDAEHMQESLQRAARPGPGDFGHFDIRISPTDNPGLFAGHIRYIVAGQRFSDASLDLATHREMLFAAEETVPEPALRVDELDPMPVIRMQAVAEAIADKVAALYELHGPQGQTPSTRVHDLVDLAILTGTQRVDAAQLHTALRYQEQRRAITIPVPLVLPSPSWQRDYPDRAAHSGVPRELGTAERALAYTNTLIEPVLSGRVTSGQWDPGTGAWAPPTRSIADLLADTRSPQRAHTPTPPATTSPTPQPYSTDRARDTERGL

SEQ ID NO: 2829 - protein, 296 aa, Gordonibacter pamelaeae 7-10-1-bT, DSM 19378
MMAYATPTALEMAVKAAAKASSLDTGRAVSGFYFHRFLCRIFSRQDTPFVLKGGQSMLARTADARATRDIDLLSEKADIDEALAELKHLAAIDLEDFVTFEFVGYKPIKAEDDYRAGLNVTFTPLLGGKRLQDISIDLVFDQIAYGKSEVVEPADRIDVPDIPTFGYRIYPATCSLADKLCAMVEMHGDRPSSRVKDLVDVAVYAVTTDFDGGELCRRARIEATVRGIKLPEKYAAPMEWKRLYRGTFRKLVRQTGLPPEYAEIETAEALAASLLDPVLSQEADGRRWYHENLGWE

SEQ ID NO: 2830 - protein, 283 aa, Intrasporangium calvum 7KIP, DSM 43043
MAANGAQVLRQLQRQALASRQTGATVTTGELVTRHALESFLDRLQRTPHGMDFVLKGGILLAGYGVRRPTKDVDCQARSASVTAAHIERVVRDVATVEAADGLEIDLGSLDVQTIREAADYPGLRMRALGTVGTARVVVAWDISTGDPVVPLPKMVSIPRVLGEPIEMLGYAPETSVAEKGVTILERGITSTRWRDYVDIVQLAKHGIDRSVLLDSARAVARFRQVILRPVADSVAGYGAASQPKWAAWRRKEGLEDVCEPNLDDQLLEVIAVLDPVFSSGSE

SEQ ID NO: 2831 - protein, 301 aa, Legionella longbeachae NSW150 uid46099
MKSPKNSAASIRQRLLNHSKTYQKPFNEILQYYAMERFLYRLSLSQHKNKFILKGALMLRVWNAPESRPTMDIDMLGKTSNDEINIVQQMKEILSVNVPEDGLAFDATTMQAERIKEDADYHGIRILFKGNLDTAKIHMQIDIGFGDVVYPVPKKSLMPTILDLPAPELLTYSRETAIAEKFEAIIKLGSLNSRMKDFYDIWMLSRQFDFNGKELSEAIRLTFENRNTVLSDDIEAFSNQFIQLKQTQWLAFTKRLKQEYVPIQFQEIISKIQAFLYPLVLTFSQQNPMPQKWCSITCQWS

SEQ ID NO: 2832 - protein, 283 aa, Legionella longbeachae NSW150 uid46099
MTKNTGESVRSRLKNIAIKEGSDFNAVLTRYGLERLLYRIGESEYSKQFLLKGALLFNLWYDMPHRPTKDIDLLGFGDNDLAYVKQTFSKICRISTDDGISFLSESVTVDTIKKDGGYTGARVELFGELAKAKIKIQIDIGYGDAVTPGPIDAHYPVLLSDLPAPKIWTYPIYTVIAEKLHAIALLGMANSRLKDYLDLYVLLSNEQIDNQVLAKAIQATFNRRGMDLPEALPVGLTDEFANDPSRESMWKAFLRKNELEQKPLTEVIAVIRNLIQVPYSLAK

SEQ ID NO: 2833 - protein, 63 aa, Lentisphaera araneosa HTCC2155
MSKAASVQQLLRNQAKAQGINPNILQVRYSLERFLYRLGLSEHKDRFTLKGAMLFILWSDKSF

SEQ ID NO: 2834 - protein, 279 aa, Lentisphaera araneosa HTCC2155
MSKAASVQQLLRNQAKAQGINPNILQVRYSLERFLYRLGLSEHKNRITLKGAMLFILWSDKSFRPTKDADFLITGDISPNNIQQVIIDICSTKVEQGDAMEYDAESIKIIPIKESQEYQGLRVTLKSKLGHIPIPMQLDMGTGDIVTPPATEADFKVLIDTLPAPRLKVYNRETVIAEKLQAMVLLDLANSRMKDFYDVWIICTQFGFDEEILKEAIVSTFKRRGTDYPSEGISSLTEYFYDDPSIKIRWKAFTKKLKLDLSLEQVCIDIKGYLEAILK

SEQ ID NO: 2835 - protein, 294 aa, Mariprofundus ferrooxydans PV-1
MSGKGTNTAASIRQRLLNISREQKVNFNRILTDYGLQRLLYRLSVSRYRDEFVLKGAMLFSYWSGDAFRATKDADFLKSGEASMDYLREVFTNLCNQSVEPDDGLIFDPASVSAEEIREEDAYGGIRITMTAKLSGARISIQADIGIGDVITPAAQEIEYPVLLDMPAPKLKAYPVETVIAEKFEAMVHLGFANSRMKDFYDIWALSKFMKPDCDTLAMAIANTFRRRGTALPSDTPVALTGEFSRDDMKQKQWAAFIRRAAVGNSAKATLHETVEEIRPMLMSMVDIARNGNG

SEQ ID NO: 2836 - protein, 313 aa, Methylobacterium extorquens AM1
MSPLAASRRSLLQNQANKLGISNELVMRRYVFERFLDRLASSAHRGELVLKGAMALIAVTQSFGRPTKDMDMLGLNPLSMEDALELIRHVASIAPGQDDAVEFIPSSFKASVINEETDEPGTRIMGEARIGTARIPIKIEISHGQAMTPGAVLMDYPTVLGGMDAPKVLVYSKETMLAEKFEAIVSLGTHISRFKDFYDVRQLARRLAFDGEVAAQAFLNTFGNRGTDIPEGELAAFDPAFVSGAGQRGWSSFLRKQVIRDAATFGEVVDEIRPFVLEVAAMARGEAPIRNWTPGEGWSSPEEVYAPAPGPRP

SEQ ID NO: 2837 - protein, 279 aa, Mobiluncus mulieris ATCC 35239
MDILGLLRQRAREVTRRDGIQPPTQEIYVHYVLEGFLARLAASPYREDFVLKGGLLLGVYTGRRFTKDIDSNAVSATVDAAELRTIATSIARIDIGDGVVFNPERLTTREIRETDDYPGIRLKMPARISSWEGVFAWDVSTGDPIVPNPQWITISHEPGESLQVLSYPPEAIMAEKVVTILERSITSTRWKDYVDILDLYRAGLDESALVAALKAVARHRGVELRPIAGLMDGYGDVYQNRWATWRKKENLEGKTEANLDSQLAKMATILDPMLVSAVE

SEQ ID NO: 2838 - protein, 279 aa, Mobiluncus mulieris ATCC 35243
MDILGLLCQRAREVARRDGIQPPTQEIYVHYVLEGFLARLAASPYREDFVLKGGLLLGVYTGRRFTKDIDSNAVSATVDAAELRTIATSIARIDIGDGVVFDPERLTTREIRETDDYPGIRLKMPARISSWEGVFAWDVSTGDPIVPNPQWITISHEPGESLQVLSYPPEAIMAEKVVTILERSITSTRWKDYVDILDLYRAGLDESSLVAALKAVARHRGVELRPIAGLMDGYGDVYQNRWATWRKKENLEGKTEANLDSQLAKMATILDPMLVSAVE

SEQ ID NO: 2839 - protein, 279 aa, Mobiluncus mulieris FB024-16; identical to SEQ ID NO: 2837

SEQ ID NO: 2840 - protein, 119 aa, Mycobacterium leprae Br4923
MQPARYVTTSVLKGGVLLAASGNCHPTRDIDLSGIDVNNDAATVLNLVRPVFTSRLPDDDVLIYQADSATAEVTSKEDNYSGVQVTATTTLASARLTFHVDVSVGYPIYPPVPTIRKPS

SEQ ID NO: 2841 - protein, 119 aa, Mycobacterium leprae; identical to SEQ ID NO: 2840

SEQ ID NO: 2842 - protein, 283 aa, Mycobacterium marinum M
MSAGDAVFRRIQSLARSAAAKDGTGAPTQEYLIRHTLESFLDRLARSSHAGDFVLKGGVLLAAYGVRRPTKDADANAVHADVTAEHLAHVVRDIAVIDVEDGVVFDLETINVRQIRDQADYPGLRVRVAVSIGPWKGAVAWDVSTGDPIVPPPRQMTIDRILGDPITLLGYAPETAIAEKGVTILERGITSTRWRDYVDIVQLARRGIDPEELLRSARAVARHRGVTLEPVAPHLVGYGAVAQARWAAWRRKEHLESVCEENLDDQIALVTSSLDYVFAHGLE

SEQ ID NO: 2843 - protein, 283 aa, Nakamurella multipartita DSM 44233
MDGRIAAEYFRLYALEGLLLRLSHSVHRDRFVLKGGVLLAAYQLRRPTTDIDFAALATSNDLEEIRQTVIEIARTPLPPDLDDGLVFDLGAVTARVIRDQDQYSGVRVRLGARLVTAWELFHVDVNVGDPIWPAPADVELPRLLDQPAIPLRGYPMEMVLAEKVVTALQLGIASTRWRDYGDIYQLTGRYDFNSGLVRDAVAAVAAYREIELTALTDELAGYAELAQTKWFAWRSRQDLIDRLPASFTQVLTAVAGFADPVLSPTDDVGSARWSPQTRSWVDV

SEQ ID NO: 2844 - protein, 311 aa, Nitrosococcus halophilus Nc4 uid46803
MTQHRGPNLATSIRQRLLNEARETDRPFNEVLQYFAMERFLYRLSKSDHADKFVLKGALMFTVWQAPVMRPTLDIDLLGITDNDVEAIVAVMRDICRQDVETDGLAFDVAGVEGERIVEDADYAGVRVRFRGTLGTARITMQLDIGFGDVVVPKPEAADYPTILDLPAPRLRGYSRESAVAEKFEAMVKLGVVNSRVKDFFDIWLLSRRFDFDGRTMAQALTETFVTRDTTIPAEPVALTGDFGNDAGRQDQWRGFIRRSRLQNVPSSFAEIVEAVAVFLGPVTKALAAGERFQGSWKAPGPWRGHYAGNT

SEQ ID NO: 2845 - protein, 295 aa, Olsenella uli VPI, DSM 7084
MYKSAAALEMAVKAAALSSPLNTSRAISSFYFHRFLCRVFAGGNDAFVLKGGQSMLARTIDARATRDIDLLATRGDLDEALRSLIGLAQENMDDFVTFEFAGSRPIKAEDEHRSGLSVRFIPIIGSKRMQQIAIDLVIEEIPLEDTELIAPVDRIDIEGLQTCDYLVYPVENALADKLCALAEKHGGRVSSRVKDLVDIAIYATTCSINGDKLQKCVHREAAVRRVALPKSFAIPEGWDESHEGRFEKMCLQTGLADSFWSIDASAKLARRLFDPALAGLANDMTWSPQKTAWEE

SEQ ID NO: 2846 - protein, 312 aa, Chlorobium luteolum DSM 273
MSANAIKNIGASVRQRLLNKARQENRPFQELLQYYAIERFLYRLSVSSFADRFILKGALLLRVWQAPLARPTMDIDMLGKTGNAPESIMTIIHQVLAVEKQGDGIVFDPESITVEPITEDADYEGLRIRFRGDLDAARLTIQLDIGFGDKVYPDPVQESLPSLLNFPQAEMYCYSRESMIAEKFEVMAKLGILNSRMKDFYDIWMLSRQYDFEGASLAEAIRQTFAQRGTTLVQMKEIFSGEFIEEKQVQWNAFRKRIGLEYLPASFADVVQQVQVFLSPAVEALRAKRFFQDNWIAPDSWRSNHEKPEVRA

SEQ ID NO: 2847 - protein, 312 aa, Pelodictyon phaeoclathratiforme BU 1
MSTKAIKNIGASVRQRLLNKARQENRPFQELLQYYAMERFLYRLSISSFADRFILKGALLLRVWHAPLARPTMDIDMLGRTGNAPESITTIIRQVLAVEKQGDGIVFDPESITVEPITEDADYEGLRIRFRGDLDAARLTIQLDIGFGDKVYPDPVQESLPSLLNFPQAEMYCYSRESMIAEKFEVMAKLGILNSRMKDFYDIWMLSRQYDFEGASLAEAIRQTFAQRGTTLVQMKKIFFGEFIEEKQVQWNAFRKRIGLEYLPASFADVVQQVQVFLSPAVEALRAKRFFQDNWIAPNSWRSNHEKPEVRA

SEQ ID NO: 2848 - protein, 323 aa, Phenylobacterium zucineum HLK1
MAVRGDRPGPNRDAPLPRGAHVNDKPKDMAVSARARLTNRARERKENAQLLMTRYVIERLLWRLSVSPYRQLFVLKGAMLFSLWAPTPYRATGDLDLLGFGNNDPDQVAGLFRELMVIPGDDGIVFKPDTIVAAAARAEDEYSGVRLDFQAELAGARLPIHVDIGFGDAITPGAQDIEYPSLLDLPPPKLRAYPPETVVAEKFQAMTALGMVNSRMKDFFDLWAIANTFAFEGAVLAQAIAATFARRETPLPKEPPLALTAGFAEAKQAQWTAFLKRTEISLAPEPFPEIQAQIVELVMAPTLRIADGETFAGRWPPGGVWTT

SEQ ID NO: 2849 - protein, 293 aa, Polaromonas naphthalenivorans CJ2
MTHDIAASVRARLLNLAKAEGSEFNQVLVRYTLERLLYRLSQSAHADRFVLKGALLFTLWYDMAHRPTRDADLLGFGPSDLASIDQMFRDIAGVAVEDGIVFEPASVKVEDIRKESGYGGARVLITGELAKARCRAQVDIGFGDAVTPGPVQAVFPVLLADFPAPQLRTYPVYTVIAEKLHAIALLGMTNTRLKDYLDLSVLLEREALDPTILATAIAATFMRRGMAVPAQLPIGLSDEFANDATRQALWRAFLKKNALTITPLPDTVSALHAYLHPVIRQAALQQMDLSKTL

SEQ ID NO: 2850 - protein, 112 aa, Polaromonas JS666
LAKLDSARIALQVDIGFGDAVTPAPEAISYRVLLNDLPAPQLRAYPKYTVVAKKFHAVCLLGMTNTRMKDYFDLWVLLGENTLDPWELRRAIETTFERRKMAITSHCMGRPR

SEQ ID NO: 2851 - protein, 318 aa, Propionibacterium freudenreichii shermanii CIRM BIA1 uid49535
MKGQGPYVDWFGVESAIQQAARRQAADHPGASVGQYLDHIRRDRFLSRVFADPESGWLLKGGTAMLARVPTGRHTRDVDLSTTRATLDEAVEDLAHRVAVDMGDHLRFQLESERPGLAVTQPGVLVARLSFACITDTGKRFDNVAVDLAVGPPPVGHIEHTRPADSPDLPRLISPPYAMFPLTDQLAEKVSTMMTPRPDGRPNSRAKDLVDVDIIAATQYVDLRELRLALAVQQQRANTDLGRHLRVPPHWEPRYQSLATGTSAAAVAPTFADAVDLAARFINPALDAVRTVRTTWGPEAMEWTVGTGSPAAGPHRGV

SEQ ID NO: 2852 - protein, 97 aa, Raphidiopsis brookii D9
MSAKNLKNISASVRQRLLNRAKDEQRPFSELLQYYAMERFLYRMSQSPHADRFILKGALMLRAWHSTEFRLNVKNVENSLVKIWILWARTYTRAVGK

SEQ ID NO: 2853 - protein, 289 aa, Rhizobium leguminosarum bv  trifolii WSM1325
MAKEIRNVGASVRARLLHLAKASGQSFDLVLTRFALERLLFRLSQSPHANRFVLKGAMLIMSWFDDPHRGTRDLDLLGFGDPSPDPMLETFLEILAQEADDGVTFDPDTLHVDRIREALDYGGLRLRVIATISGARINLTIDIGFGDALEPGVEILDYPSMLDFPMPRLRAYARETVIAEKFQAMVMLGRVDSRMKDFYDIWILSRSFDFSDDRLARAIAATFKRRETSIPTNLPDALTDAFGKDQQKQRQWRAFIEGVAHNPGDLTDVIAEIAAFLMPHAVAAARLDQ

SEQ ID NO: 2854 - protein, 281 aa, Rhizobium leguminosarum bv  trifolii WSM1325
MARELKKNVGASVRARLLDRSRAERTDFQILLTRYALERLLYRLSLSEHRDRFILKGAMLFVTWIADPFRPTRDLDLLGYGENSPKAIAETFHAICTQPVDADGVVFDVDALAAAPIREEVEYGGVRVRTTATIGGARIPIQVDIGFGDAVTPGPVDIEYPSLLDAPVPRLRAYPVGTVVAEKFEALVSLGMANSRLKDFYDLWLIAETFELERSTLAEAVRQTFARRGTGIPTEGPTGLSEAYAEVWIGNGGRSLVANGWRPHHPPWARWSLISDASYCR

SEQ ID NO: 2855 - protein, 353 aa, Rhizobium leguminosarum bv viciae 3841
MRWRGCARGSAGARPQATTSGHMRKRPGSGRSCDPMSKRRWPMARELKKNVGASVRARLLDRSRAERTDFQILLTRYALERLLYRLSLSEHRDRFILKGAMLFVTWVADPFRPTRDLDLLGYGENSPKAIAETFHAICTQPVDADGVVFDVDALEAAPIREEVEYGGVRVRTTATIGGARIPIQVDIGFGDAVTPGPVDIEYPSLLDAPVPRLRAYPVATVVAEKFEALVTLGMANSRLKDFYDLWLIAETFELERSTLAEAVRQTFARRGTGIPMERPTGLSEAYAEAWDRQWRAFLGRERMAAAPPALGTVVADLGRFLLPLTQPVEGEWRWKPYEGWIQLQVKQLGYPKR

SEQ ID NO: 2856 - protein, 201 aa, Agrobacterium radiobacter K84
MAKEIKNIGASVRARLLQLAKASGQSFDLVLTRFALERLLFRLSRSSHADRFVLKGAMLMMSWFDDPHRGTRDLDLLGFGDPSAELMLATFREILAQDASDGVEFDADALRVDRIREELEYGGLRLRTTASISGARISLTIDIGFGDALEPGTEELDYPSMLDFPMPRLRGYARETVIAEKFQAMVALGRANTRMKDFYDI

SEQ ID NO: 2857 - protein, 237 aa, Sinorhizobium fredii NGR234
MAKEIRNVGASVRARPLQLSKASGQSFDLVLTRFALERLLFRLSQSPHAGRFVLKGAMLMMSWFEDPHRGTRDLDLLGFGSPEPDLMLGTFREILAQQVDDGVMFDADTLRVDRIREELEYGGLRLRAVASISGARINLTIDIGFGDALEPGAEMLDYPSMLDFPAPRLRAYARETVIAEKFQAMVMLGRVNSRMKDFYDIWILSRSFDFDDDRLARAITATFERRETPIPEDLPDA

SEQ ID NO: 2858 - protein, 291 aa, Rhodomicrobium vannielii ATCC 17100
MPNIAASVRARLRNVAATRNEPVELLLTRYVLERLLYRLSTTEHRKRFVLKGAMLMRMWFDMPFRPTRDLDLLGFGDPDPEAMLAIFRGICSIQLDDGVEFDAEGLRIHRIREDNEYGGLRLKTIATLAGARIAVTIDVGFGDAVEPEITDVELPVLLDLPPPRLYAYPRETVIAEKFQAMVNLGRANSRMKDFYDIWQLSIAYDFHGESLPRAIAATFARRNTPVPSESPDALTAAFAEDLVKQQQWNSFLQDIDAPFVPLAEILAALNSFLMPHAEAARTIAASKGLPS

SEQ ID NO: 2859 - protein, 290 aa, Rhodopseudomonas palustris DX-1
MAREIRNIGASVRARLLNLSKAKGQSFDLVLTRFALERLLFRLSQSPHADRFVLKGAMLMMSWFDDPHRGTRDLDLLGFGDPSEAAMLATFRDILAQDAEDGVVFDPDTLRVDRIREELDYGGLRLRAIASVGGARINLTIDIGFGDALEPGAEVVDYPAMLDLPAPRLRAYARETVIAEKFQAMVALGQANSRMKDFYDIWILSRSFSFDDDRLAKAIAATFDRRKTAIPTERPDALTPAFAADEQKQKQWRAFVEDVAVDPGPLALVIEELTGFLMPQASRANEFGRY

SEQ ID NO: 2860 - protein, 288 aa, Rhodopseudomonas palustris DX-1
MARPPVRNVAASARDRLANLARERKQPFELLLTRYVLERLLFRLSQTPHGSRFVLKGAMLLTTWLEAAFRPTRDLDLLGYGDPDPDAMLGVFTDVCAIDFDDGVVFDVAALEIDQIREELEYGGLRIKTNATVGGARVRVVVDIGFGDAVEPQAAEVDLPVLLDQPSPRIRTYPPETVIAEKFQAMVALGRANSRMKDFYDIWVLSRDYQFEGESLARAIAATFARRRTEIPTELPDALTKAFAEDAAKIKQWKAFMENIEVDVVPLADVVADLAAFLMPRAAQARGV

SEQ ID NO: 2861 - protein, 302 aa, Slackia heliotrinireducens DSM 20476
MGYSSPKALEMAVKDAAKASPLDTNRAIAGFYFHRLLYRVFSEPGTPFVLKGGQGMLARTADARATRDIDLATDSMDVDAAVDELERLAAKDADDFVTFELRGVAPIKGEDAYRDGYTVVFDAFIGPKRVQRVSVDLVADSIAIGEPDYMAPADRIDVRGIPVCDYPVYPSARAVADKVCGIVERHAGRPSSRVKDLMDIAAYALTDDFDAETLGAALKREASARRLSLGSEFSLPAEWGDAHEAQYSKLAVQARMSQDMSTLSGALSISRALLDPVLSGSATGSWSHIARAWVESIVRDAL

SEQ ID NO: 2862 - protein, 278 aa, Synechococcus sp. RS9917
MKANRAASIRQRLLNRSRQEQETFDAVLNRFGRERLLYRIGISEYCDRFLLKGAMLFALWYDMPHRPTRDMDLLGFGPGELFVLERVFREIAQQRVDDGLAFSETVTAAEIRNEANYAGARVTLLATLEQARIPLQVDIGFGDPVTPEAEQIDYPVLLEDLPPPRLGAYPVYTVIAEKLQAIVSLGMVNSRLKDYFDLQVLLVREELDAQVLAEAVRRTFAVRSTPLPQQVPLGLSSEFGEDPDKQAQWRAFLQRNELAEIPLPAVVSQIRDGDCQQR

SEQ ID NO: 2863 - protein, 310 aa, Syntrophobacter fumaroxidans MPOB
MTQNRLRNVGASVRQRLLNLSKKKSEPFDLVLTRYALERLLYRIGRSEWRSRFLLKGAMLYTLWFDASYRPTRDMVLLGFGPGQIAHLEGTFRALCEVAVEDDGLTFLKENVRGSEIRGESEYRGVRMQVTAILSGAVIPLQIDVAFGDVVLPGPEEVRYPTILDLPAPEVLAYPRYTVVSEKFQAMVMLGIANSRMKDFYDIRELARRFEFDGLLLSRAIRATFEQRRTVLPAEIPLALTESFSHDRVKMTQWGAFIRKNRLMEEKVSLQEVAVFLTGFLMPPVRAAQQGEAFEMIWTAPGPWEPRNPT

SEQ ID NO: 2864 - protein, 230 aa, Variovorax paradoxus S110
MSRNLAASVRARLKQRADATRQDFNLTLTRYGLERLLYRLSVSPHAANYLLKGALLFSLWYDQPHRPTRDADLLGFGPDDVDTAVSAFREICQIEVDDGIAFDAASVRGSVIRKEAGYGGVRIDLLAKLDGARLALQVDIGFGDAVTPAPEPVSYPVLLEDLSAPQLRAYPKYTVVAEKFHAVCLLGMANTRMKDYFDLWVLLTEGALEAAELRRAIALLRGEFQKLGTA

SEQ ID NO: 2865 - protein, 288 aa, Verrucomicrobiales sp. DG1235
MTKSNLAASVRQRLLNKSKENREAFDFVLSRYAIERFLYRLSLSQHSNTFVLKGAILFYFWNHEMHRPTRDIDFLGSGTADCEILERIITEIVTTPACEDGLTFNTSTIKAAPIREEAFYDGIRAKLIAKLGTVRIPMQIDIGFGDAVTPAPETKHIQSLITELPGPEVNAYPMYSVIAEKLEAMVVLGEQNSRMKDFFDIHFLLTKEELNANSIREAVVATFKRRRTDLPLTTPPSLLVEFAVLKQMQWKAFLRRNNLESTNEDFSKILEEIREHLPINWISLGKES

SEQ ID NO: 2866 - protein, 307 aa, Xanthomonas oryzae MAFF 311018
MNEPDKSRRTVAASVRARLLNKARAERLDFNLLLTRYALERVLYRLSVSEQQGQFLLKGALLFDIWFDIPHRPTHDADLLGFGSTEIPHLEDLFRRISQIASDDGIVFQADSVKAAEIRKEANYAGVRVTMIGLLDGARCTVQIDIGFGDAVTPGPDNVQYPVILDGMPQPQLRVYPRYTVVAEKLEAMVKLGILNSRMKDYFDLWVLAGHSDFDGAVLATAIRATFECRGTAIPPGAPLGLTDEFGLDEQKTKQWQAFLRKNTLEPMPLTTVIEALREFVLPVLAALAAGEGFDRQWRAGAGWDAA

SEQ ID NO: 2867 - protein, 283 aa, Xanthomonas oryzae pv oryzicola BLS256
MSNVAASVRARLRGVAKAQGVDFNQVLVRFALERILYRLSQSEHADRFLLKGALLFTLWYDMPHRATRDADLLGFGASDLESVAQTFRDIASVAVDDGIVFDPASVVAEEIRKDAGYAGARILIGGELAKARCRTQIDVGFGDAVTPAPVHSVYPVLLEDLPAPRLRTYPVYTVIAEKLHAIALLGMTNSRMKDYLDLSVLLERESLDIDLLAQAVKATFERRGMAVAAALPIGMTDEFAHDTSRQALWQAFLKKNELAPEPLAAIVVRLRAALEPALHRAAR

SEQ ID NO: 2868 - protein, 307 aa, Xanthomonas oryzae KACC10331; identical to SEQ ID NO: 2866

SEQ ID NO: 2869 - protein, 307 aa, Xanthomonas oryzae PXO99A; identical to SEQ ID NO: 2866

SEQ ID NO: 2870 - protein, 287 aa, Xylanimonas cellulosilytica DSM 15894
MSPNPTRDTPAGRAYNDLRNLAKSHRRDPAEYLALYALECFLARLAASDLSGDFVLKGGVLLAAFAARHPTRDIDLAAMGFPNDIAEVERRVRTIIAVDAQDGLHFAADSISSDVIRDEADYTGVRVHLVATLAKARIPVHVDVNFGDPIWPAPQETALPRILGGEVWLLGYPAHMVLAEKIVTAIDRGVANTRWRDFVDIATISRTQTFAGHELAAAIRTVARHRQVEIRLLAEELAGMGDIAQSRWSAWRRKQRLVDGTPEAFQVLLDDVIAFADPVLNAADEEL

SEQ ID NO: 2871 - protein, 290 aa, Opitutaceae sp. TAV2
MSAPKNIAASVKARLQNAASRRGEDFNLLLMRYGIERLLFRLSQSAHADRFLLKGAMLFVVWDEKTHRPTRDLDLLGFGPSEKEDLQKIFQAVVSTPVVDDGLVFDPASVRAEEIREDNAYGGVRIRLMGKLGTAEVPVQIDVGAGDVVTPAPETAAFPTLLDFPAPKIRTYPVYTVVAEKFEAMTTLGPANTRMKDFHDVWFLARRFNLDVAILRQAIKATFARRKTSLPQFPEPLTESLANDPAKQAQWTAFIRRNGLSGVPGQFSEVVAALRTFIAPVLRPSGRLPQ

SEQ ID NO: 2872 - protein, 691 aa, Acinetobacter johnsonii SH046
MNYNATRSLELLQTGSQNPHAEFREGQEAAIQHLVESTQRLLVIQKTGWGKSFVYFIATKLLREAGKGPVILVSPLLSLMRNQIEAATRMGVKAFSITHENDSQSDEIQSLMAQDQVDILIISPERLSNLDFKEKILNKYSAYFSMIVIDEAHCISDWGHDFRPDYRLIERILKNLPQNLRVLATTATANKRVMDDLAAILGPNITVHAGDLNRSSLTLQTIELPTHAEKLAWLIENIPKLQGSGIIYTLTIRDAQLVTQWLTEHDIHAEVYNSKIEGSKESLENALINNKLKVLVATVALGMGFDKPDLAFVIHYQMPSSIVAYYQQVGRAGRAIDSAYGILLAGNEDDEISNWFIDSAFPTSIEIHNVLLALEKAPIGLTVPKMLTQINMSSSRIEKTLKALSLEYPPLVAKIGTQWRRTPIPYHDSVLQRAERLTTLRRAELEQMHEYVKLPFGSHMHFLIRALDGDTQSIQPPSLPPLPINVDPESINMANNFLHRTGVPIKVRHKWPDLIGMPQYNLKGRIHDSEKAQEGLALCLWGDAGWAKLVKKGRYEDFSFDDVLVHECVKMYKTWNLDSSPTWVTCVPSLNNPTLVPNFAQRLAKELNLPFVPILIKTAHRGQQKSMANLTQQALNIDGSLAISDKPSNGPVLLVDDIVNSGWTFTVAAWLLRSNGSGPVIPFALATTGYK

SEQ ID NO: 2873 - protein, 464 aa, Arthrospira platensis NIES-39
MVARIFTPTSWQWNYLYIDGQRRAETNQFFKKKGIKSAAYDGQLDNELRQKLENDLLANQLKVLVATTALGMGFDKPDLGFVIHYQRPGSVVHYYQQVGRAGRAVDEAYGILLSGKEDEEITNYFIKNAFPSSHNIQQILEALLTKNELSVPEIEQSVNIGRGQIEKVLKFLSLESSPPVVKRKSKWYATPAALRYQLNSHKIDEITRIREEEQAEMRDYMNSQECLMQFLQCSLDDPNPAPCGKCAVCLNRPLLKTTCNQELVKEAIEYLKRTYQTIEPRRQFPKNALLEYNFNGKISHQLQAEAGRSLCCWGDPGWGEQVQQGKYQNNHFDDKLVEAMVEMINKWQPQPFPTWVTCVPSLTRPHLVPNFAERVAVRLNLRFLPVVEKIRETPPQKKMSNSYQQAHNLDGAFRINYQEVQPGSVFLIDDMVDSRWTVTIITALLRQSGSGRVFPVALTLNSFR

SEQ ID NO: 2874 - protein, 1130 aa, Chlorobium phaeobacteroides DSM 266
MIYKSARALELLRIASCNPDAMFRESQEEAIRYIVEGRGRLLVVQKTGWGKSFVYFIATRLLREGGSGPALLISPLLALMRNQIEAAERMGVRAATINSDNPDDWAEVELSIARNAIDILIISPERLANERFSANVLARIASQISILVIDEAHCISDWGHDFRPYYRLLERIVKSLPSNLRLLATTATANNRVMEDLSEVLGPYLEVLRGDLNRPSLTLQTILLPDQAQRLAWLSEQLAALQGHGIIYTLTVRDANTVAAWLKSRGFSVEAYTGETGDRRPEFEQALLHNKVKALVATSALGMGFDKPDLAFVIHYQMPGSVVAYYQQVGRAGRALESAYGILLSGREETDITDWFIRSAFPTRHEVNEVINALENELAGLSVPELLAKVNLSKGRIEKTIALLSLESPAPVAKQGSKWQLTAATLGEGFWARADRLTALRRDDQRQMQEYLALPFAEHMGFLIQALDGDPNTVSFPLLPPLPILADAALVLEAVAFLRRTSLPIEPRLQWPGGGMPQYQVKGKIPVNLQAGHGKTLSVWGDAGWGELVRQGKYLDNCYSDRLVTACVEMIQKWNPEPAPAWVTCVPSLRHPDLVPDFAQRLADALHLPFQKVFVKREERPEQKTMANSTQQARNIDGSLAVNGQTVPESPVLLVDDVVDSRWTLTVSAWLLRKYGSGVVWPMALAQTGYDMQKLSSNTKAILLLTAPLIASHGSLLPDLLSPSEYNRLARHLHDMQREPADLLLPDAGDLHRACKHLVDEKRLQSLLERGFLLSQVIEHWQARAIWVVSRADAAYPRRLKARLREGAPAVLYGCGDINLLEAGGLAVVGSRHVDDEQINYTMAIGQLAALADRMIISGGAKGIDQAAMQGALEADGKVCGILADRLERTAMNREHRNLIIEERLVLVSPYDPSAGFNVGHAMQRNKLIYALADASLVINSDINKGGTWAGATEQLDKLRLVPVYVRSTGTASRGIDALRNRGALPWPEPHDVKAFEALLDTSPSLIPVGRDVSIGLFPNGMVQDSVTDTVQEKPQVQVMQEISLPVLVSGKAELSPAQRLFATVREVIRQLLKKPMTDTEIAERLELSTLQTRVWLQLLVDEGILEKKNKPVRYFIKEPGFFENGHHAT

SEQ ID NO: 2875 - protein, 697 aa, Cyanothece PCC 8801
MTSQLYDKALRYLRHALNNPKANFRDGQWEAISNLVNNHSRLLVVQRTGWGKSLVYFIATRLLRDQGAGTSLLISPLLALMRNQIATAQRINVNADTINSSNTEEWNRVQEQLLAGNIDILLISPEKLANDQFRENILITIASRISLFVVDEAHCISDWGHDFRPDYRRIARILQALPANIPVLATTATANNRVVNDIKAQLGDSLQISRGNLTRQSLKLQNLYFPSPAARLAWLAQYIPTLPSSGIVYTLTVRDAQRVANWLKQQGIDAEAYYGALEKKIREPLEDQLLNNEIKVLVATTALGMGFDKPDLGFVIHYQRPGSVVHYYQQVGRAGRAVDQAYGILLSGDEDEEISKYFIENAFPPEVHNQEVLNALESAQNGLSVRELEQKLNLSRGQIDKVLKLLSLESPALVSKQESKWYATAVNYQPNRQKIKQLTDIRYEEQDQMRDYMKSDSCLMQFLASALDDENPTVCGKCAVCLGKSLLPVTYSPNLVDQAVMFLKRSDHIIEPRKQWPLKGAFSVYQFSGNIKPELTAENGRALCLWGDAGWGQLVKQGKYETNHFDDHLVEAMAEMIQRWKPEPKPTWITCIPSLNRPHLVPNFSQRLANHLQILFIPVVTKIKKNPPQKNMSNSYQQAHNLDGVFSIDREKVMPDSVFLVDDFVDSRWTLTVVSALLRQTGSGQVFPTTLALNSLS

SEQ ID NO: 2876 - protein, 690 aa, Dehalogenimonas lykanthroporepellens BL DC 9 uid48131
MAVYSRARALELLRVGCGKPNAKFREGQEEAIRHIVEGKGRLLVVQKTGWGKSFVYFIAVKLLREQGHGPALLISPLLSLMRNQIQAAEKMGVKAVKIDSTNEANWTDIEESIKNNEIDILLISPERLENKRFNDKVLSKISDKISLIVIDEAHCISDWGHDFRPQYRLIERIIKRLPRNLRMLATTATANNRVMDDLKQILGPHLMVSRGELTRYSLVLQTIIMPNQAERLAWLAEYVPLLEGNGIIYTLTVRDAYRVANWLKSRGLNVEAYTSESENREKLELALLNNNLKALVSTVALGMGYDKPDLAFVIHYQTPGSVVAYYQQVGRAGRALKAAHGILFSGEEDTDITDYFIDSAFPSQAEVSAILNALLEEPSGLTIDELTQTANIGYGRIKQALQLLSLESPAPVVKDGYKWQLTAAKINPEFWERITRLTELRKTEQRQMQDYVRLNHDHMEFLVHALDGDINQIYKPRAPKLSEETDPNLVKDAVRFLQRTEQVIEPRLKWPVGYLPIYGLKGYIPTEFRNKPGKALCVWGDAGWGQMVRKGKYTDSHYPDELVTACVQLYRKWNPQPAPAWVTCIPSTRHPNLVPEFAARLARELKLPFVQVLKKRDQRPEQKTMANSYYQALNLDGSLEIKADIIPNGPVLLVDDMVDSRWTLTIAGWLLTTKGSGPVWPMALSVTSGK

SEQ ID NO: 2877 - protein, 695 aa, Desulfitobacterium hafniense DCB 2
MQAQALSLLRKMIGRDAEFHQGQWEAIESVLRGKKTLLVQRTGWGKSVVYFIGAKLLRERGLGPTIIVSPLLSLMRNQIENAVKIGISAETINSDNTDEWTEIEEKLKRKAVDILLLSPERLGNKDFTERVLPSIEGGIGMLVVDEAHCISDWGHDFRPDYRRIVRIIKQLPPNVPLIATTATANQRVVDDIKAQLGDELNSIRGPLTRESLQLQVIKLADQAERLAWLHENINKMEGSGIIYCLTVADCNKVAKWLRGKGINALEYHADLSKDAKEKRKLREERERKLLNNEVKALVATVALGMGFDKPDLGFVIHYQRPGSIVRYYQEIGRAGRALDKAYAILLNGAEDDEIEEYFIQSAFPTPKEMNAVVNAIEKASLGMTKNKILKELNMSYGRVEKCLKTLEIEGIIYKEKSSYFRSPVSWLPDSTKSSAITKLRINELEDMRKFVDTEDCYMRYISAKLDDPYLKNCGKCRNCLDTQFFSEVVSRDNVLEAIQFLKGEYLDIEPRKQWPAGIKAEATKKIPEEEQNFTGKALCSYGDAGWGRVVAEDKYRNEYFSDELVDASLALLKNTLLKEDLGWVTSVPSLRRPLLVKDFAMRLAEKIGLPYIDAIRKTEDTPYQKKMENSYQQCSNALHGFSVIERVPESPVLLVDDIIDSGWTLTVCGILLRGERSGPVYPFALAKASGLEGGE

SEQ ID NO: 2878 - protein, 712 aa, Desulfitobacterium hafniense Y51
MMRSVTHIRKANKGGINMQAQALSLLRKMIGRDAEFHQGQWEAIESVLRGKKTLLVQRTGWGKSVVYFIGAKLLRERGLGPTIIVSPLLSLMRNQIENAVKIGISAETINSDNTDEWTEIEEKLKRKAVDILLLSPERLGNKDFTERVLPSIEGGIGMLVVDEAHCISDWGHDFRPDYRRIVRIIKQLPPNVPLIATTATANQRVVDDIKAQLGDELNSIRGPLTRESLQLQVIKLADQAERLAWLHENINKMEGSGIIYCLTVADCNKVAKWLRGKGINALEYHADLSKDAKEKRKLREERERKLLNNEVKALVATVALGMGFDKPDLGFVIHYQRPGSIVRYYQEIGRAGRALDKAYAILLNGAEDDEIEEYFIQSAFPTPKEMNAVVNAIEKASLGMTKNKILKELNMSYGRVEKCLKTLEIEGIIYKEKSSYFRSPVSWLPDSTKSSAITKLRINELEDMRKFVDTEDCYMRYISAKLDDPYLKNCGKCRNCLDTQFFSEVVSRDNVLEAIQFLKGEYLDIEPRKQWPAGIKAEATKKIPEEEQNFTGKALCSYGDAGWGRVVAEDKYRNEYFSDELVDASLALLKNTLLKEDLGWVTSVPSLRRPLLVKDFAMRLAEKIGLPYIDAIRKTEDTPYQKKMENSYQQCSNALHGFSVIERVPESPVLLVDDIIDSGWTLTVCGILLRGERSGPVYPFALAKASGLEGGE

SEQ ID NO: 2879 - protein, 694 aa, Desulfotalea psychrophila LSv54
MRCKMKERAIGYLRNALNKPEANFRDGQWESIEQLLNNKRVLVVQRTGWGKSMVYFLATKLLREQGAGPTLLISPLLSLMRNQVEAATRIGVRAKTINSTNNEEWDTVQTELEANQVDVLLISPEKLGNDDFRQNILSTMADKVGLFVVDEAHCISDWGHDFRPKYRQIVRVLQALPSNIPVLATTATANNRVVDDVKSQLGDDIELIRGSLVRQSLRLQNITMPSSAARLAWLAQTIPKLPASGIVYTLTKRDADRVTEWLQLVNIDAKAYYNGVPNREDLEQQLFHNEVKVLVATVALGMGFDKPDLGFVIHFQRPSSVVHYYQQVGRAGRAVEEAYGILLSGTEDDQITDFFIRSAFPPQKHISEVIRVLDESNDGLSSYSMEKVLNLRTKQIMNTIDYLAAESPAPVVKVGTKWNATATASTYRINQENIDAITAIRRQEQQQMHEYMQHTGCLMAFLQDALDDPAPQNCGKCQNCAPELRLDESYDNDLANKAGLFLRRSYQPVKAKKKWPPHNPLPTYNFSGMIRENLIASEGRALSLWRDAGWGELIYKGKYEDNHFSDVLVTACVEMLREWAPEEAPKWVTCIPSINHPDLVPNFAKRLARALEIPFVDCVVKVQNNQQQKTMENSFQQARNLDGVFKVNLESRAYSPCLLIDDMVDSGWTFTVAAALLRQVGCTAVYPLALALNS

SEQ ID NO: 2880 - protein, 756 aa, Desulfotomaculum acetoxidans DSM 771
MNRRLLYRWLASGVLWLLLLIVVVISIRSVNIVNSTLALFVTHRGKFLLPAKYLYYWKLTCLGDKSMRERAVRLLKAMLGAGVVFREGQWEAIESIINRKRTLVVQRTGWGKSIVYFIATKLLRDQGAGPTILISPLLSLMRNQIENAARIGIRAESINSQNEEDWEHVKSTLVRGECDVLLVSPERLANFYFLDQVLPLISSGIGIFVVDEAHCISDWGHDFRPDYRRIVRIVNNLPSNVPVIATTATANDRVVNDIKEQLGQNLSIFRGPLKRDSLRLQTIRLADQSERLAWLVANIPKMNGSGIIYCLTVADCDRVARWLQEKGINALEYHGKLGNDLRKEREQKLLDNEIKALVATVALGMGFDKPDLGFVVHYQRPGSIVAYYQQIGRAGRALDNAYAILLNGREDDEIQDYFINTAFPGADEMDRVVRVLNSSQRGLKASEIMLLLNISQIRLEKCLKMLQIDEAISKNGTVYSRTLNPWQPDIARSEQVTAQRKHELRRMQDYVNTDMCLMKFVSLELGDPYAGNCGRCKNCCGEGFFSEQVGIENILEATQFLRGNFLVIEPRKQWPPGGVGDMKGKISGEHRNQEGYSLCMYGDAGWGRLVREDKYEQGYFRDELVFAAVDLIKNQWNPYPFPVWVTAVPSLRHPNLVPDFAKKVAEKLGIPFNPVLVKVKSTPQQKTMKNSFLQADNVIDCFEIQFGCPEGPVLLIDDMVDSRWTFTVCGMLLSKSGSGLVYPFAIANTAGGGDIE

SEQ ID NO: 2881 - protein, 699 aa, Escherichia coli 83972
MMEKHGAELLLQRMLSNTSATFREGQWEAIDAVVNQRRKLLVVQRTGWGKSAVYFIASKIFRDHGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2882 - protein, 698 aa, Escherichia coli ABU 83972
MEKHGAELLLQRMLSNTSATFREGQWEAIDAVVNQRRKLLVVQRTGWGKSAVYFIASKIFRDHGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2883 - protein, 695 aa, Escherichia coli B088
MEKHAAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDADLVAEWLRTNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHKFFRESAFPAEAQIHEILNVLSENDGLTLRGIEQRTNLRYGQIEKALKLLVAENPSPVVYTEKLWRRTIVSFSPDHERINHLMNQRKNELADVESYITTKECKMQFLRRALDEPSAERCGKCSSCLQHPLLSPDIDSGLLHAANLFIKHADLPLNLNKQVASGAFTQYGFKGNLPAGLQGSTGRVLSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRRQVARRFILLPLLLPR

SEQ ID NO: 2884 - protein, 698 aa, Escherichia coli B185
MEKHAAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGAVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRGIDSAVGILLCGSEDRAIHKFFRESAFPAEAQIHELLNVLSVNDGLTLRGIEQRTNLRYGQIEKALKLLVAENPSPVVYTEKLWRRTIVSFSPDHERINHLMNQRKSELADVESYITTKECKMQFLRRALDEPGAEHCGKCSSCLQHPLLSPDIDSGLLHAANLFIKHADLSLNLNKQVAAGAFTQYGFKGNLPASLQGSTGRILSRWGDSGWGKQVAQEKKTGRFSDELVEACAEMVRQRWNPHPEPTWVCCVPSLKHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2885 - protein, 698 aa, Escherichia coli IAI39
MEKHGAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKSDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVAAGAFTQYGFKGNLPAGLQGSTGRILSRWGDSGWGKQVAQEKKTGRLSDELVEACAEMVCQRWNPHPEPTWVCSVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2886 - protein, 699 aa, Escherichia coli MS 185-1; identical to SEQ ID NO: 2881

SEQ ID NO: 2887 - protein, 699 aa, Escherichia coli MS 200-1
MMEKHGAELLLQRMLSNTSATFREGQWEAIDAVVNQRRKLLVVQRTGWGKSAVYFIASKIFRDRGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVADWLRKNGISAFAYYSGVTCGGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2888 - protein, 698 aa, Escherichia coli MS 21-1
MEKHGAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWCRTIVSFSPDHERINHLMNQRKSELADVESYITTKECKMQFLRRALDEPSAERCGKCSSCLQHPLLSPDIDSGLLHAANLFIKHADLPLNLNKQVAAGAFTQYGFKGNLPAGLQGSTGRILSRWGDSGWGKQVAQEKKTGRLSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2889 - protein, 699 aa, Escherichia coli MS 45-1; identical to SEQ ID NO: 2881

SEQ ID NO: 2890 - protein, 699 aa, Escherichia coli MS 69-1
MMEKHGAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVAAGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2891 - protein, 698 aa, Escherichia coli O103 H2 12009
MEKHAAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDADLVAEWLRTNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHKFFRESAFPAEAQIHEILNVLSENDGLTLRGIEQRTNLRYGQIEKALKLLVAENPSPVVYTEKLWRRTIVSFSPDHERINHLMNQRKNELADVESYITTKECKMQFLRRALDEPSAERCGKCSSCLQHPLLSPDIDSGLLHAANLFIKHADLPLNLNKQVASGAFTQYGFKGNLPAGLQGSTGRVLSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2892 - protein, 699 aa, Escherichia coli O150:H5 SE15
MMEKHGAELLLQRMLSNTSATFREGQWEAIDAVVNQRRKLLVVQRTGWGKSAVYFIASKIFRDRGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSDLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2893 - protein, 45 aa, Escherichia coli O157:H7 EC4076
MPGPALLVDDIVDSAWTLTVLTALLRQAGCPTVYPLALASTSVKN

SEQ ID NO: 2894 - protein, 45 aa, Escherichia coli O157:H7 EC4113; identical to SEQ ID NO: 2893

SEQ ID NO: 2895 - protein, 51 aa, Escherichia coli O157:H7 EC4196
MITPPLMPGPALLVDDIVDSAWTLTVLTALLRQAGCPTVYPLALASTSVKN

SEQ ID NO: 2896 - protein, 51 aa, Escherichia coli O157:H7 EC4401; identical to SEQ ID NO: 2895

SEQ ID NO: 2897 - protein, 45 aa, Escherichia coli O157:H7 EC4486; identical to SEQ ID NO: 2893

SEQ ID NO: 2898 - protein, 365 aa, Escherichia coli O157:H7 EC4501
MGRAGRGIDSAVGILLCGSEDRAIHKFFRESAFPAEAQIHEILNVLSVNDGLTLRGIEQRTNLRYGQIEKALKLLVAENPSPVVYTEKLWRRTIVSFSPDHERINHLMNQRKSELADVESYITTKECKMQFLRRALDEPGAEHCGKCSSCLQHPLLSPDIDSGLLHAANLFIKHADLSLNLNKQVAAGAFTQYGFKGNLPASLQGSTGRILSRWGYSGWGKQVAQEKKTGRFSDELVEACAEMVRQRWNPHPEPTWVCCVPSLKHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2899 - protein, 51 aa, Escherichia coli O157:H7 EC508; identical to SEQ ID NO: 2895

SEQ ID NO: 2900 - protein, 51 aa, Escherichia coli O157:H7 EC869; identical to SEQ ID NO: 2895

SEQ ID NO: 2901 - protein, 324 aa, Escherichia coli O157H7 EDL933
MGRAGRGIDSAVGILLCGSEDRAIHKFFRESAFPAEAQIHEILNVLSVNDGLTLRGIEQRTNLRYGQIEKALKLLVAENPSPVVYTEKLWRRTIVSFSPDHERINHLMNQRKSELADVESYITTKECKMQFLRRALDEPGAEHCGKCSSCLQHPLLSPDIDSGLLHAANLFIKHADLSLNLNKQVAAGAFTQYGFKGNLPASLQGSTGRILSRWGYSGWGKQVAQEKKTGRFSDELVEACAEMVRQRWNPHPEPTWVCCVPSLKHLDLVPDFESTSTWFLILPGDWRRNLAYLLLMPLKKSWTIHRRKCSKTVSTSVKISTGRL

SEQ ID NO: 2902 - protein, 365 aa, Escherichia coli O157:H7 TW14588; identical to SEQ ID NO: 2898

SEQ ID NO: 2903 - protein, 698 aa, Escherichia coli 536
MEKHGAELLLQRMLSNTSATFREGQWEAIDAVVNQRRKLLVVQRTGWGKSAVYFIASKIFRDRGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVADWLRKNGISAFAYYSGVTCGGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2904 - protein, 699 aa, Escherichia coli CFT073; identical to SEQ ID NO: 2881

SEQ ID NO: 2905 - protein, 698 aa, Escherichia coli SMS 3 5
MEKHGAELLLQRMLGNTTATFREGQWEAIDAVVNQRRKLLVVQRTGWGKSAVYFIASKIFRDRGAGTTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSGLLHAANLFIKHADLPLNLNKQMAAGAFTQYGFKGNLPAGLQGSTGRILSRWGDSGWGKQVAQEKKTGRLSDELVEACAEMVCQRWNPHPEPTWVCCVPSLRHLDLVPDFARRLAAKLGLPFIDAIEKVVDNPPQKMQQNRFHQCQNLDGAFVIIPPLMPGPALLVDDIVDSAWTLTVLTALLRQAGCPTVYPLALASTSVKN

SEQ ID NO: 2906 - protein, 692 aa, Kingella denitrificans ATCC 33394
MAYNPKRALELLRIGSGRADAIFRDGQEDAIRHIVDGKGRLLVVQKTGWGKSFVYFIAIKLLREAGSGPALLISPLLALMRNQIAAAERMGVRAATINSDNVEDWTDVEGKLGKGEIDVLLISPERLANERFRTQVLAGIAAQVSMLVIDEAHCISDWGHDFRPHYRLLERIAKTLPPNLRLLATTATANNRVMEDLAAVLGPKLQVSRGDLNRTSLTLQTIRLPSQAERLAWLAEQLITLHGHGIIYTLTVRDANQVALWLKAQGFNVEAYTGETGDRREQLEQALLKNQVKALVATTALGMGYDKPDLAFVIHYQTPGSVVAYYQQVGRAGRALESAYGVLLSGEEESDITDWFIRSAFPTRQEVADVLRALEGEPNGLSVPELLSRVNLSKGRVEKTIALLSLEAPAPIAKQGSKWQLTAATLSEAFWDRAERLTVLRRDEHQQMQDYVSLPFGEHMGFLIGALDGDPSVVTEPALPPLPATVNTELVKAAVEFLRRTSLPIEPRKKWPDGGMPQYGVKGFIAPAHQAESGKALCVWGDAGWGGLVRQGKYHDGYFSDDLVAACVKMIQEWNPQPSPTWVTCVPSLRHPELVPNFAQRLAAALGLPFHMVIAKTDARPEQKTMANSTQQARNIDGSLALNGQPIPPGPVLLVDDMVDSRWTLTVSAWLLRKSGSGAVWPMALSQTGPDE

SEQ ID NO: 2907 - protein, 699 aa, Lyngbya sp. CCY 8106
MNNPLKDKALLLLRQALKNPDANFREGQWEAIAELVENRSQLLVVQRTGWGKSLVYFLTTRLFREQGSGPTLLISPLLALMRNQIVAAERIGVKAATINSSNTEDWEAVSSQLINGKIDLLLISPERLANEEFQNTVLSQISQRIGLFVVDEAHCISDWGHDFRPDYRRIVRVLQALPRNIPALATTATANNRVVRDIIDQLGSELWVFRGTLTRSSLKLQNIKLSSPAERLAWLVENLPKLPGSGIIYALTVKDTERIANWLKQNGINAKPYHADVKENRELLEDQLLNNELKALVATTALGMGFDKPDLGFVIHYQRPGSVVHYYQQVGRAGRAVESAYGILLSGEEDEEITNYFIQTAFPPEAHTQQILDCLNQAENGLSIPQIQQYLNLSQGQISKVLKLLSLESPTPVTKQGSKWFATPVIYQPNQKKIQQLTELRYQEQEQMREYMETKNCLMQFLANALDDPNCVPCGKCAVCLGKPLLPITSSIERTNQAIQYLRRSDHKILPRKQWTPQALQIYGFSGNIRENLRAEEGRALSLWGDAGWGKLVKKGKYEDCQFSDTLVQGMAEMIQRWKPQPFPTWVTCIPSLKRPELVPNFAQRLAHQLQLPFVPVVKKVRQNQPQKTMSNSYQQAHNLDGVFVVESWEGMKGSVFLVDDFVDSRWTFTVVAALLRQAGSENVFPIALTQNSLGFTSD

SEQ ID NO: 2908 - protein, 696 aa, Maribacter sp. HTCC2170
MDKNGAVALLRKALDLPDATFREGQWEAIEKLTINKEKLLVVQRTGWGKSSVYFISTRILRDQGKGPTIIISPLLALMRNQIEAAKRLGIKAASINSNNFEDWKTIQAEVLRNNIDTLLISPERLANERFMNEILLPIANKIGLFVVDEAHCISDWGHDFRPDYRRIVGILKVMPKGMPVLGTTATANDRVVADIKEQLGGINVLRGALTRESLKLQNIILKDQASRLAWLKENIPNLNGSGIIYVLTKRDAKTVTQWLNDCNIDAAAYYSGVTDENFENTAVYREVLEDALYNNELKVLVATTALAMGYDKPDLNFVIHFQAPDSIISYYQQVGRAGRAINTAYGILLSGQEDADVHQYFRESAFPPEHVVQDILKALIDHDGLSIPKLQEVLNIKHGQIDKTIKYLTVEEPSPIIKEGTKWKRSAVSFTMDTDKIERLTNQRLFEWKTVQDYIQTEECLMTFLQKELDDPNVEPCGKCSNCLGIKTIPDMVSHNNTVEASIYLKHSEFDILPRKQIAANALPIYEWSGRLNNLIAEKGKVLSRWGDAGWGNIVANDKHQGFFRNELVDAMNEMIVERWCPDPYPEWLTCIPSLRHPDLVPDFAKRLAEKLGIPFRPIILKVKDTQPQKEQENSFHQCHNLDGVFHIEEDVENKPVFLVDDAIDSGWTFTIVTTLLKKSGSGLVYPVALTSTSVS

SEQ ID NO: 2909 - protein, 698 aa, Marinobacter aquaeolei VT8
MNRTDAEALLRTAVGNAAASFRSGQWEAINALVNQRQKLLVVQRTGWGKSSVYFIATRIMRDQGYGPTIIVSPLLALMRNQIESARRLGIHAITINSTNRDQAEALIQQVHTNQVDCLLISPEKLANEQFVEQALHPILDNVGLLVVDEAHCISDWGHDFRPDYRRLLNILRQMPPNMPVLGTTATANDRVITDVLDQLGDIEVLRGPLVRDSLSLQNIVLADQASRLAWLSETIPTLQGAGIVYVLTKRDAEQVKSWLLSQGIDAKAYYSGIEHSDFENSDQYREHLEDLLLNNQLKVLVATTALGMGYDKPDLHFVIHYQTPGSIVSYYQQVGRAGRGIDESLGILLSGAEDERIHDFFRRSAFPNQPQINQVLSVLEDSDGLSVPKLEERLNMRKGQIEKVLKFLSVETPAPVYKAGSQWTRTPVAYQLDHDQVQRLTNMREQEWQEIQEYTTTSGCLMEYLRRSLDDPEAQPCGKCANCLGAPLVSASPDRQRVIAAAQFLRHSEFVFKPRVQVAANGFPQYGLRGNLPQNLRAQEGRVLSRWADAAWGGLVEQDKHGGYFRDELVDAMAEMIQQRWQPTPRPEWVTCVPSLKHPELVPDFARRLANKLGLPFHPVISKVQDNEPQKLQNNRYHQCSNLDGVFAVDAGLPSGPVLLVDDVVDSGWTMTVLAALLRQQGSGEVYPVALASSATGD

SEQ ID NO: 2910 - protein, 696 aa, Microcoleus chthonoplastes PCC 7420
MTTQLKAQALSLLRQALNNPTAQFRDGQWEAIASIILARSRLLVVQRTGWGKSIVYFLATRLLRNSGAGSTLLISPLLALMRNQIVAAKRININAATINSSNPEEWEQINAQLQAGIIDILLISPERLANEDFRQKILLPISQRIGLFVVDEAHCISDWGHDFRPDYRRIVRVLQALPQTIPALATTATANNRVVNDIITQLGANLLVSRGTLTRKSLQLQTIKLSSPAARMAWLAEHLPNLPGSGIIYALTIKDTERVAHWLNQQGIHAQAYHAALTHEQRLTLEDQLINNQIKALVATTALGMGFDKPDLGFVIHYQRPGSVVHYYQQVGRAGRAVEQAYGILLSGDEDQEITDYFIQTAFPPEAHVQDVLNALEQAEDGLSVPQIEQHLNLSNGQIKKVLKLLSLESPAPITKQGYKWYATPVFYQPDTEKIERLTQIRRQEQTRMFDYMNSRECLMTFLARELDDPQPTPCGKCAVCLGRPLLPETYSLNRVNQAIQYLRRSDQIIEPRKQWASKALPSYGFSGKIRDNLRAEPGRALSLWGDAGWGELVKRGKYDNHDFDDALVQGAFEMIQRWHPQPFPTWVTCVPSLHHPQLVPNFAQRLAHQLQLPFQPIVQKVRHTQHQKQMGNSYQQAHNLDGVFDVNSWQGMKGAVFLIDDMVDSRWTFTVIAALLRRAGSGLVFPLALALNSLA

SEQ ID NO: 2911 - protein, 697 aa, Nitrococcus mobilis Nb-231
MREYAEHILRSALDNPQASFHPGQWEAIDALVNERKKLLVVQRTGWGKSVIYFLVARLLREQGRGPSVIVSPLLALMRNQIDAADRLGVRAITLNSTNYDQADDLIAEIQANRVDCLLVSPEKLANEDFVTRAIEPVLEQIGFLVVDEAHCISDWGHDFRPDYRRLLNILMQMPPNMSVLATTATANNRVIDDVVAQLGHIEVQRGPLMRHSLSLQNVVLSDQGSRLAWLADTLPKLPGTGVIYVLTKRDAQQVRDWLVHCGINAQAYYSGIEHDDFTDTNHYREHLEARLLNNELKVLVATTALGMGYDKPDLAFVIHYQAPGSIVSYYQQVGRAGRGISQAYGFLLAGCEDQDIHEYFRRSAFPSENQVQKLLDVLGESDGLSVVELQRHLNLCQGQIDKLLKFLSVESPSPIYKQDRKWVRTPVSYQMDHEQIARLTRMREQEWQEVQAYVQTDDCLMMFLGKALDDPYLNPCGRCANCLGQTLVATEPSLDTARKACQFIRHAEFDFQSRRQVASGAFPKYNFTGNLPQRLRASKGKILSRWNDAAWGRLVADDKHAGHFQDALVLAMAEMIRERWQLAPPPQWVTCVPSLRHPELVPDFTMRLAGQLGLPFRAVIDKVKDNAPQKLQENRYHQCSNLDGIFAITGDVTNEPVLLVDDIIDSGWTMTVLAALLKQYGSGDVYPVALASAAPGK

SEQ ID NO: 2912 - protein, 692 aa, Nitrosomonas europaea
MAYDPKRALELLRIGSGRANATFRDGQEDAIRHIVEGKGRLLVVQKTGWGKSFVYFIATKLLREAGAGPALLISPLLALMRNQIAAAERMGVRAATINSDNMDDWTVVEGKLAKGEIDILLISPERLANERFRTQVLAGIAAQISMLVIDEAHCISDWGHDFRPHYRLLERIVKTLPPNLRLLATTATANNRVMEDLAAVLGPKLDVSRGDLNRTSLSLQTIRLPSQAERLAWLAEQLATLQGHGIIYTLTVRDANQVAQWLKTQGFNVEAYTGETGDRREQLEQALLNNQVKALVATTALGMGYDKPDLAFVIHYQMPGSVVAYYQQVGRAGRALDSAYGVLLSGQEESDITDWFIRSAFPTRQEVADVLGALEDEPNGLSVPELLSRVNLSKGRVDKTIALLSLEAPAPIAKQGSKWQLTAATLSEAFWDRAERLTALRRDEHQQMQDYVSLPFGEHMGFLIGALDGDPSVVAEPALPPLPATVDAELVKAAVEFLRRTSLPIEPRKKWPDGGMPQYGVKGFIAPAHQAESGKALCVWGDAGWGGLVRQGKYHDGHFSDDLVAACVKMIQEWNPQPSPTWVTCVPSLRHPELVPNFAQRLAAALGLPFHMVIAKTDARPEQKTMANSTQQARNIDGSLALNGQPIPPGPVLLVDDMVDSRWTLTVSAWLLRKNGSGEVWPMALSQTGHDE

SEQ ID NO: 2913 - protein, 698 aa, Nostoc sp
MVTPNKEKALLLLRQALDNPTSNFRPGQWEAIEELIERRSRLLVVQRTGWGKSLVYFLATKLLRDKGAGCTLLISPLLALMRNQIAAAQRIGIKAATINSSNQDEWRAVKTQLLAGQVDILLISPERLANNDFRENILLPISQSIGLFVVDEAHCISDWGHDFRPDYRRIVRILQGLPKNIPILATTATANNRVIDDIIAQLGANLQVVRGNLTRESLRLQNISLPSPAARMAWLVEQLPQLPGSGIIYTLTVRDANRVANWLQTQGINAKSYHSDLESDIRITLEDELLNNQIKALVATTALGMGFDKPDLGFVIHYQRPGSVVHYYQQVGRAGRAVDIAYGILLSGDEDEEITNYFINTAFPPQIHTQQVLNILNQEEGLSVPQLEQKLNLSRGQIDKVLKLLSLESPSPVTKIDSKWYVTAINYQYDEQKIANLTAIRRQEQATMSAYMQSQQCLMAFLATELDDANPQNCGKCAVCVGRPLLPVNCSIEMLNQAVLYLRRSQQIIEPRKQWPSQALLSYKFSGNISNNLRAQEGRALSLWGDAGWGELVKQGKYRDNYFNDVLVQGTVEMIKRWQPQPFPSWVTCVPSLNRPELVPNFAQRLAEKLGITFVPIVRKVKQTQLQKDMSNSYQQAHNLDGAFKIDAWPGIGGSVFLVDDMVDSRWTFTVIAALLRGAGSGQVFPVALALNTLGQGD

SEQ ID NO: 2914 - protein, 466 aa, Oscillochloris trichoides DG6
MAWLAEYIPQLPLSGIVYTLTVRDCERVASWLQSQHIDAAAYHSDIDSAQREELEQRLLSNDLKVLVATTALGMGFDKPDLGFVIHFQRPASVVHYYQQVGRAGRAVNDAYGIMLSGDEDQDIADYFIRTAFPPEGHVLEVLSALEYADNGLTLNQLEARLNLSHSQIEKVLKLLSLESPAPIIKEGTCWRVTHITYIPDTQKVKRLTDLRRMEQARMHDYLHSRECLMQFLGRELDDPSANPCGRCAACIGAPLIPVEYGNEIANQAATFLRRTEQVIEPKRSWKGDSLNQHGWSGRIPSELRAEPGRALSIWGDAGWGALVKHGKQHDGHFDDALVQGLVEMIRDRWKPQPFPRWVTCVPSQTHPDLVPDLARRLAVALNLPFVACIQKIRPTKPQKFMQNSYQQAHNLAGAFSVEAWERMAEPVFLIDDMIDSGWTLTVIAALLRNAGSGPVFPVALALVQHT

SEQ ID NO: 2915 - protein, 691 aa, Pelodictyon phaeoclathratiforme BU 1
MMYTSARALELLRIGSGYPCAVFRESQEEAIRYIVEGQGRLLVVQKTGWGKSFVYFIATKLLREGGNGPALLISPLLALMRNQIEAAERMGVHAVTINSDNPDDWAEVEMSIARNAIDILIISPERLANERFRTNVLAPIASQIAMLVIDEAHCISDWGHDFRPHYRLLERIVKTLPPNLRLLATTATANNRVMDDLVEVLGPQLEVFRGDLNRPSLTLQTISLPDQAQRLAWLAEQLDTLQGHGIIYTLTVRDANMVAGWLKSRGFNVEAYTGETGDRRPEFEQALLNNRVKALVATSALGMGYDKPDLAFVIHYQMPGSVVAYYQQVGRAGRALESAYGILLSGREETDITDWFIKSAFPTRQEVDDVINALENEPSGLSVPELQGKVNISYGRIEKTIALLSLESPAPVAKQGSKWQLTAAKLGEGFWARADRLTALRRDEQRQMQEYLKLPFGEHMGFLVQALDGDPNEVSFPLLLPLPITVEEALVQEAVAFLRRTSLPIEPRLQWPAGGMPQYRVKGKIPVNLQAGPGKTLCVWGDAGWGGLVRQGKYHDNCFSDILVTACVEMIQQWNPEPAPTWVTCVPSLRHPNLVPDFAKRLADALGLPFQLLLVKTNNRPEQKTMANSTQQARNIDGSLAVKEQRVPDGPVLLVDDMVDSRWTLTVSAWLLRTYGSGEVWPLALAQTGYD

SEQ ID NO: 2916 - protein, 700 aa, Photorhabdus luminescens
MNRAQAQQLLQTALANPNAEFHDGQWEAIDALVNQRQKLLVVQRTGWGKSSVYFISTKIFRDRGMGPTIIVSPLLALMRNQIESAQRLRIIAETMNSTNTADWQTVTQRIINNQIDCLLISPERLANDNFIETVLHPIADRIALMVIDEAHCISDWGHDFRPDYRRIVNILRQLPPNTPVLGTTATANNRVVADIQTQLGNIQIQRGPLIRESLSLQTMVLPDQSSRLAWLAQVIPTLHGTGIVYTLTVRDAEQVANWLNVNGINARAYHSSIEADGFENSNDYRQYLEELLLTNQLKVLVATTALGMGYDKPDLSFVIHYQAPGSIVAYYQQVGRAGRGIDNAIGVLISGIEDQDIHKFFRNSAFPSETQVNEILQVLDNSDGLSLRSIEEQTNLRYGQIEKVLKLLSTENTAPVIKVGNLWRRIPVPYAMDRTRIAHLTNQRKQEWAEVQAYLSDTRCKMTFLRRVLDDHDPTPCGKCSSCIGQPVVNQAINPVLVHQAGTFLKHAEMIIQPRKQVATSNRAFPTYCFPRQLGCLVAQPGRVLSRWGDAGWGKTVIENKHSGYFSDELVDAMAEMISQRWQPNPSPTWVCCVPSLRHPNLVPAFACRLAQRLNLTFVDAVAKVQDNQPQKEQQNSFHQCHNLDGVFEITQIIQNQPVLLIDDIVDSGWTLTVIAALLQQAGSGIVYPAALASSSVKDS

SEQ ID NO: 2917 - protein, 693 aa, Polaromonas naphthalenivorans CJ2
MPFYVPERALELLRKGSGRADATFRDDQAQAIRHVVEGRGRLLVVQKTGWGKSFVYFIATKLLRDAGQGPVLLISPLLALMRNQIAAAKRMGLRAATINSDNLEDWTDVEAKLGSDEIDILLISPERLANERFRTQVLVGIAGRISMLVIDEAHCISDWGHDFRPHYRLLERIVRTLPPNLRLLATTATANNRVMDDLAAVLGPNLEVSRGDLNRTSLTLQTIRLPSQAERLAWLAEQLATLEGHGIIYTLTVHDANQVADWLKTRGFNVEAYTGETGDRREELEQALLSNQIKALVATTALGMGYDKPDLAFVIHYQMPGSVVAYYQQVGRAGRALESAYGILLSGEEESRIADWFIKTAFPTRQEVADVLDALEREHNGLSVPELLSRVNLSKGRIEKTLALLSLESPAPIAKQDSKWQLTAAILSEGFWARAERLTALRRGEHRQMQAYVSLPFGEHMGFLIRALDGDSSVVNPPALTPLSTHVNDDLVRDAVAFLRRTSLPIQPRLQWPAGGMPLSHMKGKIPENLRAQPGKALCTWNDAGWGQLVKQGKYRDSHFADSLAAACVKMIHEWSPQPTPTWVTCVPSLRHPDLVPNFAQRLAAALNLPFHRLLQKTDNRPEQKTMENSAQQARNIDGSLALNGQAVPDGPVLLIDDMVDSRWTFTVAAWLLRKGGSGEVWPLALSQTGSDQ

SEQ ID NO: 2918 - protein, 699 aa, Providencia stuartii ATCC 25827
MNRAEALQLLRTALASPTAEFRDGQWEAIDTLVNHRQKLLVVQRTGWGKSSVYFISTKIFRDRGMGPTIIVSPLLALMRNQIESAERLGIVAETMNSTNQDDWQSVTQRIHNNQIDCLLISPERLANDSFIETVLQPIADRIALMVIDETHCISDWGHDFRPDYRRIVNILRQLPANTPVLGTTATANNRVVDDIQALLGHIRIQRGSLIRESLALQTMVLPDQSSRLAWLAQVIPNLPGTGIVYTLTVRDAEQVAEWLNRNGIDAKAYHSSVESDDFENSNVYRQHLEELLFNNQLKVLVATTALGMGYDKPDLSFVIHYQAPGSIVAYYQQVGRAGRGIDHAVGVLMSGVEDRDIHEFFWGSAFPSEMQVNEVLQALEQGDGLSIRNIEEKTNLRYGQIEKVLKLLSVENPAPVIKNGSRWVRTPVHYQMDHARIEHLTGQRVQEWQEVQAYLKDSGCKMTFLRKALDDHDPTPCGKCASCIARPVVNQAIDPALVHRAGTFLKHAEMAIKPKAQVAANAFLEYGFKGSLPQNLRAQEGRVLSRWGDAGWGRLVANNKYAGYFSDELVEAMAEMIQNRWKPTPAPQWVCCVPSRNHPELVPSFARRLASRLGLPFVNSVSKIKDNQPQKSQQNRFHQCQNLDGAFAITELLCGQPVLLVDDIVDSGWTLTVIAALLQQAGSGMVYPVALASSSVKDS

SEQ ID NO: 2919 - protein, 735 aa, Pseudomonas aeruginosa 39016
MLVVFLSWADFRYFGHRWVTVSGSLHSSKQLSLWPKMAREGSKVAYDPRRALELLQIGSGSADANFRDGQEDAIRHIVEGKGRLLVVQKTGWGKSFVYFIATKLLREEGSGPALLISPLLALMRNQIAAADRMGVRAATINSDNMDEWTAVEGKLAKGEVDILLISPERLANERFRTQVLAGIAAQISLLVIDEAHCISDWGHDFRPHYRLLERIVKTLPPNLRLLATTATANNRVMEDLAAVLGPKLDVSRGDLNRTSLSLQTIRMPSQAERLAWLAEQLSTLQGHGIIYTLTVRDANQVAEWLKTQGFNVEAYTGETGDRREQLEQALLNNQVKALVATTALGMGYDKPDLAFVIHYQMPGSVVAYYQQVGRAGRALDSAYGVLLSGEEEFDITDWFIRSAFPTRKEVADVLGALEEEPNGLSVPELLSRVNLSKGRVEKTIALLSLEAPAPIAKQGSKWQLTAAMLSEAFWSRAERLTALRRDEHQQMQDYVSLPFGEHMGFLIGALDGDPSAVTEPALPPLPISVDAELVKAAVAFLRRTSLPIEPRKKWPDGGMPQYSIKGFIAPEHQAESGKALCVWGDAGWGGLVRQGKYHDGHFSDDLVAACVKMIKEWDPQPAPTWLTSVPSLRHPDLVPNFAQRLAAALGLPFHMVISKTDARPEQKTMANSTQQARNIDGSLALNGQPIPPGPVLLVDDMVDSRWTLTVSAWLLRKSGSGAVWPMALSQTGHDE

SEQ ID NO: 2920 - protein, 698 aa, Pseudomonas syringae pv B728a
MQRNDAEKLLKVAINNGAATFRDGQWEAIDALVNHRKKLLVVQRTGWGKSSVYFISTRILRDRGQGPTIIISPLLALMRNQVDAAQRLGINAVTINSTNTDEWEKARQDVHANRVDCLLISPERLANDGFMETFLQPIADRIGLMVIDEAHCISDWGHDFRPDYRRIVNILRFLPPNTPVLGTTATANTRVVNDIQAQFGDINIVRGPLARESLALQNLIMPDQASRLAWLAQTIPTLPGTGIVYALTQRDSEQVARWLRANGIDAASYHSDVAHSDFGNSDQYRQHLEDELLANKLKVLVATTALGMGYDKPDLGFVIHYQAPSSLVAYYQQVGRAGRAIDYSLGLLMSGEEDEKIHAFFRRAAFPPAGQVNHLLSVLAKSNGLTIRELEEHSNLSHGQIEKILKLLSVESPAPLIKHQSKWLRTPIHYELDQNRVSRLTELREHEWQQVLAYLNEPRCLMAFLRHALDDAENDACGKCVRCLERELVSSKVDGRLVHQAATFIRHAELPIKPKKQIAKGGFEYYGFPTNLPLNIQAAEGRVLSQWRDGSWGELAANGKELGHFDDALVSAMAEMIQSRWQPNPKPTWLCCVPSLGHPMLVPDFAQRLANALGIPFVNCVTKVRQNEPQKWQNNRFHQCRNLDGVFAVSAHIPPGPVLLVDDMIDSGWTMTVIAALLKQAGSEHVYPLAISSTASNA

SEQ ID NO: 2921 - protein, 708 aa, Roseiflexus castenholzii DSM 13941
MHALNEVLTLSTSMPLRHYAEHLLKQALRNPSATFRDGQWEAIADLVERRARLLVVQRTGWGKSLVYFLATRLLRERGSGPTLLISPLLALMRNQLLIAERVGVRAATINSSNKNEWTNVLSHLHAGGIDMLLVAPERLANDEFRSEALRPIADTISLFVVDEAHCISDWGHDFRPDYRRIARVLQMLPPTIPVLATTATANNRVVADIQVQLGVNLRIVRGPLARNTLRLQNIALDSQAERLAWLAAHIPDLPGSGVVYTLTVRDAQRVASWLQSCGIDAHAYWGDLDSQTREDLEQRLLESRIKVLVATTALGMGFDKPDLGFVVHFQRPGSVIHYYQQVGRAGRAIDQAYGILLSGKEDQDITEYFITTAFPPRDHIEMVLHTLESADEGLTMAQIESRVNLSRSQIEKTLKILSVETPSPVTKIDNRWFATPVNYTIDLQRIEDLTTLRRAEQERMREYVHASECLMVFLKRELDDPDLQPCGQCAVCIGQPLVSPTYPEALERRAVTFLQRHHQRIEPRRMWPGDALQVYGWRGKISPSLMAEEGRALCIWGDAGWGELVKRGKQIDGRFDNALIDALVELVRQRWLPEPAPGWVTCVPSLTHPTLVADMAQRLAQRLGLPFVAAVRKVRPTEPQKRMQNGFQQAHNIAGAFVVDRWSGIDGPVLLVDDMVDSGWTFTVVAALLREAGSGPVFPLALALVQGH

SEQ ID NO: 2922 - protein, 699 aa, Shewanella baltica OS155
MNRDQAKLHLQTALANTDADFRDGQWEAIDALVNHRQKLLVVQRTGWGKSSVYFISTKIFRDRGMGPTIIVSPLLALMRNQIESAARLGIVAETMNSTNTADWQAVTQRILNNQIDCLLISPERLANDNFIETVLQPIADRIALMVIDEAHCISDWGHDFRPDYRRIVNILRQLPANTPVLGTTATANNRVVADIQTQVGDIQIHRGPLTRESLALQTMVLPDQASRLAWLVQVIPTLPGTGIVYTLTVPDAEQVANWLTNNGIDAKAYHGSVEAEGFENSNTYRQHLEELLLNNRLKVLVATTALGMGYDKPDLSFVIHYQAPGSIVGYYQQVGRAGRGIDHAVGVLMSGVEDQDIHEFFRESAFPSEAQVNEILHVLEQSDGLSLRSIEEQTNLRHGQIEKVLKLLSVENPAPVIKDGSRWFRTPVRYQMDHARIAHLTGQRVQEWQEVQAYLADTDCKMTFLRRALDDFDPTPCGKCASCVGRLVINIPVDPSLAHRAGTFLKHAEMVISPKAQVAANAFLEYGFRGNLPLNLRAQEGRVLSRWGDAGWGHMVADNKHAGRFIDELVEAMVEMVQQRWQPNPAPQWICCVPSRNHPELVPDFARRLAIRLGLPFVDAVSKVKDNQQQKGQQNRFHQCRNLDGAFAVNQDIPTTPVLLVDDIVDSGWTLTVISALLQQAGSGVVYPVALASSSVKDS

SEQ ID NO: 2923 - protein, 129 aa, Shigella dysenteriae 1617
MEACAEMVRQRWNPHPEPTWVCCVPSLKHLDLVPDFARRLAAKLGLPFIDAIEKVVDNPPQKMQQNCFHQCQNLDGAFVITPPLMPGPALLVDDIVDSAWTLTVLTALLRQAGCPTVYPLALASTSVKN

SEQ ID NO: 2924 - protein, 162 aa, Shigella dysenteriae
MNVNAGHERTSKARIIHQIQLIRGITKLLVAENPSPVVYTEKLWRRTIVSFSPDHERINHLMNQRKSELADVESYITTKECKMQFLRRALDEPGAEHCGKCSSCLQHPLLSPDIDSGLLHAANLFIKHADLPLNLNKQVAAGAFTQYGFKGNLPASLQGSTG

SEQ ID NO: 2925 - protein, 699 aa, Teredinibacter turnerae T7901
MNRAQAQRLLQTALANPAAEFRDGQWEAIDALVNHRQKLLVVQRTGWGKSSVYFISTKIFRDRSMGPTIIVSPLLALMRNQIESAQRLGIVAETMNSTNQNDWQAVTQRILNNQIDCLLISPERLANDTFIETVMQPIADRIALMVIDEAHCISDWGHDFRPDYRRIVNILRQLPANTPVLGTTATANNRVVADIQTQLGNIQIHRGPLTRESLGLQTMVLPDQASRLAWLAQVIPTLPGTGIVYTSTVDSAEQVAQWLSGNGIDAKAYHGSVEADGFENSNSYRQHLEELLLINQLKVLVATTALGMGYDKPDLSFVIHYQAPGSIVAYYQQVGRAGRGIAHAVGVLMSGVEDQDIHEFFRDSAFPSEAQVNEILQVLEQSDGLSIRSIEEQTNLRHGQIEKVLKLLSVENPAPVIKDGSRWVRTPVRYQMDHARISHLTGQRVQEWQEVQAYLDDAGCKMTFLRRALDDLDPTPCGKCSSCLGQPLLNAAIDPALAHRAVTFLKHAEMVITPKAQVAANAFLEYGFRGNLPQQLRAQEGRVLSRWGDAGWGRTVADNKHAGRFGDELVEAMAEMIRERWQPDPDPQWVCCVPSLNHPELVPEFARRLAARLGLPFMGAVSKVKDNQPQKGQQNRFHQCRNLDGAFAVTQLYQGQPVLLVDDIVDSGWTLTVIAALLQQAGSGVVFPVALASSSVKDS

SEQ ID NO: 2926 - protein, 693 aa, Trichodesmium erythraeum IMS101
MIQKEALSLLRRALNNSTAEFRDGQWEAIAAITEHQSRLLVVQRTGWGKSFVYFLATRLLRDKGKGITLLISPLLALMRNQIAAAERIGIRAQTINSSNKEEWEKVENNLMVGKVDILLISPERLANENFRENILIYIAKNIGLFVVDEAHCISDWGHDFRPNYRRIARILQALPKNIPVLATTATANNRVVDDITVQLGANLKIFRGLLTRDSLQLQNIYLPSYCDRLGWLAEHLPNIPGSGIIYTLTVRDTEIVANWLKSQGINVAAYHSKKNTEEKEELEQQLLNNEIKALIATVALGMGFDKPDLGFVIHYQRPGSVVHYYQQVGRAGRAVENAYGILLSGEEDKEITNYFIKTAFPPEAHNQAILDALNQAEDGLSVPMLEEKLNLTNGQINKVLKLLSIETPSPIKKIQSKYYATPINYQTDTEKIARLNEIRHQEQDRMLDYMHSQECLMQFLRKELDDPNPSPCGKCAICLGKPLLPGNVSSKFVTEAVQFLRTREQIIETRKVWRKNALLTYNLTGKISKDLQAEIGRSLSIWNDAGWGQFVEKGKYKDNHFEDSLVQATYDMIQRWQPQPFPTWVTCIPSLTHPELVPNFAQRLAKKLGLPFVPCIIKIRQTSLQKDMTNSYQQAHNLDGAFKVYNWEGIRGNVFLVDDIVDSRWTFTVVAALLRNAGSGKVFPLALAINRFK

SEQ ID NO: 2927 - protein, 699 aa, Vibrio furnissii CIP 102972
MNRVQAQQLLQTALANPTAEFRDGQWEAIDALVNHRQKLLVVQRTGWGKSSVYFISTKIFRDRGMGPTIIVSPLLALMRNQIESAQRLGIVAETMNSTNTADWEAVKQRILNNQIDCLLISPERLANDNFIETVLQPISDRISLMVIDEAHCISDWGHDFRPDYRRIVNILRQLPPNTPVLGTTATANNRVVEDIQIQLGDIQIQRGPLSRDSLALQTMVLPDQASRLAWLAQVIPTLEGTGIVYTLTVRDAEQVAQWLKDNGINACAYHGSVEAEGFENSNDYREHLENMLLQNDIKALVATTALGMGYDKPDLSFVIHYQAPGSIVAYYQQVGRAGRGIEHAIGVLMSGAEDADIHEFFRSSAFPSEPQVNEILAVLAASDGLSIPRIEERTNLRHGQIEKVLKLLSVESPAPVIKVESQWRRTAVHFTMDRERIEHLTSQREQEWQEVQAYLGAAGCKMTYLRRALDDNDPTPCGKCASCLGKAVINLPVNPALAHQAATFLKHAEMVIKPRAQVAANAFLEYGFRGNLPQNLRANEGRVLSRWGDAGWGRLVADQKHAGEFSDELVEAMATMILERWHPNPMPQWVCCVPSRNHPELVPQFARKLALRLELPFIDAVSKVKNNQPQKGQQNRFHQCRNLDGAFAITQPVPNTSMLLVDDIVDSGWTLTVIAALLKQAGSGDVYPVALASSSVNDA

SEQ ID NO: 2928 - protein, 698 aa, Escherichia coli E22 (EPEC); identical to SEQ ID NO: 2891

SEQ ID NO: 2929 - protein, 698 aa, Escherichia coli M605
MEKHGAELLLQRMLSNTSATFREGQWEAIDAVVNQRRKLLVVQRTGWGKSAVYFIASKIFRDRGAGPTIIISPLLALMRNQVAAAERLGITAETLNSTNREEWQRISDKLLQGGVDCLLISPERLANQDFLETVLYPVADRIGLLVVDEAHCISDWGHDFRPDYRRILDILRQLPANTPILGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRAIDSAVGILLCGGEDRAIHQFFRESAFPAEAQIHEILNVLSENDGLTLRGIEQRTNLRYGQIEKALKLLVAENPSPVVYTEKLWRRTIVSFSPDHERINHLMNQRKSELADVESYITTKECKMQFLRRALDEPSAERCGKCSSCLQHPLLSPDIDSDLLHAANLFIKHADLPLNLNKQVASGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2930 - protein, 698 aa, Escherichia coli M718
MEKHAAELLLQRMLGNTTATFREGQWEAIDAVVNQRRKLLVVQRTGWGKSAVYFIASKIFRDRGAGPTIIISPLLALMRNQVAAAERLGITAETLNSTNREEWQRISDKLLQGEVDCLLVSPERLANQDFIETVLYPIADRIGLLVVDEAHCISDWGHDFRPDYRRILDILRQLPANTPVLGTTATANNRVVEDIRQQLGDIVIQRGTLARESLALDALVLGEQSSRLAWLATVIPQFSKSGIVYTLTTRDAELVAEWLRKNGISAFAYYSGVTCEGAEDSNTAREYLEQALLANKIKVLVATTALGMGFDKPDLGFVIHYQMPGSIVGYYQQVGRAGRGIDSAVGILLCGSEDRAIHKFFRESAFPAEAQIHEILNVLSVNDGLTLRGIEQRTNLRYGQIEKALKLLVAENPSPVVYTEKLWRRTIVSFSPDHERINHLMNQRKSELADVESYITTKECKMQFLRRALDEPGAERCGKCSSCLQRPLLSPDIDSGLLHAANLFIKHADLPLNLNKQVAAGAFTQYGFKGNLPAGLQGSTGRILSRWGDSGWGKQVAQEKKTGRFSDELVEACAEMVRQRWNPHPEPTWVCCVPSLRHLDLVPDFARRLAAKLGLPFIDAIEKVVDNPPQKMQQNRFHQCQNLDGAFVITPPLMPGPALLVDDIVDSAWTLTVLTALLRQAGCPTVYPLALASTSVKN

SEQ ID NO: 2931 - protein, 698 aa, Escherichia coli O111:NM B171 (EPEC2); identical to SEQ ID NO: 2891

SEQ ID NO: 2932 - protein, 699 aa, Escherichia coli O139:H28 F11 (ETEC); identical to SEQ ID NO: 2887

SEQ ID NO: 2933 - protein, 45 aa, Escherichia coli O157:H7 EC4042; identical to SEQ ID NO: 2893

SEQ ID NO: 2934 - protein, 45 aa, Escherichia coli O157:H7 EC4045; identical to SEQ ID NO: 2893

SEQ ID NO: 2935 - protein, 45 aa, Escherichia coli O157:H7 EC4206; identical to SEQ ID NO: 2893

SEQ ID NO: 2936 - protein, 212 aa, Acidovorax avenae citrulli AAC00-1
MAVPDRPKLYHICHVDRLPSIIASGGLLSDAAVVQVAAPGTVIGMNHIKQRRMTELQLTSHPGLYVGQCVPFYFCPRSVMLYLIHRQNADLAYKGGQGPIVHLEADLHTTVAWANGQGLRWAFTLSNAGARYFEDRADLGRLGEVDWDAVAARNWSAQKEGKQAEFLLERGFPWQLIERIGVLSQPIATQVAHALPVGGHRPPVQLMPAWYY

SEQ ID NO: 2937 - protein, 183 aa, Actinosynnema mirum DSM 43827
AGESAPQRTGPANWLVWHFTHVDNLTSIAAAGQVVADHVPFYIAAKSPMLYAVPKGRADHPGGDRDTVFQGLAVGAIAASGATWCVSDVNASIRTVWFTRDLTALGEHVDFDLLCQRAWNSTEQDNHRPNRRAAEVLVLDEVPLENLAFVATKEEKTPARARSALGTAGTALQHHVVPHLYHS

SEQ ID NO: 2938 - protein, 71 aa, Aliivibrio salmonicida LFI1238
MNQRDYGDDEGRSVCMAECLSPNPVPATNITQIYVATQENKESVESILRDYQLSPHVNLNAAMFPKRGSRD

SEQ ID NO: 2939 - protein, 96 aa, Alkalilimnicola ehrlichei MLHE-1
MANDWSHGLNPEKALIFRIMHRDNLPWVLEHGLYCCSAPEKTERYQAEALIHHHLPVSALLGIGAYTDRVRADIESQALAVGLQLKVVTRPNWFFS

SEQ ID NO: 2940 - protein, 208 aa, Arthrospira maxima CS-328
MTTYIYHITHLKNLPSILRSEGLLANNHLKSQPINYVDIAHETIQNKRAQINIPCSRGGTLHDYVPWYFAPRSPMLYAISRGNVQGYEQGQSPVIHLVATAEDIAAASLPFAFTDGHAIVRYSEFYDNLDSLNAIDWEIMNAGYWADTLEDGDRKRRRQAEFLVYEFFPWTLVREIGVIDAGRKAEVEEILQNFTISTPVKVFREWYY

SEQ ID NO: 2941 - protein, 208 aa, Arthrospira maxima CS-328
MTTYIYHITHLKNLPSILRSEGLLANNHLKSQPINYVDIAHETIQNKRAQINIPCSRGGTLHDYVPWYFAPRSPMLYAISRGNVQGYEQGQSPVIHLVATAEDIAAASLPFAFTDGHAIVRYSEFYDNLDSLNAIDWEIMNAGYWADTLEDGDRKRRRQAEFLVYEFFPWTLVREIRVIDAGRKAEVEEILQNFTISTPVKVFREWYY

SEQ ID NO: 2942 - protein, 117 aa, Arthrospira platensis NIES-39
MRSGGILANKRLKFQRINYVDIAHETIQNKRAQINIPCSRGGTLHDYVPWYFAPRSPMLYAISRGNVQGYEEGQSPVVHLVATAEDIAAAGLPLKSVKMNGLITTRTREFLSGNDSV

SEQ ID NO: 2943 - protein, 117 aa, Arthrospira platensis Paraca; identical to SEQ ID NO: 2942

SEQ ID NO: 2944 - protein, 212 aa, Aurantimonas manganoxydans SI85-9A1
MADLTAERALIFRIVHRDNVEWILDNGLHCKKAHVSDPNYVAIGNLELIDRRTNHPVPCHPNGTLGDYVPFYFTPFSPMMLNIKTGYGGIRKRANEEIVVLVSSLHKLNEAGLPIVFTDRHAYLQAARFYTDMQRLNEIDWAILRAKDFKRNAEDPGKFERYQAEALVHRSLPCAGLLGIACYNEAVMASVKRQTERRGLNMRVIAQRKYYF

SEQ ID NO: 2945 - protein, 210 aa, Bacillus thuringiensis IBL200
MHSNTFIYHMTHYRNLSKILSSNGLVCVSNIMNNGQTYCNIANNDIQSRRASYSVPVEPFGTLHKYVPFYFAPKSPMLYSIYKGNVIQYNEGQEPLIYFVSSAQKIKQNGVPFCFTDGHGIMHFTEYYNDLTELHNIDWDIMKSKYWHDTIEDNDRKRRRMAEFLVYQYVPLDCIIGIAVYSQKYKEETEKILTEHNVSLPVKLKPNWYY

SEQ ID NO: 2946 - protein, 213 aa, Beggiatoa sp. PS
MTVPAQPKIYHIVHIDRLASIIAAGELWCDAQIVAQNPGGTTIGMTSIKQRRLYELSLNSHPNLHVGDCVPFYFCPRSIMLYLIYQANHPKLAYYGGQEPIVHLQADLHASVAWAHKQKRCWAFTLSNAGSYYFEDRCDLAQLNELDWAAIQSNQWQHCKEGKQAEFLMEASFPWNLIERIGVFSQPIYQQTMNILQTGVYRPPITISREWYY

SEQ ID NO: 2947 - protein, 206 aa, Brachyspira hyodysenteriae WA1
MSAKTGKLIYHLTAINNFESIIRNGLCPRNKIKPNIDVADNEILNGRNKYNLLDYVPFHFFINTPFDGAVKKKYKTTDFIYICLEREIAKMNEFKIIPCHPLSNRLINYENILFDYDKGFDLIEWDKIDSDNRNYVDQDIKNACMAECLYKGVISCRIFSSISVKDVESFKKIDKILLKFGFISDKNKYTYHGEYSFFVDINPSWF

SEQ ID NO: 2948 - protein, 213 aa, Candidatus Accumulibacter phosphatis clade IIA UW 1
MTLPARPKLYHIAHVDRLPSIVTDACLWCDSEVSRRGPAGTMIGISSIKQRRLSELTLSSHPGLHVGDCVPFYFCARSVMLYLIHQANHPELAYRGGQSPIIHFEADLGAVVDWADRQGRRWAFTLSNAGSRFFEDRCDLAQLGEIDWNAVQARDWRQCKEGKQAEFLLEHSLPWHLVERIGVQSRPIFQQVSNALPASGYRPAVDIVSDWYY

SEQ ID NO: 2949 - protein, 210 aa, Cyanothece sp. PCC 7822
MPPSIYHITHLNNLASILRAGGLIANSRLRQQQINYTDIAHEQIQDRRARKRLPCGAGGTLHDYVPFYFAPRSPMLYAIHTGNVRGYQDGQDSIIHLVTDIEAPFFEEENAFVFTDGHAIMDYSDFYDDLNALDFVIDWELMKSKYWFDTEDYPDRKWRRQAEFLVYERCPWDLITEIGVINSTIQLRVQNILKNFSDLTPVRVYPNWYY

SEQ ID NO: 2950 - protein, 211 aa, Dermacoccus sp. Ellin185
MWPGIVHFTRVEHLGTIVQQGLLSDHAVGSALQHEIGNRNIKAQRTRRVVPIPPGGVVADYVPFYFAARSPMMYSIAMGNVPGYAEGTARIVYLVSDVGRVLTDGMRVVISDRNAALHVAAFRPPTVELFAGDFIDWDLMRARYWGQYDDGSTRADGRERRMAECLVHQKVSWGCITHVVAKSEAVAREARLLLGDRLPPGGVVVRPEWYF

SEQ ID NO: 2951 - protein, 128 aa, Desulfovibrio sp. 3 1 syn3
MYTQFKNDIIKNDETIYLVANAHDLIPKYKWCCSNMNAAKNDTSFFETVEDLEKELSWEIFSTQYWNNTDAYPDRMERRMAEFLVYERVAWDDFLGVAVYNEAAKVKVYDMMCESQRKDVIVKNDWYF

SEQ ID NO: 2952 - protein, 215 aa, Dickeya zeae Ech1591
MPIPERPKIYHILHIDRLHSIIAEGLLSDEQISVRHGAGTMIGMSSIKQRRLHELTLTNHPNLYVGQCVPFYFCPRSVMLYLIYRANHPELAYRGGQEPILHLEADLYTTIAWAEQHRQRWAFTLSNAGSLYFEDRCQQSQLGELNWEAIQSNQWSGGNGTKEAKQAEFLIERCFPWHLIERIGVHSPLIYQQVANMIPLDGHRPPVEVKREWYY

SEQ ID NO: 2953 - protein, 218 aa, Edwardsiella ictaluri 93 146
MAYDYSANLNPEKALIWRIVHRDNIPWILDHGLHCGNSPVQAANWINIGNPELIGKRAGHPVPVGMGGTLHDYVPFYFTPFSPMLMNIHSGRGGITQRPNEEIVILVSNLRNVAAQNIPFVFTDSHAYYNWVNYYTRLDDLNQIDWSILQARDFRRDPDDPAKFERYQAEALIWKHCPITLLVGMICYNDGVRLQLEQWLSQRNLTMPVHARAGWYFS

SEQ ID NO: 2954 - protein, 218 aa, Edwardsiella tarda EIB202
MAYDYSANLNPEKALIWRIVHRDNIPWILDHGLHCGNSPVQAANWINIGNPELIGKRAGHPVPVGMGGTLHDYVPFYFTPFSPMLMNIHSGRGGITQRPNEEIVILVSNLRNVAAQNIPFVFTDSHAYYNWVNYYTRLDDLNQIDWSILQARDFRRDPDDPAKFERYQAEALIWQHCPITLLVGMICYNDGVRLQLEQWLSQRNLTMPVHARAGWYFS

SEQ ID NO: 2955 - protein, 218 aa, Edwardsiella tarda FL6-60
MAYDYSASLNPQKALIWRIVHRDNIPWILDNGLHCGNSQVQAVNWINIGNPELIGKRAGHPVPVGTGGTLHDYVPFYFTPFSPMLMNIHSGRGGITQRPNEEIVILVSSLRSVAAQNAPFVFTDSHAYYNWANYYTRLEDLNQIDWSILQARDFRRDPDDPAKFERYQAEALIWQHCPITLLVGMICYNDGVRLQLEQWLSQRNLTMPVHARAGWYFS

SEQ ID NO: 2956 - protein, 216 aa, Enhydrobacter aerosaccus SK60
MVYDYSNTLNPHKGLIWRIVHIANLPWIFANGLHSGNSPIQSPNWQHIGNPELIQKRANHPVPVGRQGYLNDYVPFYFTPFSPMLLNIKSGRGVMQRPMQDIVILVSSIDTVESQHLDYVFTNSHAYYQWTNFFTDRKDLDKIDWALLQRRDFSRDPNDLAKFERYQAEFLIYQHCPISAIIGICCYNDNVKQSIQQLINMSGITLDVHSRPNWYL

SEQ ID NO: 2957 - protein, 218 aa, Escherichia coli 0127 H6 E2348 69
MAYDYSASLNPQKALIWRIVHRDNIPWILDNGLHCGNSLVQAENWINIGNPELIGKRAGHPVPVGTGGTLHDYVPFYFTPFSPMLMNIHSGRGGIKRRPNEEIVILVSNLRNVAAHDVPFVFTDSHAYYNWTNYYTSLNSLDQIDWPILQARDFRRDPDDPAKFERYQAEALIWQHCPISLLDGIICYSEEVRLQLEQWLFQRNLTMSVHTRSGWYFS

SEQ ID NO: 2958 - protein, 218 aa, Escherichia sp. 4 1 40B
MAYDYSASLNPQKALIWRIVHRDNIPWILDNGLHCGNSLVQAENWINIGNPELIGKRAGHPVPVGTGGTLHDYVPFYFTPFSPMLMNIHSGRGGIKRRPNEEIVILVSNLRNVAAHDVPFVFTDSHAYYNWTNYYTSLNSLDQIDWPILQARDFRRDPDDPAKFERYQAEALIWQHCPISLLDGIICYSEEVRLQLEQWLFQRNLTMSVHTRAGWYFS

SEQ ID NO: 2959 - protein, 202 aa, Eubacterium saburreum DSM 3986
MKASERFTEITGQTGIYNIQAIDNIPSIIRRGLLSNERAVSIKHKSIAMDEVQARRDNIIIPNGLKLHQYANLYFDPRNPMLFKRKSQNEEICILKFDRVILDFNGVVLSDRNASSSYAAFYEAKYGLENIDFKLVYARYWTDDNYFEQCRRKSIKCAEVLVPYGISYDYVVFAAVVNDAAADRLRLNGFDKNIFIEPKIFF

SEQ ID NO: 2960 - protein, 213 aa, Geobacter lovleyi SZ
MAIPDRPKIYHIVHVDRLTSIIASNGLLCDAEIVRSKPPGTTIGMGTIKQRRLNELFLSSHFGLNVGDCVPFYFCPRSVMLYLIWRANDPELTYRGGQAPIVHLEADLHQTVAWAESQNLRWAFTLSNAGAYYFEDRSNLDRLGDIDWQAVEATNWQKCKEGKQAEFLIEQRFPWELVTRIGVMTTQTHAQASAAIAASTHKPRVELMQNWYY

SEQ ID NO: 2961 - protein, 194 aa, Gloeobacter violaceus
MIDCGCIWSDVQMIARGLANLNIGISDIKERRRKLQVHCNPGTKVGEYVPFYFCPRSIMLYILHCKNHKDLKYTGGQQPILHLESKLKVVVQWAEANQKPWAFSTRNAGTHYADFYNDLRDLYRINWSAVSATDFRDATIKEGKQAEFLLFESFPLTFVDRVGVFDSQVEQQIESLFEGTKYNPVVVVQRNWYY

SEQ ID NO: 2962 - protein, 226 aa, Gluconacetobacter diazotrophicus PAl 5, DSM 5601
MTYYKNLKAFLANGAEFAKDSPDGRPRYRISFEEIVARRGTVFRVPSGYSVNEFVPFYFSPSTKMAYSIHTKNVPLRTPDDQNLGPASMDDVAYMVVDPEVLFRSGRECWFTDQACNSAITPAYESDPGNLSQHVAWPLFDEYPRMATIPQLGYGGVCQYQHDRDALGYQQRSKQRMAEFLVKDHLRMDELSAIVLKTDVHRAQVEAWIRRAGFSIPVFVNPGCYF

SEQ ID NO: 2963 - protein, 218 aa, Klebsiella pneumoniae 342
MAYDYSANLNPEKALIWRIVHRDNIPWILDNGLHCGNSPVQAANWINIGNPELIDKRAGHPVPAGTGGTLHDYVPFYFTPFSPMLMNIHSGRGGIKQRPNEEIVILVSSLRHVATQNVPFVFTDSHAYYNLANYYTDLNNLHRIDWPILQARDFRRDQDDLAKFERYQAEALIWQHCPITLLVGMICYNDGVRLQLEQWLSQRNLTMPVHARAGWYFS

SEQ ID NO: 2964 - protein, 200 aa, Leptotrichia goodfellowii F0264
MWIHHLTHIDNLESILERGLISRNQLKQFNIKFNDTADKRIIGERNDLNNYIPFHINYLQKKYSIPYNWKVLKNQSSENMIFLNYNIDDFSNNELDFYLYHPISKSQNNAIKINDLMGFKEKLLKEEKKLQNDMGYLDFSDNKTQQFLMSEVLIKDRIYLSEKWKIGVFSFAQKQIVEKKLEKNNLKIEVFIDDKRYFYR

SEQ ID NO: 2965 - protein, 209 aa, Lyngbya sp. CCY 8106
MSTPIYHITHIDNLVSIISSGGLIACSQLRQQQVRYTDIAHQNIQDRRANKPVPCSVGGLLHDYVPFYFGPRSPMLYAIYRRNVQGYQGSQSSIIHLVTEIETIANSDLDFAFTDGHAIMDYSDFYDDLWQLGEVIDWGLMEERYWSDTEEDRNRKWRRQAEFLVHRFYPWRFITAIGVINDSIKTKVQSILQKKQHQPLVRVCSNWYY

SEQ ID NO: 2966 - protein, 213 aa, Marinobacter sp. ELB17
MTVPAQPKVYHIVHVDRLASIIADQVLWSDAQVIARAPAGTTIGMSGIKQRRLNELTLTSHPDLYVGACVPFYFCPRSIMLYLIYQGNHPDLGYKGGQGPIIHLEADLNDSVAWAEANQQRWAFTLSNAGSCYFEDRSDLFRLNEINWTAVGARNWMSCKDGKQAEFLLENCYPWHLVERVGVCSQAIYTQVANILAGVPHRPDLQIKPDWYY

SEQ ID NO: 2967 - protein, 194 aa, Micromonospora aurantiaca ATCC 27029
MERGRVQELHFITPISNLESVLRHGILSHNAARRLPHLSVADEDVQSRRRQKRVPGGMQLHDYANLYFDARNPMMYRIKGNGTPLAVVCVNPSILDLPGVVITDGNAASDGTRFAASPGGIAILDEGLVYAHSWTSSDRWDYIERKRARCAEVLVPNCVDPSYIDKAKVIRQSHVISCHAAGLRGEVFANVFFA

SEQ ID NO: 2968 - protein, 230 aa, Mycobacterium bovis
MITRYKPESGFVARSGGPDRKRPHDWIVWHFTHADNLPGIITAGRLLADSAVTPTTEVAYNPVKELRRHKVVAPDSRYPASMASDHVPFYIAARSPMLYVVCKGHSGYSGGAGPLVHLGVALGDIIDADLTWCASDGNAAASYTKFSRQVDTLGTFVDFDLLCQRQWHNTDDDPNRQSRRAAEILVYGHVPFELVSYVCCYNTETMTRVRTLLDPVGGVRKYVIKPGMYY

SEQ ID NO: 2969 - protein, 230 aa, Mycobacterium bovis BCG Pasteur 1173P2; identical to SEQ ID NO: 2968

SEQ ID NO: 2970 - protein, 230 aa, Mycobacterium bovis BCG Tokyo 172; identical to SEQ ID NO: 2968

SEQ ID NO: 2971 - protein, 230 aa, Mycobacterium tuberculosis 210; identical to SEQ ID NO: 2968

SEQ ID NO: 2972 - protein, 122 aa, Mycobacterium tuberculosis 98-R604 INH-RIF-EM
SGGAGPLVHLGVALGDIIDADLTWCASDGNAAASYTKFSRQVDTLGTFVDFDLLCQRQWHNTDDDPNRQSRRAAEILVYGHVLFELVSYVCCYNTETMTRVRTLLDPVGGVRKYVIKPGMYY

SEQ ID NO: 2973 - protein, 230 aa, Mycobacterium tuberculosis CDC1551; identical to SEQ ID NO: 2968

SEQ ID NO: 2974 - protein, 230 aa, Mycobacterium tuberculosis F11
MITRYKPESGFVARSGGPDRKRPHDWIVWHFTHADNLPGIITAGRLLADSAVTPTTEVAYNPVKELRRHKVVAPDSRYPASMASDHVPFYIAARSPMLYVVCKGHSGYSGGAGPLVHLGVALGDIIDADLTWCASDGNAAASYTKFSRQVDTLGTFVDFDLLCQRQWHNTDDDPNRQSRRAAEILVYGHVLFELVSYVCCYNTETMTRVRTLLDPVGGVRKYVIKPGMYY

SEQ ID NO: 2975 - protein, 230 aa, Mycobacterium tuberculosis H37Ra; identical to SEQ ID NO: 2968

SEQ ID NO: 2976 - protein, 230 aa, Mycobacterium tuberculosis H37Rv; identical to SEQ ID NO: 2968

SEQ ID NO: 2977 - protein, 230 aa, Mycobacterium tuberculosis KZN 1435; identical to SEQ ID NO: 2974

SEQ ID NO: 2978 - protein, 230 aa, Mycobacterium tuberculosis KZN 4207; identical to SEQ ID NO: 2974

SEQ ID NO: 2979 - protein, 230 aa, Mycobacterium tuberculosis KZN R506; identical to SEQ ID NO: 2974

SEQ ID NO: 2980 - protein, 230 aa, Mycobacterium tuberculosis KZN V2475; identical to SEQ ID NO: 2974

SEQ ID NO: 2981 - protein, 230 aa, Mycobacterium tuberculosis SUMu001; identical to SEQ ID NO: 2968

SEQ ID NO: 2982 - protein, 230 aa, Mycobacterium tuberculosis SUMu002; identical to SEQ ID NO: 2968

SEQ ID NO: 2983 - protein, 230 aa, Mycobacterium tuberculosis SUMu003; identical to SEQ ID NO: 2968

SEQ ID NO: 2984 - protein, 230 aa, Mycobacterium tuberculosis SUMu004; identical to SEQ ID NO: 2968

SEQ ID NO: 2985 - protein, 230 aa, Mycobacterium tuberculosis SUMu005; identical to SEQ ID NO: 2968

SEQ ID NO: 2986 - protein, 230 aa, Mycobacterium tuberculosis SUMu006; identical to SEQ ID NO: 2968

SEQ ID NO: 2987 - protein, 230 aa, Mycobacterium tuberculosis SUMu007; identical to SEQ ID NO: 2968

SEQ ID NO: 2988 - protein, 230 aa, Mycobacterium tuberculosis SUMu008; identical to SEQ ID NO: 2968

SEQ ID NO: 2989 - protein, 230 aa, Mycobacterium tuberculosis SUMu009; identical to SEQ ID NO: 2968

SEQ ID NO: 2990 - protein, 230 aa, Mycobacterium tuberculosis SUMu010; identical to SEQ ID NO: 2968

SEQ ID NO: 2991 - protein, 230 aa, Mycobacterium tuberculosis SUMu011; identical to SEQ ID NO: 2968

SEQ ID NO: 2992 - protein, 230 aa, Mycobacterium tuberculosis SUMu012; identical to SEQ ID NO: 2968

SEQ ID NO: 2993 - protein, 217 aa, Nitrosococcus halophilus Nc4 uid46803
MSTPITYNLNPVKGLIFRITHRDNILWILDHGLHCPNGTVFDHNFVPIGNPELIDRRHHREVPIPPGGVLGDYVPFYFTPYSPMMYNIKTGYGGVKKRRNDEIVVLVSSLHQVAKEQRKFVFTDRHAYLRAANFYNNINDLNLVDFKLLRSRDFSRDVEDPEKIERYQAEALVHQSLPVQALLGIVCYTKAVADEVQSVLRVRKITMRTLVKPSWYF

SEQ ID NO: 2994 - protein, 240 aa, Nitrosomonas europaea
MRFHHAHGSLFPRKILICIKARINPDLVMNGIPLCPKLYHIVHVDRLSSILKDGFLWCDVHMAQHIPVGTTIGMNNIKQRRLQNCLNSYPDLHVGDCVPFYFCPRSVMLYLIYRQNTELDYKGGQGPIIHLEADLNAVTTWAKTQSARWVFTLTNAGSFYFEDRNDLTCLKEVNWTAVHALNWKEHKEGKQAEFLIEQCFPWNLVERIGVQSEVIYNHVVNALPVNGHRPKVEIKPEWYY

SEQ ID NO: 2995 - protein, 211 aa, Oscillatoria sp. PCC 6506
MPTFIYHITHINNLESIVKAGGLLACNAMYEANAEYTNIAYDGIQDRRARTSVPCSVGGVLHDYVPFYFAPRSPMLCAINNKGKVKGYSEGQTPIIYLVSEVEKIADSNLHFAFTDGHAVMTFTDFFDNLEYLDEAIDWEVMESRYWFDTDEDNDRKRKRQAEFLVYKFFPWQLVTEIGVKNYQIKTEVDKILEKNTTHQPPVKTRTAWYY

SEQ ID NO: 2996 - protein, 214 aa, Parvibaculum lavamentivorans DS-1
MAIPAQPKIYHIVHVQNLASIVTDGHLWSDATMVNRPPGGTVIGMGGIKLRRLRLPVTCHQGTHVGDFVPFYFCSRSIMLYVLHCANHAELTYRGGQQPIVHLEADLYRSVRWAEENGSRWAFSLSNAGAAYTQFRSKREQLSEVNWEAVRATDFRPADVKEGKQAEFLVERSFPWHLVERVGVHSQAVVDQVSTAMRGVRHRPQIEIRKDWYF

SEQ ID NO: 2997 - protein, 218 aa, Pectobacterium carotovorum PC1
MANDYSASLNPQKALIWRIVHRDNIPWILDNGLHCGNSPVQAGNWINIGNPELIGKRAGHPVPAGAGGTLHDYVPFYFTPFSPMLMNIHSGRGGIKQRPNEEIVILVSSLRTVAAQNVPFVFTDSHAYYNWANYYTDLNNLNQIDWPILQARDFRRDPDDPGKFERYQAEALIWRHCPITLLSGMVCYNDSVKLQLEQWLSQRNLTMPVHARAGWYFS

SEQ ID NO: 2998 - protein, 139 aa, Pedobacter sp. BAL39
MLYNIITGHGVNPVNQAEIIYLCCKLSDLACEDFKWCYTNGNAAKKITKFFDSFDGIAKNIDWHSIKTTDFRDANADGDEDRIRKKHAEFLVLDHVPAHFIRNIVVLNAKVKVQVEEILATQGFEVNVHINPKNSFYFT

SEQ ID NO: 2999 - protein, 211 aa, Prevotella timonensis CRIS 5C-B1
MSDNKIKYAFRIVHIDNIPYILENGIVNAAKSTKKDDSYISIGDESLIEVRRNQNIIHTESCIGDYIPFYFGPRTPMLYTIQHGYNGVKKCDATNLVYLVLKISDIIKSGFQGYFTDGHARNICSHTYEIDKLNQLNELVHYENVYRTYWSIREDNSGEYKRLKSAELLIENNIPTTMIAGYVVYDKAAHDKLVSFGIDNEKIIINNNYYF

SEQ ID NO: 3000 - protein, 213 aa, Pseudomonas entomophila L48
MTYTRLNPSKALIWRVVHRDNLPWLLDNGLCAVSRGNLSSGYVGIGNPDLISKRSRRAVPIHPGGTLADYVPFYFTPFSVMMKNIHSGRGVQQRRNEEIVILVSSLYHVRSLGLPFVFTDAHAYPDWAGYYSDLEHLDKIDWQILQSRDFKRDPDDPRKMERYQAEALIHGHVPVAGLLGIVCYNEALQRRVDQEVRQRQLDLPVHARPGWYF

SEQ ID NO: 3001 - protein, 217 aa, Pseudomonas mendocina ymp
MPNHYPNLNPEKALIWRIVHRDNLVWILDNGLHCASANVQAPNYVVIGNVDLISRRRERTVPVAPGGTLSDYVPFYFTPFSPMMYNIHTGRGEVQQRHNEEICILVSSLRRVHELGLGFAFTDRHAYTPLARYFNELDLLEQLDWPLLQARNFSRNPDDPEQIERYQAEALVHRYLPIEGLLGVVCFTQAVKDRLDAQAQAKGLKLDIRVMPQWYFR

SEQ ID NO: 3002 - protein, 223 aa, Rhodopseudomonas palustris TIE 1
MPPPIPTAIFHITAIANLDSIAKQGALLSKNEAAARGLVAANIAYDHIQGRRAVRTVPIAPGGTLHDYVPFYFAPRSPMLFTINQGNVPDCIYRQDDIVHLATTAQTVADTGQQIVFSDIHAALDYARFFSDLGSLTEIDWRIFFEPPRLEGYCKFWQNRQIPIHHLRRLEIRQAEFLVHGELPIAAISEIGVKTAQAAAQVEQAVAGSGWTPTVRVVPGWYF

SEQ ID NO: 3003 - protein, 226 aa, Roseiflexus sp. RS-1
MARIMIPTFPKKPIPENPKIYHITHVDNIRNIVSTGGLLSDARILQQGGPTQMIGLSNIKRRRIEELEVRCHPGTKVGEYVPFYFCPRSIMLYVIHRADHPELMYRGGQDSIAHLEADLHQVVDWADNNGVRWAFSLSNAGARYTQFRSNLRYLHELDWDAIAATDFRDSDVKEGKQAEFLVHGFFPFDLVERIGVHRANIWNKVRSVLAGSGYTPRVEVRDDWYF

SEQ ID NO: 3004 - protein, 111 aa, Roseovarius nubinhibens ISM
MAPLPTLSADIGQLETHVHWSVFDDYPLTARIPEIGYDGVCKFFFNKFPPPKYQLRKQQRMAEFLVKDAVSLQQVTCIVVPSDGMKRTIQAQVDTSGWGTPVLEKPGCFVR

SEQ ID NO: 3005 - protein, 206 aa, Ruminococcus flavefaciens FD-1
MKPSEIFRSKFHNKNGFYNIMPISNLASVLKYGILSNELAERIPHRSVAMSIIQDRRDQVLIPNGLMLHQYANLYIDARNPMLYKRKDEDVIVLKVDCRILDLPDVVVSDQNASSSYVRFYEPEEAMNKLDFNMIFARSWESDNQFEYWRKKSAKCAEVLVPGKIEPSYVIAAAVKNDADKEKIIALGFDKRIYVNGDLFFGKEVE

SEQ ID NO: 3006 - protein, 212 aa, Shewanella putrefaciens CN-32
MVPAQPKIYHIVHVDRLAPILASNALLCDAEIIAQQAAGTTIGMNTIKQRRLNELTLDSYPDLYVGQCVPFYFCPRSIMLYVIHRADSAELVYRGGQGPIIHLQADLHATVQWAQQQGRRWAFTLSNAGSYYFEDRNDLARLNELDWQAIGARQWQGCKEGKQAEFLMEHSFPWHLVEEIVVQSPIIHQQVVNTLQRVGHRPPVRINPNWYY

SEQ ID NO: 3007 - protein, 209 aa, Stigmatella aurantiaca DW4/3-1
MNLPRGVPQDPLIFHITHVDNLPNILREGGLWCDAQRIARGLSSTNIGHLHIKQRRLLRPVTTTAGGTLGDYVPFNFCSRSVMLYAVHCGHQDYKGGQESIVHMVSSVSRATALGRAWAFTDRHAELAHALHFDDLGKLGEVPWQVMPLQYWSEVKEERQAEFLVREFFPWEAVTEVAAMTPAASARVQQALRGAAHHPPVTTQAGWYY

SEQ ID NO: 3008 - protein, 212 aa, Synechocystis sp. PCC6803
MTVPAQPKIYHIVHVDRLPSIIADGCLWCDAAISQRNPAGTTIGMNKIKQRRLKELTLTSHPSLYVGQCVPFYFCPRSIMLFLIHKKNTELTYQGGQEPIIHLEGDLIQAVNWADQNNLRWAFTLSNAGSSYFEDRNSLAQLHEIDWAAVQATNWQTCKEGKQAEFLVESTFPWHLVERIGVKSRVIYDQVIKALPTGGHHPQVEVRPDWYY

SEQ ID NO: 3009 - protein, 225 aa, Syntrophothermus lipocalidus DSM 12680 uid49527
MKAIGLDVPPIRDMLPTVIPVAEVKEDMKPEELTELHYITHIENMKSIMRFGLLSNRRASRTRHNSVAMQVIQERRAGKRVPGGLLLHDYVNLYLCARNPMMYKLRGRHKELCVLRIDVGVLNIPGTIVTDRNASSDWACFYPSPVGLKHVDLELVCAQSWVHNDEIETFKHKSIKCAEVLVPHHVPTSFFKGVYVSCAESMSRLHCLAGDGKLEIEVYPHMFFL

SEQ ID NO: 3010 - protein, 224 aa, Thauera sp. MZ1T
MPAPYPTRLFHITAIANLPAIFAAGALLSKNGGAAAGINYQNIAHAGAQGARAVRAVPNPPGGLVHDFVPFYFAPRSPMLFAINGGRVAGCQWRQTDIVHFETTVQCLVARGRPFVFYDRNATLAFSTPYTDLAHLDTAVAWDLMTEAPQLDGYCKFWQNNPAVARYADRMERRQAEFLVRDNVPLDCMTRLGVIDAARQAQVLALLAQAGVALTVDIMPAWYF

SEQ ID NO: 3011 - protein, 222 aa, Thermus aquaticus Y51MC23
MPQQGLAYPVPTLIYHITHLNNLQGILQRGGLLPYSQRPPTQQNVAYGHIQAHRAQVVVPVGPRGKLHDYVPFYFCPRSPMLYAIHTQQTDYQGDQRPILHLVSSAQKVAEARIPFVFTDRHAAVQYVCFFHKLEHLKALDWQAIQASYWANVREKKQAEFLVKDFFPWELVEEIGVIDKTIQAQVESILAQFPDLHHPPVRVRRSWYYKKRLCSASCEATF

SEQ ID NO: 3012 - protein, 226 aa, Thiobacillus denitrificans ATCC 25259
MAVPNPVRLFHITAIANLPAICAAGALLSKNQGATNGIAYQNIAHQGAQGARSIKSVPNPPGGLVHDFVPFYFAPRSPMLLAINGGRVAGCDWRQADIAHFETTVEHVTAAGEDFVFYDLNATLAWSTPYTGLANLDKVAWDLICESPALDGYCKYWQSKLDHARYSDRMERRQAEFLVKGMVPLVRFTRIGAIDRGHADVVRAILDQAGVKLPVVVKPEWYFLGQ

SEQ ID NO: 3013 - protein, 214 aa, Zymomonas mobilis
MIYKSFNPQKALIWRIVHYSNLPWILDNGLYCGNSKIKSPNWFNIGNPELIQKRADHSVPLPPSGMLNDYIPFYFTPFSPMLRNISTGWGGIPQLPNEKIIILVSSLHHIADLGLPFLFTDSHAYSPCANYYSNLSDLNQIDWPILQHRDFKRDPDDPAKFERYQAEALIYQHLPINGLYGIICYTELLKQRIEQEICARNLNLRVYARPEWYF

SEQ ID NO: 3014 - protein, 208 aa, Arthrospira sp. PCC 8005
MTTYIYHITHLKNLPSILRSEDLLANNRLKSQRINYVDIAHETIQNKRAQINIPCSRGGTLHDYVPWYFAPRSPMLYAISRGNVQGYEQGQSPVIHLVATAEDIAAASLPFAFTDGHAIVRYSEFYDNLDSLNAIDWEIMNAGYWADTLEDGDRKRRRQAEFLVYEFFPWTLVREIGVIDVGRKAEVEEILQNFTISTPVKVFREWYY

SEQ ID NO: 3015 - protein, 208 aa, Arthrospira sp. PCC 8005
MTTYIYHITHLKNLPSILRSEGLLANNHLKSQPINYVDIAHETIQNKRAQINIPCSRGGTLHDYVPWYFAPRSPMLYAISRGNVQGYEQGQSPVIHLVATAEDIAAASLPFAFTDGHAIVRYSEFYDNLDSLNAIDWEIMNARYWADTPEDGDRKRRRQAEFLVYEFFPWTLVREIGVIDAGRKAEVEEILQNFTISTPVKVFREWYY

SEQ ID NO: 3016 - protein, 144 aa, Desulfonatronospira thiodismutans ASO3-1
MKLDEPIPIYRLMHVDNLPVCLNRGGLHAPHYVPENGLSYTAIHNIDIQQIRRVRYIKCGPGGTVHDYVGFYFGPRPPMLLQLHTGQVPGYDQGQEPLIYIVSTVQSVIEAGLDYVFSDGHGIAAYTQWFSNIEDLDKVDWNTV

SEQ ID NO: 3017 - protein, 214 aa, Methylobacter tundripaludum SV96
MIYKNLNAEKALIWRIVHRDNLSWILDNGLHCANSKTLSPNYINIGNSDLIDKRRHRVVPIAPSGTLADYVPFYFTPFSVMMLNIHSGRGGVPRRRNEEIVILVSNLHHVHSIGLPFLFTNAHAYPNWTNYYSNLAQLYNIDWDILQRRDFKRDPDDLRKMERYQAEALIFKHLPINGILGIVCYTEQLKHDIEQQVQDRNLMLEVYARTKWYF

SEQ ID NO: 3018 - protein, 174 aa, Mycobacterium tuberculosis 02 1987
EVAYNPVKELRRHKVVAPDSRYPASMASDHVPFYIAARSPMLYVVCKGHSGYSGGAGPLVHLGVALGDIIDADLTWCASDGNAAASYTKFSRQVDTLGTFVDFDLLCQRQWHNTDDDPNRQSRRAAEILVYGHVPFELVSYVCCYNTETMTRVRTLLDPVGGVRKYVIKPGMYY

SEQ ID NO: 3019 - protein, 230 aa, Mycobacterium tuberculosis 94 M4241A; identical to SEQ ID NO: 2968

SEQ ID NO: 3020 - protein, 230 aa, Mycobacterium tuberculosis C; identical to SEQ ID NO: 2968

SEQ ID NO: 3021 - protein, 230 aa, Mycobacterium tuberculosis CPHL A; identical to SEQ ID NO: 2968

SEQ ID NO: 3022 - protein, 230 aa, Mycobacterium tuberculosis EAS054; identical to SEQ ID NO: 2968

SEQ ID NO: 3023 - protein, 230 aa, Mycobacterium tuberculosis GM 1503; identical to SEQ ID NO: 2974

SEQ ID NO: 3024 - protein, 230 aa, Mycobacterium tuberculosis Haarlem; identical to SEQ ID NO: 2968

SEQ ID NO: 3025 - protein, 230 aa, Mycobacterium tuberculosis K85; identical to SEQ ID NO: 2968

SEQ ID NO: 3026 - protein, 230 aa, Mycobacterium tuberculosis KZN 4207 (DS); identical to SEQ ID NO: 2974

SEQ ID NO: 3027 - protein, 230 aa, Mycobacterium tuberculosis T17; identical to SEQ ID NO: 2968

SEQ ID NO: 3028 - protein, 230 aa, Mycobacterium tuberculosis T85; identical to SEQ ID NO: 2968

SEQ ID NO: 3029 - protein, 230 aa, Mycobacterium tuberculosis T92; identical to SEQ ID NO: 2968

SEQ ID NO: 3030 - protein, 213 aa, Providencia rustigianii DSM 4541
MSIPKEPKIYHIVHVDRLSSIFASNGLLCDAEVIFQNLSGTNIGISNIKKRRLTELQLSSHSNLYVGQCVPFYFCPRSIMLYVIHRGTNTNLTYQGGQNSIIHLQADLYASVQWAKKHKNRWAFTLSNAGSYFFEDRCDLSQLNQLVWQDIQATQWQNCKENKQAEFLMERYFPWHLVEQIVVHSQDIQQKVIQLLRMEEHRPPVTIKSDWYY

SEQ ID NO: 3031 - protein, 321 aa, Acidovorax delafieldii 2AN
MRVLAPERRELIEALVAEAESGAITAGLLEKDEHLTDALRALFALKPEGVQLVFCGGTSLSKAYGLIERMSEDADLKVVLPDAGQASRADIRRRLSALKAQVTKTLAGIGLVENKAKGLAFNENRYFCSEWTYERHYASAAGLRPHLQIELTARAPVLPSQICRITTLADQLAGRSDQAFEVPVVAVAETVAEKILSFLRRYAQHRAGLMRQAWDTALVRHLYDVHRIHQRQPEALADARRAFPALVAGDQKEFGAQFPDFAAAPLEVLNGALRQARADTKIQAEFTGNLLPLVYGGETPAFEQAFSDFNTVAEALLEALP

SEQ ID NO: 3032 - protein, 321 aa, Acidovorax sp. JS42
MRVLAPERRELIEALVAEAAPGGITAGLLEKDEHLTDALRALFALQPEGVQLVFCGGTSLSKAYGLIERMSEDADLKVVIPDVGQASRAEIRRRLSALKALVTETLASIGLVEDPAKGLAFNENRYFCSEWSYARHYGSAAGLRPHLQIELTARTPVLPAQVCRITTLADQLAGRSDPAFEALVVAVAETVAEKILSFLRRYAQHRAGLMRQAWDTALVRHLYDVHSILQRQPEVLADAQRAFPALVAGDQKEFGVQFPDFAAAPHQVLNGALRQARADTKIQAEFTGNLLPLVYGGGTPAFEQAFGDFEKVAATLLETLR

SEQ ID NO: 3033 - protein, 308 aa, Burkholderia pseudomallei 1106a
MIDALLAEKDVGRISAAILEKDIHVTDALRALSTLAHEHVTLVFCGGTNLSKAHGIIERMSEDVDLKIVLSPSHGLSDSALKKHLSALKKKVAETLTVLDFQEILEAASARNANRYFASSWRYASVYGPHQSLRTHLSVEFTVRTPAFDTSKRQLGYLIDRLADRTGNPFAFQCVSVEETLAEKVLAFLRRFAEHRAKVRENWDEALVRHIYDTWRIVSVDPAAADRAATHFKDLVEFDRGEFRLHEAFVTDPATCMKSALGEIEHDAQTISEYADKLIPLIYGKDKPTFNEAFGVFKDVANKLLGTL

SEQ ID NO: 3034 - protein, 318 aa, Burkholderia pseudomallei 14
MKTITTDQRELIDALLAEKDVGRISAAILEKDIHVTDALRALSTLAHEHVTLVFCGGTNLSKAHGIIERMSEDVDLKIVLSPSHGLSDSALKKHLSALKKKVAETLTVLDFQEILEAASARNANRYFASSWRYASVYGPHQSLRTHLSVEFTVRTPAFDTSKRQLGYLIDRLADRTGNPFAFQCVSVEETLAEKVLAFLRRFAEHRAKVRENWDEALVRHIYDTWRIVSVDPAAADRAATHFKDLVEFDRGEFRLHEAFVTDPATCMKSALGEIEHDAQTISEYADKLIPLIYGKDKPTFNEAFGVFKDVANKLLGTL

SEQ ID NO: 3035 - protein, 318 aa, Burkholderia pseudomallei 9; identical to SEQ ID NO: 3034

SEQ ID NO: 3036 - protein, 318 aa, Burkholderia pseudomallei B7210; identical to SEQ ID NO: 3034

SEQ ID NO: 3037 - protein, 249 aa, Burkholderia pseudomallei Pakistan 9
MSEDVDLKIVLSPSHGLSDSALKKHLSALKKKVAETLTVLDFQEILEAASARNANRYFASSWRYASVYGPHQSLRTHLSVEFTVRTPAFDTSKRQLGYLIDRLADRTGNPFAFQCVSVEETLAEKVLAFLRRFAEHRAKVRENWDEALVRHIYDTWRIVSVDPAAADRAATHFKDLVEFDRGEFRLHEAFVTDPATCMKSALGEIEHDAQTISEYADKLIPLIYGKDKPTFNEAFGVFKDVANKLLGTL

SEQ ID NO: 3038 - protein, 315 aa, Chlorobium limicola DSM 245
MRTITAHERNLILDVTGEGLTPLPAAALEKDVLVTKVLEKLADIDVDGIQLIFCGGTCLSKAHGLIGRMSEDIDFKVVVPPGLSRSQNSLRLSQFKKHLVAVLATEGFVVPENEVLARDENNYFALNIRYESRFEVVASLRPEIKLELSARPLLLPMQLLSVRSILDILVNPPIEGIRINCLGVQESIGEKTLSFLRRTAEALSGRVSKDYDDRLIRHVYDVTVINRRLPDLISGLAGEVFDKMVDSDAERFGRQFPEFRLNPVVEMSKSVEYLENDESFAAEYDRFVTDLVYGEQVAFEEAKREFIEFARRLLS

SEQ ID NO: 3039 - protein, 117 aa, delta proteobacterium sp. MLMS-1
MRAGRNRADYDDRLVRHLYDVRVIARGRYGLVNALPHEHFAAMVAGDAAQYRNQYPEFEQDPVGQMRLVLDALHHEADAFERDYLQFVDELVFGEPVSFAEARTVFVELANRLLSQL

SEQ ID NO: 3040 - protein, 317 aa, Desulfatibacillum alkenivorans AK 01
MEGISLLKKSVDKTVIQNISLELGLDPSFIEKDWYAVQLLVLLSDFKSDKEVKIVFSGGTSLSKGYGLIKRFSEDLDFILTIPVGSSLSAGQRKAFRKELVLAIQRDERFNIDEDKIQRGDSHRFFKIPIQYDRIYDAASLRPHLQLEMSFKELNRPFERRSIRSMASEMAKSDPELEIDCVSAIETAGDKLSALTWRILVRDRADEKDDPTIIRHLHDLAALENMILDASDDFVSSAKKSLEQDKNQRGGDIIANMSVIDRLANTLKILKEDDLYKKEYTMFVTSMSYAPEDELTGFEGAVHALERIIHHYNALSE

SEQ ID NO: 3041 - protein, 246 aa, Escherichia coli 83972
MPELTSLFPDVADALDIESVAIVEKDYFVVDLLRLLKEIKPETHTLVFAGGTALSKAGISLNRMSEDIDIKLVPTENFMQNGRDKRRKIRKEIVQIITDVIHNSDIFSLDNENARITRDEYRYNEISVRYPQTFAQVPCLRPFIKLELMESTLLEHPESRDIYSLVTELTGKGTPVTAFPCATILSTQAEKLISMMRRTAAHLRNPEQQDDEFLVRHIYDNYCIVREKGVNVPVLKNFVQICIQLW

SEQ ID NO: 3042 - protein, 246 aa, Escherichia coli ABU 83972; identical to SEQ ID NO: 3041

SEQ ID NO: 3043 - protein, 246 aa, Escherichia coli FVEC1302; identical to SEQ ID NO: 3041

SEQ ID NO: 3044 - protein, 246 aa, Escherichia coli FVEC1412; identical to SEQ ID NO: 3041

SEQ ID NO: 3045 - protein, 315 aa, Escherichia coli MS 119-7
MDDLTTLFSEVADALGIESVAIVEKDHYIVELLQLLKPLVFDTHQLVFAGGTALAKSGVALNRMSEDVDIKLVPKDAFQALSRTQRKNTRKEIVQAVSSAIASSGVFNFDDDYPKVTRDEYRYNDIPVRYPQRVVQAPCLRPFIRLELMEAKLLEPSELRDIHSLVTGITGKAAIVSAFPCATIISTQAEKLVAMLRRTAAVVRDVERFDDASLVRHIYDTNCIVETSHVDMSLLVDFVQQTIEQDIQRYGNQYPQFCASPVDELKMGLDELANNPLYQMRYQQFVSPMVYGERKITWDEAYSRFRSLALAILNA

SEQ ID NO: 3046 - protein, 246 aa, Escherichia coli MS 198-1; identical to SEQ ID NO: 3041

SEQ ID NO: 3047 - protein, 246 aa, Escherichia coli MS 45-1; identical to SEQ ID NO: 3041

SEQ ID NO: 3048 - protein, 305 aa, Escherichia coli MS 69-1
MPELTSLFPDVADALDIESVAIVEKDYFVVDLLRLLKEIKPETHTLVFAGGTALSKAGISLNRMSEDIDIKLVPTENFMQNGRDKRRKIRKEIVQIITDVIHNSDIFSLDNENARITRDEYRYNEISVRYPQTFAQVPCLRPFIKLELMESTLLEHPESRDIYSLVTELTGKGTPVTAFPCATILSTQAEKLISMMRRTAAHLRNPEQQDDEFLVRHIYDNYCIVREKGVNVPVLKNFVQICIHAMVTSTHNFVAHQLMNLRKGWMHSGIILYTNCAFNDLLNRWYLVIHRLTGKKPIPVSDKQR

SEQ ID NO: 3049 - protein, 315 aa, Escherichia coli MS 69-1
MDDLTTLFSEVADALGIESVAIVEKDHYIVELLQLLKPLVFDTHQLVFAGGTALAKSGVALNRMSEDVDIKLVPKDAFQALSRTQRKNTRKEIVQAVSSAIASSGVFNFDDDYPKVTRDEYRYNDIPVRYPQRVVQAPCLRPFIRLELMEAKLLEPSELRDIHSLVTGITGKAAIVSAFPCATIISTQAEKLVAMLRRTAAVVRDVERFDDASLVRHIYDTNCIVETSHVDMSLLVDFVQQTIEQDIQRYGNQYPQFCASPVDELKMGLDELANNPLYQMRYQQFVSPMVYGERKITWDEVYSRFRSLALAILNA

SEQ ID NO: 3050 - protein, 246 aa, Escherichia coli UMN026; identical to SEQ ID NO: 3041

SEQ ID NO: 3051 - protein, 305 aa, Escherichia coli CFT073; identical to SEQ ID NO: 3048

SEQ ID NO: 3052 - protein, 315 aa, Escherichia coli W
MDDLTTLFSEVADALGIESVAIVEKDHYIVELLQLLKPLVFDTHQLVFAGGTALAKSGVALNRMSEDVDIKLVPKDAFQALSRTQRKNTRKEIVQAVSSAIASSGVFNFDDDYPKVTRDEYRYNDIPVRYPQRVVQAPCLRPFIRLELMEAKLLEPSELRDIHSLVTGSTGKAAIVSAFPCATIISTQAEKLVAMLRRTAAVVRDVERFDDASLVRHIYDTNCIVETSHVDMSLLVDFVQQTIEQDIQRYGNQYPQFCASPVDELKMGLDELANNPLYQMRYQQFVSPMVYGERKITWDEAYSRFRSLALAILNA

SEQ ID NO: 3053 - protein, 315 aa, Escherichia coli W, ATCC 9739; identical to SEQ ID NO: 3052

SEQ ID NO: 3054 - protein, 246 aa, Escherichia sp. 1 1 43
MPELTSLFPDVADALDIESVAIVEKDYFVVDLLRLLKEIKPETHTLVFAGGTTLSKAGISLNRMSEDIDIKLVPTENFMQNGRDKRRKIRKEIVQIITDVIHNSDIFSLDNENARITRDEYRYNEISVRYPQTFAQVPCLRPFIKLELMESTLLEHPESRDIYSLVTELTGKGTPVTAFPCATILSTQAEKLISMMRRTAAHLRNPEQQDDEFLVRHIYDNYCIVREKGVNVPVLKNFVQICIQLW

SEQ ID NO: 3055 - protein, 310 aa, Legionella drancourtii LLAP12
MLNKIKETSDFLDLHESIIEKDYYVTQLIQTLSGIENEYFRLVFCGGTCLAKAHRVVRRMSEDVDFKIQRKSTTDDFSKSHMLKELKTFRLELQSKFSIPNLTASEPVVRNEGKYSRVQFTFPSVFTLNDTLRPHILFEFTLSNICCDVVIRSVMTLMEETFPDLSLFPKSQTHCVAVHETAIEKWVGLTRRIIAIERGSHHDDRSLIRHVYDLNAIELAEPIPDDFLMLAKDIVLTDAQQFKNQNPEYAANPAEEINRSLDLLRTKPIWRERYYDFIENMVFNPDLAADYDKAINVIADLSKRVISFLH

SEQ ID NO: 3056 - protein, 307 aa, Legionella pneumophila Corby
MPGELNEQQIRQTAIILGLPADFIRKDYFVTKAIRLLVGISNDYFELVFQGGTSLSKGYGVISRLSEDIDFRVIPKPACLSLGKDARRRELRLFRRALVESLINAGFNVEPQDVKVFYEGRYMSIRASFDGAQGIVYLKPHIAIDCFLGTLELDPEIRNISSMVKVTLGDAECDHQYFPVPCVALDETAAEKWVALSRRIVDANETARDSDKHLVRHLYDLHQLQQQNCLTENYYLVLEKVLEKEQEMFGCESSDSVYEKSISALHYLRSDKKWEEHWRFFLEQMVYQLEKPGFEQAIATVEKLSSR

SEQ ID NO: 3057 - protein, 315 aa, Legionella pneumophila Lens
MLDSSMFQYIETTANTLDLPESVIEKDYYVTQVIQSLSKIENEYFRLVFCGGTCLAKAHKVVQRMSEDVDFKIQRKSTTDGFSKSHLLKELKAFRLQLQSNFAIPNLTASEPVVRNEGKYSRVEFFYPSEFTRNATLRPHILFEFTLSNIRCDIVTRSVKTLMEDTFPSLSLFPQSQTHCVAVHETAIEKWVGLTRRIIAIERGYHYDDPSLIRHVYDLNAIESAEPITDDFLMLAKEVILTDAQQFKNQNPEYAANPVEEINRSLDLLRAKPLWRERYQDFIENMVFNPSLATDYDKAINVIADLSKKVVSYLH

SEQ ID NO: 3058 - protein, 308 aa, Legionella pneumophila Paris
MPGELNEQQIRQTAIILGLPADFIRKDYFVTKAIRLLVGISNDYFELVFQGGTSLSKGYGVISRLSEDIDFRVISKPACLNLGKDARRRELRLFRRALVESLINAGFYIQPQDVKVFYEGRYMSIRASFDGAQSIVYLKPHIAIDCFLGTLELEPEIRNISSMVKVTLGDTECDHQYFPVPCVALDETAAEKWVALSRRIVDANKTVRDSDKHLVRHLYDLHQLQQQNCLKGNYYLVLEKVLEKEQEMFGGESSVSVYEKSISALHYLRSDKKWEEHWQFFLEQMVYQLEKPSFEQAIATVEKLNSRR

SEQ ID NO: 3059 - protein, 355 aa, Methylovorus SIP3 4
MKSINDSERNLINSIYNELQPNINISALEKDIHITEIIKELSQLQFENFHLVFCGGTCLSKAHGILERMSEDVDFKLVLKKDVAEYSKNELNHKLSEVKHILKDKLISLNYISLADTESTANSIIKAHDSNQYIVFNIPYQNKFPSSTVLRPHIQIELNYTKLQLPMKLYQVGYIYKDLIKNTDIKFQVRCVSIEEAFCEKLIAFPRRYSHAIANNNLDNFDQALVRHLYDVHQIKHKYPVIDKNETLITGLIKTLIQNDAIEFSNQHQQFIADPIGELNKAMESALTSQTIRKNYNDFLEHMVYQDNAKKPTFEAAINTFQIALNNAIKHIPKIQVEIPIKQVIKPNKIKTLKL

SEQ ID NO: 3060 - protein, 299 aa, Chlorobium luteolum DSM 273
MSRNQLLPKKSAIERAAGLLVTTDEAFIEKDWHVVRALRLLNGLQSPGLQLAFGGGTSLAKAGLIKRFSEDVDFKATIQPAGRTQYRATRKTIIETLLDEGFSLLAEPMVRDESRFFSLELDYGATFSTSRRLRKHIRVEVRFVPPKIPVVFQPVQSLLGLTEQQPAEIGSMPYVHPVEIAADKLSALSWRLLDDDESQDKTLIRHVHDMAALEPMITSNGAFQNLVRQAMTDDLNRSHIPLVQRLRRVMTALKTAVWKKAYQSFVQDMSFAREDEIIAYETALNACERLIDLVERKRT

SEQ ID NO: 3061 - protein, 296 aa, Pelodictyon phaeoclathratiforme BU 1
MPINQVLPTKTAIERAAGILVTTDEAFIEKDWHVVRALTLLNGLHIQGLQLAFGGGTSLAKAGLIKRFSEDVDFKATITPAGHKYYRETRKKIIAALEDGGLVLVAKPMVRDGSRFFSLELDYGATFMRNQRLRTHIRVEVRFVAPQMPVVFKPVQSLLRFTEGQPAEIGSMPYIDPVEIAADKLSALSWRLLDEEERQDKTLIRHVHDLAALETLIASNVKFPDLVRQSIAGDYNRSDIPQEQRLRGVMTNLQNAVWKEAYQSFVQDMSFARDDEIIPYESALDACERLVYLVDR

SEQ ID NO: 3062 - protein, 313 aa, Photobacterium sp. SKA34
MNKLKQQFLEVSDALVLGNPAIIEKDYWVVALLAQLEKLTIDSHQLVFSGGTALAKSNVKIMRMSEDVDIKLIPNADFHTLSRSKKKTVRKSLLETLEKAIEESNTFSIEDKQAWDEYRYVEYDLKYPQQFSQAPCLRPIIKLELMETIPLQETEQRSIQSLVAELYRTKKEVKAFACVSVHATLAEKIISMLRRTMLAKRDENRKDDQTLVRHIYDVYCIDATQQIDIESLSLLFNAVLQEDITRFGNQHDEFVNNPSKELQSGLLELEANPLYRQRFEAFVTPMVFNQQPHDFDTCFASFKRIAASLIEKI

SEQ ID NO: 3063 - protein, 316 aa, Photorhabdus asymbiotica
MDDLTKLFPDVADALGIESVAIVEKDHYIVELLRLLQPLSFDTHQLVFAGGTALSKAGISLNRMSEDVDIKLVPVAGFSQQYSRGQRKDIRKGIIQTIIETITASGTFRMDEGYPKVTRDEYRYNEISVRYPQEYAQIPCLRPFIKLELMETGLLEAAENRVISSLVMDLTKKGEVVRAFPCATIASTQAEKLISMMRRTAASMSDVERVVDESLVRHIYDNFCIVREKGADVPVLKQFVQECIEQDIERYGDQYPEFCESPVEELKMGLEELESNPVYKERYLRFVTPMVFGESHVSWEDAYTCFRKTTLDVFDA

SEQ ID NO: 3064 - protein, 320 aa, Photorhabdus luminescens
MDDLSGLFADVADVLGIGTISIVEKDYYVVELLRLLQPLAFDTHKLVFAGGTALAKAGISLDRMSEDVDIKLVPQPEFLVGVQYSRSQRKNIRKDIVQTISATIAASGFLGIDDSNPKITRDEYRYNDISVRYPQRVVQVPYLRPFIKLELMESDLLQAAERRDIRSFVTQLTGKGRAVEAFPCTTIISTQAEKLVAMLRRTAVFMRNIDRKDDESLVRHLHDNYCIVNAIGVDIRQLAGFVQQTIEQDIQRYGRQYPQFQISSINELRAGLEELGSNPIYQQRYQQLVIPMVFEHSRIPWAEAYDCFRQTALSVLNELN

SEQ ID NO: 3065 - protein, 300 aa, Pseudoalteromonas haloplanktis TAC125
MGNPAIVEKDYYVVALLKLLSELSFDTHLLVFSGGTALTKSGIKTHRMSEDIDIKIIPTDVFANISKTQKRKARKELHLQLLNAISLHNSFSVENRPTIYDEYRYQQIDIRYPQAHSKVPCLRPFIKLELIETLLYDQVVSRDICSLMNEVTQKPPEVALMGFSSIKSTQAEKLVSMLRRTASFARDNIRDDDPALIRHIYDTYYIQQAGLASASDVMSLVSKVIAEDLTRYSNQHAEFMKSPIAELKFGLSLLQTNTLYEERFNQYVVPMVYGNNSLNWQQAFDVFKLYCNQVLNNIKL

SEQ ID NO: 3066 - protein, 329 aa, Rhodospirillum centenum SW
MSDPRYDLGAVQDFFGFSGVSVVEKDLEIVKVLKIFSELKTDGIRFVFAGGTCLARAHGRIKRMSEDLDIKLVLSPGLAAAGATRQRKVLSALKEALVQEFGRVGLHLDHTGAEADEPPLLARNENRHVSYRLTYDRATKDASILDSRIRIETVVSILRREAELRPVSSLAAEAYGHPAEVDGIACVSVAETAAEKIVSLTRRIAARLEGDAGRFDNRIIRHVYDLHMIRDSIDPGDVGSIAREIAGQDAVQFRNQHPGYADDPEEATRRALDALVRDPEHGRQYDAFMTDIVYGDKIGFDVAMRTVAEIAAAMWEWDAVNTPGSGRGA

SEQ ID NO: 3067 - protein, 313 aa, Shewanella baltica OS155
MKKLKQQFLEVSDALALGNPAIIEKDYWVVALLSELEQLTFETHQMVFSGGTALAKSNVKILRMSEDVDIKLIPTPQFQHLSRGRKKQYRKALAVQIETALIASNKFSIEARLVQDEYRYVEYELKYPQQFSQAPCLRPIIKLELMETIPLLALETRGIQSLVAELYKLPQEVNVFICVSVNTTLVEKVLSMLRRTMSVKRDAARNDDVTLVRHIYDVHCIHAAQALDNELLAPLFLAILAEDIARFGNQHAEFVMDPANELRLGLQEIESNPLFRQRFNDFVKPMVFNSQSPNFDTCFMSFKHIATSLILTI

SEQ ID NO: 3068 - protein, 313 aa, Shewanella sp. ANA-3
MKKLKQQFLEVSDALALGNPAIIEKDYWVVALLSELEQLTFETHQMVFSGGTALAKSNVKILRMSEDVDIKLIPTPQFQHLSRGRKKQYRKALAVKIETAIIASNTFSIEARLVQDEYRYVEYELKYPQQFSQAPCLRPIIKLELMETIPLLALETRGIQSLVAELYKLPQEVNGFICVSVNTTLVEKVLSMLRRTMSVKRDAARSDDVTLVRHIYDVHCIHAAQALDNELLAPLFRAILAEDIARFGNQHAEFVMDPANELRLGLQEIESNPLFRQRFNDFVKPMVFNSQPPNFDTCFMSFKHIATSLILTI

SEQ ID NO: 3069 - protein, 200 aa, Synechocystis sp. PCC6803
MSSTLAITEIIQAIAAEFVVDECFIEKDWYAMRIIGVLSQIQDPTFQLVFSGGTSLSKGFGLIQRFSEDLDFKVKIINNHPPSKNRQQKQRKAFRDKILENLEQYQTDWQVDLNALQKGNESKFFKVPIRYQPLFQVSNSLRPHVQLEVTFESPALEPELKDLQSFVGKALKQQPEAINFPCVNPIETAADKLSALVWRI

SEQ ID NO: 3070 - protein, 257 aa, Verminephrobacter eiseniae EF01-2
MSEDVDYKLVPTPETMVLSNGKRRAALGDFAKAAIDALQAGRFGQGSVERRSRNANAYTRLDVSYESAFSKPAALRGHLLVEFNHSPLRLEPDKRLVGLLLDKLALGAYTDPFEVECIALQEALTEKLVSFPRRLSMLLARHSDPARALGCEADGDSSLVRHLYDARRLLQVHPELAEDGAGLAKLVDAAVRQDMAAFANQHPEFVADPGLELLLAMKFAKASPDLAAQFDAFVSDQTQFTLAGCSWRAPAHRIGRW

SEQ ID NO: 3071 - protein, 313 aa, Vibrio harveyi ATCC BAA-1116
MNTLKQQFLEVSDALELGNPAIIEKDYWVVTLLAELAKVSPEHHQMVFSGGTALAKSNVKILRMSEDVDIKLIPNPAFDELSRAKKKTARKACVNEIEQALTQSGLFNVETRSVRDEYRYVEFELKYPQQFSQAPCLRPIIKLELIETIPLLDVESRSIQSLVAELYQQPQEVSAFDCVSIHATLVEKIISMLRRTMSVKRNTERSDDVALVRHIYDVHCITKLAMPELNEIDGLFKAVLAEDIARFGNQHAEFVANPKQELQLGLKELEENAIFRQRFQDFVTPMVFNTEPHDFDTCFASFKRIAASLIEKI

SEQ ID NO: 3072 - protein, 313 aa, Vibrio tapetis CECT4600; CIP104856; B1090 plasmid pVT1
MKKLKQQFLEVSDALALGNPAIIEKDYWVVALLAELEKLTFETHQLVFAGGTALAKSNVKILRMSEDVDIKLIPSKEFDALSRGKKKTARKMLIEQIEQVIARSQQFTVESRLVRDEYRYVEYELKYPQQFNQAPCLRPIIKLELMETIPLLEVEDRGIQSLVAELYKQPQEVSAFACVSVYATLVEKVLSMLRRTMLVKRDTERKDDVTLVRHIYDVHCIDTAQTLDIESLTSLFLTVLKEDIDRFGNQHAEFVAAPIKELRLGLQELEDNPIFRQRFQDFVTPMVFNTEPHDFDTCFASFKRIAESLIKTI

SEQ ID NO: 3073 - protein, 132 aa, Vibrio vulnificus CMCP6
MNALKQQFLEVSDALELGNPAIIEKDFWVVALLAELAKVSPEYHQMVFSGGTALAKSNVKILRMSEDVDIKLIPNQAFDELSRAKKKGVRKAWVNEIEQAIIHSERFTVETRSVRDEYRYVEFELRYPQQFS

SEQ ID NO: 3074 - protein, 313 aa, Vibrio vulnificus M06-24/O
MNALKQQFLEVSDALELGNPAIIEKDFWVVALLAELAKVSPEYHQMVFSGGTALAKSNVKILRMSEDVDIKLIPNQAFDELSRAKKKGVRKAWVNEIEQAITHSERFTVETRSVRDEYRYVEFELRYPQQFSQVPCLRPIIKLELIETIPLLDVESRSIQSLVAELYQQPHEVSSFDCVSVYATLVEKIISMLRRTMSVKRNTERSDDVALVRHIYDVHCITKLTMSELNSIDGLFKAVLEEDIARFGNQHAEFVANPKQELQLGLKELEENPIFRQRFQDFVTPMVFNTEPHDFDTCFASFKRIAASLIEKI

SEQ ID NO: 3075 - protein, 317 aa, Vibrionales sp. SWAT-3
MEKLKQQFLEVSDALELGNPAIIEKDYWVVALLSELAKVSPVYHQMVFSGGTALAKSNVKILRMSEDVDIKLIPHQEFGELSRGQKKAARKTCIHEIEMAITQTERFTVESRLVRDEYRYVAFELRYPQQFSQAPCLRPIIKLELIETIPLLDVEPRPIQSLVTELYRQPQEVKAFDCVSIQATLVEKVISMLRRTMSVKRDTQRKDDATLVRHIYDVYCILKTEAQLENFDLTAMTALFNTVLKEDIDRFGNQHTEFVANPKQELQLGLKELEDNPVFRQRFQDFVTPMVFNTEPHDFDTCFASFKRIAQSLIKTI

SEQ ID NO: 3076 - protein, 320 aa, Yersinia aldovae ATCC 35236
MIFADVADALGIGATSIVEKDYYVIELLRLLQPLIFETHQLVFAGGTSLAKSGIKLNRMSEDVDIKLIPNSDFLDDNQFSRSQRKNARKEIIEKISDIIIVSELFKFDKSYPRIARDEYRYNDIQIQYPQEFTQVPCLRPFIKLELMESDLLEPAELRNISSFVYELAGKGSEISAFPCTTIISTQAEKIVAMMRRTAAFMRNVDRKDDESLVRHIYDNYRIVDALGLNICQLSVFVQQTIQLDIERYGCQHPQLEANAIDELKAGLDEIGSNPYFKERYGQFVVPMVFENSRVEWEEVYHCFRQTALETLKCLDGSLTK

SEQ ID NO: 3077 - protein, 331 aa, Yersinia enterocolitica 8081
MHVTDALRVLANLNVVHEAQLKGFDPRSKKLPVEPVNIELPVRLVFAGGTCLSKAYNLISRMSEDIDIKVILPEVPNTYKLKNECSSDKARLKDIHKKLTTKLEELGFYLTDKEGENPEINDRHRHYNVDLSYQGNFSSGVSNPLRSCIKVELINRPINLSTEKLKINYLYQQLVNGKSYPDFDIECINISETLAEKVLSLLRRFAMYCAGVKQAEFDEALVRHIYDVWRIYTIKPKAINAAASMFGHSVKTDMEEYSQQFQAFVDGPYSVLSKSLDVIKNTKDGQGKWLNHLYITRLSPLVYSQEPHSYEEALASFVEVANHLLRALAEK

SEQ ID NO: 3078 - protein, 315 aa, Escherichia coli H591; identical to SEQ ID NO: 3045

SEQ ID NO: 3079 - protein, 660 aa, Nitrobacter hamburgensis X14
MHGIEKLNLNDPETQSADVVAENIDALRSLFPEAFEEGKIDFEVLKQLLGGAVDERDEKYGLNWHGKRKARQIALTPSTGTLLPCPDESVDWDTTQNLVIEGDNLEVLKLLQKSYAGKVKLIYIDPPYNTGKEFIYPDRFQDNLDTYLKYTGQKGEDGLKTTSNTENDGRFHTNWLNMIYPRLKLARTMLADDGAIFISIDDNEKANLKEICDEIFGEDNFLTAIIVQSNKRGQTYKEIAKCHEYILVYYKTENGALGELDKDGDALPYADEHGGYDLWELRNRNPKFGRHNRPNLYFPIYVNPNSVGANGLASISLTKSDEYCREALPKNSEGADSCWRWSSKKVQTDGIDATPITVFAKQRRDGEWNIYEKSRKSTTKAKSIWSDTAVISEQGTVEAGKLGMSGVLDFPKPIELIRRCVFLGTNEDDLVMDFFAGSGTTAHAVMLQSAQDGLSRRWISVQLPEPTYEYKDGEKVAKPQNKIAFENGHETIADICKERIRRSANKLKEEYPGNNADLGFRVFKLAQSNIRAWEPEPSDIEGTLLANAEHLAQGRSEQDVLHELLLKLGLDLCVPIEKKQIAGKAVHSIGGGALIVCLADGLTKDVVEALANGIVAWRKALAPAVDTRVVFKDSGFADDVAKTNMAAILNQNGILDVRSL

SEQ ID NO: 3080 - protein, 611 aa, Syntrophomonas wolfei Goettingen
MNKLDGKTMDLVQHNIDELKKLFPEVITEGKIDFDRLRLLLGDEVDTGKEKYEFTWPGKSDCIRLSQQQSTGTLRPDKESSKDWDTTKNLYIEGDNLEVLRLLQKAYHRKVKMIYIDPPYNTGNDFIYKDDYKDNVKSYKEKTEQSMKANPATAGRYHSEWLNMMYPRLRLAKNLLSDDGAIFISIDDTELDNLKKICNEVFGEENFIACIAWHKNYASANDSKGFSSVLDYILVYRKSENFVRNLLPRTDKQNSLYKYDSNDGYGPWRPDNLSVKTYSKEYDFTIINPTTGVEYNPPKGRCWVTNKNTIDKWIKEGRVFFGQTGNGAPQLKRYLNEVQQGVVPITYWSYDECGHNDEARKEIKQLFSEPPFDTPKPTRLIKQILNISTNKDSIVLDFFSGSSTTAHAVMKLNSQDDGNRKFVMVQLPEPCNEDSEAYKAGFPNICEIGKERIRRAGENLKEEYKDKEGIENLDIGFKVFKLDTSNLKAWDPDVEELEGTLKGMVDPIKEDRTQEDMLYEIMLIYGIDLTIPLEEIQIKGKTAYSVGLGYMIVCLEDGLTLDVIEAIGAMKQSGQEIARVVFRDSGFADDNVKTNAVQLLKKFGIEDFRTI

SEQ ID NO: 3081 - protein, 626 aa, Pelobacter propionicus DSM 2379
MEKLNGQSADVVADNIDQLKALFPEALTEGKIDFDTLKQLLGGDIDEREEKYGLNWHGKRRARQLALTPSTGTLRPSPEESVDWDTTQNLMIEGDNLEVLKLLQKSYAGKVKLIYIDPPYNTGNDFVYPDNFQDNIKNYLELTGQVEGGAKISSNTEASGRFHTDWLNMVYPRLKLARNLLSEDGVLFISINYRELAHVLRLCDEIFGEENFVGNVTWKARVKPVNIGEAKYRPQGETEYVVIYQKSDKEGKFQPLYTGGVRSYPHEINGRKYRLTTILKSNRGANFRNTMSFEIDGYAPPDGQRWQGGEEEIKRLNIEGYLEFRDGTPFKRYYEDEEGAEHDPFYCFMESDWSSTSEAGKAELNEILGNDHGFDTVKPTRLLKTLIQSITNPGNNEIVVDFFAGSGTTGHAVMAQNSADGGNRRYVLVQLPEPLDPENKDQKTAANFCDQIGKPRTIAELTKERLRRAAKKVKDDNTLFAGDLGFRVFKLDSSNIRAWEPNRDDLEQTLLDHAEHIVSGRSEQDILYELLLKLGLDLTVPIEQKPIAGKTVHSIGAGALLVCLSDTIDRDAIEPLAQGIVAWHNELKPAVDTRLVFRDSAFADDVAKTNLTAILQQQGLDDVRSL

SEQ ID NO: 3082 - protein, 668 aa, Acidovorax avenae citrulli AAC00-1
MTNSNMQKIVATAPETQSADLVAGNIAQLKALFPELVTEGSKGVAINLDVLKALVGDAKVTDAEEKYGLNWHGKRRARQLALTPSTGTLRPCPEESVDWDSTQNLMIEGDNLEVLKLLQKSYAGKVKLIYIDPPYNTGKDFVYPDNFQNGIQNYLELTGQTESGVKVSSNTEASGRFHTDWLNMMYPRLKLARQLLKEDGAIFVSIDDIELPRLKIALDELFGEDNLIAQFVWRSDGNFDNQAKVKVCHEYIVAYAKSAPNFAHPPVVDPSTPTDSKIFRPQIRNTIVKNGPKNPPSEILLPAGFPADFDDGVIEGRTEGWPIYKGAAVIRGGRLIAPALVESGWSSKDLLLEFVANGCLPIFDGKGQSTSFVISRTGAIEVIKERTDTKSHVISVLTGFGGTQKATSQLEELGAFFNGYPKPLELIRYLTKMVPGNDGIFLDFFAGSAPLGHVIYEQNAEDEGTRRFVLVQLPEQLSPDSDVQKAAVAYCDKLGKPRTVAELTKERLRRAAKKFSANKGEATGDNGFRVFKLDTSNVKGWTTQVPDLNQALLEHQEHLLPNRTEQDLLYELLLKLGLDLCVPIQQQMIASKSVHAVGAGVLLACLAEGITAAEVETLAEGIVQWHQQLAPVGDTTCVFRDSAFADDVAKTNMAAILQQHGIQNVRSL

SEQ ID NO: 3083 - protein, 610 aa, Clostridium thermocellum ATCC 27405
MIETTLTGKTPDIGEENIKKLMTMFPEVVTEGKVDFEKLKQLLGEYVDDSNERYNFTWNGKGRALRLSQTPSLGTLRPCKEESKNWDTTQNLYIEGDNLEVLKLLQKSYYGKIKMIYIDPPYNTGKDFVYRDDFHDSLENYKRITGQVDGNGKAISTNTETSGRYHTDWLNMMYPRLRLARNLLSDDGVIFISIDDNEVDNLKKICNEIFGEDNFIANCVRKRRDSQANLSQNISPIHEYVLIYAKRFGNILNKVTPSLDMGSYKNPDNDPRGPYTTMPCTNVGGAVYSIVTPTGKTITDEWRFKKETFEKLLLDNRIVFPRNGEGKPRYKIFLSEKMAEGVLANTWLDKIASNQEGTREIKELFGGLLFNNPKPTGLLKFLLELGSSKDSIILDFFSGSATTAHAVMQLNAEDGGNRRFIMVQLPEPTDENSEAYKAGYMNISEIGKERIRRAGEKIKEEYKDKGNIENLDIGFKVFKLDTSNIRKWQPDYDNLEQSLMDYVDNFVEGRTELDVVYEIMLKYGLDLTYPVDEFTIAGKKVYSIGYGMLMICLDNEITTEVAKGILTKIKELSPESSRVVFKDNGFKTDSNKTNIKEILKSGGIEEFITI

SEQ ID NO: 3084 - protein, 661 aa, Delftia acidovorans SPH-1
MEKLTAASPEAQSADLVAANIEQLKALFPELITEGADGVAVNVDVLKALVGDASVTDADEKYGLNWHGKRRARQLALTPSTGTLRPCPEDSVDWETTQNLMIEGDNLEVLKLLQKSYAGKVKLIYIDPPYNTGKDFVYPDNFQDNIKNYLELTGQVEGGQRISSNTEASGRFHTDWLNMMYPRLKLAKNLLLDSGLIIISIDSSEATNLRLIMDEVFGQENFIGLLPTIMNLKGNNDAFAFADTHEFTVVYARNKEKCVVFQLPVSEESLDDWLEDERGLYKRADTLRRTGQDASRERRPNGWFPVFIDEKGEVYATLDDEPRSGSDLTLWPVSEAGEELSWTWSKKKINDENFNLIVVEGRSGKNIYKKQRATLGDLPTSKPKSILYKPEYSSSNGTAEISSLLGSNVFDSPPKPRSLIRDFVTIGTSPQDIILDFFAGTGTTGHAVMAQNFLDEGNRRFILVQLPQYLDPEDKGQKNAAEFCDQITKPRSIAELTKERLRRAGTKIKAESSGWQGDTGFRVFKLDTSNIRVWNPKPDDLEATLFDHQDHLLEGRSEADVLYELLLKLGLDLCVPIEQRNIEGLHVHAIGGGVLLACLAETITREQVEPLAQGIIGWHKALAPAGDTTCVFRDSAFADDVAKTNLAAILEQHGIQNVRSL

SEQ ID NO: 3085 - protein, 637 aa, Natranaerobius thermophilus JW NM WN LF
MKKFNGESKDIVAENISKLKELFPEVESEGKIDFERLQEILGEYIEDKEEKYRFEWNGKSKAIKLSQTPSTGTLRPCKEESKNWDETENLFIEGDNLEVLKLLQKTYHSSIKMIYIDPPYNTGGDFVYEDDFQDNLNNYLKITGQINEEGKKNSTNTENGGRFHTKWLNMMYPRLKLARNLLNDQGVIFISIDDNESGNLWKVCNEIFGETNFVAEITVIVKTEGRRYGFFAKSHEKIYVYAKNIDNLALNEIDIKGKKFTYRDEFGGFNIKELRNQNTRAFNSSNRPNLRYPFYVNTDNVDENGFMEVSVDYQEGWEEVYPMITNGLKSVWRWGKESARQQENKNLVARRGRDGIIRIYQKYRKLTEIPKTVWKDKEIISIKGTKEVQELLGSGIFDFPKPVKLLSDIITIATDQDSIILDFFSGAATTAHATIKKNAEDGGTRKYIMVQLPEKSDEKSEAYKAGYKNISEIGKERIRRAGEKILDENKDKEGIENLDTGFKVFKLDSSNLKEWNPDYDNLEMTLEDMVENFVDGRTEEDVVYEIMLKYGIDLTFPIETTEIDGKKVYNIGFGALFVCLDDEITLNVVKSIAKLKEDIDPEITRVVFKDNGFQSDAAKTNAIEILKRHGIEEIMSI

SEQ ID NO: 3086 - protein, 643 aa, Pelodictyon phaeoclathratiforme BU 1
MTEHEEATIKPLTANDPEAQSADILAGNIEQLKTLFPEAFTEGKIDFEVLRQLLGGTVEEREEKYGLNWHGKRKARQLALTPSTGTLRPCPEESVDWETTKNLMIEGDNLEVLKLLQKSYSGKVKLIYIDPPYNTGKDFVYPDNFQDNIKNYLELTGQIEGGRKISSNTEASGRFHTDWLNMMYPRLKLARNLLREDGVIFISIDDGELDNLRKLCAEVFGDENFVVQIIWRKRSTPPNDKIIGANHDYILCFAKNAISVKLQHRERSADQIARYKNPDNHAKGPWAPGDLMANIKGGRFVKSLNFPIVNPQTGEEHFPGNNGNWRFSRETIATLLANNEIYFGENGRGKPKLKRFLCEVKEGVTYPSIWDFVPLNTSGSNEMGAIFGNPTIFESPKPVGLIQELVALGCEPNGVVLDFFAGSGTTGHALMAQNVIDGGNRRYILVQLPEQLYLENNEQRVSGDYCDQIGKPRTIVELTKERLRRAARKIKDENPLFPGDFGFRVFKLDSSNINTWEPDRDNLELTLLNSIEHLKGDRTEADIFYELLLKLGLDLCVPIEKRTFAGKEVHSVGGGVLLVCLATHITPDEVEPLAQGIVAWHKELAPAGETTSVFRDSAFADDVAKTNLAAILQQHGLEIIRSL

SEQ ID NO: 3087 - protein, 651 aa, Acidimicrobium ferrooxidans DSM 10331
MKKLTPADPEARSDDLVAENVAKLKALFPELITEGPNGAAVNVDVLKQLVGDATVTDCDEKYGLNWHGKRQARQLALTPSTGTLRPAPEDSVDWDTTQNLVIEGDNLEVLKLLQKSYAGKVKLIYIDPPYNTGKDFVYPDNFQDSIKNYLELTGQVEGGRKISSNTEASGRFHTDWLNMMYPRLKLARNLLREDGVLFISIDDGEIGHLRTLCDEVFGAENFCGVIKRRAARKTAFLRKRMTDMCDYVVAYVRSDAAAPLSAGQVSDGTRPVFNEGNTVSVRVLRSGAIAKCGDGTYNAGTYAARSLSFELLDDLKVTDGRVARDVRIRGPWRINQETLDRTLFVTRNLGLRRTMLPEELDQAKLLNDLLDDNTCYNEKGSEELQQLFEATVFNNPKPRGLIEYLASAAGVKEKELVLDFFAGSGTTGHAVMAQNAADGGNRRYILVQLPEPVDPENKEQKVAADFCDKLGKPRNIAELTKERLRRAARKIQDENPQFAGDLGFRVFKLDTSNIRAWNPKPDDLEAELFAHQDHIVEGRSEADILYELLLKLGLDLCVPIQEKEVKSQGTEGKKYTVYAVGYGVLIACLSEEIAVDDVEALGQGIVGWRKELAPAGETTCVFRDSAFADDEAKTNLAAILNQNGIANVRSL

SEQ ID NO: 3088 - protein, 397 aa, Maricaulis maris MCS10
MLAVVDCVGHGSNQHEVTATGDLFEMLGDQPRKLVRGSSDERFDAIYVHVTETDDVIADTGKLSWYDSRANQPHRGPEWRLYYQANDITRAMKPGDQLFIVVLPDRTIGFLACDRDSSFQGLVEAIFRVQHSKSEQMVIIPVSPDTSSPADYFTFQLLDALGIEPDIPPDFDAASVVAQFKGTFPPTATFSTLARETLPGLDPRDDPDKVLLAWIDREEAMFRALERGIVGDRLMLGFLDSRGEPDVDAFLKFSLSVQNRRKSRAGHALMNHFSKILRAFEIPFTPEATTEKKGAADFLFPSEAAYADPGFPSANLRMVAAKTSCKDRWRQVLAEADRIKPKHLLTLQPKISLAQTTEMTDQGIILTLPSPIHSSFQDDQRASLLTVADLLQELASL

SEQ ID NO: 3089 - protein, 411 aa, Halorhodospira halophila SL1
MIDSISELFEGAAAKWLSAVDAEPDRSNQHEIGGLPSAGFRSHLGEPSKNDVARFPATMAYLGDHEPPEIVRDTVSWYDCRWKQAHRSPEYRLYYRSNSVTLRLSAGDLMVIAKARDGSLLIVFAPAESDVEAQVRQVFGFGEMGQRFQAARMPPSSLTLPLKLLLEDVGVEAFEPDDAADDLELVLNRFPERFPSTAEFSALAREVTQGDPVGEPDRTLLAWMEREEALFRAYEREIVQERLERGFAGDVDEFIRFSLSVHNRRKSRVGHAFENHLTELFERHGLRFEKGGVNRVTENKSKPDFLFPGFTEYHDPQFPNSRLFLLGAKTTCKERWRQVLAEGERLKRKHLATLEPGISRTHTDEMSAHGLQLVVPLPIHATYSETQRMKIMGIQDFISHVRPKVFKTRPG

SEQ ID NO: 3090 - protein, 411 aa, Rhodobacter sphaeroides ATCC 17029
MRYGSLSDHFTGIVAKRLSTVEADTARSNQHEFNGTNELRRLLGGERIERRPSRFIWLGGENEGITDDAPVTWYDARERHPTRSEWRLYFQANAVTEVAQAGDLLVVARRPSGDLMFIVAPQSSTLENQIAWLFGLDHGLGAGFRYEGFEGAGDRGLDFVSNYVLEEIGIEPEVPEADRLDEIVGRFGAQFPSSRTFSALARQNLPEVDPRDDADAALLAWIEFEEALFRRLERHIVAARLEVGFLTDGTADVDGFLQFSLSVQNRRKSRMGLSLENHVEEMLTVLGLRYARGARTEGNSKPDFLFPGVAEYADPGYSADRLSMLGVKSTLKDRWRQVLAEAARIDRKHLLTLEPGISTHQTNEMIRHSLQLVVPRGLHTTYTPEQAGWLMTVRGFLNLVAAREAARPYRE

SEQ ID NO: 3091 - protein, 412 aa, Acidiphilium cryptum JF-5
MALTDLVGWMDEYGVPGAVWFAKRLAANDTLATGAHGAGPYIPKEFLFSVFPDLNHPEEENPDCWFDLYIDSHADRRRIRAIWYNNRLRGGTRNEARLTNFGGGRSALLDPDSTGALAVFAFLPHGPGRQMECHVWVCDQGAEADLLEERIGPVEPKAPVVWQPGEIARDLFMHTDAGPGSCRLLPGEIPPAWLTRFPTGEEIIRETVKRRQRNGLEPDRLLMRRRECEFEIFLSVEEAVYLPRIRQGFSAIGDFLSLAQTILQSRKTRSGTSLELHVREIMTEEGLLADTSFTYRPVIENGKRPDFLFPSKAAYDNPAFPAERLRMLAAKTTCKDRWRQVLNEADRIATKHLLTLQEGVSEGQFREMSEAGVRLVVPAELHRSYPASVRPHLVTFENFIGDVRPLSAIQGP

SEQ ID NO: 3092 - protein, 404 aa, Serratia proteamaculans 568
MSDFQNWLTEKSSDNWYIHIKRLSANDTGASGGHQSGVYLPNNSANFLFPSINRIDEENPSVGLTAKIISHEVNDSQVRAVYYNSKLRNLNPKGRNETRITCWGGQKSPVQNQNNTGAIAIFAFYTPENLKDCGLVEAWVCCTVEEEDLLEAIIGEVLPGTARSGPSAQILGGFAIDDSDWKSHNYSIPDPWKVTFPSGSDIIEYLPNIFKFKGDTPDKLLLERREKEYSLFRQIEEIHVLDKIKKGFNSVEEFIELANSVSNRRKSRSGKSLEMHLEKIFLANGLTTFTTQSITEGKKKPDFLFPSGIEYHNPAYPAENLRMLAVKTTCKDRWRQAINEANRINNIHLFTLQEGVSANQFQEMKDAGVTLVVPEPLHKKYPEKIRSELVSLSDFISETLAIYT

SEQ ID NO: 3093 - protein, 464 aa, Pseudomonas putida GB 1
MAKMKHSTAFVPDLFTEPEAEASDFLTSLLDKSDSLYVKKLSVNDRDWARLSNKRQAGIYVPSTERDGNFFPPLATKERDKAEAAEIRETYFEIEWPTVGQVKRARLVHYTSKGEETHLTGLPKPPFRDAPPASLLVVGKSGGRYKALVVDSESDEYEVVHDVLSLPPDFHSEIFITTVVRREREEKTVSFIEEVVRAFFDGTFPELASRYGAMPTTSELAAAARNRYLGENRLRSLDPYAMCKPGDALRAISRGLEYEIFKDYQIKARSIDLARMILGDDPSKASLERVLRAVVLDFPKIDALLLSAAQQRKSRAGYSFEHHIDAMLADAGVPFEKQVVLEARKRPDFILPSKAMYESSTRQHCEALVLSAKTTLRERWKQVKGEMRDCDLYLATVDESIAVNAIKDMASQGIRLVVPESLKSSDTTEYKAQDSVLSFKDFFENDIAARRKLWIANGIFATGV

SEQ ID NO: 3094 - protein, 403 aa, Geobacter lovleyi SZ
MNHGHLSQYFSAVACKPLSAVEADLCRSHQHELNGVEALIKMFGRATEKHTFQASFMYLCDHDDEPVVADGYVTWYDSRLKNTTRTEHRLYFPTTAVSMCAAEGDLLIIGKRTDNSVMIIIAEAESTIASQVSWLFGFGVDVHPGFSVRSELECEQNRIEFASRIILEHIGVQVEEVAENYLDEMLRLFGGKFPNTRDFSEYARASLIDIDPRDGADAALMAFVEREEILFRTLERHIIGDRLQVGFVDDVDGFVTYSLSVQNRRKSRAGSSLENHLEVIFNAQGIQYTRTPVTENNEKPDFIFPDIIHYRDPDFDVSKLTMLGVKSTCKDRWRQILSEADRIKSKHLLTLEPGISENQTNQMKRSNLQLVVPSALQRTYKTEQQTWLLTFDDFIRLLRIRQS

SEQ ID NO: 3095 - protein, 512 aa, Pseudomonas syringae pv B728a
MILHTNDYLEYYLTLVGWLINGGIWNMIEDSGLFAAPFAAIVISEWLRARGEGADEGNKGVLSLARVENRFYTAILVIILACMPLVNVSIDTIQFDRSRSEQCQYSIPNPTDTGWETSFSTLNGKSATVPVWWLFVHAMSKAATAASVAAIPCGVDLQQVRMDVNKARINDPLLAQEVADFTNDCYARARAKLFMTQPTLSNDQLNDVNWIGSHFFLQTSGYYSDGFSGFRSHTPRTKWPYDATRDAGLPQTTGGGGFPTCTQWWSDGSVGLRARLLEQVSPDLLSKLAQWAKFMTQTEVSDSVIRDLVSPRKQQLTQGQVYSDYGGQVGGSVLNDFTRIAATAGQAAGSLVMYPAMDSVRQAAPMVMAFLKMALIICIPFVLVIGMFDLKVVMTITFAAFALIFVDFWFQLARWVDSTILDALYGNGIGSNVPHSNFDPVFGASNAQGDLLLDFVMGAMFIALPGFWVVALGWSGMQLGSLMTGLTIGTNGAKDAGGKGADVAMGIAKGRI

SEQ ID NO: 3096 - protein, 505 aa, Burkholderia xenovorans LB400
MTLFTTDYLEYYLTLVSWIVNNGIWAVLVSSGVFALPFVAIVIQEWLKARAEGADEGNKGVLSAARIENRVFVAIVVVMFAGIPFIDVDLSTIQYDSSRSAQCQVSVPQPAQTGWSQSFSTINNQSAKVPVWWAFMHALSRAVTSASVAAIPCGTDLRQMRMEIDATRIDDPVLAQEVADFSRDCYGPARAKLFMQRPDLDEQQMHDVTWIGSRFFTDTGGYYDSYRSSTAREAWPYDDTRDAGLAQVTNGGGYPTCKQWWSDGSNGLRARLLGQVDPSLLNRLAGWAGFLSRAEVDDSVIRAIASPRQQKLNQGSVYTDYGGQIDKTLPNVVNRATSDVGLAVGALAAFPAMDVVRQALPMVLALLKMALVICIPLVLVVGTYDLKMVVTVSTVQFALFFTDFWFQLARWIDSTILDALYGWGFGWNRPHTNFDPLVGLNNAFGDMLLMFVTGTMFLVLPTFWVAALGWVGVKAGVIAQNLAVGSKEARDSAGSGVNKVTGKVL

SEQ ID NO: 3097 - protein, 515 aa, Cupriavidus metallidurans CH34 uid250
MTLFTTDYLEYYLTLVSWIVNNGIWAVLVSSGVFALPFVAIIVQEWLKARAEGADEGNKGVLSAARIENRVFVAIVVVMFAGIPFIDVDLNTIQYDSSRSAQCQVSVPQPSNTGWSQSFSTINNQSAKVPVWWAFMHALSRAVTGASVAAIPCGTDLRQMRMEIDATRIDDPVLAQEVADFSRDCYGAARAKLFMQRPQLDEQQLHDVTWIGSRFFTDTNGYYDTYRSSTPREDWPYDSTRDAGLAQVASGGGYPTCRQWWADGSNGLRARLLGQVDPSLLNRLAGWAGFLSRAEVDDSVIRAIASPRQQKLNQGSVYTDYGGQIEMTDPNIITRAAADVGLAVGSLGYFPSMDAMRQALPMVLALLKMALVVCIPVVLMVSTYNLKTLVTVSVVQFALFFVDFWFQLARWIDSTILDALYGWGWGWNRPHTNFDPVMGLNNAFGDMLLNFVMATMFIVLPLFWVTALGWAGYAVGGMLQGLAAGTAGAKAAGGKAADMAFGGAMKWASTPSKRK

SEQ ID NO: 3098 - protein, 505 aa, Acidovorax sp. JS42
MTLFTTDYLEYYLTLVSWIVNNGIWAVLVSSGVFALPFVAIIVQEWLKARAEGADEGNKGVLSAARIENRVFVAIVVVMFAGIPFIDVDLNTIQYDSSRSAQCQVSVPQPTDTGWSQSFSTINNQSAKVPVWWAFMHALSRAVTSASVAAIPCGTDLRQMRMEIDATRIDDPVLAQEVADFSRDCYGPARAKLFMQRPQLDEQQMHDVTWIGSRFFTDTNGYYDTYRSSTPRDDWPYDSNRDAGLAQVSSGGGYPTCRQWWADGSNGLRARLLGQVDPSLLNRLAGWAGFLSRAEVDDSVIRTIASPRQQKLNQGSVYTDYGGQIDKTLPNIVTRATGDVGMAVGALAAFPAMDVVRQALPMVLALLKMALVICIPLVLVVGTYDLKTVVTVSVVQFALFFTDFWFQLARWIDSTILDALYGWGFGWNRPHTNFDPLVGLNNAFGDMLLMFVTGTMFLVLPTFWVAALGWVGVKAGVIAQNLAVGSKEARDSAGSGANKVAGKVL

SEQ ID NO: 3099 - protein, 507 aa, Acidovorax sp. JS42
MTLFTTDYLEYYLTLVSWIVNNGIWAVLVSSGVFALPFVAIVVQEWLKARAEGADEGNKGVLSAARIENRVFVAIVVVMFAGIPFIDVDLNTIQYDSSRSAQCQVSVPQPAETGWSQSFSTINNQSAKVPVWWAFMHALSRAVTSASVAAIPCGTDLRQMRMEIDATRIDDPVLAQEVADFSRDCYGPARAKLFMQRPQLDEQQMHDVTWIGSRFFTDTGGYYDSYRSSTAREAWPYDDTRDAGLAQVANGGGYPTCRQWWSDGSNGLRARLLGQVDPSLLNRLAGWAGFLSRAEVDDSVIRAIASPRQQKLNQGSVYTDYGGQIDKSLPNIVTRAAGDVGMTVGAIAAFPAMDVVRQAVPMVLALLKMALVICIPLVLLVGTYDLKTVVTVSVVQFALFFTDFWFQLARWIDSTILDALYGWGFGWNRPHTNFDPLVGLNNAFGDMLMMFVMGTMFIVLPTFWIMALAWAGVRAGNVLQGLAGATADAKAAGGKGGSIAINAVAKK

SEQ ID NO: 3100 - protein, 507 aa, Acidovorax sp. JS42
MTLYTTDYLEYYLTLVAWVVNNGIWSILVASGVFALPFVAIVIQEWLKARSEGADEGNKGVLSSMRIENRVWVAIVVIMFAGIPFIPVDLATIRFDTTRSAQCQVSVPLPNDTGWSNVYTALNDQSALVPVWWFFMHALSKAVTGSAVAAIPCGTDLRQIRMDVDATRIDDPVLAQEVADFTHDCYGPSRAKLFMNRPTLSDEQMNDVTWIGSSYFLDTPGFYDTYRAKTPRTAWPYDATRDAGLAQVDSGGGYPSCRQWWADGGQGLRSRLLAQVDPDLLTRIGRWAGFLSQSEVNDSVIRAVVSPRQQKMNQGAVYTDYGGQIDKTLPNVVTRGASDLGLTVGSLAFFPAMDVVRQALPMVLTMLKMALVICIPLVLLIGTYDLKTVVTVSCVQFALFFVDFWFQLARWIDSTILDALYGWGFGADRPHTNFDPLIGLNNAFGDMLLNFVMAMMFIVLPGFWVAALAWVGVRVGNISQMLSAATDGAKSAGGKGADLAIKAAKAK

SEQ ID NO: 3101 - protein, 507 aa, Methylibium petroleiphilum PM1
MTLYTTDYLEYYLTLVAWVVNNGIWSILVASGVFALPFVAIVIQEWLKARSEGADEGNKGVLSTMRIENRVWVAIVVIMFAGIPFIPVDLATIRFDTTRSAQCQVNVPLPNDTGWSNVYTALNDQSALVPVWWFFMHALSKAVTGSAVAAIPCGTDLRQIRMDVDATRIDDPVLAQEVADFTHDCYGPSRAKLFMNRPTLSDEQMNDVTWIGSSYFLDTPGFYDTYRAKTPRTAWPYDATRDAGLAQVDSGGGYPSCRQWWADGGQGLRSRLLAQVDPDLLTRIGRWVGFLSQREVNDSVIRAVVSPRQQKMNQGAVYTDYGGQIDKTLSNIVTRGASDLGLTVGSLGFFPAMDVVRQALPMVLTMLKMALVICIPLVLLIGTYDLKTVVTVSCVQFALFFVDFWFQLARWIDSTILDALYGWGFGADRPHTNFDPLIGLNNAFGDMLLNFVMAMMFIVLPGFWVAALAWVGVRVGSISQMLSAATDGAKSAGGKGADLAIKAAKAK

SEQ ID NO: 3102 - protein, 507 aa, Parvibaculum lavamentivorans DS-1
MTLFTTDYLEYYLTLVSWIVHNGIWAVLVSSGVFALPFVAIIVQEWLKARAEGADEGNKGVLSAARIENRVFVAIVVVMFAGIPFIDVDLNTIQYDSSRSAQCQVSVPQPTGTGWSQSFSTLNNQSAKLPVWWAFMHALSRAVTGASVAAIPCGTDLRQMRMEIDATRIDDPVLAQEVADFTHDCYGPARAKLFMQRPNLDEAQMHDVTWIGSRFFTDTAGYYDNYRSSTPRDDWPYDSDRDAGLAQVSSGGGYPTCRQWWADGSNGLRARLLGQVDPNLLTRVAGWAGFLSRAEVDDSVIRTIASPRQQKLNQGSVYTDYGGQIDKTLPNVITRAAGDVGMAVGGIAAFPAMDVVRQALPMVLALLKMALVICIPLVLVIGTYDLKTVVTVSVVQFALFFVDFWFQLARWIDSTILDALYGWGWGWNRPHNNFDPLVGLNNAFGDMLLNFVMGTMFIVMPTFWVMALAWAGVRAGNVLQGLAGATGDAKAAGGKGGGIALNAVSKK

SEQ ID NO: 3103 - protein, 507 aa, Serratia proteamaculans 568
MMTNSYLEYFLTLLGWLINNGLWELLVSTGLFVLPLLFKVAAIWLKVREEGEDEGNKGMLSLPRIENLLYGAFFVMLTCCLPLMNVSLDTIKYDSSRAATCGTWTPKKPDETGYANIMSSMNGQTAKVPVWWLVVHKLSKGITSAAVATIPCRPDLRQVRFEVQHSRVNNPALAKELQDFTNDCYALALYTWQNRDQGQTTDKATLRDIEWLGSKTFLNGGYYNNLQSKTPRASFPWNEARDSGRPNTGRGGYPTCSEWWSAGEKSLEVRLVKQVDPGVMLRMSAALKMMGQSDADYKEAVVRRLVSPDNLTISQGGRAYAGYGGNADFTLDNSVNRIASMGGTALGSLAAYPAFDAMRQALPMVQAVLLMAVYIMVPLILAFAAYEYKTVITVTFVVFALNFLTFWWELARWLDSWLLEALYDSDTHSRWNVAGFQNSTDDVIMNLVMGCMFIVLPIVWMGALSWAGVNVGHAIASAVNSGTETAKNTGGKFGDTAGNIIAGKATQ

SEQ ID NO: 3104 - protein, 507 aa, Delftia acidovorans SPH-1
MTLFTTDYLEYYLTLVSWIVHNGIWAVLVASGVFALPFIAIIVQEWLKARAEGADEGNKGVLSAARIENRVFVAIVVVMFAGIPFIDVDLNTIRYDSSRSAQCQVSVPQPTDTGWSQSFSTINNQSAKVPVWWAFMHTLSRAVTGASVAAIPCGTDLRQMRMEIDATRIDNPVLAQEVADFSRDCYGPARAKLFMQRPNLDEAQMHDVTWIGSRFFTDTGGYYDTYRSSTPRDDWPYDSNRDAGLAQVASGGGYPSCRQWWADGSNGLRARLLGQVNPSLLNRLAGWAGFLTRADVDDSVIRTIASPRQQKLNQGSVYTDYGGQIDKTLPNIVTRATGDVGMAFGAIAAFPAMDVVRQALPMVLALLKMALVICIPLVLVVGTYDLKTVVTVSVVQFALFFVDFWFQLARWIDSTILDALYGWGFGWNRPHSNFDPLVGLNNAFGDMLLMFVTGTMFIVLPTFWIMALAWAGVRAGNVLQGLAGATGDAKAAGGKGGSTAISAVPKK

SEQ ID NO: 3105 - protein, 506 aa, Thauera sp. MZ1T
MTLYTTDYLEYYLTLVAWVVNNGIWSILVASGVFALPFVAIVIQEWLKARSEGADEGNKGVLSSMRIENRVWVAIVVIMFAGIPFIPVDLATIRFDTTRSAQCQVSVPLPNDTGWSNVYTALNDQSALVPVWWFFMHALSKAVTGSAVAAIPCGTDLRQIRMDVDATRIDDPVLAQEVADFTHDCYGPSRAKLFMNRPTLSDEQMNDVTWIGSSYFLDTPGFYDTYRAKTPRTAWPYDATRDAGLAQVDSGGGYPSCRQWWADGGQGLRSRLLAQVDPDLLTRIGRWVGFLSQREVNDSVIRAVVSPRQQKMNQGAVYTDYGGQIDKTLPNIVTRGASDLGLTVGSLGFFPAMDVVRQALPMVLSLLKMALVICIPLVLLFGTYELKALVAVSCVEFALFFVDFWFQLARWLDSTILNALYGWGFGASRPHSNFDPLIGLNNAFGDMLLNFVMATMFLVLPSLWVTALGWVGVRAGGMLQGLANGTRDAGQAGGKGSNLLISAAKK

SEQ ID NO: 3106 - protein, 506 aa, Thioalkalivibrio HL EbGR7
MTLYTTDYLEYYLTLVAWIINNGIWNVLVASGIFALPFLAIVVQEWLKARAEGADEGNKGVLSSMRIENRVWVAIVVILFAGIPFIPLDLSTIQFDRTRSTQCQVNVPLPSETNWSTSFTTMNNQSAHVPVWWFFMHSLSKAVTSAAVAAIPCGTDLRQMRMEIDSTRIADPVLAQEVADFTHDCYGPARARLFMSRPTLSEEQMNDVTWIGSRFFLDTAGFYDTYRSRGPRDAWPYDDTRDAGLAEVSTGGGYPTCRQWWADSGDGLRDRLLAQVDPGLLSRLGQWAGFLSQAQADDAVIRAIASPRQQVMNQGHVYTDYGGQIGMTLPNVATRVVSDVGLTVGSLGMFPAMDVVRQALPMILSFLKMAMVICIPLVLIFGTYDLRTVVTVTAVQFSLFFVDFWFQLARWIDSTILNALYGWHSPHSNFNPLMGLNNAFGDMLLNFVMATMFIILPGFWVVALTWAGVRTGNILGGFITGTTDAKSAGSSGSRLAMAAATKGAAK

SEQ ID NO: 3107 - protein, 521 aa, Azotobacter vinelandii DJ
MTVTLYTNDYLEYYLTLVGWLVNNGIWNLISDTGLFAVPFIVIVAREWLKVRQEGADEGNKGVLSLARIETHLYVGYMVVSLAGIPAVHVGLDTLQFDQERAQQCQTTVPAPADTGWSTTFSSLAGKSAQVPIWWAFMHALSKGITSGAVAAIPCGTDLRQMRMEVDATRIANPLLAQEVADFSHDCFGPSRARLFMRQPDLGAMANDAKALQDLNWIGSRFFLDTAGYYDTDYSKTPRAAWPYDAKRDVGLPQVTGGGGYPTCKQWWSDSGKGLRARLQAQVAPDLLTRFQGWANWLSQEEVTDAVIRELVSPNRQLAGAVYSDYGGRAGEGQTISHALTRTLGTIGIITGATEYFPGVDIVRQGLPMVLAFLKMAMVICLPMVLLIGAYQLQVAMTMSVIYFAIMFVDFWFELARWVDSTILDALYGSGLQSLTFDPLIGMQNESQSILLNYVIGAMFIILPMFWVGALGWAGIQAGKVLEGLSDGTKAAQNAGTKGFGVVNDTYSGAKSGFNKGKKGD

SEQ ID NO: 3108 - protein, 505 aa, Ralstonia pickettii 12D
MTLNTTDYLEYYLTLVGWIVSNGIWNILVASGVFALPFVVIVVQEWLRARAEGADEGNKGVLSSMRIENRVWVAIVVILFAGIPFIPVDLSTIKFDTTRSAQCQVSVPQPTDTGWSNAYTTLNNQSALVPVWWFFMHAISKAVTGGAVAAIPCGTDLRQMRMDVDATRIDDPVLAQEVGDFVHDCYGPSRAKLFMSRPALSDEQMNDVTWIGSSYFLNNAGFYDTYHSNTPRTAWPYDATRDAGLAQVDSGGGYPTCRQWWSDGGSGLRARLLAQVDPDLLTRIGRWAGFLSQAEVNDSVIRAVVSPRQQKMNQGSVYTDYGGQIEKTLPNVVTRGAGDLGMTMGSLGFFPAMDVVRQALPMVLSLLKMALVICIPLVLVFGTYELKALVAVSCVQFALFFVDFWFQLARWLDSTILDALYGWGFGANRPHSNFDPLIGLNNAFGDMLLNFVMATMFIVLPTFWVAALGWVGVRAGTAIQGLAAGTRDAQAAGGRGAGVAMKAAK

SEQ ID NO: 3109 - protein, 507 aa, Dickeya zeae Ech1591
MTLFTTDYLEYYLTLVSWIVHNGIWAVLVSSGVFVLPFVAIIIDEWLRARTEGADEGNKGVLSSMRIENRVWVAIVVVMFAGIPFIDVDLNTIRYDQARSAQCRISVPQPEDTGWSKSFSTLNNQSAKVPVWWAFMHALSRAITSASVSAIPCGTDLRQMRMEINATRIDDPVLAQEIADFTHDCYGPARAKLFMTRPNLDKTQMHDVTWIGSTYFVSTAGFYDTYHARTPREGWAYDSHRDAGLAQVPSGAGYPSCRQWWSDGGNGLRARLLAQVDPSLLNRIAGWAGFLSRTEVDDSVIRTIASPHQQKLNQGSVYTDYGGQIDKTLPNIVTRAAGDIGMTVGGLAAFPALDVMRQGLPMVLALLKMALVICIPLVLLVGTYNLKTTITVSVVQFALFFADFWFQLARWIDSTILDALYGWGWGWNRPHGNVDPMAGLSNTFGDMLLNFVMGTMFIVLPTFWIMALAWAGVRAGNVLQGFAGATADAKAAGAKGGDMVLKSVSKK

SEQ ID NO: 3110 - protein, 274 aa, Methanosarcina barkeri fusaro
MAWSLYRVSLRLLSPVHIGWKKTDNLQQTRPYVPAKTMWGALTARLARDSGSFNYEEVGNEVAENLRFSYFYPTIINNEIGKVPTKIDIFPWENIDDFSWKYLNSSQNTALNQKTAEEGSLHETENISHKTRNGDSVYLLGYIFEKEGFDLKWKESLKKIQIGGERGYGWGNMEIIEISKLLEKIIFDGYAVNLSGDHPIINVIKENKYVLAHVITKNLNLNGLVEPFVGRETSKNKYFGGKYSNAEICWMPGSTVIKNEEFEILPTGLWRICI

SEQ ID NO: 3111 - protein, 277 aa, Roseiflexus sp. RS-1
MNWIGYRVVFRLHSPLHIGWRKVGNVQVTRPYLTGRSFWGALTERLARDTAAQKGQKATTSNDYHESGHQVNEYLAFTYFYPALQSGNDYQVVWPWDDERTFRRRFLSSYQSTALVYPEHSAAEGSLHEIEFLSPHTLDTADPVYLIGYVFAHKDCSLPWHDALTRLQFGGERGYGWGKTELVSLEKTDDAFSCTVDCSGRRPVITVPQDKRLLAHTKPDQIMIAGEVEPLVGREWHTNSGAGASITHFGVVYAPGGIATNEHCFAVESFGLWQKQP

SEQ ID NO: 3112 - protein, 275 aa, Roseiflexus castenholzii DSM 13941
MTWQVYHVIVRLRSPLHIGYRKVGNVQRTRPYVTGRALWGALTMRLTRDATAPATGSHAYQQIGDEVHQQLAFTYFYPALQSGNDYQVVWPWDNETLFRPRFLSSYQSTALAYPQHAAAEGMLHEVEYISPHTLDTGQPVYLQGYIFAKTDCTLAWQSALERLHIGGERGYGWGATELVQISPCEDDQLFGGVAQFQQSNNSFTISLPKDGRLLAHTKADNAAIIGNLEPLVGREWRSHGGAGQHIAFTGVCFSPGSVVATAQCFTVKEFGVWEA

SEQ ID NO: 3113 - protein, 298 aa, Thermotoga RQ2
MKEEKWILYSLVFQLKSPLHIGYHKIMHLTRTRLYVPARTLWGAMTVKLVQKTGRNDYKKAGQFLREKMRFGYFYFSNGKELFLPHYTEEGLKLGRMCLYEFEKKYIRSISTTAIDANSLSAEEETLHHLEYINYRNTEDSSPLFLEGLMWIKIDGHPKEDDFLFTYEDVQVKLSELLQSLQIGGERKYGFGETELVKLERLDDTDLRSKGFCGSWLESDESVKVTILQGNFIWAHAKYEPNLNMKGEIEIFMGREWDDKKGSGRNIVTHGLCWMPGSVVEEQATFEITPSGIWEVYK

SEQ ID NO: 3114 - protein, 267 aa, Chlorobium limicola DSM 245
MTWQKYELVFRMLAPLHIGYRTAGNLMQTRSYVPGRVLWAALTTRLTRDEENGTDGLRYIEIGQQVQDHFRFTYLYPATQNGNGYKTYYPWEKDFDYLFLNSYASTSLNYASQSAEEAMLHETEFIAPHTRTGQSVYLVGNVYTKTNLPTPLENWPKALEKLQLGAERGYGWGRVRTVSCDSQGERFYNEPVAELFDGHITAHLKAEKVSGIVGPVEPLIGWERNNDINRKSNWRLTEEAIICYVPGAKVTVDGNYIIGPNGVCGIN

SEQ ID NO: 3115 - protein, 287 aa, Prosthecochloris aestuarii DSM 271
MTAWKVFHVIFRLNAPIHIGCGKSGNLQRTYPFVTGRVFWGALTARITRNNPEALQQHGHRAYRLIGEQIHREITYTYFYPAVKSSLDFEVRWPWEDGFAARHIRTYASTALTYPEQQAEEASLHEIEYLSPVTCDTVEQVYLRGYVFVKESSTLEWQKALGQLQFGGERCYGWGDVETILNDEQTATPELFDGHAKFMDDDLPVIRLSDSSANHLLAHTEANCCQAHGQTEPLVGREWRSDNDVNRYAGQHIAFNAFCFRPGSTVASLPCQFQIGKYGIWKTKSPH

SEQ ID NO: 3116 - protein, 307 aa, Chloroflexus aggregans DSM 9485
MSWKLYRWVWRLEAPLHIGVTPAGLLNRTRLYIPARNIWAALTEELARRSSSASFPDYAGTGRQVQEAMRFSYLYPAEQVNGKWQAWLPQYKQNGNESGLIWCREDGGKSLPDRQFRQRILITRPSTAIDPSADSAAEATLRELECISPWWRQVNGQDSAHAVAMVGYVLCQDDQLHQDVMAIDEIFVGGDVRYGLGHLRRYDQPNEEQHLFGNQVNLQPPDAQSADPQSRAPQSAAPQSADPIVKTQRVLAHTLPNGNVSFIGRWTCIGGWDKGSMMSAHSAWEPGSFTETMHSFAIQKEGWWQRQ

SEQ ID NO: 3117 - protein, 277 aa, Chloroflexus aggregans DSM 9485
MTWQVYHVILRLRSPLHIGYRKVGNVQRTRPYVTGRALWGALTMRLTRDAIPQDAPATNSHAYQQTGDQVHQQLAFTYFYPALKSGNDYQVVWPWENETLFRRRFLSSYQSTALAYPQHAAAEGMLHEVEYISPHTLDTGQPVYLQGYIFAKTDCTLAWQSALKRLHIGGERGYGWGSMASKVWPINDKYLFDNSITYDVNGDRPKIRVPAGGRLLAHTRAANLSLNGNLEPLVGREWGSNGGAGQHIAFTGVCFSPGSVVAEERCFTVKEFGVWEA

SEQ ID NO: 3118 - protein, 1168 aa, Anabaena variabilis ATCC 29413
MNKALSDYFSLKRRYSRSINLERDFDKIESLQGYILTERSVDATKRILAGLTGKSENRAWTITSVYGTGKSAFAHFFVSLCAPLNSQSHQVALEIVIKTFGSDSSEYSAIQNTLPTQGLFRAVVTAQREPLSNTIVRALERGAETFWSRQQINKIKVARKLVDLGAQVADGKIIDSKEIPSLIREVANSASTGIVLVIDELGKNLEFAVQNQGAEDLYLLQQLAELPKDKDYQIYIIGLLHQAFADYSERLASIQRNEWSKIQGRFEDIPFKDSPTQMMRLIGKAIDQSKAINHQGIIAEQTKKWIENLPDEIKDDYTHEILADTYPLHPITALVMPMLCTRYAQNDRSLFTFLTSDEPYSFKSFLKETPIDNISLPVLKLDRVYDYFIEAVGSGLGSRPNLQRWIEIKNLIDDAKGKDIDSLRVLKTIGILNLVTTTGAMRATRTLVTMAMCDNILDKNKNHWEGVIENLLQKGIITYRRQLDELRIWQGSDFNVDIELTNYLERERSPLVNLISDIRPLKPIVAQRHSYQTGTLRYFERCYVDGLKDLTKLYCSSNDCDGLIAYWVDEVEPTHIPASTADGKPLIVLNPSRLDILRIRAREFAALKKIQTTAAELQSDGVARQEVRYRLTQAEKLLDETITQTFDVATNNICWFRGKKEKVNYITDFNAKLSDICDEIYHLGLKLRNELINRRELTSQGAKARRELIEAMLEKQDRERLCLEGFGPEVAMYYSVLSETGIHRQENGDWGLYSPYDKSGISTIWHAINDFCLQAKDKIQNLDKLYKILEAPPYGVKRGVIPVLIAAVLLYHVEDVGVYKDGTFIPVLGSEHFELLLKEPSRFGVKYFEVMGLRSQVFRELELILRQQNITKARGVRNSTLLVVVKPLFQFVKKLPSYTIKTKRLSNEALAVLQNLQKAQEPDELLFTSLPLACGLNPIVAGEEDDGTVAKTLRKKLVASLHEIQTAYDRLLSECQSLLYAAFSVRSGEEKLREDLRVRASYLSGQVLERRVRSFVQAAVDENATDTEWLEALLMIVADKPAESWTDEDATNFELKLSDLARRFKNLEALQKDSQTRTSEGFEARKITVTRPDGQETHSLVWFDNENQLQIDSVFEEILAILKKYDNPQLHQAVVAKLTERVLSVSFNDNNSQVRAKRKEREHEQKTS

SEQ ID NO: 3119 - protein, 1138 aa, Shewanella frigidimarina NCIMB 400
MALKMTESLITINQRYKSSTRIDGDSEDLRSFIDDFILHGTAVNVLDTVSREYDANAQRVYTITGPYGSGKSTVALFLSCLLSTDTKLREYATAKLQSSPVLLSEFKKRFAINIGWKTVKHVCGLESPANSILQSLYIALGITHDVNIIADLTDDECLSEIKLALSSTQSNDDGVLILLDEMGKALDYQSRANKDLHLFQALADVVQQANRPVLMIGFLHQAFSDYAKNKDAKTQQEWSKVQGRYRDLSFNPSIDESLILVGDSITRSAEISVKIESKYAKLVNVVSSTFANQNRNVGALTDTLPLDPIVSLLLGPVSRRRFSQNERSLFGFLASHEKYGFREFLEDNYTQPQDDLVLYRPEMYWDYLHHNLHHLIVTSHDSKAWLEGCDAIYRAEQKAEGSELHVSITKVISLLTIFGFHHQLHAKKDFLKKYFVNRGYKNTEIAKALDDLQTWTVIIYRQKHDALFVFQGSDIDINTLISERVEAVSQGVDWTSVCDLPQNILATAHYHKTGTMRWATTKLINKVEKSLLEQLCTEPKTGEAFLTFVLSVSPDVTEKFKEIASNLSHCVIGEYGDFSILQTAAIELIALKQILKDEQKITHDLIAKNELENRIIFAQQNVEKELQHIYKNAQWTHWNNPLPPSSPLTSLASVIAEEIYHKAPIVINELVNRSKPSGSANSAIRKLMNAMFVNGDKKDLGFDETSFPPEKGLYLSCLKSKGWHNYTPEGYLFPKTWSKETKDANPKMHALWQDGFTFIKENSTTAHVSIAQLYERWMLPPFGLTTGLCRIYGLALLKSLEGQIAFYDWDSTNQFIFIPELDEELVNKIYKHPHEAAVRYFEISDIQSHLLENLAQATIGNAKTDSAILNIAKHIVGIVHKLPSWVKKTSGESFSGSQQNGLTKEARDFRNKVIGASDPFKLILEDLPAVFGFDKNDPVLEDQLGYKLRTAIEDLSAQNDILYNGFKQIIIDTLGEEFNKNLKTRCEFVESIAKRPNVKELAKRIGQCINNPSKFEFVINLATGAPERNWTDKHLRNGLDELQNLCVQFRRIESFGNLQTKGSSKPLAFITTNSEGKHQEFGGFIQYDLEMDSDVLQVVEKIKSSFSDLSKEKQLAALTNLLTNLMEQSESGTEVVND

SEQ ID NO: 3120 - protein, 1111 aa, Polaromonas naphthalenivorans CJ2
MTEAKTKLSDIVRIARHYQRSIRIDIDYGRSDALNGYICHGTAVGVLDSMCKQLTSTNQRAFTWTGPFGGGKSSLAVALASAVGPSKSLRMRAREVLCLEKLPLFDEAFPFKKGWLAIPIVGKRTSIVQELSKGMRAALGLGSEEKKTSPTALIEDLCEAAESKQHDGVLIIIDEMGKFLEAAALGVGDDVYFFQELAEASARSAGKIVVVGILHQSFSQYATRLGIDTRDDWTKVQGRYADIPLVAASDEVVELIGRAIEVDKRPPWMFDASKAIADSIRTRRPAVGSDFANSLNACWPLHPAMAALLGPISKRQFGQNERSTFGFLASVEPFGFRSYLENTPLPEASWYRPDNYWDYLRANLEPAILASTDGHRWAQAVEAVERTEAKTSESIYLILIKSIAIIDLFRNGSGLAAEESVLVSVLYDRSKRKVEEALQQLSDWKVILYKKHISAWSVFEGSDFDIESAISQARGALPGVDFALLTSLTNLYPIIAKRHYHHTGTMRWMTMALCRLEDAERITTNFKPQKGEFGQFLLALPGRTAELTSAVRHSHEISRIAPWPMVVGVPPNHVRIEDFGAELLALQHVQSRHELSGDQVARREVQARLSSVRANLEEQLRAAVSKATWTAADLEPVEGSRLSHMASNLADVVYEYAPELWSELINRDSPSSNSVKGRRDLLYRMLTHEEEPSLGMEGFPAERGLYETLLKATGLHRKDINGMWGFMPPTKKDSPTFVKLWDETKKKFADINARVKASEIHEMWAAPPFGVRNGMVPVIFTAFLLAHKGNVAVYKDGIFIARMTDADIDEYLQDEKRFSLRWIVIDAEKTGILAGISEILAQVGAASGAKDPLEAARGLVALVVGLPMWSQRTHRISHEARLIRDTLLKAHDPHKVLFIDLAAILESSGGDSYVNALRGPIVEISGAYDALLKEIETSLLEALDAPADRLDRLQARAFAVEGVTGDLRQDAFAARLSKHDGTKESMEGILSLAANKPPRDWNDRDIDAAQLELAQAALRFRQAEAFVSVKGRKPTSEAFAVVMGAGAETITVSRAFSLSDRHRETVEAMADKLALELKSGGMDTNVLLAVLARAGMRLTVDDDTQKEKSHG

SEQ ID NO: 3121 - protein, 1110 aa, Methylibium petroleiphilum PM1
MSDEQLVPRPLSEVVSISRQFLRSIRLDADFGREDALSGYVCQGTARSLLESMARQLVSTRQRAFTWTGPYGGGKSSLALMLCSLVGPNPRLRARARDILDLPADSPVSKAFEARGEGWLVVPVVGKRASVVQELHTALNKARGGGRRKQGELVTELVAAAEAHRQGVLVVVDELGKFLEASAQGAGDDIYFFQELAEAASRTAGKLVVVGILHQAFDAYATRLGRDARDDWAKVQGRFVDIPLVAASDEVIELIGQAIDVNPSVDRSLLMHCVEPVASAIRTRRPGTPASLAKSLAKCWPLHPVTASLLGPISKRKFGQNERSTFGFLASREPNGFAEFIEGQPADWRSIYEPARYWDYLRANLEPAILASPDGHRWAAAADAVERAEAKGEAIHVAATKTVALIEMFRNGSGLVADESVLRVSVHARNYGEVSKALHDLVQWKILIERRHLGAYGVFAGSDFDIEGAISHARGEIGGPSLEHVSALSDLQPVLAKRFYAQTGTMHWFTRRIVRLADLPHTLEHFRQDKGSAGAFLLCLPDVDTSERTAERQVRSASAENPTVQALLGTPANAARISELALELAAVERVMKTRPELEGDAVARRELGGRLAAVRGALEDELADAFVLSKWYWKGERTGADKHSSLSSIASDVAKDVYRKAPTIFSELLNREDPSSNSNKARKDLMYQMIRGGARENLGYTGYPADAGLYYTILQATGVHRRDEKRGWGFYEPYVTNPRLEGMWQMWTAARERVAQPAHETTASDLYAYWGAPPYGVRAGVMPVLALAFYLAYRSELAMYVDGVFTPDLSEAVIDDWLQDPQRIRFQYVAASKDQESLVKAIAASVSEQSNVTIPAAPLDAARALVGLVTSLPGWTKRTLTVSPAAQDVRAMLLKASDPHKVLFADLPTLLKADSPSELVLRLRAVTNELSTAYQSMLARVREHVLKALDHQDRPLESLNHRAINVKGITGEFRLDAFAARLEVFDDTDQAVEGIISLAVSKPSAQWVDRDIDAALLQLGSWAIDFRRAEAMAPLRGRPSTRRVIGVVFGAGKGQDATGSVDVAESDIPAIDQLVKELLATVQRERREIVLAALAEAGAMLVKLGMKEKA

SEQ ID NO: 3122 - protein, 1071 aa, Flavobacterium johnsoniae UW101
MAIKFSTSTNIIRDTDRELTYIPTPNAIRISNQISNDFKQGTRSFNIIGSYGTGKSSFLWAVEQTLKKNKAYFGLNLLADPKIDFIKIIGEYQSLKQSFCDFLQIKNDKDAVENIFSEIFNRYYQLGNKSPLLFVVIDEFGKFLEYASQNDPEKELYFIQQLAEFTNNSDHNIVLLTTVHQNFDAYAINLDSAQRQEWTKVKGRFKEITFNEPVEQLLYLASEHIEEKQSAVKKEKNVNDIVNLLTQSKAFNINEDYVKEIAKKLYPLDAISAYVLTLSLQKYGQNERSLFSFLESTDHTGLYQHSILSDSFYSVSEVYDFLMHNYFSFLNSRYNPDFGAWKSIRTSLEKAGTLFDHNLSDYEKIIKTIGLLSINAQSGSFINRDFLVAYAERSLNISNALKIIENLELKKIVLYRNYNNRYILFEGTDLDIPTALYEAGNKIDDITDVVTLLNKNYSLPPVLAKRAMFETGTPRLFEYKISSHPISLKPEGEVDGFINLIFNESDILTDIEKVSFENQEAILYCYYLNSKEIKDLLFEIEKTRKVIEENPDDKVAVTELKNIVLHQRNLLNHKIQNSLFGEKASVIWIFSGQKKEIKSQKEFNSFLSQICKTVYSKTPYFNNELVNKHRISTSIHTAKRNYYRALANDWDIPQLGFSADKFPPEKTIYLSLLENNGIQLCNDNSSNLVQPHDENGFHSLWQASVEFLDSAKASKRRISDFIEVLSNKPFKLKQGFIDFWVPSFLFIKRDEYALFNEKIYTPTINEDILELIAKVPKDFEVKSFALEGVKLDIFNSYRKFLNIDSNNNGSAQTFIETIKPFLVFYRALPDYSKETKRLSKESLAIREAIANSKDPEQSFFEDFPTALGYSVSKIQKDRSELQHFIIQLQDSIKEIRNCFDELVNRFESFLQDKYFDQPLAFEDYQAKFQKRYKNLHRHLLLNSQKSFVQRLDSQIEDKKAWLNSLAQSLMGKSLEKFKDEDELLLYDKFSDMILSLDSLNRISMVKFNEEKEIAIDLQINSFGEGMTNKIIRLPKGKTKDVNVLEEKIKEMLSKDKSIDLAAVTAVLKSLL

SEQ ID NO: 3123 - protein, 1155 aa, Sphingomonas wittichii RW1
MPKSPVAIASLFHVPGRFVRSVQLERDFADPAALDDYIATPAIAQAFARITEGLRPASGRRAWRITGDYGVGKSSFALVVAQMLARRNDENVARIGRGLGWDAAGDNVPRFWSILLTGSRGPIVPNLARAISDAVEARRPARGKVPRAHSAIMTEAAAVAQSGDAGALEALVASFRALAAEQGEGVLLVIDELGKFLEHVAQNDGNQDVFILQRLAEAASRSGKQPFVLVTMLHQGFHAYAEKLPMASRNEWEKVAGRFEEIVFDQPLAHMAALVAGALRVETAKLPAPLRSAASGIASATADMGWLAGGTVSAADLDITRLYPLHPTILPVLVRFFARFGQHERSLFGFLLSNEPFGLQSFSAQSVAADCWYRLDDLYDYVRACFGHRLAGASYRSHWLRIVETIDSVVDASALELRLLKAIALLNLIDAEDLLPTDRALAAAFSPACEAEVGKALSSLQAQGAIFRRGIAGGYRLWPNASVNLEVALETAARSVGEIRSVAGALIPHLSTDPIMARRHYLETGTLRYFEIGFCAAEDLGEALCREHKADGLLFVALADDQAGADQAATVAYSKAAAERSDIVLCIPPPVAGLAGELRDLSLWTWVAQNTPELAEDTFAAAEVARQVAAARRALLTRAEQLIGMRHASLGSQCIWKGADVPGASRRRGMSSALSAICDELFGKAPRITNELLNRNALSTPAAAARMRLIERLYQSAEAPDLGMDPDKAPPEKSIYLSVLKAGGIHVATDEGFGVTLPSSDDPLQLAPALEELRTRIEAGQGDRVGVVDLFQHLRRPPYGVRDGVAPLLLAILLRTNAHELAVYEHGTFLHRFGPSDFQRLIKGPHYFEIQHCRVSGVRLEVFDALVSTFAKEVQGKSVDLLDVVRPLCQFAAQLPPYSQKSTGLSPAALGVRDALLTAREPITLLFRDLPVACGFAAFEEGLGGDTVRAFASRLQDAIDELRQTYDALLQRIMDRIAAALDQTEGFDRVTLASRASRVSLVAREPRLRTFALRLRDPGLSDTAWAEALASYVVAKPPSKWLAADEARFAEEAGTLAEHFRKTEAAAFAHADMAPQADAVRVNLTRGDGEDLVCIVEPGEDEDLRQQAELLSGRLPKDAQLRRRLLADLMWRELQAEAGEAKVSKPTGATRRGAA

SEQ ID NO: 3124 - protein, 1077 aa, Alteromonas macleodii  Deep ecotype
MITIKQNYKSSTRIDGLVDPKQFIDNIVLHGTALSTLDTLGKEVNNTNQRCFTLTGTYGTGKSTFALFMSLLLSADKKVRSLASKKLLAAQADSTFIKDFKVKKGWKVVKHVCGLGAPAEGLANSVLSTLQGNVAPSGEDDNFYVELIKSALNSQDEDADGVLILLDEMGKALDYQSRENKDLHFFQELADAIEKSNKPVVLIGFLHQSFAEYARSMTSHIQREWGKVQGRYRDIAYSPSIDESLILIGETVKADNDLKQRIERKYARLVDVVAKYLGREKNITNSLKNALPIDPVVSLLLGPISKRSFSQNERSLFGFLASSEKLSFNQFINTFYADDESSEALKLYNANLFWQYLTTNLDHIISSSRDGKIWLEAKDALYRASLDGEELHEAITKTVALITMFGYQYQLFASREFLISYFEQLGYKAKNVTNALEELESWKVLIYRDLHQALTIFQGSDIDVNEIITSTVDAIKDGVDWVSEVSSTKHILASAHYHRKGTLRWADVQLINERSVNLIASKAKSSAENAAFVNFYVPTSKAALELLKKVAAKQSQVVFSESIAPENLRTLAIEQIALRNIKETNKTLVHDKIAREEVESRLQANERALENELDLLFNKSQWHYEGRQYSDVSLSTIVSALADEIYSESPVIINELVNRNKPSGSANAAIKKLVLAMAENYGEELLGFPSDTFPAEKGLYFSCLANFGIHCAIDNGWGYPTEIENSDVDNLFRKTHETLIADTNAPVWLSEIDEYWAAAPYGLTKGIRAIWLMAFVMKHMKDYAFYDKNDATGEIIFITQPDDEFALKLIQKPHNVAVQAIHIDQEKTAYLNKVAEALDSVTNHEHDYSKDVTPLNVAEGLVTFYSSLSSYTVATKNVTKKARKFLEITKKASDPNAYLFKALPELLETDLDSISVQDVEDILRTLKNAHGELLSNFKKTTEKALGNDLIAKSTCTAVVDFTDDHKLKSFAQRLSERKENDNRWVSNLISLLSSKSERNWDDLAIKRAQVALPELVEKFKIAAHRAKFSGLDFAEIEKEFNEQIQGITSSLEGLDSEKKKTLLVALLDELENGAVKS

SEQ ID NO: 3125 - protein, 884 aa, Thauera sp. MZ1T
MNAHNTKKLSELVRIRRQYQRSIRLDADLGRMDALDGYVCHKTAADVLDAMAKQISGSNQRAFTWTGPFGGGKSSLAIALASALGPDKDLRAKARDVLRLDSHPNFDEALPVRRGWLVLPVVGRRGFVSEEISKTLNHALGSNTAPGSAAEVVVDLCSAAADERYDGVLLVIDEMGKFLEAAVLGLGDDVYFFQDLAESAARAQGKIVVVGVLHQSFRQYASRLGSESRDDWAKVQGRYADIPLVAASDEVVELIGRAVETDARPKSNRADARAIASSMAARRPAIGVEAFAESLDACWPLHPAMAALLGPVSRRQFGQNERSTFGFLGSVEPHGFRSFLKEQTLSDECRYRPDHYWDYLRVNLEPAILSSPDGHRWAQAADAVERTEAHHSPLHSALIKNIAVIDLLRSASGLAADSNVLRSLFPETLGKEVDAALEQLSKWRVAIYKKHLGAWSIFEGSDFDIEKALAQAKSTLPGIDFSVLTSLANLYPAIAKRHYHKTGTLRWMDVALCRLEDAEGIASNFTPKKGEFGLFLLALPSKDVRLEAAVDACEKIARSRPWPVVVGIPPNYARIEELSLELVCLQSVQGRPELEGDQIGKREVTARISAARSALEEQLRSAVTRAIWTVAERTYRPGTPIARCASDLADDLYRDSPRLWSELINRDAPSSASVKARRDLIHAMLETEHLENLGFEAFPAERGLYESLLKGTGLHRKDEGSDAWRFQPPDERRGATLIRLWDETRKLFSDASKRVEAVQIDKLWAGEPFGIRSGVRPILMTAFLLAHKGNLAVYKDGMFIPSLNDADLDEYLQDEKRFSFRWVVVDDEKTRILSGISNLLASIGAAAPASDPLEAAKGLVALVFRLPNWTKRTATLSPEAREVG

SEQ ID NO: 3126 - protein, 976 aa, Methylobacterium nodulans ORS 2060
MSKARSFFRAVNLESDIEVPDRLSHYQPTTRSLPIIEAVLGRDPTLVIAAYGSGKSLAAGVGALIAINDPRSRDAVKCILPKVQRVDPEAHQRLSQRFAARGQGRAIILSGHIADLAREIGSALGAPEKLSTLERVLNWASANLPSAAHLAIVWDEFGRHLESLVAEGRSRELDFVQRLAEWAARAEAPTASLTLLSHQNLLAYAGGLNQTSRNEWRKIEGRFRTLRFVEDSRELYRLLVDRIGERRESGTPPLDSRLKGAVVQRAMEAGWFDGAADVNEVADLVEGAWPLSAGALQSLPRLAARIGQNERSLFSFVEEVDLSRPVGFEELYRGFSDAMRSDVGAGGAHKRWIETESARAKAESDVEREALAAACLLQLGTDGERRKLSRAALEVAVASRGIPLAEAASAINALIGRKLLLHRCVVDDVSVWHGIDVDVASRLAEERAKRADAFDAVAFLAERRPAPIVRATRHNIEYGTARYLCGRYLLSEEVELQAEGSAPDAAPVGPWGDVLYVLAESEVEIAKARGAALASPRERTLYVIPSRPLRVVDAALEVACLEALRADDNLLAEDPLVSVEIDELLSVARRQLDLAVHRLTSDRPTDAKWYYAGAELPVTGERPATIVASEMMGAWYPKTPLIANDQLMRQRVSKQMNTARVRLLMRMTESAKKPWMGYGRDDTSVEASVYRTVLANTGLHREGPAGLWGFAEPEKVQDPGLKLAWTTAKSFFQEPSAEPKKLSGLVAVLTGPPIGAPSGVIPVIVMAGYQAFARCVSLRSDGAYVADILGFDANRMFADPERHEVEVHEADDGTLLYLDELAYVFAHAKNDEEVEALRFAHDAFAQWWAGLPNGARRSHRLSQGAQALLRAAAEASDPAAFFLRVLPDLFGGGRRDFDAVVAVVEAARDEIDGLVEGYLDEAVRVLGEAFRIGNDNAVQGMQSWVACLDVDSLLTRNDLRLTDKAILRVRWERVIS

SEQ ID NO: 3127 - protein, 1192 aa, Actinosynnema mirum DSM 43827
MTVAAPSPPSRDTRTAIPEFPAGIALVGSQMRSTNLERDVRDALQSPYIGARAVDVLERITSAIADLRRTRAWSFTGPYGSGKSTLSNLIDALLGHDDSRRDEAERILTGTSPALAQRLAAARAERTNTGFLGAVATARREPLVSTLARALETAASRRWGKRAPKAIASALANCSHPATTGAKQIMAAITAMTAEQPLLLIIDEFGKTLEHLAGHSEFASPEHDLFLLQELAEHCAGPNGLPVYLLTLQHLSFLDYASRTSDLETREWAKIQGRFEDITFLPHHGDSLQLLRRRLDHSAVSPAGKALIQVCADAAAREWKEHGLNILAELDSKDFADLYPLHPLTAIAAPILAAQIGQHDRSLSGFLNSGEPNTVRDALTAHSRTDAERASTVRLPQLYDYFLNAGRTSLLASPNASRWIEIDARIRDANGLPDSDQDLLKTIGVLNLIDADGALSATNEMIHFALRDPDDLVDAAAYAALEEQIADLVRRGFLVYREFSGEYRLWQGTDVDIDGRLKEITSHLDEASVIQRLSAYVPSSVVAGRHSQVTGMLRVFVTAVSGPETSHVDAPDEMTEPADGLVVFHLGTSTKRPVVDSTLPVVFGTTLNPDIVLSAATHLVALKELQQQALDHVALREVTDRAVQAEATFREIFQAAFYPPATDATWSTWHAGLPADQDPNTAQLMARSLSGLVSQVCDEVYSQTPHIRNEMLGRHALTSQAARARSDLLDAMLTSSGKQDLGFPTDKYGPERAMYRGVLAYLGLHRQNGAVQAEQTSDSLFPYGFSAPGDKDPERYAKPVWEALQQALTEATERTSLDHVVRVVMSPPFGVKAGVWPLLVVTALLIRRHDVALFEEGTYLPRLTQDIVERLEKVPSRFQVKYTPVSSGQRASVVKKLLVSLKVEPARSQALRNPDMLSVTRALLERVMVLNKYARQTKQISSDALAVRKALVGSQDPDDLLFKALPKALGRGPIGPAARADAAAVDEYVTRLTAAVDEIAAIDSKLRAKVVETLAHEFRLPSELHELRSTLAARLRGFADVALSAELKGFVDFVLSDSLSDEDWLDPIVVRLTNSALGDWDDREAAMFPRRAREMAAALDRVGHLHRTTDASAQEENLEAQLLTLTDKAGVEQRTLIYMPARSRAKAENLAADALKRAEKALGPDGARILLAALAQRVAEATTVAPETKEQA

SEQ ID NO: 3128 - protein, 199 aa, Mesoplasma florum L1
MKKVLVINSSVSQLNNSDSLAMSNMFIEEYKKMNPNDEIINLDLNETKMSQKTLTRNNIAEYFNQEDSFDFIEQLKSVDKIVLNFSMVNWGIPAILKNYIDHITIANLTFTYKGSTDGNAIGLLSNIQDVQILATKGGTGTPNSAFTEYVKNIWEFLGAKVKSEIIINEMMDIPPYAEQSPIENLEKVKEQILKAAKNF

SEQ ID NO: 3129 - protein, 206 aa, Burkholderia 383
MSRILLITSSPRSTDSLSTRFAHDLARQLAARDAAGAVTLRDLSNDPLPHIDDAYIVGRMLPSDARSAEQAQAVELAQALVDELRAADIVVIGSAMTNFGPSTQLRAWFDRVIWPQVTFRYGESGVAGTLEGKQVYLVTASGGIFSEGPYAPFDYQSGYLKHLLGFIGMTDIREVRVEGTVLGAEAVQAAIAKAGQELQALVEQAG

SEQ ID NO: 3130 - protein, 202 aa, Rhodopseudomonas palustris BisB18
MKLLHIDSSVLGPHSVSRQVSAAIVARLREVNPGAAVTYRDLGASPLAHLSGAHLAVAQGAVPAPELQDDLAAGAAVLEEFLAADTVVIGAPMYNFTIPTQLKAWIDRILVAGKTFSYSGGTVQGLAAGKRVIIAISRGGFYGPDTPMAVGEHLESYLRFVFGFIGITEPDIIAADGIKFSPEHREKAIASALSAVTALRAA

SEQ ID NO: 3131 - protein, 182 aa, Paracoccus denitrificans PD1222
MTILHIDSSITGENSVSRIVSQAIIDRLAEAQPGIPVIRRDLASAPLPHLTLDALGDTSVLDEFLAADTVVIGAPMYNFTLPSQLKAWIDRIVVAGKTFRYTAEGPEGLAKGKRVIVALARGGFYSDEARIALEHLESYLRSVFAFIGIEAEFVMADGVSIGPEQRQAAIDQALGQTRQLAA

SEQ ID NO: 3132 - protein, 198 aa, Sphingomonas wittichii RW1
MDSPLMKLLHLDSSIQGDASASRHLSAAVVDRLQALHPALDIAYRDLAADPLPHIVPAGFATPEAAALLDQFLAADILVIGAPMYNFGLPSQLKAWFDHILVAGRTFRYTEAGAEGLAGGKRAIVALSRGGFYSEGHPGAAFEHAQSHIGGMLGFIGIQPEFVVAEGVAFGPEQRAAAIAAAEAHIATLEPVALRTAA

SEQ ID NO: 3133 - protein, 203 aa, Methylobacterium extorquens PA1
MKLLHVDGSILGPHSVSRTVSAAIVDRLRAQHPGLDVIYRDLAGTPLPHLSGAVLAGAQPNATNTPDVQHDVELGRQVLEEFLAAEIVVIGAPLYNFTLSSQLKAWIDRILVAGVTFRYGPSGAEGLAGGKRVIAVVSRGGLYGPGTPAAAAEHAETYLRTVLAFIGITAPEVIVAEGIALGPEARERALAGALDAAAALKAA

SEQ ID NO: 3134 - protein, 203 aa, Methylobacterium populi BJ001
MKLLHVDGSILGPHSVSRTVSAAIVDRLRAQHPDLDVAYRDLAQTPLPHLSGAVLAGAQPNATNAPDVQHDVDLGRQALDEFLAADVVVIGAPLYNFTLSSQLKAWIDRILVAGVTFRYGPSGAEGLAGGKRVIAVVSRGGLYGPGTPAAAAEHAETYLRTVLAFIGITAPEIIVAEGIALGPEARERALAGALDAAAALKAA

SEQ ID NO: 3135 - protein, 201 aa, Gluconacetobacter diazotrophicus PAl 5 JGI
MKLLHLDASILPEDSSVSRTLSAAVVAHVRALQPDLTVTRRDLVAHPLSHMTLANLPPDHPASVPGNEVERAESQAVLEEFLTADIVVIGAPMYNFTIPTQLKSWLDRVLVPGRTFKYGPEGVKGLVEGKRVIVALSRGSFYGQETPYATAEHTETYLRTALGFIGIATPEVIVAEGVSRGEDQRAAAIEAAHQTVAALRV

SEQ ID NO: 3136 - protein, 204 aa, Methylocella silvestris BL2
MKLLHIDSSILGDHSVSRQLTAAIIARLQEVTPDLDVSHRDLAANPLSHLSGALLAASAPGAPAPDPSTQAALGESAAILAEFLAADIVVVGAPMYNFAISSQLKAWIDRLVIAGKTFRYADGAVEGLAGGRRLIIASSRGGVFEAGAAAAALDYQETYLRAIFGFIGIADVEIIRAEGLAFGEDARALAIKQAGDAILRLEAA

SEQ ID NO: 3137 - protein, 203 aa, Methylobacterium chloromethanicum CM4
MKLLHVDGSILGPHSVSRTVSAAIVDRLRAQHPGLEVIYRDLAGTPLPHLSGAVLAGAQPNATNTPDVQHDVELGRQVLEEFLAADIVVIGAPLYNFTLSSQLKAWIDRILVAGVTFRYGPTGAEGLAGGKRVIAVVSRGGLYGPGTPAAAAEHAETYLRTVLAFIGITAPEIIVAEGIALGAEARERALAGALDAAAALKAA

SEQ ID NO: 3138 - protein, 206 aa, Agrobacterium vitis S4
MTMKLLHLDSSVLGPYSVSRDLSASIVKTLSEKTAGLDVTYRDLAANPLPHLSGLTLAAAMGNYDASNDEATKADLALGGEVLEQFLTSDVVVIGVGFYNFGIPSQLKAWIDRISVAGKTFKYGATGPEGLCGGKRVIVAISRGGIYSQGPAAPLEHAETYLKGVFTFLGITDLEFVVAEGVNMGEEAKAAAVKGAKDSIATLKAA

SEQ ID NO: 3139 - protein, 222 aa, Catenulispora acidiphila DSM 44928
MATLLRIDASLFPDEASASRSVTSAFTDAWRAAHPDGTVVHRDLAADPLPHLDVLTVSAGFADPSAHSEAQAAAHAARLALIEEAEAADAIVIGAPMYNFGLASGLKAWLDHVILNGRTSGEGARSLAGKPVVVVASRGGSYEPGTPREGMEYVKNYLGSVLSEHLGITPEFITIQLTLASAVPAMADLIPLAEQSRAEALEQADAKARELAAQLSGEPVAA

SEQ ID NO: 3140 - protein, 380 aa, Thermobifida fusca YX
MKFRVERDVLADAVAWTARTLPVRPSVPVLAGMLLDADDVDGHQRLTLSSFDYEVSAQVSVDVDIDEPGRILVSGKLLAEIVRNLPPQTVEVSTDGAKVVVSCGSAKFTILTLPVEDYPTLPAMPALTGSVLSDTFAAAVSQVAVAAGRDDTLPMLTGVRIEIEGSTVTLVSTDRYRLAVRELTWTPEDPNVSAVALVPAKTLADTAKSLTGGAQISIALSTAENGGEGMIGFEGGGRRTTTRLLEGEFPKYRKLLPESFNSVAEVQKNEFIEAVKRVSLVAERNTPLRLSFTSDRLVLEAGTGEEAQAVEELSATLEGDDIQIAFNSTFLLDGLNAIESDVAHLQFTTSTKPAIITGKPADDGTASDYRYLIMPVRISN

SEQ ID NO: 3141 - protein, 398 aa, Mycobacterium MCS
MDVVPTTAGHTDLKFRLVREDFADAVAWVARNLPTRPTVPVLAGVLLTGDDDGLTISGFDYEVSAEVRVVAEIASPGSVLVSGRLLSDITKALPAKPVDVSVEGTRVSLTCGSARFSLPTMAVEDYPALPTLPDETGVIGADLFAEAIGQVAVAAGRDDTLPMLTGIRVEITGESVVLAATDRFRLAVRELTWSTSSPDVEAAVLVPAKTLAEAAKAGTDGTDVHLALGAGSAVGKEGLLGIRSEGKRSTTRLLDAEFPKFRQLLPSEHTAVATIGVAELTEAIKRVALVADRGAQVRMEFADDVLRLSAGADDVGRAEEDLAVAFSGEPLTIAFNPTYLTDGLGSLHSERVTFGFTTPSRPAVLRPAGDEDTGGGAGPFPALQTDYVYLLMPVRLPG

SEQ ID NO: 3142 - protein, 374 aa, Arthrobacter FB24
MKFRVERDVLAEAVTWTARSLSPRPPVPVLSGLLLKAEAGTVSLSSFDYETSARLEIPADISVEGTILVSGRLLADICRSLPSAPVDVETDGNKVTLTCRRSSFHLATMPEAEYPPLPALPTISGTVPGDSFAQAVSQVIIAASKDDTLPILTGVRMEIEDDLITLLATDRYRLAMREVPWKPVTPGISTSALVKAKTLNEVAKTLGNSGDINLALADDDSRLIGFESGGRTTTSLLVDGDYPKIRSLFPDATPIHATVQTQELVEAVRRVSLVAERNTPVRLAFTDGQLHLDAGTGEDAQASEELEAQLTGDEITVAFNPHYLIEGLSVIETKFVRFSFTTAPKPAMITAQVDADGEDQDDYRYLVMPVRLPN

SEQ ID NO: 3143 - protein, 408 aa, Nocardioides JS614
MQSPERALLPPPFNPRSTLAPPSRPEGTIVKFRVERDVLADAVAWAARSLPVRPSVPVLAGLLVEASDDGLVLSTFDYETSARATLTAEVSDEGQALVSGRLLADICRSLPAKPVEMVLDGARVSLTCGSARFSLQTMPVDDYPSLPSMPAATGTVQSEAFAHAVAQAVTAAGRDDMLPVLTGVRIEIDGSTISLLATDRFRLSHRELEWSPRTPDESAAALVPARVLGDTAKSLTGGGEVTIALATTGSGEGIIGFEGHGPGGLRRTTTRLLDGEFPKVRSLFPNEHQTTALVDKAALVESVKRVALVAERNTAVQLAFSDGVLTLDAGSGDEAQASESIEATIDGEDITTGFNPQFLLDGLTAIDQPVVELAFTQASKPVVISGAVDGDDTDSSFRYLLMPRRLLS

SEQ ID NO: 3144 - protein, 398 aa, Mycobacterium KMS; identical to SEQ ID NO: 3141

SEQ ID NO: 3145 - protein, 398 aa, Mycobacterium vanbaalenii PYR-1
MNVPTTAGLTDLKFRLTREDFADAVAWVARNLPSRPTVPVLAGVLLTGSDEGLTISGFDYEVSAEVQIPAEIASPGSVLVSGRLLSDIVRALPAKPVDVSVEGTRVSLTCGSARFSLPTMPVEDYPTLPTLPDETGVVSSDLFAEAIGQVAVAAGRDDTLPMLTGIRVEISGEKVVLAATDRFRLAVRELTWSTGAAGVEAAVLVPAKTLAEAAKAGTDGNEVHLALGAGPSVGKEGLLGIRSKGKRSTTRLLDAEFPKFRQLLPTEHTAIATIGVAELTEAIKRVALVADRGAQVRMEFADGVLRLSAGADDVGRAEEDLPVEFSGDPLTIAFNPTYLTDGLSSLHAERVTFGFTTPSRPAVLRPAAEDDGGAGGSGPFPAAQTDYVYLLMPVRLPG

SEQ ID NO: 3146 - protein, 398 aa, Mycobacterium JLS
MDVVPTTAGHTDLKFRLVREDFADAVAWVARNLPTRPTVPVLAGVLLTGDDDGLTISGFDYEVSAEVRVAAEIASPGSVLVSGRLLSDITKALPAKPVDVSVEGTRVSLTCGSARFSLPTMAVEDYPALPTLPDETGVIGADLFAEAIGQVAVAAGRDDTLPMLTGIRVEITGESVVLAATDRFRLAVRELTWSTSSPDVEAAVLVPAKTLAEAAKAGTDGTDVHLALGAGSAVGKEGLLGIRSEGKRSTTRLLDAEFPKFRQLLPSEHTAVATIGVAELTEAIKRVALVADRGAQVRMEFADDVLRLSAGADDVGRAEEDLAVAFSGEPLTIAFNPTYLTDGLGSLHSERVTFGFTTPSRPAVLRPAGDEDTGGGAGPFPALQTDYVYLLMPVRLPG

SEQ ID NO: 3147 - protein, 398 aa, Mycobacterium gilvum PYR-GCK
MNVATTAGLSDLKFRLTREDFADAVAWVARNLPSRPTVPVLAGVLLTGSDEGLTVSGFDYEVSAEVQIPAEIASPGSVLVSGRLLSDIVRSLPAKPVDVSVEGTRVSLTCGSARFSLPTMAVEDYPTLPTLPDETGVVSADLFAEAIGQVAVAAGRDDTLPMLTGIRVEISGEKVVLAATDRFRLAVRELTWSAGAAGVEAAVLVPAKTLAEAAKAGTDGTEVHLALGQGPTVGKEGLLGIRSKGKRSTTRLLDAEFPKFRQLLPTEHTAIATIGVAELTEAIKRVALVADRGAQVRMEFADDVLRLSAGADDVGRAEEDLPVQFSGDPLTIAFNPSYLTDGLGSLHAERVTFGFTTPSRPAVLRPAGDDDGSAAGSGPYPAAQTDYVYLLMPVRLPG

SEQ ID NO: 3148 - protein, 377 aa, Salinispora tropica CNB-440
MKFRVERDALAEAVAWTAKSLPNRPSVPVLAGVLLRVTDGNLQVSGFDYEVSSQVTVEVQGDADGATLVSGRLLAEITKALPAKPVDIAAVGAHLELVCGSARFTLPTMPVEDYPTLPEMPVSAGTIDAAAFAAAVAQVAVAAGRDETLPMMTGVRLELSGGTLAMLATDRYRLALREIEWNPEDPEISLNALVPARTLHDTAKALGPLGGQVTMALSQGAAGEGMIGFVGGPRRTTSRLLDGANYPPVRSLFPATQNAQAQVPVSALIEVVKRVALVAERTTPVLLSFSDDGLVVEAGGTEEARASEAMEATFSGDPLTIGFNPQYLIDGLSNMGTQFAVLSFVDAFKPAVISPVGEDGEVVPGYRYLIMPIRVSR

SEQ ID NO: 3149 - protein, 377 aa, Salinispora arenicola CNS-205
MKFRVERDALAEAVAWTAKSLPSRPSVPVLAGVLLRVSDANLQVSGFDYEVSSQVTVEVQGDADGAALVSGRLLAEITKALPAKPVDIAAVGAHLELVCGSARFTLPTMPVEDYPTLPEMPVSTGTVDAAAFAAAVAQVAVAAGRDETLPMMTGVRLELSGGTLAMLATDRYRLALREMEWNPDDPEITLNALVPARTLHDTAKALGSLGGQVTMALSQGAAGEGMIGFAGGTRRTTSRLLDGANYPPVRSLFPATHNAQAQVPVSALIEVVKRVALVAERTTPVLLSFSGDGLVVEAGGTEEARASEAMEATFTGDPLTVGFNPQYLIDGLSNMGTQSAVLSFVDAFKPAVISPVGEDGEVVPGYRYLIMPIRVSR

SEQ ID NO: 3150 - protein, 374 aa, Arthrobacter chlorophenolicus A6
MKFRVDRDVLAEAVTWTARSLSPRPPVPVLSGLLLKAEAGTVSLSSFDYETSARLEITADIRDEGTILVSGRLLADICRSLPSAPVDVETDGNKVTLTCRRSSFHLATMPEAEYPPLPALPAISGTVPGDAFAQAVSQVIIAASKDDTLPILTGVRMEIEDDLITLLATDRYRLAMREVPWKPVTPGVSTSALVKAKTLNEVAKTLGNSGDISLALSDDDTRLIGFESGGRTTTSLLVDGDYPKIRSLFPESTPIHATVQTQELVEAVRRVSLVAERNTPVRLAFTAGLLNLDAGTGEDAQASEELEAQLSGDDITVAFNPHYLVEGLSVIETKFVRFSFTSAPKPAMITAQADADGEDQDDYRYLVMPVRLPN

SEQ ID NO: 3151 - protein, 378 aa, Actinosynnema mirum DSM 43827
MKIRVERDGLADAVAWVARSLPSRPPVPVLGGVLLDAGAEDGSGDALTVSGFDYEVSAQCGVPATISDGGKALVSGKLLADITKALPNHPVEINVDGARMTITCGSAKFSLPTMPVEDYPALPSMPQLAGELPGEVFGEAVAQVAVAAGKDDTLPMLTGVRLEIADGKLVLVATDRFRLAMREFEWTPDETLGDVAVLVPAKTLNDSAKTLGASGAKIELSLAANDGLLGLSGNGRRTTTRLLDADFPKYRQLLPSEHSAAAIISVDTLVQAIKRVSLVAERGTQVRLEFGDAGLKLSAGGDDEGSAEEELPVDYQGDPVTIAFNPTYLLEGLQAVRTPRAHLSFTTPSRPALLKPVNEDGEVAEGYVYLLMPVRLPG

SEQ ID NO: 3152 - protein, 378 aa, Beutenbergia cavernae DSM 12333
MKFRVDRDVLADAVTWTARTLPTRPSIPVLAGVRIEADPQGALRLSSFDYEVSALSEIAADVPDAGTVLVSGRLLAEISRALPGKPVDVELDGTRVVLTCGSSRFTLLTMPLDDYPSLPAMPPASGTVDAGTLAEAVAQVTIAASRDETLPLLTGVRVEIEGDKLTLLATDRYRLAMRELSWNPASPGLEATALVRARTLSEVAKSLTSAGAVSISLPNGDGKDLVGFEAGGRRTTSLLVEGDYPPVRRLFPEATTSHAVASTNELVEAARRVSLVAERNTPIRLTFSEGQVVLEAGQGDDAQASEAIESTLTGEPITTAFNPGYLLDGLGVVGTEFTRLSFTHGTKPAVLTGQPKLEDDDADRDVFRYLIQPIRFAS

SEQ ID NO: 3153 - protein, 378 aa, Kytococcus sedentarius DSM 20547
MEFQVQRDVLSEAVAWVVRGLTNRPPVPVLAGVRLVADPAGTLTLSAFDYEVSGEVTVEADVVTGGEALVLGRLLSEISRSLPDKPVRIQQDGGKLQVTCGSSRFALLEMPLADYPSLPTSPEASGTVDGALFTKAVAQVSVAADRSDALPILTGVHVEFDGERITMLATDRYRMARRELTWTPRDPSAHHVALVPSRTLSDTAKSLGAVGSVDIALGDEAGGKGLIGFAAGQRHSTTRLLDGEYPKVSSIFPTTSDVDAVMETSALVEAIKRVSLVAERTTPVRLRFTPGSVAIEAGTGDDAQASEAVECTLDGDEIDVAFNPGFLLDGLGALGTPFARMSFTQPGKPALLTGQAEADGEADDAFSYVIMPVRFPGA

SEQ ID NO: 3154 - protein, 396 aa, Catenulispora acidiphila DSM 44928
MKFRVERDVLSEAVAWTARSLPSRPAAPVLAGLVFEAVEGEGGEDHGSVTLSGFDYEVSSRAQIGADVTEPGRILIHGKLLADIAKSLPNRPVEFSTEGSKVLLSCGSSRFTLQTLPVEDYPALPTMPTATGAVTASGLAGAVSQVAIAAGRDDTIPMLTGIRVEIEGEKITLVATDRFRLAVRELQWKPEQDDMSATALIPSKVLSDTAKALTGGDWVSLALSGGDAGEGLIGFESGEGTSGKAKGSRRMTSRLLSGEFVKYRSLFPNEYNITATVETAPFLEAAKRVSLVADRTSPIKLAFTQGEVTLEAGAGDEAQASEAMDAVLDGEDISVSFNPSFLLDGLQVIDTQYAQLSFTVASKPAVLMGRPALDAPAQEEFRYLMMPLRVPGQSAG

SEQ ID NO: 3155 - protein, 379 aa, Saccharomonospora viridis DSM 43017
MKIRVERDGLAEAVAWVARSLPSRPPVPVLGGVLLDAGGDSGDGADTLTISGFDYEVSATAGVPSTIAEGGRTLVSGRLLADITKALPAQPVDISVEGARVSITCGNAKFSLPTMPVEDYPELPAQPELAGEVAGDAFAQAVAQVAVAAGKDDTLPMLTGMRVEITGSTLTLVATDRFRLAMREFSWQPAEGITDSAVLVPARTLADAAKSLGSAGTTVQIGLAGGDGLLGLSGGGKFTTTRLIDAEFPPYRQLLPSDYSSRAILHVPALTEAIKRVSLVAERGTQVRLEFEDGSLRLAAGGDDEGSAEEELPVDYEGEPVTIAFNPSYLADGLGALHAERAELTFTTPNRPALIKPADDNGEVVPGYLYLLMPVRLPG

SEQ ID NO: 3156 - protein, 408 aa, Nakamurella multipartita DSM 44233
MKFRVARDDLADAVAWVAKSLPARPPVPVLGGILLEVSGSTLTVAGFDYEVSTRATLTVDTLDELEPDAPGGPAGTDRVLVSGRLLAEITRSLPAKPVDLAVLGPKVSIVAGSARFTLPTMPVEDYPPLPQMPAASGTVDSAEFAEAVAQTAIAAGRDDTLPMLTGIRVEIDGDRLTLAATDRFRLAVRELGWHPDQENLSTAVLVPARTLADAAKTLGGAKQVTVALGEGLLGLDAGDRRTTVRLLDVEFVKYRSLLPTSHTTTVEVPVAALGESIKRVALVTDRGHHLRLQVGEGALTLTAGGDDEGRAEEDLPAEVDGEELLIAFNPSYLLDGLGVVHADTVRLSFTTPARPALLVPIVKSDEPAESAEAAAEAAATPDIDADGVGSDEDTPAYRYLVMPARLPG

SEQ ID NO: 3157 - protein, 286 aa, Escherichia coli BL21 (DE3)
MIAITGATGQLGHYVIKSLMKTVPASQIVAIVRNPAKAQALTAQGITVRQADYGDEAALTSALQGVEKLLLISSSEVGQRAPQHRNVINAAKTAGVKFIAYTSLLHADKSPLGLADEHIETEKMLADSGIVYTLLRNGWYTENYLASAPAALEHGVFIGAAGDGKIASATRADYAAAAARVISEAGHEGKVYELAGDSAWTLTQLAAELTKQSGKQVTYQNLSETDFAAALKSVGLPDGLADMLADSDVGASKGGLFDDSKTLSKLIGRPTTTLAESVSHLFNVNK

SEQ ID NO: 3158 - protein, 288 aa, Ralstonia solanacearum
MEIGVSGASGQLGKAVLAELAARGAGHRVVGISRTPERVPAPAQGRLGDYDRAETLLQAYRGLDRLLLIPSADLGPGVRGRQFTAAIDAAVRAGVKHIVMVSTAGTRELAEPALGAAYWVGEQRLVKTAPRWTILRMNYYAESFAQQAPMFLGSGILPGLGENRVAFVSRDDVAAAAAGILLGEGHAGAIYNATGPVALSGAQRAALVAELSGKPLRFAVSDEAPLRQGLAQAGLPGGFVDAVIDLEKSFVAGAFDVVTGDVARLAGREPRALRTLLADSLRPAVADA

SEQ ID NO: 3159 - protein, 285 aa, Pseudomonas syringae tomato DC3000
MIVVTGATGQLGRLVIEQLLARVPAEQIVAAVRSPEKATDLSAKGVQVRHADYSQPATLDSAFAGADKVLLISSSEIGQRFSQHKAVIDAAKRSGVKLLAYTSVLHAEASTLGLAKEHVETEAYLRASGLPFALLRNGWYTENYTAGVPGALAHGAVMGCADEGRISSASRLDYAEAAAVLLTSGEDQSGRVYELAGDESYTLAEFAAELSKQAGKTLPYVNLTQAEFEAALIQAGLPDFVARLLADSDAAAAKGALFDDSRQLSKLIGRPATPLSATIAEAVRG

SEQ ID NO: 3160 - protein, 285 aa, Pseudomonas syringae pv B728a
MIVVTGATGQLGRLVIEQLLSRVPASQIIAAVRSPEKAADLSRQGIQVRQADYSQPATLDSAFAGADKVLLISSSEVGQRLPQHKAVIDAAKRAGVQLLAYTSVLHADTSALSLAKEHRETEDYLRASGLPFALLRNGWYTENYTAGIPGALAHGAVMGSADEGRISSASRLDYAEAAAVLLTSETTQAGKVYELAGDESYTLSEFAAQLSTQSGKSLPYVNLPQAEFEAALIQAGLPDFVAQLLADSDAAAAKGALFDDSRQLSALIGRPTTPLSATIAETLKG

SEQ ID NO: 3161 - protein, 294 aa, Rhodopseudomonas palustris HaA2
MSSPRFLVTGANGQLGRRVIDTLLGTISAPQISALVRGADAAAALSARGIQAHVGDYGRPETLAPALAGVDRVLLISSSEIGRRTPQHRNVIAAAREAGVQFLAYTSLLHADISPLGLAEEHRQTEAALRESGVPFALLRNGWYTENYAASIPAALAHSALLGSAGDGRISSASRADYAAAAAAVLTADTPAANQVYELAGDEAYTLTEFAAEIARQSGKAVAYRDLPEADYKAALLGAGLPEPFAALLADSDAGAAKDALFDDSRTLSRLIGRPTTPYAETIGDTLKASRPER

SEQ ID NO: 3162 - protein, 296 aa, Rhodoferax ferrireducens T118
MTSTLLVTGASGHLGQRVIHHLLETLKVAPQRIIATTRKPETLKDLAAKGITVRGADFDDAASLRSAFAGADRLLLISTDALDRPGRRLAQQQAAVAAAQQAGVAHVVYTSMPLPENSPLLIAPDHAGTEKALASSALKGWTLLRNHWYFENLFMWLPSALASGQWYSAAEQGKVAHIARDDLARAAAAALLKDTGKNTYTLSGAEAFTTEQIAQQVSQATGKPLQVVPVPLAGLIQGMVSAGFPEPLAAVFASFDTNTAAGRVAEVTGDFQKLTGVAPQPFAGWLSANAAALAAL

SEQ ID NO: 3163 - protein, 280 aa, Paracoccus denitrificans PD1222
MTVAVTGATGQLGRLTIARLKTLLPAGEIVALARNPEKAADLGVEARAFDYDRPETLATALQGVDRLLLISSSEVGKRAAQHRAVIEAAKAAGVGQIVYTSLLHADRSPLSLAEEHVATEAMLAASGIPHAILRNGWYAENHTGAIPAALAHGALIGAAGEGRISAAARADYAKAAASVLADGGHAGQTYELAGDDGWTLAELAAELSAQSGKAIPYRNLSQQDYAAALTGAGLPEGLAGAIASWDTGAAQGALFDDSRTLSRLIGRPTATLAEVVRAAL

SEQ ID NO: 3164 - protein, 285 aa, Nocardioides JS614
MSIVITGATGHLGRLVVEALLARGAEGIVATGRSVERLADLADRGVRVERLDFDDVPESVDWLGAGDVLLLVSGSEVGQRLPQHRAVVDLAVRAGVRRIAYTSAPAADDTTLAVAPEHAATEAMIRESGLPFTFLRNGWYTENYLPTFAQARESGLVIGSAGEGRVASAPRSDFAEAAAVVLTTDGHEGAVYELFGDAAWTYGELAATFADVLGREVTYRSLTPEAHREALLAAGLDEGTAGFVVALDQDIAAGLLGLSTGHLAKLLGRPTVPLRDTVSTWAAQD

SEQ ID NO: 3165 - protein, 288 aa, Acidovorax avenae citrulli AAC00-1
MIAITGASGQLGRLAIDALLRNAPAGDIVALVRTPAKVQDLAERGVVVRQADYADPAGWDAALQGVRRLLLISGSEVGQRVAQHRTVIDAARRAGVELLAYTSVLRADTSALELAREHRDTEALLRESGVPHVLLRNGWYTENYLAGVGAALQHGVLLGSAGEGRIASAARADYAEAAAAVLQAPDQAGKVHELAGDSAYTLAELAAEISRASGRSIPYRDLPEAEYARVLEGAGLPAAFAAILAQSDAAAAQGALFDGGGQLARLIGRPTTPWQGQADEAVRAAMPG

SEQ ID NO: 3166 - protein, 284 aa, Polaromonas naphthalenivorans CJ2
MIVVTGASGQLGRLVIEALLQTVPASQVVAAVRNPAKAGDLAARGVQVRQADYSQPATLDAAFKGADKLLLISSSEVGQRAAQHRAVIEAAQRAGVKLVAYTSILHADASPLGLAAEHQETEALLRASGLPFVLLRNGWYTENYAGGIPAALAHGVVLGSAGAGRIASAARADYAAAAAAVLTQADQAGRIYELAGDGSYTLAEFAAEIARQSGKAVVYQDLPEADYKAALLSVGLPEGLAGLLADSDVGASRGGLFDDSHQLSQLIGRPTTPLAASVSAALAA

SEQ ID NO: 3167 - protein, 282 aa, Enterobacter sp. 638
MIAITGATGQLGQHVIENLLKTVPAHQIVAIVRNPAKADALIQQGITVRQADYTDQTAFTEALKGVEKLLLISSNEVGQREPQHKNVINAAKTAGVKFIAYTSLLHADKSPLGLANEHVATEKALADSGIPFALLRNGWYTENYLASAPPAIEHGVFIGAAGDGKIAAATRADYAAAAAKVIAEDGHAGNVYELAGDSAWTLSELAAELSKQSGKPVVYQNLNEADFAAALKGVGLPAGLADMLADSDTGASKGGLFDDSHTLSKLIGRATTPLAESVKSIL

SEQ ID NO: 3168 - protein, 289 aa, Bradyrhizobium BTAi1
MTGAAGQLGRAVIRHLLTTLKVPAGSIIAATRKPEQLKDLAAQGVQVRAADFDDPQSLPAAFAGVGRMLLISTDRLDRPGYRAEQHGRAIAAAEQAGVGHVVYTSMPKPDNSPLLIAPDHARTEAALRDSKLAGWTVLRNHWYFENLLMSLPQILGSGRWFTADEGGASADIARDDLARAAAVVLAGNFSGKRAFTLSGGQALTKAEIARILSAATGKPIEVVQVPLPGLIQGMVGAGLPQPLAEIFASFDTNTAQGRVAEVTGDYQAITGVAPQSFADWVEKTKGAFA

SEQ ID NO: 3169 - protein, 295 aa, Sinorhizobium medicae WSM419
MSQKLLVTGATGQFGKLVLDALLESGKTKPADIIATSRDTAKLAGYAAQGVETRAADFDDPASLERAFTGAGRILIISTDVLDQPGKRLKQHLTAVEAAKKASVNHILYTSMPAPEASVIPFATDHLGTEEAIKATGVPYTILRNAWYMENLLLSLPRALATGRWFSSAGNGRISHISRRDLAAAAASALQSGSTESRTYTLTGAQAYTTDEIAALVTKATGKALDVVHISDEALAGGLKGAGVPDFFIPILVSFDANTREGHFDVVTDNAIAMTGRNPTELASFLETNKAALTH

SEQ ID NO: 3170 - protein, 281 aa, Marinomonas MWYL1
MILVTGASGQLGRLVIASLLEKTAASNIIAAVRNPEKVADLAEKGVQVRQADYTDQDSLVAAMQGVEKVLLISSSEVGQRTAQHSNVIHAAKQAGVSLLAYTSILNADKSPLILAKEHVETENLLAESGVPYVLLRNGWYSENYTMGVAGALEHGVVGCAEDGKLSTAARADYAAAAAAVLVKDGQAGKVYELAGDNAFTLSVYAAAISKVSGKTVAYQNVPEAEFTKILVGAGLPEGFAAILADSEVGASQGALFSDSKDLSTLIGRPTTQIEDSIKAAL

SEQ ID NO: 3171 - protein, 285 aa, Yersinia pseudotuberculosis IP 31758
MIAVTGATGQLGRLVINVLLKKVPAHDIIAAVRSPDKAKDLMALGVQVRQADYNQPTTLDSAFKGVDKLLLISSSEVGQRVAQHTAVINAAKRAGVKLLAYTSLLHADKSPLGLGEEHRATEGLLRDSGLPVVLLRNGWYTENYAASIAPALAHGAFIGAAGNGRIASASREDYAEAAATVLVQENQAGKIYELAGDDAYTLSEFSAEITRQSGKAVAYQDLSEADFKHALISAGLPDGLAGMLADSDAGAAQGGLFDDSHTLSKLIGRPTTPYAKVITATLATR

SEQ ID NO: 3172 - protein, 299 aa, Xanthobacter autotrophicus Py2
MYLPDTWFPMETYQAAFREQDMSDAILVIGATGNVGRPLVEALKARGARVRAASRSGKAVDGAEGVAFDIADPATFGPALAGVKSAFVMLPTGSMDPKGQLLPLIAAAAARKVKVVFQSVLGADADEAIPYRQVERALEASGTPYVILRPNWFADNFHTFWKPGLDHGVIAVPAGAGKSSFIDTRDIAESAAAALTSDRFDGRAFNLTGPEALGYGDAAAILAPVIGRPVTYTPIDDGTFVGILVGAGVPQDYARFLASIFVPVREGWTAAVTTDVETLTGHAPRSLETYAKDNADRLK

SEQ ID NO: 3173 - protein, 286 aa, Escherichia coli HS
MIAITGATGQLGHYVIESLMKTVPASQIVAIVRNPAKAQALAAQGITVRQADYGDEAALTSALQGVEKLLLISSSEVGQRAPQHRNVINAAKAAGVKFIAYTSLLHADTSPLGLADEHIETEKMLADSGIVYTLLRNGWYTENYLASAPAALEHGVFIGAAGDGKIASATRADYAAAAARVISEAGHEGKVYELAGDSAWTLTQLAAELTKQSGKSVTYQNLSEADFAAALKSVGLPDGLADMLADSDVGASKGGLFDNSKTLSKLIGRPTTTLAESVSHLFNVNN

SEQ ID NO: 3174 - protein, 286 aa, Escherichia coli E24377A; identical to SEQ ID NO: 3173

SEQ ID NO: 3175 - protein, 289 aa, Frankia EAN1pec
MSIVVTGAGGHLGRLVVENLLARGVPAGRIVAGTRNVDALSALAERGVDVRRLDFDDPASLATAFTGAEKALIVSGTDFGRRVEQHVGASRAARDAGASLVVYTSAPYADTTDMLLAEDHRGTEEGIRALGVPFTFLRNGWYFENYTDQLPVYLQVGAVVGCAGEGRVSGAARSEYAEAAAAVLTGEGHEGAVYELGGDTSFTLPELAEQIAKHTGQPIVYRDVTQPELEAVLTGAGLPGPVARVLADADRAIGAGRLQIDTGDLSRLIGHPTVNLADAVAAAGAPAVP

SEQ ID NO: 3176 - protein, 285 aa, Yersinia pestis Angola
MIAVTGATGQLGRLVINVLLKKVPAHDIIAAVRSPDKAKDLMALGVQVRQADYNQPTTLDSAFKGVDKLLLISSSEVGQRVAQHTAVINAAKRAGVKLLAYTSLLHADKSPLGLGEEHRATEGLLRDSGLPVVLLRNGWYTENYAASIAPALAHGAFIGAAGNGRIASASREDYAEAAATVLVQENQAGKIYVLAGDDAYTLSEFSAEITRQSGKAVAYQDLSEADFKHALISAGLPDGLAGMLADSDAGAAQGGLFDDSHTLSKLIGRPTTPYAKVITATLATR

SEQ ID NO: 3177 - protein, 297 aa, Methylobacterium extorquens PA1
MSTPEPRLFVTGATGQLGRLVIEALLKRVPADSIVAGVRSLESAAAEDLRAQGVTLRMADYARPETLVEAFRSIDRLLLISSSEIGQRVAQHQNVIQAARQSGVNLIAYTSLLRADTSPLALADEHRRTEDALKASGLSFAVLRNGWYTENYAASIAPALAHGVLLGSAGEGRIASAARADFAEASAVVLTTDGHDGRVYELAGDDAYTLDEFAAAVSVLSGQTVVYRNLTEAEFKAALVAAGLPEDFAALLADSDMAAAQGGLNDTNRQLSRLIGRPTTPYRTTIAGTISGMAAQD

SEQ ID NO: 3178 - protein, 286 aa, Escherichia coli C ATCC 8739; identical to SEQ ID NO: 3157

SEQ ID NO: 3179 - protein, 285 aa, Yersinia pseudotuberculosis YPIII
MIAVTGATGQLGRLVINVLLKKVPAHDIIAAVRSPDKAKDLMALGVQVRQADYNQPTTLDNAFKGVDKLLLISSSEVGQRVAQHTAVINAAKRAGVKLLAYTSLLHADKSPLGLGEEHRATEGLLRDSGLPVVLLRNGWYTENYAASIAPALAHGAFIGAAGNGRIASASREDYAEAAATILVQENQAGKIYELAGDDAYTLSEFSAEITRQSGKAVAYQDLSEADFKHALISAGLPDGLAGMLADSDAGAAQGGLFDDSHTLSKLIGRPTTPYAKVITATLATR

SEQ ID NO: 3180 - protein, 293 aa, Xylella fastidiosa M12
MTRTISRILVTGTSGQLGALVIEELLKKIHASHLIAAARDPKALMAFSRRGVETRLLDYTDQISIDAAFQGVERLLLVSSNAIDQRLVQHRNVIEAAARAGVGLFAYTSLLHADNSSLLLAKDHVQTEALLKGSGIPYVLLRNGWYTENYTDSIGAALVHGAVLGSAGTGRIAAATRADYAAAAAAILASDVDQAGRTYELAGDEAFTMPEYAAEIAQQSGKPVIYRDLPEAEYAAILMQVGLPESFAAILAQSDIGASQGALFDDSHQLSTLIGRPTTPLREVVAKALSAVR

SEQ ID NO: 3181 - protein, 286 aa, Escherichia coli SMS 3 5
MIAITGATGQLGHYVIESLMKTVPASQIVAIVRNPAKAQALTAQGITVRQADYGDEAALTSALQGVEKLLLISSSEVGQRAPQHRNVINAAKAAGVKFIAYTSLLHADKSPLGLADEHIETEKMLADSGIVYTLLRNGWYSENYLASAPAALKHGVFIGAAGDGKIASATRADYAAAAARVISEAGHEGKVYELAGDSAWTLTQLAAELTKQSGKQVTYQNLSEADFAAALKSVGLPDGLADMLADSDVGASKGGLFDNSKTLSKLIGRPTTTLAESVSHLFNVNN

SEQ ID NO: 3182 - protein, 284 aa, Leptothrix cholodnii SP 6
MIVITGATGQLGRLVIESLLKTVPASEIVAAVRSPEKAQDLAARGVRVRQADYNQPATLDAAFTGAHKLLLISSSEVGQRAPQHRTVIEAAQRAGVKLIAYTSLLHADSSPLALAGEHVETEAMLRASGLPFVLLRNGWYTENYAASVPAALAHGVVLGSAGNGRIASAARADYAAAAAAVLTADNPAGKVYELAGDTSYTLAELAAEIAAQADKPVAYNDMPQAAFEAALLGFGLPAGLASLLADSDVGASKGGLFDDSHQLSALIGRPTTPMASTIAQAVKG

SEQ ID NO: 3183 - protein, 294 aa, Methylobacterium radiotolerans JCM 2831
MTRTDYPSYFVTGATGQLGRQVIAALLERIPAGAVVAGARDIEGESARSLRSLGVAVRRADYADPTSLDAAFQGIQRLLLISSSEIGRRVAQHRNVIDSAGRTGVGLIAYTSVLHADTSALALAEEHRQTERLLADSGVPFVVLRNGWYTENYAAGIAPALAHGAVLGCAGDGRIASAARVDYAAAAAAVLTAEGQGGRIYELAGDESYTLTEFAAAIAAAAGRPVAYRDLPQAEYRAALVAAGIPSDFAALLADSDAAAARGALDDDTRQLSALIGRPTTPYRSTVHDAVARL

SEQ ID NO: 3184 - protein, 294 aa, Methylobacterium radiotolerans JCM 2831
MTLPSHTRLFVTGATGQLGGLVIQDLLRTVPAAQVVAGVRDAGSEGARKLAGLGVEVRTADYAKPDTLATAFEGIERLLLVSSSEVGQRSVQHRNVIVAAKAAGVLLIAYTSLLHADTSPLALAEEHRATEAMLAASGVPHVLLRNGWYTENYTASIPLVLAHGVFLGSAGEGRIASAARADYAAAASIVLTAETDQGGRIYELAGDEAYTLSDFAKLISQASGKPVAYRNLPETDFKTALIGAGLPDAFAGLLADSDAGAEKGALFDGGHQLSALIGRPTTSTSSVIEAALKG

SEQ ID NO: 3185 - protein, 293 aa, Xylella fastidiosa M23
MTRTISRILVTGTSGQLGALVIEELLKKIHASHLIAAARDPKALMAFSRRGVETRLLDYTDQISIEAAFQGVERLLLVSSNVIDQRLVQHRNVIEAAARAGVGLFAYTSLLHADNSSLLLAKDHVQTEALLKGSGIPYVLLRNGWYTENYTDSIGAALVHGAVLGSAGTGRIAAATRADYAAAAAAILASDVDQAGRTYELAGDEAFTMPEYAAEIAQQSGKPVIYRDLPEAEYAAILMQVGLPESFAAILAQSDIGASQGALFDDSHQLSTLIGRPTTPLREVVAKALSAVR

SEQ ID NO: 3186 - protein, 286 aa, Xanthomonas oryzae PXO99A
MILVTGASGQLGALVVEALLGHVPAGRIVATARDTASLVEFAKRDIAVRQADYAIPHSLHTAFAGVGRVLLVSSNAVGQRVPQHRNVIEAAKRAGVELLAYTSILHADTSTLSLAAEHVATEALLRDSGVPHALLRNGWYTENYTGSIAAEVAHGAVIGSSGEGRISAATRADYAAAAAAVLAADAPQAGQVYELAGDTAFTMAEYAAEVAQQSGKPVAYQDLPEADYAAALVQIGLPAGFAQVLAQCSAASRGGDLFDDSHTLSRLSGRSTTPLRDAVAAALAAG

SEQ ID NO: 3187 - protein, 286 aa, Shigella boydii CDC 3083 94
MIAITGATGQLGHYIIESLMKTVPASQIVAIVRNPAKAQALAAQGITVRQADYGDEAALTSALQGVEKLLLISSSEVGQRAPQHRNVINAAKAAGVRFIAYTSLLHADTSPLGLADEHIETEKMLADSGIVYTLLRNGWYSENYLASAPAALEHGVFIGAAGDGKIASATRADYAAAAARVISEAGHEGKVYELAGDSAWTLTQLATELTKQSGKQVTYQNLSEADFAAALKSVGLPDGLADMLADSDVGASKGGLFDNSKTLSKLIGRPTTTLAESVSHLFNVNN

SEQ ID NO: 3188 - protein, 289 aa, Rhodopseudomonas palustris TIE 1
MSASRFLITGASGQLGRLVVDGLLKSLPPAQIGVLVRSEKVAAEFAAKGLHVHIGDYSNPETLGPAFAGVERALLISSSEIGQRTAQHRNAIEAARAAGVSLLAYTSLLHADTSPLGLAEEHRQTEAALKASGVPHALLRNGWYSENYTASIPAALAHGALLGSAGNGRIASAARADYAEAAVRVLTAEQPQAGRIYELAGDDAYTLAEFAAELSQQSGKAVAYRDLPQAEYEAALVAAGLPKPFAALLADSDAGAAKGALFDDSRALSLLIGRPTTPIATTISAALKA

SEQ ID NO: 3189 - protein, 285 aa, Geobacter bemidjiensis Bem
MIVVTGATGQLGRLVIASLLKKVPASRIVAAVRNPDKAKDLANLGVQVRRADYDLPESWESALVDAEKVLLISSSEVGKRIGQHRTVIDAARRAGVKLLAYTSLLRADSSPLGLAAEHVATETMIRDSGISFVMLRNGWYTENYAASIAPAVEHGTFYGSAGDGRIASAARADYAEAAVAVLTTEAEGGRVYELAGDTAYTLNEFAAEISRQYGKPVNYVNLPELEYKKLLVSVGLPEPFAALLADSDSGAAKGGLFDDSRQLSTLIGRPTTALEAVIAQGKKGA

SEQ ID NO: 3190 - protein, 298 aa, Methylobacterium sp. 4-46
MSAHATHRLFVTGASGQLGTLVIDALLARLAPERVVAGMRRPDGEAGARLSARGVAVREADYDRPETLAAAFAGIDRLLLISSSEIGRREAQHRAVIAAARAAGIGLVAYTSVLRADTSPLALAGEHRRTEAALAESGLPCVILRNGWYTENYAASIPAALAEGALLGAAGEGPIASAARADYAEAAAAVLSAADPAGGADAPRIHELAGDGAYTLAEFAAEIARQARRPVAYRDLTEAAFKDALLGAGLPEPVAALLAQSDAAAARGALFDDGRALSRLIGRPTTPAAVTVAAALRR

SEQ ID NO: 3191 - protein, 286 aa, Escherichia coli O157 H7 EC4115
MIAITGATGQLGQYVIESLMKTVPASQIVAIVRNPAKAQALTAQGITVRQADYGDEAALTSALQGVEKLLLISSSEVGQRAPQHRNVINAAKTAGVKFIAYTSLLHADKSPLGLADEHIETEKMLADSGIVYTLLRNGWYTENYLASAPAALEHGVFIGAAGDGKIASATRADYAAAAARVISEAGHEGKVYELAGDSAWTLTQLAAELTKQSGKQVTYQNLSEADFAAALKSVGLPDGLADMLADSDVGASKGGLFDDSKTLSKLIGHPTTTLAESVSHLFNVNN

SEQ ID NO: 3192 - protein, 302 aa, Rhizobium leguminosarum bv  trifolii WSM2304
MSETILVTGAAGQLGQRVIHHLIETYKVAPGTIVTATRSPEKLAELANKGVVTRKADFDDAAGLEKAFAGVDRLLIISTDALDTPGKRLAQHKAAVAAAAKAGVKHIAYTSMPSPDDSLVTFAPDHLGSENAIKASGLAYTIIRDAWYHDNYLHSMPHNLQGGKWYSATGDGKVSTISRDDCALAIAAALASGTSDSATYTLTGAASLNNRQIAAIAAEAAGKPLEVVDVNDEQLGQGMRGAGLPGFVADMLVSADANIRAGKFDIVTEDFTKLTGKQPQSLKDFFVAHKAALTAAGNAGGH

SEQ ID NO: 3193 - protein, 294 aa, Rhizobium leguminosarum bv  trifolii WSM2304
MSDTLLVTGAAGHLGRLVLDNLLASGTEPSRIIAVSRDTAKLADYAAKGVQTRKADFEDSASLDAAFAGADRILIISTDALDEAGKRLRQHLAAVAAAKKAGAKHILYTSMPNPETSVIPFAPDHLGTENAIKATGIPYTILRNGWYMENLFLSLPHALSTGQWFTSTGEGRLAHISRADIAAATAAALAATSSESVTYTLTGAKSLNTAEIASLVTTATGKPLQVIQITDEQLAGGLEAAGLPGFMIPVIVSFDTNTREDHISLVTDDAVTLSGKPLTTLSSFLDTNKAALAG

SEQ ID NO: 3194 - protein, 297 aa, Methylobacterium chloromethanicum CM4
MSTSEPRLFVTGATGQLGRLVIEALLKRVPADSIVAGVRSLESAAAEDLRAQGVTLRVADYARPETLAEAFRGIDRLLLISSSEIGQRVAQHQNVIQAARQSGVSLIAYTSLLRADTSPLALADEHRRTEDALKASGLSFAVLRNGWYTENYAASIAPALAHGVLLGSAGEGRIASAARADFAEAAAVVLTTDGHDGRVYELAGDDAYTLDEFAAAVSVLSGQTVVYRNLTEAAFKAALVAAGLPEDFAALLADSDMAAAQGGLNDTNRQLSGLIGRPTTPYRTTIAGTISGMAAQG

SEQ ID NO: 3195 - protein, 288 aa, Arthrobacter chlorophenolicus A6
MSIVVTGATGQLGRHVLEALLERNVPAGDIVAAGRSVDKLADFAAKGVRVVSVDYSDADSVAAALKGATRILLISGSEVGQRVEQHRTVIEAAKAEGGVELLAYTSIANADTTGMKLADEHKATEELLRESGVPFALLRNGWYLENYTEQLPGTLAQGAIAGSAGDGKVSGASRQDYAQAAAAVLVADGQAGKVYELGGDHAFSMADLAAEITAATGTDISYNNMPSGNYAGLLAQVGVPQAFAEILADSDLGIARGDLLVTTGDLQKLIGRPTTSLAEAVRSAAASA

SEQ ID NO: 3196 - protein, 290 aa, Anaeromyxobacter dehalogenans 2CP 1
MIAITAASGKLGHQAVEALLKRVPAATLVALVRHPARAADLAALGLQVREGDYDRPATLDTALAGVEKLLFISGSEVGRRVPQHQAVVDAARRAGVGLVAYTSILHADTSGVMLAVEHRETEAMLRASGVPHVLLRNGWYLENYTEHLGPALAHGAIAGAARDGRIAGAARADYAEAAAAVLTGEGHEGRAYELAGTPFTMADLAAEVSRQAGKPVAYRDLPPADYRAVLVGAGIPGPYADALVDADLGVARGELDDASGDLERLIGRPSTPLATAVAAALAALGARPRA

SEQ ID NO: 3197 - protein, 291 aa, Agrobacterium vitis S4
MTKILITGASGKLGRLVINHLLESQHVAAADIVAASRNPSGLADLAAKGIETRQADFTDPASLDQAFSGIDRLLIISTDAIGSRVEQHKAAVAAAANAKVGRIFYTSMPNPETSKILFAPEHAQTEQAIKASGLAYTILRNNWYMENLFMTLPSALASGQWHTSAGEGKTAYIAREDIARAIASALAKPVAENIVYTLSGSRAYSNREIAALAEKATGKPLAVVDITDQQLEDGMVAAGIPKPVAPVFASIDTAIRAGDLDVITDDAQSLSGHPLLSLEAFIEANKASLIG

SEQ ID NO: 3198 - protein, 271 aa, Actinosynnema mirum DSM 43827
MTTLITGATGHLGALIADHVLTRIPASELAVSTRSPEKAEALSARGVDVRKADFDDAESLRAAFAGVDRLVLVSADGPDRIAQHTRVVEAAKAAGVSFIAYTSVVDADTSTLSLAPDHAATERVIRESGIAFAFLRNGMYHENYTQALGHGVVAHAAGDGRNASASRHDLAEAAAVVVTGEGHEGKVYELTGPSAWTFAELAALAGDEAKPVTAQERIAGLVGFGLPDFVAELLTDIEVNIGRGALERVTDDLPTLLGRPATPIAEAVANR

SEQ ID NO: 3199 - protein, 301 aa, Rhizobium leguminosarum bv  trifolii WSM1325
MSETILVTGAAGQLGQRVIHHLIETYKIAPGSIVAATRSPEKLSELEKKGVVTRKADFDDAAGLEEAFAGVDRLLIISTDALDTPGKRLAQHQGAVAAAVKAGVKHIAYTSMPAPDNSLVTFAPDHLGSENAIKSSGIAHTIIRDAWYHDNYLHGMPHNLQGGKWYSATGDGKISTISRDDCALAIAAALASGTSESATYTLTGAQSLNNRQIAAIVSDVAGKPLAVVDVNDEQLGQGMLGAGLPGFVADMLVSADANTRAGKFDIVTEDFTKLTGKQPQPLKDFFVEHKAALTTSGNAAH

SEQ ID NO: 3200 - protein, 283 aa, Pectobacterium carotovorum PC1
MIAITGASGQLGRLVIAQLLEKVPAGDIVALVRDVNKVADLSAKGVLVKAADYNQPEALASALQGVDKVLLISSSEVGQRAAQHRNVIEAAVKAGVKLVAYTSLLHADKSPLALAEEHRQTEALLKDSGLPHVLLRNGWYTENYAASIPAALEHGVFIGSAGEGKITSATREDFAAAAVAVLTQEGQAGKVYELAGDEPYTLAELAAEISKQSGKSIGYQNLSEAEFTAALVSAGLPDVFAQIIADSDVGASKGGLFDGGKQLSRLIGRPTTPLSAVVKATLK

SEQ ID NO: 3201 - protein, 291 aa, Chitinophaga pinensis DSM 2588
MGKILVTGVTGHLGRAVLDKLLVKVPASNVKVLVRDAAKAEAFKPLGVEIAIGSYDDKASLVAAFQDTDKLYFVSGNDVANRGPQHENVVNAAIAAKVGHVVYTSVQRKSESATSSLAFIASTHLLVENLLKASGLQYTIMEHGLYAEVIPMFVGDRVLETGIIFQPAGAGKTAYALREDMAEAGVAVLTGEGHENRNYVITGSKAISYTDIAAAISAATGKQVTYVSPTVEAFKEELTKVGVPEMYIGLFAGFSTAVKEGEFEEVSGDLEKLIGRKSGSVEAYLKETYGK

SEQ ID NO: 3202 - protein, 287 aa, Catenulispora acidiphila DSM 44928
MTIAITAAGGHLGRLVVEDLLARGVPAGQIRAIVRTPEKVQDFADRGVQVVRGDYADVPGLTEALRGADKWVFISSSGSDEDRLSQHLTAIQAGKAAGVPHVVYTSIPKAETNPISFASVHKETEAAIKESGLPHTFLRNNWYWENLTASLPNAIEHGAIIGAVGEGLTAFAARADYAAAAAVVATTEGHEGKIYELTGDRAYSYAEIAAEISRQTGKEIAAVNLDPEEYRKTLAGFGLPDFLSAGLAHADSKIAEGALADVTSDLSTLIGRPTTTVAEAITDALKA

SEQ ID NO: 3203 - protein, 366 aa, Clostridium perfringens SM101 uid12521
MNEEFLGALSEIVKEKGISVEALLETIDDAIIAAYKKNFSNSGTTAQNVKVKRDEKSGEIHVYAQKVVVEEVYDDVTEISLEDAKAISAIYQLDDIVEIEVTPKNFGRVAAQLAKQMVIQRIKESERNVIYSEFAEKEFDILPGTVIRKDKGNVFVDLGKIEGVLGPNEQMPTEKYNFNEKLQLYVVEVKKTSKGASVLCSRTHPGLVKRLFELEVPEIYEGIVEIKSIAREAGSRTKIAVYSNDESVDAMGACVGPKGVRVQNIVNELKNEKIDIIKWSNTPSEYIENALSPAKVVSVEADEETKSAKVIVDDSQLSLAIGKEGQNVRLAAKLTGWKIDIKSKSKAEELLQEEDIVVKEDTIIEE

SEQ ID NO: 3204 - protein, 383 aa, Streptococcus agalactiae 2603
MSKEMLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 3205 - protein, 368 aa, Bacillus cereus ATCC 10987
MSTELLDALLVLESEKGISKDIIIDAIEAALISAYKRNFNQAQNVRVSFNPQVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVHAENIDVDPVGSCVGPKGQRVQRIVDELKGEKIDIVRWSNDPVEYVANALSPSQVVKVLVDEEEKATTVVVPDHQLSLAIGKRGQNARLAAKLTGWKIDIKSESDAKQLGIVTEEDSVVAFGFDSVEDEIE

SEQ ID NO: 3206 - protein, 372 aa, Listeria monocytogenes 4b F2365
MSTELLDALHVLEHDKGISREVLVEAIEAALTSAYKRNFKDAQNVRVDLNMENGSIRVLARKEAVEQVFDSRLEISMEEAHKLNPVYKPGDVVELEVTPKDFGRIAAQTAKQVVTQRVREAERGIIYDEFIDREDDIMTGIVERQDSRFIYVNLGKIEAILSQNEQMPNETYHAHDRIKVYLTKVEKTTKGPQIFVSRTHPGLLKRLFEMEVPEIYDGVVEIKSVAREAGDRSKISVYTANEEVDPVGACVGPKGARVQTIVNELKGEKIDIVEWSEDPFTFVANALSPSKVLDVIVNEADQATTVIVPDYQLSLAIGKRGQNARLAAKLTGWKIDIKSETVATELGIYPRNDVEAPEVEDAESETYSEDEE

SEQ ID NO: 3207 - protein, 368 aa, Bacillus anthracis Ames 0581; identical to SEQ ID NO: 3205

SEQ ID NO: 3208 - protein, 368 aa, Bacillus anthracis str Sterne; identical to SEQ ID NO: 3205

SEQ ID NO: 3209 - protein, 368 aa, Bacillus thuringiensis konkukian; identical to SEQ ID NO: 3205

SEQ ID NO: 3210 - protein, 471 aa, Mesoplasma florum L1
MVNGAQILEALASLESEKSISKEVAIEGIKEGFQKAYERFFDTEAVVKTEINEQTGSINLFQELMVVATDDEIEDDWLEIVLEDALKINKEAKVGDKVYKPIDFDEEFSRVAVGQVRQIFQQKIRATERAMIYEKFIQLEGEIVRGKIVGMNDQGTSYILDIDGVHTSLWNQKTINREEFVVNELVDVLLEEVARENKYSQLVVSRVAPKFLAKLVEKEVSEVAQGLVEVMSVSREPGKRAKIAVLSHDEDVEPIGAIVGVKGSRINNISKELRGEKIDVVKWDDEIIPFIINAMAPVKVISVNEVEGEFDIVVPNQQLSLAIGKGGMAAKLVANLLKRRINIYSLENAITDNMDVLWNGNITEEEVNNPDFINEVNKRKINSQTVKPEYHKNSFRNAQANNEEELMSFQAEVEEEYNQVEELIEETNAVVQENKDLESIQSELESFNDILNDEDEEDFEEDEYEDLYDQE

SEQ ID NO: 3211 - protein, 368 aa, Bacillus cereus ZK; identical to SEQ ID NO: 3205

SEQ ID NO: 3212 - protein, 491 aa, Dehalococcoides ethenogenes 195
MKSDFLLAITQLSAEKNLPKEVVLATVESALVSAYRKESFAPNQNIAVKIDQLTGKVKVMAEKLVVEKVTDSRQEMRLLEAKRLKADAKIGDLMMVEDTPADAGRIAAQTAKQVILQRLHEAENTAIFDEYASKAGDTLVGVVQRIEPKQITVDIGRVEAIMPASEQAYGERYRAGQRIKVYVVDVAKTAKGPAVIVSRSHPGLVRRLFEMEVPEVFNQLVEIKAVAREAGSRSKVAVGALQPGIDPVGCCVGLRGIRIQNIVSELNGEKIDVVAWDSEIANFIANSLSPAQVTKVILNEAEKSAIVVIPDRQLSLGIGKEGQNVRLAVKLTGWRIDIKSASDEEVERAEETARKQGETEKPAITEKVIEKQPAAAPAAKAEAEPIEPVMPEAIIAEPAVKETPAKTEAVPEEQGVVVPLNVLDKVAEGDTVKLRFAEDLLPRREIVIDDKNKGKNKKKTVKGKDTAEDGIKLKGKKRRNVTDYESEEIDF

SEQ ID NO: 3213 - protein, 391 aa, Staphylococcus aureus COL
MSSNELLLATEYLEKEKKIPRAVLIDAIEAALITAYKKNYDSARNVRVELNMDQGTFKVIARKDVVEEVFDDRDEVDLSTALVKNPAYEIGDIYEEDVTPKDFGRVGAQAAKQAVMQRLRDAEREILFEEFIDKEEDILTGIIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVFSENNDIDAVGACVGAKGARVEAVVEELGGEKIDIVQWNEDPKVFVKNALSPSQVLEVIVDETNQSTVVVVPDYQLSLAIGKRGQNARLAAKLTGWKIDIKSETDAREAGIYPVVEAEKVTEEDVALEDADTTESTEEVNDVSVETNVEKESE

SEQ ID NO: 3214 - protein, 407 aa, Staphylococcus epidermidis RP62A
MSSNELLLATEYLEKEKKIPREVLIDAIEAALITAYKKNYDSARNVRVELNMDEGSFRVIARKEVVEEVFDDRDEVDLSTALVKNPAYEVGDIYEQDVTPKDFGRVGAQAAKQAVMQRLRDAEREILYDEFIDKEEDILTGVIDRVDHRYVYVNFGRIEAVLSEAERSPNEKYIPNERIKVYVNKVEQTTKGPQIYVSRSHPGLLKRLFEQEVPEIYDGTVIVKSVAREAGDRSKISVYSDNPDIDAVGACVGSKGARVEAVVEELGGEKIDIVQWDEDPKVFVRNALSPSQVLEVIVDEENQSTVVVVPDYQLSLAIGKRGQNARLAAKLTSWKIDIKSESDAREAGIYPVIESEEVADEIVNSGDEDVEFDNVNLEETNLTSTELAAETDEDKKDKTEEDNDTES

SEQ ID NO: 3215 - protein, 497 aa, Prochlorococcus marinus NATL2A
MALVLLPGLNNLIEDISEEKKLPSQVVEAALREALLKGYERYRRTLYLGISEDPFEEDYFSNFDVGLDLEEEGYRVLASKIIVEDVESDDHQIAIAEVMQVADDAQVGDTVVLDVTPEKEDFGRMAAATTKQVLAQKLRDQQRRMIQEEFADLEDPVLTARVIRFERQSVIMAVSSGLGRPEVEAELPRRDQLPNDNYRANATFKVFLKEVSETPRRGPQLFVSRSNAGLVVYLFENEVPEIQEGSVRIVAVAREANPPSRAVGPRTKVAVDSIEREVDPVGACIGARGARIQQVVNELRGEKIDVIRWSSDPVQYICNSLSPARVEVVRLVDPEGQHAHVLVPPDQLSLAIGREGQNVRLAARLTGWKIDIKNSQEYDQATEDSEVAELISQREEEESLQREAEKRLEAEQTARAEEDARLRELYPLPEDEEDFQNEELSNIDSNETESESDFESSEIDSNIDTDDAETEESDIDETIEDTVTAKDKIITEEEGTR

SEQ ID NO: 3216 - protein, 425 aa, Anabaena variabilis ATCC 29413
MSMVSLPGLKDLIESISRERNLPRLAVQAAIREALLKGYERYRRAQNIERKQFDEDYFDNFEVELDIDEEGFRVLSTKSIVEEVNNSDHQISLDEVQQVAPEAQLGDSVVLDVTPDQGEFGRMAAMQTKQVLAQKLRDQQRQMVQEEFQDLESTVLQARVLRFERQSVILAVSSTFGQPEVEAELPKREQLPNDNYRANATFKVYLKKVSQGQQRGPQLLVSRADAGLVVYLFANEVPEIEDEVVRIVAVAREANPPSRYVGPRTKIAVDTLDRDVDPVGACIGARGSRIQVVVNELRGEKIDVIRWSPDPATYIANALSPARVDEVRLMDPETRQTHVLVAEDQLSLAIGKEGQNVRLAARLTGWKIDIKDKAKYDQAAEDAKFVAARAKYQLEEDDIESEELDYEENQEGELEDESFDPNDEE

SEQ ID NO: 3217 - protein, 485 aa, Synechococcus sp. CC9902
MALVLLPGLTNLIDDISEEKKLAPQVVEAALREALLKGYERYRRTLYIGISEDPFDEDYFSNFDVGLDLEEEGYRVLASKIIVDEVESEDHQIALAEVMQVAEDAQSGDTVVLDVTPEKEDFGRMAAATTKQVLAQKLRDQQRRMIQEEFADLEDPVLTARVIRFERQSIIMAVSSGLGRPEVEAELPRRDQLPNDNYRANATFKVFLKEVSEVPRRGPQLFVSRSNAGLVVYLFENEVPEIQEGSVRIVAVAREANPPSRSVGPRTKVAVDSIEREVDPVGACIGARGSRIQQVVNELRGEKIDVIRWSQDPGQYIANSLSPARVEMVRLVDPAGQHAHVLVPPDQLSLAIGREGQNVRLAARLTGWKIDIKNSTEYDQPAEDAVVAELISQREEEEALQQEAEERLAVEQAARAEEDARLRELYPLPEDDEDYVEEAELSEEPSAEFVEGDAVIEDVEGETVAPEETGEASGDAETNMSEDAR

SEQ ID NO: 3218 - protein, 481 aa, Synechococcus sp. CC9605
MALVLLPGLSNLIDDISEEKKLPPQVVEAALREALLKGYERYRRTLYLGISEDPFDEEYFSNFDVGLDLEEEGYRVLASKIIVDEVESEDHQIAIAEVMQVADDAQVGDTVVLDVTPEKEDFGRMAAATTKQVLAQKLRDQQRRMIQEEFADLEDPVLTARVIRFERQSVIMAVSSGLGRPEVEAELPRRDQLPNDNYRANATFKVFLKEVSEVPRRGPQLFVSRSNAGLVVYLFENEVPEIQEGSVRIVAVAREANPPSRSVGPRTKVAVDSIEREVDPVGACIGARGSRIQQVVNELRGEKIDVIRWSQDPGQYIANSLSPARVEMVRLVDPVGQHAHVLVPPDQLSLAIGREGQNVRLAARLTGWKIDIKNSTEYDQEAEDAVVAELISQREEEEALQQQAEERLAAEQAARAEEDARLRELYPLPEDEEEYGEEQPEQEFSEEEPAEVEAGTESETEATDAAVEADADADPDQEQVR

SEQ ID NO: 3219 - protein, 468 aa, Prochlorococcus marinus MIT 9312
MALVILPGLNNLIEDISEEKKLPPNIVELALREALLKGYEKYRKTFYIGVVEDPFDEEYFNNFDVGLDLDEEGYRVLSSKIIVEEVESEDHQISLAEVKQVAEDAQIGDTVVLDVTPEKEDFGRMAASTTKQVLAQKLRDQQRKMIQEEFADLEDPVLTARVIRFERQSVIMGVSSGIGRPEVEAELPKRDQLPNDNYRANATFKVFLKEVSEIARKGPQLFVSRANAGLVVYLFENEVPEIQEGTVKIVAVSREANPPSRGVGPRTKVAVDSVEQEVDPVGACIGARGARIQQVVNELRGEKIDVIKWSSDPIQYILNSLSPAKVDQVRLVDPAGQHAHVLVPPDQLSLAIGREGQNVRLAARLTGWKIDVKNSHEYDQKAEDAAVSELIIQREDEENLQREAELRLEAEQAERAAEDARLRELYPLPEDDQEYEEEEQYGEGDLSDNDQLETLQDSEIAAKEERKR

SEQ ID NO: 3220 - protein, 441 aa, Synechococcus elongatus PCC 7942
MSMVTLPGLEQLIYAISEQKKLPANVIEEALKEALLKGYERYRRTQQMGEQFEEDYFDNIDVELDVEQEGFRVLATKTIVNQVENPDHQIALADVQEVAPDAQAGEIVVLDVTPDKDDFGRMAAIQTKQVLSQKLRDHQRKLIQEEFQDLEDPVLMAKVLRFERQSVILGVSSGLGRPEVEAELPRREQLPNDNYRANATFRVFLKEVSEVPRRGPQLIVSRANAGLVVYLFENEVPEIQDGVVRIVAVAREANPPTRHVGPRTKIAVDTLEREVDPVGACIGARGSRIQVVVNELRGEKIDVIRWSPDPATYIANALSPARVQEVRLVDPEGRIAHVLVNDDQLSLAIGKEGQNVRLAARLTGWKIDIKDVALYDAVTEGQRISELIQERQERAAIAAEEEARAAAEAAELAEWEAEEAALAAAEAAAELAAAEAEEETV

SEQ ID NO: 3221 - protein, 395 aa, Deinococcus geothermalis DSM 11300
MAQPEFNFADALREVAQARNINELQLIEAFEQSLAQAYSRNVEPDRRVEVHLDPVSGELEVLIVREVVEKVEDENLQISLADALELDPGVEIGMEMEFPVDREKFSRIALQAAKQTLTQKMRETERNVVYNEYKDREGQVLTAQVVRSDNKGNWFVELGAGEAILPPREQIPGEKLVPGNRVKIYLKEVRKTPKGPTILASRADERLLEYLLRQEIPEVANGIVEIKAIAREAGQRSKVAVYSHNPNVDPIGACIGHRGNRIQAVTGELGRERVDVILWDANARDFIRNALSPAKVGLIEVRPDTREATVTVTPDQLSLAIGKGGQNVRLAAKLTGFKIDLRETAAIQDLDAAMQQALQEEQGNTGPSSAAASAFDALFRDSKSVATASPDDEQE

SEQ ID NO: 3222 - protein, 362 aa, Moorella thermoacetica ATCC 39073
MNSEFIQALRDLEREKGINADILLEAIEAALISAYKKNFGSLQNVRVDIQRDTGEIKVLAQRQVVEEVTDPRQEISLEEARAINSKYELGDIVEKEVTPRDFGRIAAQTAKQVVVQRIREAERGLIYEEFIGRENDLVTGVVQRQEGKNIILDLGRAEAILLPSEQSPGETYRQGERLKVYVLEVRKTNKGPQILVSRTHPGLIKRLFELEVPEIHDGIVEIKGVAREPGARSKIAVHSRDEKVDPVGSCVGPKGARVQAVVQELRGEKVDIIKWSDDPAVYVANSLSPARVLDVTVDEENKVSQVIVPDNQLSLAIGKEGQNARLAARITGWKIDIKPESEAGDWDSWDADLDLDGTIEEE

SEQ ID NO: 3223 - protein, 426 aa, Trichodesmium erythraeum IMS101
MSMVSLPGLKELIGNISKERNLPKQAVQTALREALLKGYERYRRTQRVDGVNFTDDYFENFEIELDIEEEGYRVLATKTIVEEVTNPDHHIALQEVLEVASEAQLNDTVFLDVTPEKNEFGRMAAIQTKQVLAQKLRDQQRKMIQEEFQDLEGEVLQARVLRFEKQSVILAVSSGFGRLEVEAELPKKEQLPNDNYRANATFKVYLKRVCEGSTRGPQLLVSRADAGLVVYLFENEVPEIEDEVVRIVAVAREANPPSRHVGPRTKIAVDTLERDVDPVGACIGARGSRIQVVVNELRGEKIDVIRWSPDPSIYIANSLSPARVDEVRLIDPEERRSHILVSEDQLSLAIGKEGQNVRLAARLTGWKIDIKDTNRYDHAEEDSKVAAEVSHRQALAEQEENKIEESELEVIENTFDKNFNEPDDSF

SEQ ID NO: 3224 - protein, 366 aa, Clostridium perfringens ATCC 13124
MNEEFLGALSEIVKEKGISVEALLETIDDAIIAAYKKNFSNSGTTAQNVKVKRDEKSGEIHVYAQKVVVEEVYDDVTEISLEDAKAISAIYQLDDIVEIEVTPKNFGRVAAQLAKQMVIQRIKESERNVIYSEFAEKEFDILPGTVIRKDKGNVFVDLGKIEGVLGPNEQMPTEKYNFNEKLQLYVVEVKKTSKGASVLCSRTHPGLVKRLFELEVPEIYEGIVEIKSIAREAGSRTKIAVYSNDESVDAMGACVGPKGVRVQNIVNELKNEKIDIIKWSNTPSEYIENALSPAKVISVEADEETKSAKVIVDDSQLSLAIGKEGQNVRLAAKLTGWKIDIKSKSKAEELLQEEDIVVEEDTIIEE

SEQ ID NO: 3225 - protein, 378 aa, Syntrophomonas wolfei Goettingen
MSNDLVQALNDIEKERGIPKRALIEAIKSALSTAYKKNFGIAQNVSVEFNEINGEVKVFSQKKISDEVKDPRLEMSLEEAQELYPDCKVEDLVYVEATPSDFGRIAAQTAKQVVIQKLREAERSLIYEEFLEREGEIITGTIQRLESKTVYISLGRTEGIMMASDQIFGERYEVGQRIKAYIYEVKNTSKGPNIFVSRSHPYFLRRLFEMEVPEIYDGVVEIKSIAREAGARSKIAVYSLDDKIDSVGACVGPRGLRVQNIVSELGGEKIDIIKYDKDPERYISNALSPSRVVAVNINETDKIARVIVPDYQLSLAIGKEGQNARLAAKLTGWKVDIRSESQMSDYYNEIDAEMDDEVLEQDWAEENTGETKIDEQDS

SEQ ID NO: 3226 - protein, 473 aa, Oenococcus oeni PSU-1
MASDYRRELFSALQALQAEKGISQEDAITSLKDTLVTAYKKNFEGETNVEVDVDPEKQEFNLLQIKEVIPDGDMIDPYSEIYLKDAREINSAYEAGDQIKFEINPRDFGRLAAQSGKNKSTQTIREKEKEAIHARYEGFEHEIVSARVAREDQRFLWVTMPDGQEAAMGDKDRIPGETYKTGDPIKVLINRVEDSATRGPQIYVSRTSPELVKRLFEQEVPEVYDGTVVIESIAREAGDRSKVAVRTTDSNLDPIGTLVGTRGSRVQAVVNELHGENMDIVEWVEDEAQYIANALNPAEVVDVIFSPDNDNEVTVIVPDYQLSLAIGKRGQNARLAAKLTKFKIDIKSETQAENDPQLQAILEESAKYAEEEDQSDETDETDEALEDETEYADANEYFSEGADQSDASEEEKTSESAEESSSAEEDSSKAKAKMTEAEVKEAQDEFAAALKNVDFDAILEEKEGDDNKKSDDK

SEQ ID NO: 3227 - protein, 365 aa, Leuconostoc mesenteroides ATCC 8293
MSKELVEALNALESERGIDRLVVVEALEDALKAAYKKQYNTADNVEATFDDKKGNISIKQVKHVVLDDDLEDEEIEISLSDALAINRAYEAGDEIRFDVTPKDFGRMAAQAAKQVIVQKMREAGRQAIYNKFSDYEDEIITGEVDRQDARFLYVNLPGNQEAVMAPNDQMPNERYHMGDRIKVLVNKVENNAKGPQVFVSRTAADLVKRLFEQEVPEVYDGTVEIMSIAREAGDRSKIAVYTHDTDLDPVGAMVGQRGARVQSVVNELAGENMDIVEWVEDEAQYIANALNPSEVTDVIFDPANDRAVTVIVPDNQLSLAIGKKGQNARLAARLTGFKIDIKSESEAAASLDPTPAATAADENEE

SEQ ID NO: 3228 - protein, 423 aa, Lactobacillus gasseri ATCC 33323
MLLVALQLNFRKDDQKLMSKEMVEAFATLEKEKGIKQEIIVDAIKAALVAAYKKNYNQAQNVEVVFDEKKGNFKVNAIKTVVDEVQDSRLEVSLKDALEINRAYEVGDEIRFEVTPKDFGRLAAQTAKQVIMQRLREAEREHIISEYSQYKDEIVTGTVERRDNRFVYVKIGNVEAVMTHNDQLPGENYNPQDKVRVLVTRVGSDSKGAQITVSRTAPDLVKRLFEQEVPEVYDGTVEIVSIAREAGDRTKIAVKSNDPDIDPVGTLVGPKGTRVQNIVNELGGENIDVVKYEENPSDFIANALNPAEVIAVQFSGDDDDKNALVIVPDYQLSLAIGKRGQNVRLAARLTGYKIDIKPESQVEFVDSEGDDVETDQDIDDSNVSNEEATESTAEQLEEDSSEDFPNGEDVDSALDDDADKDEE

SEQ ID NO: 3229 - protein, 382 aa, Lactococcus lactis cremoris SK11
MSKEMLNAFAMLEEQKGIKSEIAIEAIEQAITAAYKRQYGQAQNVKVIFDEKKGNFNVYSTREVVDEVFDSRLEISLEDAHELNPHYEIGDKIMFEEKPKDFARTAAGAAKQVIMQKMREEERTIIYNEYSRYKDEIIQGTVEKVDARAVYVNLGRVDALLTKKDQIPQENFHVDDRVKVYVTDVVLTPKGTRVFISRTVPDMLKRMFEKEIPEVFDGTVEIKSIARDAGDRAKVIVQSHDENVDAIGTMVGAKGSRIQGIIRELAGEKMDIIEWSEDKATLVANALKPARIEQVLITADGSSLAVVARDQLSLAIGKRGQNVRLAAHVTNSKIDIKAADEFNMDDYEFVGEADEETPTLEVEETISVDEVVEEPVVSESEE

SEQ ID NO: 3230 - protein, 391 aa, Streptococcus thermophilus LMD-9
MLEAFRVLEEEKHINKEDIIDAVVESLKSAYKRRYGQSESAVVEFNEKTGDFQVFTVREVVDEVFDSRLEISLKDALAISSAYELGDKIRFEESVDEFGRVAAQSAKQTIMEKMRKQMREITYNEYKQHEGEIMQGTVERFDQRFIYVNLGTLEAQLSRQDQIPGESFKSHDVIDVYVYKVENNPKGVNVFVSRSHPEFIKRIMEQEIPEVFDGTVEIMSVSREAGDRTKVAVRSHNPNVDAIGTIVGRGGSNIKKVVSRFHPTRLDAKTGIEVPVEENIDVIQWVEDPAEFIYNAIAPAEVDYVLFDEDDSKRATVVVPDNKLSLAIGRRGQNVRLAAHLTGYRIDIKSASEYEALEAEKAEAEVDEVVEEIVAEATPVDVTTEEAPEAE

SEQ ID NO: 3231 - protein, 428 aa, Desulfovibrio vulgaris DP4
MSMELKKAIDQISKDKGLERDMLVATLEEAVRTSVVRKYGDDIDVEVSYNDESGEIEVYQFKIVVAELDDEDEDGNAHIVLEEARKHDPSVQIDDEMGFRLKVEDLGRIAAQSAKQVIIQRMRDAEQELIYDEFKDRRGEIISGIIQRRDKAGWIINLGRTEALLPKEEQIPREHYKRGDRVQAIIIEVRKEGRGPQVIVSRSHRDYMAALFRREVPEVDDGTVQIMGVARDPGSRAKVAVLSRERDVDPVGACVGIRGSRIQNVVQELRGERIDIVVWSPEIATYARNALSPAVISRIVVDEEENLLEVIVPDDQLTNAIGRKGQNVKLAAKLLGWKIDIYTETRYNEANAIGRGLEQIASVAEISIEQFVTAGFQSIERLREASDEELASGLGIDDNRIADLRAAINFLSPAPSASDGDDADGETE

SEQ ID NO: 3232 - protein, 467 aa, Prochlorococcus marinus MIT 9515
MALVILPGLNNLIEDISEEKKLPPHVVESALREALLKGYEKYRRTFYIGVKEDPFDEEYFSNFDVGFDLDEEGYRILSSKIIVEEVESEDHQISLNEVKQVADDAQIGDTVVLDVTPEKEDFGRMAASTTKQVLAQKLRDQQRKMIQEEFADLEDPVLTARVIRFERQSVIMGVSSGIGRPEVEAELPKRDQLPNDNYRANATFKVFLKEVSEIARKGPQLFVSRANAGLVVYLFENEVPEIQEGTVKIVAVSREANPPSRAVGPRTKVAVDSIEREVDPVGACIGARGARIQQVVNELRGEKIDVIKWSADPIEYILNSLSPAKVDLVRLVDPEGQHAHVLVPPDQLSLAIGREGQNVRLAARLTGWKIDVKNSHEYNQEAEDAAVAELIVQREEEEHLQREAEQRLEAEQAERAAEDARLRELYPLPEDDEEYGSESYEEENLSENSQLENMNPDEIISTEEKAR

SEQ ID NO: 3233 - protein, 467 aa, Prochlorococcus marinus AS9601
MALVILPGLNNLIEDISEEKKLPPNIVELALREALLKGYEKYRKTFYIGVNQDPFDEEYFSNFDVGLDLDEEGYRILSSKIIVEEVESEDHQISLVEVKQVADDAQIGDTVVLDVTPEKEDFGRMAASTTKQVLAQKLRDQQRKMIQEEFADLEDPVLTARVIRFERQSVIMGVSSGIGRPEVEAELPKRDQLPNDNYRANATFKVFLKEVSEIARKGPQLFVSRANAGLVVYLFENEVPEIQEGTVKIVAVSREANPPSRAVGPRTKVAVDSVEEEVDPVGACIGARGARIQQVVNELRGEKIDVIKWSSNPIQYILNSLSPAKVDQVRLVDPAGQHAHVLVPPDQLSLAIGREGQNVRLAARLTGWKIDVKNSHEYDQEAEDAAVSELIIQREDEENLQREAELRLEAEQAERAAEDARLRELYPLPEDEEEYGEEQYEGVEFTDNDPLETVQDTETSAKEEKKR

SEQ ID NO: 3234 - protein, 484 aa, Prochlorococcus marinus MIT 9303
MALVLLPGLNNLIEDISEEKKLPTQVVEAALREALLKGYERYRRTLYLGISEDPFEEEYFSNFDVGLELDDEGYRVLASKIIVEEVESEDHQIALQEVMQVAEDAQIGDTVVLDVTPEKEDFGRMAAATTKQVLAQKLRDQQRRMIQEEFADLEDPVLTARVIRFERHSVIMAVSSGLGRPEVEAELPRRDQLPNDNYRANATFKVFLKEVSEVPRRGPQLFVSRSNAGLVVYLFENEVPEIQEGSVRIVAVAREANPPSRSVGPRTKVAVDSIEREVDPVGACIGARGSRIQQVVNELRGEKIDVIRWSPDPGQYIANSLSPARVEMVRLVDPEGQHAHVLVPPDQLSLAIGREGQNVRLAARLTGWKIDIKNSQEYDQASEDTTVAELISQREEEEALQRDAESRLAAEQATRAEEDARLRELYPLPEDEEEYDQEEPAKTMAEDENASDADGQPDDLSSQPDTSSEQLSNEESVEEEDRAR

SEQ ID NO: 3235 - protein, 497 aa, Prochlorococcus marinus NATL1A
MALVLLPGLNNLIEDISEEKKLPSQVVEAALREALLKGYERYRRTLYLGISEDPFEEDYFSNFDVGLDLEEEGYRVLASKIIVEEVESDDHQIAIAEVMQVADDAQVGDTVVLDVTPEKEDFGRMAAATTKQVLAQKLRDQQRRMIQEEFADLEDPVLTARVIRFERQSVIMAVSSGLGRPEVEAELPRRDQLPNDNYRANATFKVFLKEVSETPRRGPQLFVSRSNAGLVVYLFENEVPEIQEGSVRIVAVAREANPPSRAVGPRTKVAVDSIEREVDPVGACIGARGARIQQVVNELRGEKIDVIRWSSDPVQYICNSLSPARVEVVRLVDPEGQHAHVLVPPDQLSLAIGREGQNVRLAARLTGWKIDIKNSQEYDQATEDSEVAELISQREEEESLQREAEKRLEAEQTARAEEDARLRELYPLPEDEEDFQNEELSNIDSNETESESDFESSEIDSTIDTDDTETEESDIDETIEDTVTAKDKIITEEEGTR

SEQ ID NO: 3236 - protein, 404 aa, Clostridium thermocellum ATCC 27405
MSADLIHALEQLEKEKGIDKDTLIEAIEAALISAYKRSFGSSQNVKVSIDRETGDFKVYALKKVTANPQNELLEISIENAKKINPDFEENDIVEIEVTPRKFGRIAAQTAKQVVVQRIREAERGIIYNEFSNKEGEIVTGVVQRIERKNVIIDLGKAEAILAPSEQIPGEEYKFNDRIKTYIIEVKKTTKGPQILVSRTHPGIIKRLFELEVPEIYEGIVEIKSIAREPGSRTKIAVYSKDENVDPVGACVGQKGTRVQAVVDELRGEKIDIIKWSSNPEEYISSSLSPAKVIRVDINEEEKSAKVTVPDFQLSLAIGKEGQNARLAAKLTGWKIDIKSESQLRAAIEQQLLNFNGSYSTEKQDTPITPDQLFKTNVEESSNDTVDDNAENAADDVVEDTMDDV

SEQ ID NO: 3237 - protein, 467 aa, Prochlorococcus marinus MIT 9301
MALVILPGLNNLIEDISEEKKLPPNIVEAALREALLKGYEKYRRTFYIGVNEDPFDEEYFSNFDVGLDLDEEGYRILSSKIIVEEVESEDHQISLIEVKQVADDAQIGDTVVLDVTPEKEDFGRMAASTTKQVLAQKLRDQQRKMIQEEFADLEDPVLTARVIRFERQSVIMGVSSGIGRPEVEAELPKRDQLPNDNYRANATFKVFLKEVSEIARKGPQLFVSRANAGLVVYLFENEVPEIQEGTVKIVAVSREANPPSRAVGPRTKVAVDSVENEVDPVGACIGARGARIQQVVNELRGEKIDVIKWSSDPIQYILNSLSPAKVDLVRLVDPEGQHAHVLVPPDQLSLAIGREGQNVRLAARLTGWKIDVKNSHEYDQEAEDAAVSELIIQREDEEKLQREAELRLEAEQAERAAEDARLRELYPLPEDEEEYGEEQYEGEELTDNDPLETLQDTDISAKEEKKR

SEQ ID NO: 3238 - protein, 384 aa, Desulfotomaculum reducens MI-1
MNSEFLEALRDLEKEKGIAVDVLLEAIEAALLSAYKRNFGSLQNARVHIDRDTGDYKVYSQRAVVEEVEDDRVEISLEDARKIDPRFNLEDVVEDEVTPRNFGRIAAQTAKQVVVQRIREAERNIIFEEFSNREGDILTGIVQRIENKNVFIELGKTEAILTPSEQIPNEDYRHGDRLKTYIVEVRKTTKGPQILVSRTHPGLLKRLFELEVPELQEGVVELKSIAREAGYRSKIAVYSKDENIDPVGACVGPKGMRVQNIVTELNGEKIDIIKWNQDPSKYVASSLSPAKVVAVEVWEDEKVARVIVPDYQLSLAIGKEGQNARLAAKLTGWKIDIKSESQMTDIYPEYDAEENDGFSTDDNYLETFEDEYKHVDSSEEKNGE

SEQ ID NO: 3239 - protein, 491 aa, Dehalococcoides BAV1
MKSDFLLAITQLSAEKNLPKEVVLATVESALVSAYRKESFAPNQNITVKIDQLTGKVKVMAEKQVVEKVIDSRQEMRLLEAKRLKADAKIGDLMMVEDTPADAGRIAAQTAKQVILQRLHEAENTAIFDEYASKAGDTLVGVVQRIEPKQITVDIGRVEAIMPANEQAYGERYRAGQRIKVYVVDVAKTAKGPSVIVSRSHPGLVRRLFEMEVPEVFNQLVEIKAVAREAGSRSKVAVGALQPGIDPVGCCVGLRGIRIQNIVSELNGEKIDVVAWSSEIASFIANSLSPAQVTKVILNEAERSAIVVIPDRQLSLGIGKEGQNVRLAVKLTGWRIDIKSASDEDVERAEVAARQQEEISKSKITEKVVEKQPVIAAVSKTETVPVEKVLPADTIIEPVAKETPAKAESVPEEQGVVVPLNVLDKAAGGDSVKLRFAEDLLPRREVVIDDKNKSKNKKKTVKGKDTAEDGIKLKGKKRRNVTEYESEEIDF

SEQ ID NO: 3240 - protein, 391 aa, Staphylococcus aureus JH9
MSSNELLLATEYLEKEKKIPRAVLIDAIEAALITAYKKNYDSARNVRVELNMDQGTFKVIARKDVVEEVFDDRDEVDLSTALVKNPAYEIGDIYEEDVTPKDFGRVGAQAAKQAVMQRLRDAEREILFEEFIDKEEDILTGIIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVFSENNDIDAVGACVGAKGARVEAVVEELGGEKIDIVQWNEDPKVFVKNALSPSQVLEVIVDETNQSTVVVVPDYQLSLAIGKRGQNARLAAKLTGWKIDIKSETDAREAGIYPVVEAEKVTEEDIALEDADTTESTEEVNDVSVETNVEKESE

SEQ ID NO: 3241 - protein, 395 aa, Lactobacillus reuteri DSM 20016
MSKPKINTEMIGALDYLEKEKGIKKEIVIEALEQALESAYKQNYGDKNVEVEFNSLTGNIKVYAVKTITDDEEAVEADSNEFMSLADARKLPHGQGYDIGDEIREEVTPRDFGRIAAQTAKQVVMQRLREEERKIIYDRYKTYENEIITGEVSREDKRFTYVDLGDGVEGAMGFRDKMPNEHYHVHDRIQVYVTKVNDDRRGPQIFVSRTAPELLKRLFEREVPEIKDGTVLIENIAREAGDRAKVAVYSNDPNVDPVGTCVGPRGSRVQAIVNELDGENMDIVEYVKDPAKFIANALNPAEVLDVIFNEEKAASETEDSEGEETTEGQTERSCTVVVPDSQLSLAIGKRGQNARLAARLTKYKIDIKSESEMAENDQESEEVADSEENIDNNEE

SEQ ID NO: 3242 - protein, 442 aa, Roseiflexus sp. RS-1
MKSDFYAAISQIASERGIPKEAIVEVMEKALATAYRRTLGPNPPPMEISVRLDPVTGMARVYAEKQVVDDVFDERFEIDLESARKIKPDVELGESVVVEATPRDFGRIAAQTAKQVILQGIKEVEREHIYGEYMDREGELVTATVQRIAKGNVILEMGKAEAILPPKEQVETDRYYHGQRLKVYLMEIRREDRGPKLIASRAHKNLITRLFEMEVPEIYNGAVEIKSIAREPGIRTKVAVAARQEGIDPVGSCVGMRGIRIQNIVNELNGEKIDVVQWSSNPKEFIANALSPAQVVEVQLRDDEHAATVIVPDKQLSLAIGKEGQNVRLAAKLTGWRIDIKSASALLDEERAAAEARDAAEAEALATEAALATAKVETRKVYADGTIVYRKHRYGPLGDDLVGETVQLRATPQKLYIYRGDRLVASYILVEEDDDEEDEDEE

SEQ ID NO: 3243 - protein, 391 aa, Staphylococcus aureus JH1; identical to SEQ ID NO: 3240

SEQ ID NO: 3244 - protein, 366 aa, Bacillus cereus cytotoxis NVH 391-98
MSTELLDALLVLESEKGISKDIIIDAIEAALISAYKRNFNQAQNVRVSFNPEVGTIQVLARKDVVDNVFDPRLEISVEEARQINPNYQNGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVYAENIDVDPVGSCVGPKGQRVQRIVDELKGEKIDIVRWSNDPVEYVANALSPSQVVSVLVNEEEKATTVIVPDHQLSLAIGKRGQNARLAAKLTGWKIDIKSESDAKQLGIVTEEDNMIAFDSVEDEIE

SEQ ID NO: 3245 - protein, 442 aa, Roseiflexus castenholzii DSM 13941
MKSDFYAAISQIASERGIPKEAIVEVMEKALATAYRRTLGPNPPPMEISVRLDPLTGAARVYSEKQVVDDVYDERFEIDLESARKIKPDVELGESVVVETTPKDFGRIAAQTAKQVILQGIKEVEREHIYGEYMDREGELVTATVQRMAKGNVILEMGKAEAVLPPKEQVETDRYYHGQRLKVYLMEIRREERGPKLIASRAHKNLITRLFEMEVPEIYNGAVEIKSIAREPGIRTKVAVAARQEGIDPVGSCVGMRGIRIQNIVNELNGEKIDVVQWSSNPKEFIANALSPAQVVEVQLRDDEHAATVIVPDKQLSLAIGKEGQNVRLAAKLTGWRIDIKSASALLDEERAAAEARDAAEAEALATEAALATAKVEMRKVYADGTIVYRKHRYGPLGDDLVGETVQLRATPQKLYIYRGDRLVASYMLVGDDEEDAIEGDE

SEQ ID NO: 3246 - protein, 444 aa, Herpetosiphon aurantiacus ATCC 23779
MKSDFYAAISQIAAERGIPRESVQDVVEQALISAYRRYLGSNPPPVDVKIELEPNTGRIRVYAEKQVVDEVMDDRFEIDIEDARNVRADVEIGETVYVESTPDDFGRIAAQTAKQVVLQRIKEVERDHIYGEYFDREGEIVTATVQRTAKGNVILEVGRAEAILPQKEQISHDNYRHGQRLKVYLMEARRDDPRGPRLVASRTHKDLIKRLFEMEVPEIYNGTVEIKSIAREPGLRSKVAVHARQEGIDPVGSCVGMRGIRIQNIVNELNGEKIDVVQWGADMRVFIANALSPAQVVEVHLDEGEKTATVVVPDKQLSLAIGKEGQNVRLAAKLVGWRIDIKSASSLLEEERAAAEAREAAASEQMLQEAALSTAKVETRKVRVDSLVTYQGRQYGPLPVELIGEEVALRAAAQKLNIYFNDKLIASYIIDDEAGDSDETDTEA

SEQ ID NO: 3247 - protein, 471 aa, Prochlorococcus marinus MIT 9211
MALVLLPGLNNLIDDISEEKKLPAQVVETALREALLKGYERYRRTLYLGINENPFEEEYFSNFDVGLDLDEEGYRVLASKIIVDEVESEDHQIALSEVMQVAEDAQIGDTVVLDVTPEKEEFGRMAAATTKQVLAQKLRDQQRRMIQEEFADLEDPVLTARVIRFERQSVIMAVSSGLGRPEVEAELPRRDQLPNDNYRANATFKVFLKEVSETPRRGPQLFVSRSNAGLVVYLFENEVPEIQEGSVRIVAVAREANPPTRAVGPRTKVAVDSIEREVDPVGACIGARGSRIQQVVNELRGEKIDVIRWSADPVQYISNSLSPARVEVVRLVDPEGQHAHVLVPPDQLSLAIGREGQNVRLAARLTGWKIDIKNSQEYDQESEDSAVAELISQREEEESLQREAEERLAAEQAARAEEDARLRELYPLPEDDEENIEESTTELEELPISENEEAKQNEGLSNEQSPEDGPR

SEQ ID NO: 3248 - protein, 354 aa, Clostridium phytofermentans ISDg
MEGNKELIEALNQIEKEKDISKEVLLDAMENSLVAACKNHFGKADNIKVYIDRTTGAVSVFAERVVVEQVQDPVLEISLAEATMKFPKGKYELGDIVQVEVTPKNFGRIAAQKAKQVVVQKIREEERKVLFNQYYGREKDIVTGIVQRYVGNNVSINLGKVDAVLMENEQIKGEHFRPTDRIKLYVLEVKDTTKGPKITVSRTHPELVKRLFEAEVTEVKEGIVEIKSISREAGDRTKMAVSSNDPNVDPVGACVGLNGARVNAIVNELGGEKIDIVNWSDDPAELIENALSPAKVVSVDVSEGEMSAKVIVPDYQLSLAIGRQGQNARLAARLTGYKIDIKSESQVYGSYYEE

SEQ ID NO: 3249 - protein, 368 aa, Bacillus weihenstephanensis KBAB4
MSTELLDALLVLESEKGISKDIIIDAIEAALISAYKRNFNQAQNVRVSFNPEVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVYAENIDVDPVGSCVGPKGQRVQRVVDELKGEKIDIVRWSNDPVEYVANALSPSQVVKVLVDEAEKATTVVVPDHQLSLAIGKRGQNARLAAKLTGWKIDIKSESDAKQLGIVTEEDSVIAFGFDSAEDEIE

SEQ ID NO: 3250 - protein, 346 aa, Thermoanaerobacter sp. X514
MNAEFIEALNSICEEKGIPKDTMFEAIEAALVSAYKKNYGTSQNVKIVMDRETGDVKVYAQKTVVEEVYNDLLEISLEEARKINKKYQIGDIVDIEVTPKNFGRIAAQNAKQVVIQRIREAERNVIYEEFLAKETEVVTGIVTKVDKKNVLINLGRVEAILSPAEQIPGETFAPGDRVKVYIVEVKKTTKGPQILISRSHPGLVKRLFELESPEIQQGIVEIRSIAREAGSRTKMAVFSRDENVDPVGACVGYKGARVQAVVNELKGEKIDIVKWSSKPQEFIMNALSPAKALSIEILDEKEKVARVIVPDYQLSLAIGKEGQNARLAAKLTGWKIDIKSESMVKS

SEQ ID NO: 3251 - protein, 359 aa, Candidatus Desulforudis audaxviator MP104C
MNSEFLAALRDLEKERSISVEVLLEAIEAALLSAYRRNFGTSHNARVQVDRHTGDCKVYARRTVVQEVEDPQDQISLEEARAINPGYQLEDTVESEITPRNFGRIAAQTAKQVVVQRIREAERNMVFEEFASREGDIVTGVVQRIEQRNVYIELGKTEAVLPPAEQIPRENYRPGQRLKTYIVEVKKTTKGPLILVSRTHPGLLKRLFEIEVPELHQGLVELKAVAREAGIRSKIAVYSNDEGIDPVGACVGPKGARVQAIVQELNGEKIDVVKWSPDSSKFVSSSLSPAKVIAVEVWEDEKIARVIVPDYQLSLAIGKEGQNARLAAKLTGWKIDIKSESQMAEIYREYLEQQGYEQV

SEQ ID NO: 3252 - protein, 380 aa, Natranaerobius thermophilus JW NM WN LF
MNREFIEAIEEIERDKGINKDILFEAIEAALISAYKRNFDSDKNVRVHMERETGDVRVYHQKQVVEEVENPKEQISLEEARKISPGYEVDDLVEEEVTPKNFGRIAAQTAKQVVIQRIREAERELIYEEYVDKQDDIINGIVQRIEQKNVIIDLGKVEAILPPQEQMDTDEYNQGDRIKAYVVEVKKTTKEPQIILSRTHPGLIKRLLELEVPEIYDGTVEIKGIAREAGYRSKVAVYSRHEEVDPVGSCVGNKGSRIQSIVDELKGENIDVITWSSDPVVFISNSLSPSKVLEVKVLDEQDQKARVVVPDHQLSLAIGKEGQNARLAAKLTNWKIDILSESQLAEKGESSVEVEDFVEESASPEEPDNHGDETKDGDEG

SEQ ID NO: 3253 - protein, 524 aa, Mycoplasma arthritidis 158L3 1
MSERTEGEIKKAKEIFKAINDLSKLKNLNTNEVIELFKDAVKKVIMSYDEDAELEFVFDEENNEFIVINHTKYVVQDPITAEDKDMLCRCIEVPLSIAKELKSTAKEGDVISETINFETFQKKDYIRILQSFNQSIRELEKKVIVGVYSLKIGQIVRAKVATPTTRGIFFELEDGTPAYMPSNANNRKLTANLQPGDSIDVYIDNVGDADKNVQVLVSTVESKLIDKLLYKEVPEIANGLIDIVKIARIPGERAKIAISANEKTPIGVEVVGSVLGENGSRINNVIQQLKGERLDVIEYSADIKTFIKNAISPAKVIDIVENKEKWQANYPAYIVVVPNQHNTLAIGKRGQNVVLASDLVRAKLDIFSQDQADLAKIEYDINNGNITQAELDELAQGKRLQSQFRRRTRQDTASRDTIDMADFEKEMEEIKARMTSYESFERQLFNQDVSNEDISLAFEKAQAELASLEKEIDEDDKLYSKQPENVEEDYAKITETKMKDFIKDADLSAGLDDLDLSDLDDEDW

SEQ ID NO: 3254 - protein, 368 aa, Bacillus cereus AH187; identical to SEQ ID NO: 3205

SEQ ID NO: 3255 - protein, 360 aa, Dictyoglomus turgidum DSM 6724
MKLGEDFWVVLEQIITEKKLDKNVVLEALRKALLSAFKKAYGTSKGARVEINFNKQEINIYVVKKIVEKVNDNISEISLEEAKSLKPDAKIGDEIEIEIEPQEFGRIAVQVAKQVIMQSLKEAERKILYEKYKAKEGELVNGTVVRVEKGNVYVRFPDIEAILPVKEQIPGEEYWIGRRLRAYLLEVRKTTKDPLVILSRSHPGFLKRLFELEVPEIREGTVEIVSIAREPGMRSKVAVYSHLPEVDPIGACVGYKGVRIQNIINELNGEKIDIVLWSKDPAEFVARSLSPAKPLSVEIREDEHKAIVIVPPDQFSLAIGKDGQNVRLAVKLTSWRIDVRTPEQYAKEKEEKEKVVEKSE

SEQ ID NO: 3256 - protein, 368 aa, Bacillus cereus B4264
MSTELLDALLVLESEKGISKDIIIDAIEAALISAYKRNFNQAQNVRVSFNPEVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVYAENTDVDPVGSCVGPKGQRVQRIVDELKGEKIDIVRWSNDPVEYVANALSPSQVVKVLVDEEEKATTVVVPDHQLSLAIGKRGQNARLAAKLTGWKIDIKSESDAKQLGIVTEEDSVIAFGFDSVEDEIE

SEQ ID NO: 3257 - protein, 405 aa, Cyanothece PCC 7424
MTIVNLPGLKNMIDEISQRHNLPKSAVHEALREALLKGYERYRRAQSLEKNQFHDDYFENFDVELDTEEEGFRILSTKKIVEAVSNTDHHISLKEVQEVVSEAQLGDEVVLDVTPDQKEFGRMAAIQTKQVLLQKLRDQQRKLIQEEFQDLESTVLTARVLRFERQAVIMAVQSAFGQPEVEAELPKREQLPNDNYRANATFKVLLKKVREGSHRGPQLIVSRAAAGLVVYLFANEVPEIEEEVVRIVAVSREANPPSRYVGSRTKIAVDTLERDVDPVGACIGARGSRIQAVVNELRGEKIDVIRWSPDPSTYIANALSPARVDEVILTNPDERQALVLVAEDQLSLAIGKEGQNVRLAARLTGWKIDIKDRAIYKADKENQTQDDQSEDHQVNEEVPEEVEIS

SEQ ID NO: 3258 - protein, 412 aa, Cyanothece PCC 8801
MSLVSLPGLANMIEEISQLHNLPKSAVQEALREALLKGYERYRRSQNLERQAFHEDYFDNFEVELDTEEEGFRILSTKKIVEAVENTDHFISLEEVQEVASEAQLGDEVVLDVTPNQKDFGRMAAIQTKQVLLQKLRDQQRKLIQEEFNEIEGTVLNARVLRFERQDAIVAVQSTFGQPEVEAVLPKREQLPNDNYRANATFKVLLKKVREGSHRGPQLIVSRSAAGLVVDLFTVEVPEIEEEIVRIVAVSREANPPSRHVGPRTKIAVDTLERDVDPVGACIGARGSRIQAVVNELRGEKIDVIRWSPDPATYIANALSPARVDNVILINPDERHALVLVAEDQLSLAIGKEGQNVRLAARLTGWKIDIKDTATYQAEVEQKKHAQNQTAIDPLEEDPNLPLTEMSETQIG

SEQ ID NO: 3259 - protein, 368 aa, Bacillus cereus G9842
MSTELLDALLVLESEKGISKDIIIDAIEAALISAYKRNFNQAQNVRVSFNPEVGTIQVLARKDVVDNVFDPRLEISVEEARQINPNYQDGDVLEIEVTPKDFGRIAAQTAKQVVTQRVREAERGVIYSEFSDREEDIMVGIVQRQDARFIYVSLGKVEALLPVSEQMPNEQYKPHDRIRVFITKVEKTTKGPQIYVSRTHPGLLKRLFEMEVPEIYDGTVEIRSVAREAGDRSKISVHAENIDVDPVGSCVGPKGQRVQRVVDELKGEKIDIVRWSNDPVEYVANALSPSQVVKVLVDEDEKATTVVVPDHQLSLAIGKRGQNARLAAKLTGWKIDIKSESDAKQLGIVTEEDSVIAFGFDSVEDEIE

SEQ ID NO: 3260 - protein, 443 aa, Desulfovibrio vulgaris  Miyazaki F
MSLELKKAIDQISKDKGLDRDMLIDTLEEAVRTSVARKFGDEMDAEVSYNDETGEIDVYQFKIVVKKVENPNSEISLEDARTHDPSVQLDDEMGFRVKIEDLGRIAAQSAKQVIIQRMRDAEQEIIYEEYKDRRGEIVSGIIQRRDKAGWIINLGRTEALLPKEEQIPREHYKRGDRVQAILIDVRKEGRGPQVIVSRAHRDYMAALFRREVPEVDDGTVQIMGVSRDPGSRAKAAVMSRDRDVDPVGACVGIRGSRIQNIVQEMRGERIDIVVWSPDIATYARNALSPAVISRIVVDEEENLLEVIVPDDQLTNAIGRKGQNVKLAAKLLGWKIDIYTETRYNEANAIGRGLEQIASVAEISIEQFIAAGFQSIERLREADDEELASALGLAPGKIADLRAAINFLAPQAQDDADATAEPDAEPAPEAADGAGEGTEAEAKE

SEQ ID NO: 3261 - protein, 368 aa, Bacillus cereus AH820; identical to SEQ ID NO: 3205

SEQ ID NO: 3262 - protein, 493 aa, Desulfitobacterium hafniense DCB 2
MNMEFIEALHELEKDRGISADILFEAIEAALISAYKKNFASLQNVRVHIDRMTGEFKVFARKNVVEEVEDSRTQVSMEEAQKIDPNYAIDDVVEYEVTPREFGRIAAQTAKQVVVQRIREAERGMIYDEYINREGDIVTGIVQRYDQKNVIVDLGKVEAILTAQEQIPGETYQPFERIKTFVVEVKKTTKGPQVMLSRTHPGLIKRLFELEVPEIHDGLVEIKGVSREAGARSKIAVYSRDANVDPVGACVGPKGSRVQTIVTELKGEKIDIVNYSTDPEEFVANALSPAKVVGVYPKPNEKVALVVVPDYQLSLAIGKEGQNARLAAKLTNWKIDIKSESQALAQNLIPDKNEVQGEYEEYDEFADYAEYENYDEYEDYSEYDDYEENEDYDENATYGENYDDELVYDENDQYEEFDAYQNEELPYEESEDYAATPDNGEPKAENAEENYAYTESGDKEERLTERDRSMMKYFEADEKNSRKEKKKKAKGKR

SEQ ID NO: 3263 - protein, 377 aa, Halothermothrix orenii H 168
MNIEFLHALDDIEKEKGISKEVLIEAIETALLSAYKKEFGSKENVRVHIVPDSGEVHVYSQKKVVDEVNNERKEISLEEAQKLNKNYEPGDIVEKEVTPANFGRIAAQTAKQVVMQRIREAERDVIYEEYKQKEGEIITGTVQRFHNNNVLIDLGRTEALLPPSEQIPGELYEMGRRIKVYVVEVASTTKGPRILVSRSHPGLLKRLFEVEVPEIFDGIVEIKAVAREAGYRSKMAVSSYDENVDPVGSCVGPKGMRVQAVVDQLNGEKIDIIEWSEDPAILVANALNPAKVINVSLDEEEKVAEVVVPDFQLSLAIGKEGQNARLAAKLTGWKVDIKSESQFEKETGEVEKKIPADDGEKVDEVGVEDDSLDIEES

SEQ ID NO: 3264 - protein, 382 aa, Clostridium cellulolyticum H10
MSAELILALEQLEKEKGIKKEIIIEAIEAALISAYKKNFGSAMNVKVNIDRVTGDVKVFALRKVAEDPDVEAMDISIGEAAKLNPTLDIGDYVESEVTPRSFGRIAAQTAKQVVVQKLREAERGIIYDEFYNKESDIVTGIIQRIEKRNVIVDLGKTEAVLGSTEQTPGEEYRFNERLKSYIVEVKKTTKGPQIMLSRTHPGLVKRLFELEVPEIHDGTVEIKSISREPGSRTKLAVYSKDENVDPVGACVGQKGTRVQAIVDELRGEKIDIIKWSNDPKDYISSSLSPAKVVRVDVDEEEKSAKVVVPDYQLSLAIGKEGQNARLAAKLTGWKIDIKSESQLRQSIEKQLFDDSLNNGYLDETDTDSMNYDNDDHENNIID

SEQ ID NO: 3265 - protein, 449 aa, Desulfovibrio desulfuricans ATCC 27774
MNLELKKAIDQISKDKGLDRNMLIDTLEDAVRTSVLRRFSEDMDVEVSYNDETGDIEVYQFKIVMADGDVANPDTQIELAEAREHDPSVQVDDEMGFRVKVEDLGRIAAQSAKQVIIQRMRDAEQEIIYEEYKDRVGEIVSGIVQRRDKGGWVVNLGRTEAILPREEQIPREHYKRGDRVQALIIEVRQEGRGPQVVISRAHRDYMAALFRREVPEVDDGVVQIMGVARDPGSRAKVAVLSRERDVDPVGACVGVRGSRIQNIVQELHGERIDIVVWSADIATYARNALAPALVSRIVVDEEENLLEVIVPDDQLTNAIGRKGQNVKLAARLLGWKVDIFTETRYNEANAIGHGLEQVASVAEVSIEALLGAGYSSLDQLRQATDQELSDKLTISASRIADLRSAINFLAPVVEETPESSAVELGRTHADEEDSGQDQTGDSPREDAQD

SEQ ID NO: 3266 - protein, 413 aa, Cyanothece PCC 7425
MSMVRLPGLREMINAISRERNLPKYAVQGALQEALMKGYERYRRTLRLEGGHFDEDYFQNFDVEIDVEEEGFRVLATKTIVEQVDNPDHQISLSEVQEVAAEAQLGDTVILDVTPEQQEFGRMAAIQAKQVLAQKLRDQQRKLVQEEFQDLESTVLQARVLRFERRSVIMAVSSGFGQPEVEAELPKKEQLPNDNYRANATFKVYLKKVLEGPHRGPQLLVSRADAGLVVYLFANEVPEIEDEVVRIVAVAREANPPSRQVGPRTKIAVDTLERDVDPVGACIGARGSRIQAVVNELRGEKIDVIRWSPDPATYIANALSPARVEEVRLMNPEERQAHILVTDDQLSLAIGKEGQNVRLAARLTGWKIDIKDIATYDYEGENRKAEAEAAEKAAAQEAVEPEDEDDFEPEELE

SEQ ID NO: 3267 - protein, 357 aa, Anaerocellum thermophilum DSM 6725
MPKKEQTLDFQELFSAIDELEREYKIEKDYVYSVLESALLTAYKQVKGIKDKNLSNVKVSIDPEKGSVKIYEYRKVVENVKDRKNEISLEDAQKIDKRYKIGDIVAIEIPISQFSRKAAMTVRQTVIGKIREKKRSIIFEDYSSKIDNIVTGIIQRIDKKNVIVEIEGGKVEAILPMEEQIPGEEYKPGTLMKFYLVDVKIPPKEKEPIVYLSRTHPNLIKRLMENEVPEIQEGIIEIKAIAREAGSRSKVAVYSNSLKVDPVGACIGEKGIRIQNVLKHLNGEKIDIVKWSSDIGEFIKNALSPAEVVHIDLNLIEKKAFVLVPNSQLSLAIGKGGQNARLAAKLTGWKIDIKGKD

SEQ ID NO: 3268 - protein, 330 aa, Acidimicrobium ferrooxidans DSM 10331
MAVENPEVMDALEVIAREKGLSVETLLESLANALAAAYKRRPGAAEEAYVEIDPASGTIRVICQELDENGTVVREWEDTPRDFGRIAAQAAKQVMLQKIREAEREQKYEEYAGREGDVVTGIVSQIDPRFTLLDLGKIEAIMPHSESPSNERYSVNQRLKAYIVEVRRSIKGPQIVVSRTHPGLVRRLFEVEVPEIASGVVEVKAIAREPGHRTKIAVWSNDRSVDPVGACVGARGSRVHTVVNELLGEKVDIVPFSEDLAEFVERAIVPAHALSATVEGRDALVVVPDDQLSLAIGREGQNARLAARLTGTHLEIRPQSEVEGRQEGQP

SEQ ID NO: 3269 - protein, 441 aa, Desulfomicrobium baculatum DSM 4028
MNLELKKAIDQISKDKGIDREMLIDTLEEAIRASVTKKYGDKMDIEVTFNEETGEIEVYQFKIVVEEIEDPDTEILMVDALKHDPNVELDDAIGFRLQVEDLGRIAAQSAKQVIIQRMRDAEQEIIFEEYKNRKGEIVSGIIQRRDRSGWIINLGRTEALLPKDKQIPRERFRQGDRVEGLIIEVRKEGRGPQIIITRSDPEYMTALFRREVPEVADGTVNIMGVARDPGLRAKVTVLSQDSNVDPVGACVGIRGSRIHSIVQELRGERIDIVLWSPDIATYAANALSPARISKIAIDDEEKSLEVVVPEDQLTPAIGKKGQNVKLAAKLLGWKIDIFTNTRFNKVHKDRHLLEQLASAAQVSIADFAEAGFDSLEAMAACTNEQLLDIQGISEENIGALRGALNLLISQNREETPEESEPSEVKGLVEGEDADYADGDEA

SEQ ID NO: 3270 - protein, 382 aa, Geobacillus WCH70
MNTQLLDALADIIREKGISKEVVMEAIEAAIISAYKRNFGQAQNVRVDLNTETGTIRVFARKEVVDEVNDPRLEISLEEAQRINPNYQIGDVLELEVTPKDFGRIAAQTAKQVVTQRVREAERSVIYAEFVDREEDIMTGIVQRVDPRFVYVSLGKTEALLPASEQMPNETYKPHDRIKVYITKVEKTTKGPQIFVSRTHPGLLKRLFELEVPEIYDGTVEIKSIAREAGDRSKISVHSDNPEVDPVGACVGPKGQRVQAVVEELNGEKIDIVRWSADPVEFVANALSPAKVLRVIVNEEQKATTVIVPDYQLSLAIGKRGQNARLAAKLTNWKIDIKSESEARELGIDPYAQSTFLDSEETSVNNENDSNQSFDLQEEKIE

SEQ ID NO: 3271 - protein, 405 aa, Eggerthella lenta DSM 2243
MASSELIEALQALAHERKIDEFYLIERLEASLAKSYQHILDLEWDARVTIDRQTGHIYVYELVPVGEPDEETGEYSEFEERDVTPDDVSRIAAQNAKGVIASIVREAGRQSIYEEFSDRVGDLVTGTVLQGTPDFTIIKIRDGVEAELPHYDVKRNPNERNERPSNEHYRHNQRLKVLIIEVRDPNSDAPKMRGEQARPAIVVSRTHPDLIRRLFEIEVPEIYDGMVEIKSIAREPGARSKIAVASREANLDPVGACVGPKGSRVRMVVEELRNERVDVIQWAEDPAVYVANALSPAKVTRVVIDEDNHYATVVVPDDQLSLAIGKEGQNARLAARLTGWHIDIKSASFTGESLAPMDNMLIDEDEAADDEAGLCAYVGEDGVRCRNHARPGSRYCGVHADLDEA

SEQ ID NO: 3272 - protein, 442 aa, Chloroflexus aggregans DSM 9485
MKSDFYAAITQIASERGIPKEAIIDVMERALVSAYKRLLGPNPPAVEVTVKLDPVSGMARVYAEKQVVDEVYDERFEIDLNSARQIKPDVQIGETVLVESTPRDFGRIAAQTAKQVVLQGIKEIERSYIYSEFEDREGELVTATVQRNNGPRGNVILEIGKAEAIIPPKEQVANDRYYHGQRLKVLLLEVKKDDRGPRLIASRAHKNLINRLFEMEVPEIYNGSVEIKSVAREPGLRTKVAVAARQEGIDPVGSCVGMRGIRIQNIVNELNGEKIDVVQWSSDPREYIANALSPAQVVEVHLHDHDHTALVIVPDKQLSLAIGKEGQNVRLAAKLTGWRIDIKSASALLEEERAAAEARAEAEAEQMVIAAELAHAPVEQRIVQADGTIRYRGHRYGPLGNDLVGQTVQVRATSQKIFIYYNDRLFASYILLEGGQASPDEE

SEQ ID NO: 3273 - protein, 402 aa, Cryptobacterium curtum DSM 15641
MATSELIEALHALAHERKIDEFYLIERLEASLAKSYQNILDLEWDARVTIDRNTGKIYVYELVPQGEPDPETGEYTDFEERDVTPDDVSRIAAQNAKGVINAIVREAGRQSIYEEFSQRVGDLVTGTVLQGTPDFTIIKIRDGVEAELPHYDQKRFPDERNERPANERYRHNQRLKTLIIEVRNPNSEESRQRGEQARPSIVVSRTHPDLIRRLFEIEVPEIYDGVVEIKSIAREPGARSKVAVVSHENHLDPVGACVGPKGSRVRMVVEELRNERVDVIQWSDDAATYVRNALSPARVSHVDIDEETHYATVIVPDDQLSLAIGKEGQNARLAARLTGWHIDIKSSSFAGEPVVSENILIDEEPDDAVSGQCEFIDEEGVRCRNHARPNSRFCGIHSQAEK

SEQ ID NO: 3274 - protein, 433 aa, Anaerococcus prevotii DSM 20548
MNNDFMLALDELCKEKNLDKATILDALQKALIKSYQKNYDNEENVDVIIDEETGQIEVFALKEVVDEVDDTITEISLKDALEENSSYHLGDIARIKLTPKNFGRVAAQTARNIVIQKIRDAQRDSLYGEYIERANEMITGTIQRQDKYNVYVNLDKIEGVVPIKEQVPTEEYPANAKMKFLIKEVRNSSKEPQIVLSRSSQDLITRLFELEVPEITDGIIEIYSLAREAGSRTKMAVFSNDEGIDAVGACIGFKGIRVNSIVEELQGEKIDIINFDKDIKVFISNALSPADIIEVLVNEKSKKSLVVVSSDQLSLAIGKEGQNARLAARLTGWKIDIKSSEEYESLSQEEIDEILGLNEIDEEASEVADEDDALDDEDISLDLDEENDDTEDDLISDSEVEEIIEEESDDTVEDIANIDSTVKAYEEDESNED

SEQ ID NO: 3275 - protein, 412 aa, Cyanothece PCC 8802; identical to SEQ ID NO: 3258

SEQ ID NO: 3276 - protein, 381 aa, Desulfotomaculum acetoxidans DSM 771
MNTEFLDALRELEREKGIAVDVLIDAIEAALLSAYKRNFGSLQNARVHIDRETGDFKVYSQRTVTEEVQDDRLEITLADAQKIDPRFELGDVVENEVTPRNFGRIAAQTAKQVVVQRIREAERNIIYETFSSRESDIITGVVQRIEQKNIYIELGKTEAILTPSEQMPNETYKHGDRIKAYIVEVRKTTKGPQIYVSRTHPGLLKRLFELEVPELEEGIVELKSVAREAGARSKIAVYSKDENVDPVGACVGPKGARVQNIVNELNGEKIDIIKWDPDASKYVASSLSPAKVVAVEIWEDEKVARVVVPDYQLSLAIGKEGQNARLAAKLTGCKIDIKSESQMAALYPEGYGEAYDEESHAHNDLEDSGMSELDLYQAEDF

SEQ ID NO: 3277 - protein, 373 aa, Alicyclobacillus acidocaldarius DSM 446
MNVDFLEALDQLAREKGIDKEVLLEAIEAALIASYRRNFHSAANVRVEVKRDTGEVHVYARKTVVEEPKDTRLEISLDAARDINPSYQIGDVVEIEVTPRDFGRIAAQAAKQVVMQRVKEAERSVIYSKFADREEEVVSGIVSRLEPRVAYIDLGDTEAILPQSEQMASDKLQVGKRLKVFIARVERTSKGPQIVVSRTHPGLLRRLFELEVPEIYEGIVEIKAVAREAGSRSKIAVHSRNPEVDPIGACVGARGSRVQAIVNELNGEKVDIVEWSEDPATFVANALSPAKVIDVHIYEDERVARTVVPDYQLSLAIGKEGQNARLAARLTGWKIDIKSESQMASHSLLDQLEDTNEEEPEFATLSDDWLNEP

SEQ ID NO: 3278 - protein, 440 aa, Desulfohalobium retbaense DSM 5692
MSMELKKAIDQISKDRGIDRDLLIDTLEEAVRSSVNKKFKNKLDIEVSFDEEAGDIEVYQFKVVVEEVDDPNTEISLDEARIEDPNVQLEDELGFRMEISDLGRIAAQSAKQVIIQRMRDAEQEIIYEEYKDRRGEIISGIIQRRDRAGWIINLGRTEAILPKQEQIPRERFRRGDRVQGYIIDVRKEGRGPQIVVSRSHPDYMAALFKREVPEVGDGTVTIMGVARDPGKRAKVAVLSQDSDVDPVGACVGVRGSRIQNIVQEFKGERIDIVVWNHDVATYAMNALSPAKISRMTVDDVEKTLEVVVPDDQLTLAIGRKGQNVKLASKLLGWKIDIITESRYGADPSDQADLEQAEHVTGIPTDHFVQAGLGSLDALREASDEQLAAVDGMDTSKMADLRAALNLLAPNRDTREDDGIQASTADAPSHDTVVAPDDSTE

SEQ ID NO: 3279 - protein, 165 aa, Enterobacter sp. 638
MEMSQLSPRRPYLLRAFYEWLLDNQLTPHLVVDVTLPGVQVPMEYARDGQIVLNIAPRAVGNLELSNDEVSFNARFGGVPRQVSVPLAAVLAVYARENGAGTMFEPEAAYDEDVASLNDEDGSTGSESETVMSVIDGDKPDHDNDNDPDDDPPPRGGRPALRVVK

SEQ ID NO: 3280 - protein, 165 aa, Shigella boydii CDC 3083 94
MDLSQLTPRRPYLLRAFYEWLLDNQLTPHLVVDVTLPGVQVPMEYARDGQIVLNIAPRAVGNLELANDEVRFNARFGGIPRQVSVPLAAVLAIYARENGAGTMFEPEAAYDEDTSIMNDEEASADNETVMSVIDGDKPDHDDDTHPDDEPPQPPRGGRPTLRVVK

SEQ ID NO: 3281 - protein, 166 aa, Salmonella enterica serovar Newport SL254
MDLSQLTPRRPYLLRAFYEWLLDNQLTPHLVVDVMLPGVHVPMEYARDGQIVLNIAPRAVGNLELSNDEVRFNARFGGVPRQVSVPLAAVLAIYARENGAGTMFEPEAAYDEDVVSLNDDDNTAGAESETVMSVIDGDKPDHDDDSSPDDEPPPPRGGRPALRVVK

SEQ ID NO: 3282 - protein, 166 aa, Salmonella enterica serovar Heidelberg SL476; identical to SEQ ID NO: 3281

SEQ ID NO: 3283 - protein, 166 aa, Salmonella enterica serovar Schwarzengrund CVM19633; identical to SEQ ID NO: 3281

SEQ ID NO: 3284 - protein, 166 aa, Salmonella enterica serovar Agona SL483; identical to SEQ ID NO: 3281

SEQ ID NO: 3285 - protein, 166 aa, Salmonella enterica serovar Dublin CT 02021853; identical to SEQ ID NO: 3281

SEQ ID NO: 3286 - protein, 165 aa, Escherichia coli O157 H7 EC4115 [sequence omitted]

SEQ ID NO: 3287 - protein, 152 aa, Pseudoalteromonas atlantica T6c
MKKFKQLLAYITSRNLVADEQLSCFVTDCEITLSGKKVQDGAIIAAYIHYQAVYEIERFGGDANRVLTHFSSWLYNNDQSDTEEELDKASFDIEPVDDHLVDIMATVDFSESIELQEQDGGEFQFGAKFYSLVPNEFSVAESFEIVGDITHG

SEQ ID NO: 3288 - protein, 155 aa, Shewanella sp. MR-7
MSQLNALTLHLLNTLKPYVKPNDIDAWQTDGQLHIIQDDLGEGINIAKWQHSAVIAIERLPHTKFNPYTILAILAAWLSDNDWPQEEYGLSEPAIDIDIISDDHAQMIINIDLVDDLGIVEDEQGNIPYMGKKYRLENIPINWAEQVDLINRGEQ

SEQ ID NO: 3289 - protein, 154 aa, Desulfovibrio vulgaris DP4
MRKIRGLIDHLLAVTGLPREQVEAFADKGTLMPTGRDLGPDGDGRAQVEAGVWKYDAVIRLQRYAGDGPTLMAVVLGWLADADPDRDGLVDPELDVAINDAHTCDVEIACEFEERLVIREDPQGPVAFDGRHWSMALPDISVADAVSGMRGQRG

SEQ ID NO: 3290 - protein, 162 aa, Shewanella baltica OS155
MSQTVSQLQQVTAFLLASLTPYVKANNIDAWQERGTLILSSEDLGQGGYQVAKWKHNAVIAIEQFPHTKFNAYNLLAMLPSFLLDSGWPRDEHGLADPELDIEVVSKDHAMVLIELELIDDIDLIPDDNGPVLFNGERYRVSLVPVDYAESVDLQTRPEGAL

SEQ ID NO: 3291 - protein, 150 aa, Vibrio cholerae O395
MRALRKHIEECVGDQIAQRLEAEMTDISLKLLPKHMGNGFNLMQQKYRAEFYFDRFPFKKYDPAVLFANVGAWILDHDLDRAESNGLRDPDIDVVLEDENSAEVLVIIEFEEDIKIIECENGGIKWRGKKWKIAEYEIWVAENLIDVVNR

SEQ ID NO: 3292 - protein, 145 aa, Pseudomonas aeruginosa PA7
MNKLRALTAYLIERRLVPAEQLDSFAEQVNLALVWKPEERGLRLGDMRYRAVIILERLADHPARLMALVGSWLENNDPDRDGLPDPVFDVEQMDRDLADVELAVEFVEPVHLAEDSAGEIEAFGRRWAFVPFDLWIAEHGEVRHG

SEQ ID NO: 3293 - protein, 145 aa, Pseudomonas aeruginosa PA7
MNKLRALTAYLIDRQLVPAEQLDSFAEQVSLTLVWKPEREGLRLGDMRYRAVVLLERLADHPARLMALVGSWLENNDPDRDGLPDPVFDVEQMDRDLADVELAVEFVEPVHLAEDSAGEIEAFGRRWAFVPFDLWIAEHGEVRHG

SEQ ID NO: 3294 - protein, 150 aa, Marinomonas MWYL1
MVKLQQITAFLVGLDLVAAENIDSWVENPRIVPRCSIIDDGQVIVYTQTYDAMLSIERYPHTRHPAELLFAQVSVWLMENDEDRFEKELPMPATDVDILDSKTADIDIMITFEEDITAVLDENGPIVIDGQRYRLDDATITYVKEGEMKS

SEQ ID NO: 3295 - protein, 163 aa, Vibrio harveyi ATCC BAA-1116
MSSAIYNQTKLEHLTAYIVSHLNSNVLENKMDAWQENGSIVPSGEDRGNGGYIACYWKYNAVISVEEFPHQLLDPRCLLALIACWLSDHEEERNEQELEDPTLSVDVISSEAADVSIELELMEPIELVPDEAGMITWRGMRYRVQAVEIYTAEEAELVNETNN

SEQ ID NO: 3296 - protein, 162 aa, Yersinia pseudotuberculosis YPIII
MSKLHSLTAFVQDNLPQRLRKLEFNSDMDALRFIPAQRDLGLDQYQLALMQFDAVLSWGRFPYRDYDPRNLCALLLVWMIENAPDHGPVPELPSIDIDVIDDKTAMVVVSMGITESLSIAKDPAGDIPFMGARWRLTDPQLWLATEGTVFGADTHGAPLGES

SEQ ID NO: 3297 - protein, 168 aa, Salmonella enterica serovar Newport SL254
MSQTQIQSLTAFFQENVPPRAMQSFDSVLDEMKFIPAAKDYGLGQYRQAVIRYDAVLSWARFPYRLCPPQLLMSLLAAWLDDADRDLLDEVGLSEAEPDWDVSVEDEETATVVLTVPMVEELVIRQDENGAIPWRGERWSLADPEIWTALTASIFSVDETGAPVSGEI

SEQ ID NO: 3298 - protein, 168 aa, Salmonella enterica serovar Heidelberg SL476; identical to SEQ ID NO: 3297

SEQ ID NO: 3299 - protein, 160 aa, Salmonella enterica serovar Agona SL483
MSQLTELTDFLIANMPRRAMQGFDSQMDEIAFIPAQRDTGLGQYRIAIIRYNAVLTWERYPYREYDPKILMALFMSWLCQDERALFEETGIDAELPEFDIETIDQETAIMVVTLPMVEELNLIPDPKGQIPFDGQRWKLANPEVWTADEVTVIPVNEGDG

SEQ ID NO: 3300 - protein, 174 aa, Aliivibrio salmonicida LFI1238
MSEIQSQPQAGFMLQGLNQHLSNTTPERLHKHFECWMEDVELTLQPKNQGQGFDIGYMQYTAVFSFEKFPFKKVNPATVMVNVLAWLDDNDEFREKFNLAEPSFDVEPENDDTVIMTLEVELIEPLMVIEDPDGEIVWRGKRWINAPYEIWEAEHISVINANNPPSPVITDDQN

SEQ ID NO: 3301 - protein, 174 aa, Desulfovibrio desulfuricans ATCC 27774
MRKLAALVGHILEVTGLPPEQVFAYADQGDLYPLGRDRAPLRPEPGEDAPVLRQVELGTFRYDGVIQIERYPGAGHDFAALITTWLIERDPARDGLADPALDIELNIRGGDCDVQMTIEFEERLEAVEDPAGNIPFDGTRWSLASVTITPATTLTALAAVNTGAGHMPGKGDGR

SEQ ID NO: 3302 - protein, 789 aa, Ralstonia solanacearum
MKPSCRPGAALEADRCPSFPDRSAATPHRGLAWAMAVVLIGGCATTRDIEQLQTTSQREPTNAQLKLKYMDERDRQVKDLLDGADRLRLIHDFDRAQVLLLQALRLDPGNERGRRIAAAIDVDRRNGAVLQEAERMMARGSYDGAAERVERVLAETPNDAGALRLYREISEKRRLQKQAAEEKNAAASIMRKPVSLQFRDANVRMVFEALSRTTGLSVIFDRDVRVDLKTTIFVSNASLEDTVDMILLQNQLAKKVLNANTVFIYPATPAKQQEYQDLKVRTFQLSNTDAKHIDTLLKNLLKIKEIVTDERANTVSIRATPETIRVAERMIAAQDLPEPEVMLEVEVLEVSRDRLTDLGIDWPNSFSLGTPSSASTWGALHHLTVNQLTASGLSVTANLKLTDTDANLLASPRIRTRNKEKAKILIGDKVPVISSSSVPSTSGPVYSQSIQYLDVGIKLEVEPQVYRDNDVGIKMSLEVSNITQIISSSNAQTGLSSLAYQIGTRNASTTLRLKDGETQILGGLIQDEDRDAANKVPGLGQLPVLGRLFSNHNGDHKKTEIVLQITPHIVRPQLAADADTREIWSGTDSTVRTEQLRLDPPGVAAPATPAAPAAPAAALPAPAAGVAVVSPGAVGGGTTGGEQTPKAAAPAAAGGVVPPNGAFGQPPAAPRTTPPPAMFGGRFMTTVPPPEGVVPPAPPAPAAAPAAVAAPAAAAPAAPAAGTAGPEAAAAVSPTEAAPPAPAPAAPYTPAPAAPAAAPPAASPPPIVPTPPSDMPSDNPLHPIPTGAY

SEQ ID NO: 3303 - protein, 754 aa, Ralstonia solanacearum
MNTGQALIRTLLVACMAVSVAGCGELPPYREGEALSAEGKNEASLERFETAAKAQPTNARYRAAYLQARDRTVNGWLDEAERLRQTGKPDAARKMYERVLALAPENARARAGLEQGERDRRHANLVQQAEDALKKGERDTALAKLHLALAENQQFRPALALQQRIEQPTGDSPERALSAAFRKPISLEFRDAQMRQVFEVLSRASGLNFVFDKDVRTDQKVTVFLRNSTVANVVNTVLLTNQLEQRVLDGNSILIYPNTPAKQRDYQPLTVRTFVLSNSDAKDVANTVKTILKTRDIVVDEKRNMIVMRDTPDAIQAAEKLVAVHEMPEPEVMLEVEILEVKRSRLQDLGIQLPSQLSLTPLASSSGGTLTLDDLRHLNPTRIGATVSPLNVNVNAAVTDTNVLANPRVRTRNKEKARIQVGQRVPNVTTTSTATGFVAENVQYVDVGLKLEVEPTVTPDNEVTIRINLEVSDIISQVQTKSGSIAYEIGTRNATTLLRLKDGENQILAGLIQDEDRVSGNRVPGLGDIPALGRLFGAQSDNKLKSEIVLSITPRVIRPAQRPNLGSAEFDSGTESSLRLTSPMLRERGAPVPSPVAPAAAPTPSTDASSTPPQPVAAAGGGSALTIQGPSSVPAGSTFDVLVNVQPERPFTSLPLTLQYNPAQLQIISVTPGSLVSANEVFANNIDAAKGLVYMTMNAKQTQGKDGAGNVVRLTFKALAAGETSIHMQDQMLITPSGMASLKPTAPLVMTVQP

SEQ ID NO: 3304 - protein, 667 aa, Thiobacillus denitrificans ATCC 25259
MKTKHVVVSLVCVLGLSGCAADRAFTRGKGMLEQGQTEAGLREVEKAARIAPENKEYRIYLARQREGSINTLLGEAEQARRTGRLDAAEQAFRRALALDAENRRAADGLEAVATARKHRVLLAEAETLAVQGNLAAAATKLDTVLAEDPRSAEGRALKTRLAALKAEKRSELPGLRSLFEKPITLEFRNADLKAIFEVISRSAGINFIFDKDVRQDLVASIFVRNTRIESAIDFLLMSNQLAKKVLNENTVLVYPNIPAKTRDYQDLRAKTFYLASMDAKQALNIVKTIVKTRDVVIDEKLNTLVMRDTPDAIRLAEKLLGSQDLAESEVLLEVEVLEVSRSRLSDIGITPPTEATFRTLGPSGAPSTTLADLKGLNSGLIGVSSLSASVRARMDNGDTNLLANPRIRVKNREKAKVHIGERVPIITTTVTSAGTTSFLPETVNYLDVGIKFEVEPLISLNDEVTIKVALEVSSLGQKSVTKSGSEVYRVGTRNASTTLALRDGETQALAGLISDEERETVNGIPGFGRIPAIGRLFASKSNSTDKTEIVLLITPHIVRNLDRTALTASDFAAGTDSAAGSAPVTLQAITPEVMRAVEEGTAGAPGAAPAAPADAPAGGQAPAGVEIGREPAAEGGDAAGEPAAAQDAEPGNAAPEPSADGDAQEGS

SEQ ID NO: 3305 - protein, 656 aa, Thiobacillus denitrificans ATCC 25259
MSFHPSPLLTALVAFSLTACAGTGLKEGRKLIDAGQPEAGIARLRTALAEEPDNIKLKAYYHTQRERIASELLVRAQQDVHAARFDAAETKLDSVLEMHPENPRALALRANLETARRHEAALQQANKALAAGKVDAAAQAAREILAQAPGHAGALALLRQTQAAHAPDELAMRRLGPAFHKPITLEFRDAPLRNVFDMIARQSGLNFVFDKDVRLDTKATLFARNTPIDEAVDMLLMTGQLSKKVVNANTLLIYPDQPQKQKAYQELMVKSFYLGNADAKATMAMLRTLVKAKDLHVDERLNLLVMRDTPDAIRLAERIVAVQDLAEPEVMLEVEVLEVKRGRLLDLGIQYPTNFSLLNLPPATSSTIGPGGVVTNTTPPPSVLTVESLKNITASQIAISPTPGVDLRKQDSDVNILANPRIRVKNREKAKIHIGDKVPVITSNTTSTGVVSESVSYLDVGLKLDVEPSVLMREDVQIRVGLEVSNIVREIRSGNGTLTYQIGTRNAGTTLRLKDGETQVLAGLISDEDRSTASRIPGLGDLPLIGRLFSSQRDERNKTEIVLLITPRVLRSDATRLPALTEFRGGTENAIGGGGAVPFSAPALPEASQPPLPDEGPTSPSAIAPAPESEIPPAPDTFGTPSVPVPQIPAPPDAAD

SEQ ID NO: 3306 - protein, 749 aa, Nitrosospira multiformis ATCC 25196
MKTGKHVLLALVLAGIAGCATNNAFVEGKRLIAEGKLDTGLASLEQAARENPDNLEIRAVLARQREAIAARFVFEAEAARSTGDLEAAERSFRRALEINPRHERALAGLEAINMDRRHTAAIKRAEELLERGEYAAASSEVRSVLQENPMQRDARRLIQRITEMEVQAAQAGPILKTAFKKPITLEFRDTGLKSVFEILARTGGINVVFDKDVKQDSKTTIFVRETNIEDVFKLLLVTNQLAHKVLNENSVLIYPNTPAKQKEYQELMVRSFFVTNTDVKQMVAMVKGLIKTKDMHVDEKLNLFVMKDTPEAIRLAERLVTLNDLADPEVMLEVEVLEIGRNKLLNLGLQYPEKINVNYLTAASAAGAAPFPPFQISRAGVNGNGSNLDNLIGFVANPALIVNLKQQDGLINVLANPRIRVKNREKAKVLIGDKVPVVTTTAAANVGVASSVSYLDVGLKLDVESTISLQDEVSMKVSLEVSNIVKEVPVTGGGLAYQVGTRTAATTLALKDGETQVLAGLISDDERTTLSKVPGLAELPWIGKLFINKNVVRNKTEIALLITPRIVRNIARPAKAVSEVPFGTENAIAVSPLMIGKVAPRALAMASSSPTSDANASRQWPSAPSREETRPPAPPEGAPVATLAAPEQVSAGQEFVVSVTLAGADALPPAELDLNYDPVALEPVDEGDKSGTRVLKLSKGGGAADVRFRILAQKPVTTQISIGNISFKDESGPLPVPVPLPPAVNVDIR

SEQ ID NO: 3307 - protein, 653 aa, Methylobacillus flagellatus KT
MNTTSHASLKFSAVFIAIMLAACSGTEMRQNQTNLEFQQARDMINAGQVEAGIERLKSLVRTFPDNPEYRNYLKQQQDIQLAILLKEADQLKRQKRWGEADIAYRRVLELDSQNQRAQNGIQQMRIATTHDAMMQRADELLAKQDWEGAQNLARTVLAEDSSNRSARALFEQIEQKRMDKVVNPPHIRSSFKRPISLEFKDITIKSVFEFISQAAAINFTYDQELRSDQRTSVFLRNTPIEEAIDVILASNQLGKKVLNDNTLLIYPLSRSQEYQETFVRSFYLSNTDAKKLMAMIKTVVKTKDIYIDEKLNTLVMRDTPEAIRTAEKLIMSQDMAEPEVMLEVEVLEINRRSLENIGIRYPTNVSLDVQGRDTVNGTTTLTPGKLTINELKNFNSNLGVFSISDPVLALNLLQQDTDTNLLANPHIRVKNREKAKIHVGDRIPVLTSVANSTGFISQTVNYIEVGVKLDVEPTILLRDEVSIKIGLEVSNQTDRMETSSGTVTYTIGTRNASTILRLKDGETQILAGLMRNDEQKITNGVPGLSKLPLIGKLFNNNNNDLSKKEIALFITPRIISNLTPENAIYTTFPAGIDRSASRPGRAAEPGTVTAQAAPATPVKTPQEIQAERAESDRSFAGSVMRPVEDIASPDEQQ

SEQ ID NO: 3308 - protein, 734 aa, Cupriavidus metallidurans CH34 uid250
MHTSRGPRLIRARCKAQPICIGVILLGTCLAGCSPMYQRFPPDPSTNAEQIVGALRERDRQVNALLEEAERLRAAGQYQDAVPLLGAANQLDPTNERARILGAALQRDWRDAAILQEAERMFDRGSYDIAAERVRYVLAENPNSIAGRQLAQRIEEQRRLLRLAREEQRAAGSIMRTPVTLQFRDANIRMVFEALSRTSGLNVIFDRDVRADLKTTIFVTNAAIEDAVDLILLQSQLDKKVLNANTLFIYPATPAKQQEYQELKVRTFQLSNVDSKQVQSLLKSLLKIKEVVVDERANTVTIRGTPDTIRVAEQMIAAQDLPEPEVMLEVQVLEVSRERLTDLGIAWPNSFTMATPASATTWGVLHHLTANELEVSPLSATANFKLTDTDANLLASPRIRTRNKEKARILIGDKVPVISSSSTPSTSGPSFTQTIQYLDVGIKLEVEPQVYRDNDVGIKLALEVSNITKTIQSGNAQTGLSSLAYQIGTRSASTSLRLRDGETQILGGLISDQDRTSADKVPGLGQLPVVGRLFSDHNGDHVKTEIVLQITPHIVRPQLTMDSDTRELWSGTDTNVRTEQLRLDPSRPVASTASGAPALPYTPVKPGQVGGGTMGPPPAASGSAAATPKSAFGQPPPPMRTTPPPAPYNGRFSGTPAVPQGQAAPAGTAEPAPPPPVPASGNADGSAENTAPPPAPRGPVQVELIPPTPPAPMPRQPTDIPSDNPLYSIPGGSP

SEQ ID NO: 3309 - protein, 621 aa, Pseudomonas putida F1
MKSSKLCKPAPFLLVALCVAIAGCGSSAVRQDSDQLMKEGQYEAGIARLEEALRDDPRDTELNIALAHSRQAAVEALISQADSDRVRHDFANARMGYGRVLTLEPNNRRAQDGIRQLELIRTLDDRVALGQAALRQGDLFGAERYMREVLRLDPQNQKGITLRSDIENVQARTAQPYPQLRSKLERPVTLEFRDANLKTIFEVLSQVAGINFIFDKDLRPDMKATIFVREVRIEDAIALLLEQNQLRQKIVNDNTVMVYPDSPQKTKDYQELVMRTFYLTSIDANTALNMVKTMLKTRDVFVDERLNTLTMRDTSDAVRMAEKLLQSQDQSNPEVVLEVEVMEVATSRILDLGLQWPNTFGVLSDDGNPVSVLDQLKGISSSRISIAPAPQAKINAQDKDINTLASPVIRVSNREQARIHIGQRVPIISATSVPSTQGPVITESVTYLDVGLKLEVQPTVHLNNEVAIKVALEVSNATPLEATRQGTIPVQVDTRNAQTSLRLHDGETQVLAGLVRNDHNASGNKIPGLGDIPGLGRLFGSNKDDMSKSELVLAITPRIVRNLPYQSPSDMEFSTGTESAMQVRQMAPLPPMDVPGNAPTTDEPVVDSQMAVAPVNGSPRP

SEQ ID NO: 3310 - protein, 621 aa, Pseudomonas putida GB 1
MKSSKLCKPAPFLLVALCVAIAGCGTSAVRKDSDQLMKEGQYEAGIARLEEALRDDPRDTELNIALAHSRQAAVEALITQADADRIRHDFANARMGYGRVLTLEPNNRRAQEGIRQLELIRTLDERVALGQAALRQGDLFGAERYMREVLRLDPQNQKGMTLRSDIENVQARTAQPYPQLRSKLERPVTLEFRDANLKTIFEVLSQVAGINFIFDKDLRPDMKATIFVREVRIEDAVALLLEQNQLRQKIVNDNTVMVYPDSPQKTKDYQELVMRTFYLTSIDANTALNMVKTMLKTRDVFVDERLNTLTMRDTPDAVRMAEKLLQSQDQSNPEVVLEVEVMEVATSRILDLGLQWPNTFGVLSNDGKPVSVLDQLKGIDSSRISISPAPQAKINASDKDINTLASPVIRVSNREQARIHIGQRVPIISATSVPSTQGPVITESVTYLDVGLKLEVQPTVHLNNEVAIKVALEVSNATPLEATRQGTIPVQVDTRNAQTSLRLHDGETQVLAGLVRNDHNASGNKIPGLGDIPGLGRLFGSNKDDMSKSELVLAITPRIVRNLPYQSPSDMEFSTGTESAMQVRQMAPLPPMDVPGNAPTTDAPVVDSQMAVAPVNGSPRP

SEQ ID NO: 3311 - protein, 625 aa, Pseudomonas putida W619
MKPSKLCKPAPFMLLALCVAIAGCGSSAVRKDSQALMKEGQYEAGIARLEEALRDDPRDTDLNIALAQGRQQAVEALLSQADSDRIRHDFAGARLGYGRVLTLEPNNRRAHEGIRQLELMRTLDDRVALGQAALRQGDLFGAERYMREVLRLDPQNQKGIMLRSDIENVQARTAQPFPQLRSKLERPVTLEFRDAELKVIFEVLSQVAGINFIFDKDLRPDMKATIFVREVRIEDAIALLLEQNQLRQKIVNDNTLLVYPDSPQKTKDYQELVMRTFYLTSIDANTALNMVKTMLKTRDVFVDERLNTLTMRDTPDAVRMAEKLLQSQDQSNPEVVLEVEVMEVARSRILDLGLQWPNTFGVLSDEGNPVSVLDQLRGINSGRISISPAPQAKINAQDKDINTLASPVIRVSNREQARIHIGQRVPIISATSVPSTQGPVITESVTYLDVGLKLEVQPTVHLNNEVAIKVALEVSNATPLEPTRQGTIPVQVDTRNAQTSLRLHDGETQVLAGLVRNDKTSSGNKIPGLGDIPGLGRLFGSNRDDMSKSELVLAITPRIVRNLPYQSPSDMEFATGTESSMQVRQLALPLPAGALPADEPGQAPDDAPVVDSQMAVVPAGKGPRP

SEQ ID NO: 3312 - protein, 760 aa, Leptothrix cholodnii SP 6
MTRTLPRIWLALAMLCGAGCSTPQPPDFQAQLEQGQHKEALVRYEEAMNARPGDPERRLQYFRARDQVINRLLALGSAEFGAGQLEPAARAWGEALGIDPKNTRAANGLATIEAARRHQLLAGDARARLAAGDSAGADLMVKAILTENPGHPAARELDRALREQERRKSLAVPVLKSRLQKPVTLEFRDAPLKLVLEALARSAGINFIMDREVRPDLKASIFVRDVRVEDALDLLIHNHQLEKKILTDNTVLVYPNTPQKLREHQELVMRTFHIGNADPKQTLNLLRTMLKVRDVFIDERVNLLFLRDTPDVIRAAERLIAAQDKADPEVVLELEILEVSRTKVRDLGITYPSEFAGPGSSGAKLFEIGELNRRTIGVDTGYKLKLLRTDGDTKTLANPRVRVRNREKARVHVGDRVPVISSTIVGTTNLGSNNTPVTTEQIQYLDVGIKIEAEPTIYADDSVAISINLDVSSLGNQTRTNAGTTAYEVGTRNASTVLRLRDGETQALMGLIRDDDVQTGAGLPYLGEFPVLDRIFGSKRTDRRSRELVLLITPQLVRGIEPADATLAEFWSGTEAAVRTRSPFIEPMTPVALGPATATATATASTAPTLTLGEVAPAAVPLPLNLSWLAPAAIRAGEPFVVALQARSDGPVKGASVQLRYDAAQLEVLAVEDGGYFDPVGGRAVFTPRIDPTLGVVFATVGASGTGSATGDGPLIRLRMKTRGPAATTRLQIGNLVAVDPMNRRLPIEGSAPLELTSRP

SEQ ID NO: 3313 - protein, 614 aa, Azotobacter vinelandii DJ
MTIAMRKAAAAFWLPVLLGGVLLSGCAGQPAKEGIALIDQGRYEEGLVQLAEAAHRAPDDTGVQIALATQRALAVSRLLGQAEKARVARDNEAAQVAFQRVLAIEPGNARAAEGMRQIVQLRNVAEHYRQAGLALSRGDLAGAERLVRSILALEPQHEGALALQAGIEGTRAQTAVAYPQLRSRLQQPVSLEFREANLKLVFEVLAQTAGMNFIFDQDVSPDLKATIYVRQVPIEEAVDLLLQQGQLKHKVVNENTVLIYPNTPQKLKDYQELVLKTFYLTNIDANTALNMVKTLLKTRDVFVDERLNTLTMRDTPDAVHLAERLFLAQDQANPEVVLELEVMEVSRKRILDLGLQWPNTFGILAEDGTSAVSILGQLRGIDSDRINFSPSPTLKINANDSDVNTLASPVLRVSNREQARIHIGERVPVVSATSTPSTQGPVITENITYLDVGLKLEVEPTIHLNDEVAIKVGLEVSNATQLTRTEAGTIPIQVDTRNAVTTLRLRNGETQVLAGLMRNDQGKSGDRIPGLGDIPGIGRLFGSNKDTLSKSELVLSITPRIVRNLPYQNPYDMEFESGTESSLRLRPAALPRKAGAALRGQASEPLAAAGLERP

SEQ ID NO: 3314 - protein, 461 aa, Bacillus anthracis Ames 0581
MKKFSLLLTAFVMILTLFIPNLTSAKSFPDVQSNHWAIKEINYLSDKGIINGTPEGTFKPSDYVTRGQMALMLDLSLKLEKPSNYNHIFSDVAKGVYYYDSVHKLAHNNIVQRETNYFPDRSLTRAEMAVVLVKTFNLKPTGADVNFPDVPSNHWGYNYVKILAQNNITAGFPDGTFGPDVKVTREQFAAFLARVLEPSFRPGLPKPKGELEVHYINVEQGDATFIKSPSGETILIDGGNNGKGKVVANYLKGLGFQTIDYMIATHPDADHVGGLDEVLYAINVKNVYAPKVSHTTQTFKDFLTAVANKGLTIKEAKSGVTLPINGLNSQFLAPVKEYGNDLNEWSAVLKVTHGSKSFLFTGDAESKSEKDMVATYGSGLKSDVLKPGHHGSKTSSSQPFLDAVKPSIAIISAGAGNRYGHPTQETLAKLNAMSVKVYRTDLNGTVIINSDGSNISVRAER

SEQ ID NO: 3315 - protein, 461 aa, Bacillus anthracis str Sterne; identical to SEQ ID NO: 3314

SEQ ID NO: 3316 - protein, 461 aa, Bacillus cereus ZK
MKKFSLLLTAFVMILTLFIPNLTSAKSFPDVQANHWAIKEINYLSDKGIINGTPEGTFKPSDHVTRGQMALMLDLSLKLEKPSNYNHIFSDVAKGVYYYDSVHKLAHNNIVQRETNYFPDRSLTRAEMAVVLVKTFNLKPTGADVNFPDVPSNHWGYNYVKILAQNNITAGFPDGTFGPDVKVTREQFAAFLARVLEPSFRPGLPKPKGELEVHYINVGQGDATFIKSPSGETILIDGGNNGKGKVVANYLKGLGFQTIDYMIATHPDADHVGGLDEVLYAMNVKNVYAPKVSHTTQTFKDFLTAVANKGLTIKEAKSGVTLPINGLNSQFLAPVKEYGNDLNEWSAVLKVTHGSKSFLFTGDAESKSEKDMVATYGSGLKSDVLKPGHHGSKTSSSQPFLDAVKPSIAVISAGAGNRYGHPTQKTLAKLNAMSVKVYRTDLNGTVIINSDGSNISVRTER

SEQ ID NO: 3317 - protein, 348 aa, Moorella thermoacetica ATCC 39073
MMTLSILALLVAVLLTVNSGWYFIRRAGKKARRQALYALLAFIISVAAAAGHPGGGPGPSGSLQSQPRSQAQAPVQAPAGTPLSRESQTNPSPRREEAGKLRVHFLDVGQGDAILVQLPGGQNILIDAGTNEAGPVVVQDLKQYAVAKLDYVIGTHPHEDHIGGLDQVINTFPVGKVYLPRVTNNTASYRELLLAIKNKGLKVTEARAGVSIPLGDGVQALFINPAKKNYDDLNDWSAVLRLTYGQTSFLFTGDAGSAAEEEMLASHQPLRADVLKVAHHGSRTATGTAFLKAVAPAYAVISVGKGNDYGHPHAQTLKRLQQAGVKVYRTDRDGTITAVSDGREVIMP

SEQ ID NO: 3318 - protein, 443 aa, Clostridium thermocellum ATCC 27405
MYTFFKNIMPRWCHIRPAYFLQVLLIAGFMILSGCNADSGGYANNRTTVMSEEIQADSSNSSEEGNFVDVAETAEPSSAADNSQKSGDLQETVKSQKQDTIESNASNGRLEITFLDVGQADSILISQGQYHMLVDAGNNADAEQVVNYLKNKGIRKLEYVIGTHGHEDHIGGLDEVIKSFEISKILMPKQINTTKTFEDVLVAIRNKGMKVTAPKVGDVYELGRAKWTVLAPGREEYENINNSSIVIRLTFGNNSFLFMGDAEELSEREILANNLEIKSDLIKIGHHGSSNSTTSEFLEKVSPKYAVISVGKGNDYGHPHTQTLDKLNAAGIQIYRTDISGTIIVTSDGKSITFDKKASPVKENAPPASDKPGVQTESSDSKSNISANSNAEQSKEIVVYITKTGEKYHTGGCSYLRKSSIPVKLSDAKNRGYTPCSRCNPPR

SEQ ID NO: 3319 - protein, 367 aa, Herpetosiphon aurantiacus ATCC 23779
MTAPSFPAFCNRCGNRRSPQARFCRYCGNAFQHWQATATKSIPSTEVGVKAVQRSIKWRYWFALTLVLFIGARLSLKPLMGLVLGGLNFSNAPIAGTPNQSPPNQRLATGQTLRIHVIDVDQGDSILIQTPQGMNALIDGGYDNGLALEYLHQQGIQRIDHMIVSHPHADHIGGLVEVLNSLEVGSIWTSGAVHSTSYFENLLDAIDRQQVPYREVKTQESIPLGDLSLLVVRSEPQAGDLNDTSLILRLEYGQFSMLFTGDAEASSEVDVLQTTPNLLPATVLKVGHHGSYTSTTPAFALAVDPTLAIYSAGRNNSYGHPHQQTLTTLCNLGATVYGTDRHGTVVITSDGLEYQVQTAQRTTALCH

SEQ ID NO: 3320 - protein, 300 aa, Clostridium phytofermentans ISDg
MKRNKKISTIIKLLLIIILVIGQYLYTSDQRGQTEENKETSAKDTDDPLMKVHFIDVGQADCILVENNNKYMLVDGGNNDDKDVILDYLNRLGVKEFEAIIMTHPHEDHIGSIDTVIREFKVKKIYAPKKEHTTKTYEDVLNAVIETGNTLNAPKSGEKFNFGAVTVTFLAPSRDYGNNLNNWSIGIKVSNGKHSFVMCGDAEKEAEEDMLATKLDLSADVLKLSHHGSDTSSTKEFVKAVNPKYAVISVGKGNTYGHPSKSTIKMLKNNKIKYFRTDEQGTIVMISDGDQLTCNVSPIP

SEQ ID NO: 3321 - protein, 318 aa, Thermoanaerobacter sp. X514
MYKKRLLLPFILILFAFILTNYTIFDNTLTHEVQQVLQDEGIKKQHEAVKKSATDSLTVNYIDVGQGDSIFIQTPSGKTMLIDAGTPEMGSKVIKYIKSQGINKIDVLIGTHPHNDHIGGIVEIIKTFKIGKFYMPKVTTTTRTFEEVLKAAKSKGLSINVAKTGVVIDLGDGIIAKMLAPNSSHYEDLNNYSAVIKITYGNTSFLFTGDASEQSEKEMLSKGYNLKADVLKIGHHGSSSSSTWAFLKAVHPKYAVISCGKYNDYGHPHKETMKKLRSLGIIVYRTDECGTVIAVSDGKTINFNVEPGDNLSGSEIKR

SEQ ID NO: 3322 - protein, 461 aa, Bacillus cereus AH187
MKKFSLLLTAFVMILSLFIPNLTSARSFPDVQSNHWAIKEINYLSDKGIIKGTPEGTFKPSDDVTRGQMALMLDLSLKLEKPSSYNHIFSDVAKGIYYYDSVHKLAHNNIVQRETNYFPDRSLTRAEMAKVLVKTFDLKPTGADVNFPDVPSTHWGYNYVKILAQNNITTGLPDGTFGPGVKVTREQFAAFLARVLEPNFRPALPKPKGELEVHYIDVGQGDATFIKSPSGETILIDGGNNGKGKVVADYLKGLGFQTIDYMIATHPDADHVGGLDEVLYSMNVKNVYAPKVSHTTQTFKDFLTAVANKGLTIKEAKSGVTLPINGLNSQFLAPVKEYGNDLNEWSAVLKVTHGSKSFLFTGDAESKSENDMVETHGSNLKSDILKPGHHGSKTSSSQPFLDAVKPSIAVISAGTGNRYGHPTQETLAKLNAMSVKVYRTDLNGTVIITSDGSNISVRTER

SEQ ID NO: 3323 - protein, 461 aa, Bacillus cereus AH820
MKKFSLLLTAFVMILTLFIPNLTSAKSFPDVQSNHWAIKEINYLSDKGIINGTPEGTFKPSDYVTRGQMALMLDLSLKLEKPSNYNHIFSDVAKGVYYYDSVHKLAHNNIVQRETNYFPDRSLTRAEMAVVLVKTFNLKPTGADVNFPDVPSNHWGYNYVKILAQNNITAGFPDGTFGPDVKVTREQFAAFLARVLEPSFRPGLPKPKGELEVHYINVGQGDATFIKSPSGETILIDGGNNGKGKVVANYLKGLGFQTIDYMIATHPDADHVGGLDEVLYAMNVKNVYAPKVSHTTQTFKDFLTAVANKGLTIKEAKSGVTLPINGLNSQFLAPVKEYGNDLNEWSAVLKVTHGSKSFLFTGDAESKSEKDMVATYGSGLKSDVLKPGHHGSKTSSSQPFLDAVKPSIAIISAGAGNRYGHPTQETLAKLNAMSVKVYRTDLNGTVIINSDGSNISVRAER

SEQ ID NO: 3324 - protein, 320 aa, Desulfitobacterium hafniense DCB 2
MKGYKIGSFLLVLLLSILLIGCADLANPNPQNSQDQRNSVKEGQNPGSFLGKDNADTKALQVSFIDVGQADSALIQIPNGKNILIDAGNNADAEFLIKYLQDRGIEEIHILIGTHPHEDHIGGLDKVIEKFKIGQVIMPKVTSTTRTFEDVLLAVQEKGLKIKEGKAGVQLDLGPLEEGMPAVSAEILAPLSGQYEDMNNYSIVLRLVYGPHAFLFTGDAEDVSEKEMLAAGVNLKADVLKVGHHGSKSSTTKDFLAAVAPKYAIISVGKDNSYGHPTETVLKRLSDAGIGIYRTDQVGTITVTANGSALTFATTTHEVQ

SEQ ID NO: 3325 - protein, 406 aa, Halothermothrix orenii H 168
MGKNKLTLKTVIYLMLFIFIAYSMYLYLTPETPEKNQLEIHFISVGQGDAVLIKLPDTKNMLIDAGSNKYSNKVINYIRHQGINQLDYVIATHPHEDHIGGLDRVISTFRIGKIFMPDVIHPTRSFEDVLTIIKKKKLRITPAKKDLVIINNNKKDLKAVIISPEDKKYDKINNYSVVLKLTYHKTSFLFTGDIEKEIESKLVNSKYNLRSNLIKIPHHGSATSSSTPFLKEVSPGYAVISVGRDNDYNHPSPITLEKLKEMKVKIFRTDKQGTIIVMSDGSRLSFNLQPLEISYQKKNNNKNKAVKIISLDLKNEVVVIKNTGNETINLAGWKLVSLKGNQQFNFPDNTVLKPGQSFKILSGPSALNKPDNIIWTRSNIWNNSGDGALLTDSNGEIIDRLLREED

SEQ ID NO: 3326 - protein, 453 aa, Atopobium parvulum DSM 20469
MPNSTQFDSKTESPSTTSGEQSNYFFALILSLIFGIFGVPQLYLKGWKSGLTRLVVNTTLIVGTIVLAQIFALPALLSYLLPAILSYPVIESALNLIYEDANASKKLIKGKLKLHKRYAGKQKAGIALASLSIALYFSAALTQPLPTTVSTAGVSGQQATVQATNAPSQTDSDTSSTTSLANTNVTIKFIDVGQGEAILIALPEKTMLIDAGPTGSGPKISQVLHELGREKIDYLVATHPDEDHIGGMADVISSTQIGTIYAPNKTNNTATYRKFLTAIQNNNLQITLAEAGTIIDQTDDYKIEILWPAKDANFPDTNDYSIIIKLTIGNKTFLFTGDAPTSAILQSNPGHIDVLKLSHHGSRTGTNEQLVRKLSPTYALISYALDNSYGHPMKSVLNALHKHSVEIWGTGANGTITITCDGTTIEISGEKNGTVVAPTSPEKSGTSSTSRTK

SEQ ID NO: 3327 - protein, 294 aa, Desulfotomaculum acetoxidans DSM 771
MNKRKIFWPVLLVLLIIISAGCSRSSNNLRNTDTEKAVLQPDLGKQVKVHFIDVGQADSILLQIPGGQNILVDAGNNEDGPLVVEYLREQGVQKIDYLVATHPHEDHIGGMDNVIKNFEIGKVFMPNIQTTTKTFEDVLLALKAKDLKITTAKAGVSVLEQDNLKMNFVAPNKNNYEDLNNWSAVMRVQYGDTAFLLTGDAEQLSEKEMLAAGANLKADVLKIGHHGSNSSTGKKFLNAVAPEYAVISVGKDNDYGHPHKETLARLTKAGIKIYRTDQSGTIVFTSDGKNISVN

SEQ ID NO: 3328 - protein, 222 aa, Shewanella oneidensis
MENFQSHLAQNRYDRQLSPPIEMAMENDNHNLTADEHITDIDPLVSAIIKVANQRDKAAFGYLFSHFMPKIRAFGLQRLNQQGLAMDLVQETMTTVWTKSHLYNADKGSVATWVFTIMRNQCFDMLRRVQHNREDAFGDDIWPLYDVAVNQDNNPDHKLTAKLLAHLDALPLAQRQVVQGIYMQELTQQELADALKVPIGTIKSRLRLGLEKLKSFLETQHD

SEQ ID NO: 3329 - protein, 202 aa, Pseudomonas syringae tomato DC3000
MRITASLRTFCHLSTPHSDSTTSRLWIDEVTAVARQRDRDSFMRIYDHFAPRLLRYLTGLNVPEGQAEELVQEVLLKLWHKAESFDPSKASLGTWLFRIARNLYIDSVRKDRGWVQVQNSLEQLERLEAPVDRTLDYSQRQEQQLNSAIQNLPTDQAKVLRMSYFEALSHREISERLDMPLGTVKSCLRLAFQKLRSRIEES

SEQ ID NO: 3330 - protein, 202 aa, Pseudomonas syringae pv B728a
MRITASLRTFCHLSPSHSESTITRLWIDEVTAVARQRDRDSFMRIYDHFAPRLLRYLTGLNVPEGQAEELVQEVLLKLWHKADSFDPAKASLGTWLFRIARNLYIDSVRKDRGWVQVQNSLEQLERLEAPVDRTLDYSQRQEQQLNIAIQNLPADQARVLRMSYFEALSHREISERLGMPLGTVKSCLRLAFQKLRSRIEES

SEQ ID NO: 3331 - protein, 205 aa, Colwellia psychrerythraea 34H
MQTNLLSRPTSAKSTSMSDKINHPQLCQWLESVAISRDKQAFTHLFQFFAPKILRIARGKFPNEAQANEVVQDTMSNVWRKAHLYNQDKGAATTWVYTVMRNVTFDMLRKIQGNKEDNLSDDIWPIAESMSIENEIFDDHLEHANLLSVIEELPQAQQDVVKGFYFREMSQEQLAVHLHLPLGTVKSRLRLALGKLKVQLGEKHD

SEQ ID NO: 3332 - protein, 195 aa, Rhodopseudomonas palustris HaA2
MDHPRRKPPAVSQDLSDCIVRIATDHDEAAFDVLFRHYAPRLKSYFTRRGGDPAMAEEITQETMVSVWKNAAQFDPAKASATTWIFTIARNLGIDRLRRAKRPSFDPHDPAFVPDEEDPPDRQFERAEAQRRVRDVMNTLSSNEKSVLMLSFYENQSHGEIAQRLGLPVGTVKSRIRLAFGKLRAALEPLTGAGR

SEQ ID NO: 3333 - protein, 127 aa, Jannaschia CCS1
MQDVMATLWRKAHMYDPSRASVATWIFTIARNRKIDLLRRYARPDPEELPWGPEQAPNPADVIALQQDTTRLSQALATLPEKQRELIKHAYFGDLSHSEIAIETGLPLGTIKSRIRLALDRLRHSMN

SEQ ID NO: 3334 - protein, 208 aa, Saccharophagus degradans 2-40
MLASTTSRQKGPERRMDTDYRRDDNWSGLLERVATSQDQTAFAALFEHFAPLIKGFCQMHASGLSGENAEELVQEVMFKVWQKAPSFDARKSAASTWVFTIVRNTRIDYLRKNSKHTTNIVDGLEADDIWDESLDHQPFVYLQQARDTESVRDFLSTLPEDQSHCLKKVYMEGKSHTEISEELNLPLGTVKSRVRLGLKKLQSCVGGK

SEQ ID NO: 3335 - protein, 208 aa, Shewanella denitrificans OS217
MKNSAPNKDGSIEANLTDLQVQTELYQWLSLVSHQRDKQAFTELFQFFAPKIKRFGMQRLGSNDKANELVQETMSNVWRKAHLYDGEKGAATTWVYTVMRNACFDMLRRIKTRNEQLLGDDIWPVEQALAENNPESETFSDHLMEQHMREHINKLPSSQQTVVKGVYFQSLSQEQLAQQLDVPLGTIKSRLRLALARLKLQMRDEYHD

SEQ ID NO: 3336 - protein, 195 aa, Rhodopseudomonas palustris BisB5
MDHPRRDPRESAHDLSDCIVRIATDQDEAAFDTLFRHFAPRLKSYFTRRGGDPAMAEEITQETMVLLWKNAAQFDPSKASPATWIFTIARNLGIDRLRRAKRPSFDPNDPAFIPDAEEPPDRQFERAEAERRVRDVMDTLSANEKSVLMLSFYENQSHGEIAERLGLPVGTVKSRIRLAFGKLRAALDAQTGAAQ

SEQ ID NO: 3337 - protein, 198 aa, Ruegeria sp. TM1040
MGEGTSGCRESDRVTGEAYSETTVWMLAVRDDRDKAAFGRLFDHFAPRLKGVICRSGVSPAQAEDIVQDVMLTVWRKSHMFDPGRAQVSAWIYQIARNRQIDILRKEKRPVPEELKPVEDTEDDASQVVALEQETQALRAALQTLKPAQREMVERAYLGELTHAEIKAETGLPLGTIKSRIRLGLEKLRHELKGTQRS

SEQ ID NO: 3338 - protein, 204 aa, Pseudoalteromonas atlantica T6c
MLVGIPLESKHSHAVVPKDCADEMSSYLVLVGQSRCKRSFAEIFNYFAPRLRSYALKQMGNEALAMELVQDTMSNVWQKSHLFNAEKGAPSTWIFTIARNIRFDMLRKQRNRKEDICADDLWPVLCEQTADVNEVSLDEQITLQQLGVIFEDLPKKQREVIEAIYIEGKSQQEVADQFDIPLGTVKSRTRLALQRLKEMLKDND

SEQ ID NO: 3339 - protein, 206 aa, Rhodospirillum rubrum ATCC 11170
MPSPTAPGSTATPASPAPPPSPAADGADHGALIVAIARSGDRAAFATLFTHYAPRLKSYLRRLGANDASAEEVAQEALLMVWRKAERFDPTKAGAATWIFTIARNLRIDMLRKERRPEIDPEDPLLEPSSPDAADILIEKDQRETRVRTALRSLPADQAEVVRLAFFEDLTHVEVADRLGLPLGTVKSRLRLAFSKVRGSVGDEVR

SEQ ID NO: 3340 - protein, 222 aa, Shewanella sp. MR-7
MENFQSHLAQNRYDRQLSSPIDMAMENDSTISTANEPITDADPLTRAIIRVANQRDKAAFAELFSHFMPKIRAFGLQRLNQQGLAMDLVQETMTLVWTKAHLYNADKGSVATWVFTIMRNQCFDMLRRIQHNREDAFGDDIWPIYDVAVSQEGGPDHKLTAKLLAHLDALPLPQRQVVQGIYMQELTQQELADALKVPIGTIKSRLRLGLEKLKSFLETQHD

SEQ ID NO: 3341 - protein, 181 aa, Rhodobacter sphaeroides 2 4 1
MTDKSDRTDWVALMRAIRDHRDEAAFAELFQHFAPKVKGFLMKSGSVASQAEECAQDVMATVWQKAHLFDPSRASVATWIFTIARNRRIDGLRKDRQPEPEDLFWGPDSEPDQADVYEMQQENARLGRAIARLPEAQRALIERAFFGDLTHRELAAETGLPLGTIKSRIRLALDRLRQHMS

SEQ ID NO: 3342 - protein, 222 aa, Shewanella sp. MR-4
MENFQSHLAQNRYDRQLSPPIDMAMENDSTISTANELITDPDPLARAIAKVANQRDKAAFAELFNHFMPKIRAFGLQRLNQQGLAMDLVQETMTLVWTKAHLYNADKGSVATWVFTIMRNQCFDMLRRVQHNREDAFGDDIWPLCDVAVSQENNTDHKLTAKLLAHLDALPLPQRQVVQGIYMQELTQQELADALKVPIGTIKSRLRLGLEKLKSFLETQHD

SEQ ID NO: 3343 - protein, 194 aa, Maricaulis maris MCS10
MTDLTDRPAPTVDSQRLSDLLVQVGQARDRAAFRTLFDHFAPRIRAFLIQRRVIPAMADDLTQDVMLAIWRRASSFDPSRAAASTWIYTIARNQHIDQYRKAQRASRMDETDPSLQPAPAPAADDLCEQAEAADSVGVALEDLSADQRQVVELAFTEGLTHSEIADRLELPLGTVKSRIRLALGKLKTTLGEMV

SEQ ID NO: 3344 - protein, 220 aa, Shewanella frigidimarina NCIMB 400
MENVQSQSTQSRYDKGHLAKRSLIKLSGAMKSNEPNPMADELASLMTQVANDRCKTSFAKLFSHFGPKINSFGVQRLSQQGLAMDLVQETMTRVWTKAHLYNAEKAAVSTWVFTIMRNQCFDMLRKVQHNREDSFGDDIWPLFESDEAESNDNDFLLSASLLQHVEELPPLQRQVVQGIYMQELTQQELAEKLNIPIGTVKSRLRLGLEKLKSFMEKHYD

SEQ ID NO: 3345 - protein, 222 aa, Shewanella sp. ANA-3
MENFQSHLAQNRYDRQLSSPIDMAMENDSTISTANEPITDADPLARAILRVANQRDKAAFAELFSHFMPKIRAFGLQRLNQQGLAMDLVQETMTLVWTKAHLYNADKGSVATWVFTIMRNQCFDMLRRIQHNREDAFGDDIWPIYDVAVSQENGPDHKLTAKLLAHLDSLPLPQRQVVQGIYMQELTQQELADALKVPIGTIKSRLRLGLEKLKSFLETQHD

SEQ ID NO: 3346 - protein, 215 aa, Shewanella amazonensis SB2B
MQIFRQNQHGSHYDRSSSPINIKGMQDSKPDISEETLRHWLVAVANNRDKSAFRALFDHFGPKVRSFGLSRLSQQGLAMDLVQETLTTVWTKAHLFDTDRGNVSTWVYAIMRNQCFDMLRRVQHNREDAFGDDIWPLFDVDTHAGDHGDHKLDALLNQYLSKLPKLQREVVQGIYLQELSQQELADRLGVPLGTIKSRLRLGLEKLKSLLEKHHD

SEQ ID NO: 3347 - protein, 206 aa, Psychromonas ingrahamii 37
MIARIAHNSTDITLNNTKLNSLDSEQLKINLWLKLVATKQDKEAFSELFKWFAPRIRAHGMQRFKQEALAMDLVQETMLLVWRKAVLFNVDKGKASTWIYTIMRNYCFDMLRKKQTQKEDTISDDLWPVIEQQVPDDKDDHLQNRLLLSHLGSLPLEQKQVVEAIYLQEMTQQELATHLDLPLGTVKSRLRLAISKLKSKLEADLD

SEQ ID NO: 3348 - protein, 221 aa, Acidovorax avenae citrulli AAC00-1
MTIVRKPLAEQPPARTAFALPPYLSIVSKYHTEGLPSSPSSEAWIALVRAVADHGDRQAFAALFKHFAPRVKAYLMRLGLAEGVAEDLTQEAMVNLWRRAGTFDPAHAGVSTWVFTIARNLRIDHLRRKSNQLSESDDGLDMALDDDGPEELAYAAQCENDVRRAIESLAPEQAQVLRRSFFEDQPHARIAEDLGIPLGTVKSRVRLAVRHLRRLLGAHAP

SEQ ID NO: 3349 - protein, 215 aa, Marinobacter aquaeolei VT8
MMTIASSNTITVKERPVTTLEQQPTKTEGRKDPWGVLLEKVGKHQDRAAYHALFEHFAPQIKYYAISNGLASHAEELVQEVFVSIWRRSCLYDWRKAAASTWIFTIARNQRIDMLRKMQRTSAEMAVETEDLWQIPGDNEDEPVTSLHRLMSERRIRESLSQLPEEQITVIAKVYMEHKSHQMVADELNIPLGTVKSRVRLALNKLKVILQDQNV

SEQ ID NO: 3350 - protein, 220 aa, Shewanella baltica OS155
MENIQSQSRQNRYHGPITSLTHSAMDNDIPALKTCEPQADTLITFMLQVADKRDRAAFGHLFQHFMPKIRAFGLQRLNQQGLAMDLVQETMTSVWTKAHLYNADKGSVTTWVFTIMRNQCFDMLRRVQHNKEDTFGDDIWPLCDATMAQDTLTDHKLTAKLLQHLDALPLAQRQVVQGIYMQELTQQELADALKVPIGTIKSRLRLGLEKLKSFLETHND

SEQ ID NO: 3351 - protein, 168 aa, Rhodobacter sphaeroides ATCC 17029
MRAIRDHRDEAAFAELFQHFAPKVKGFLMKSGSVASQAEECAQDVMATVWQKAHLFDPSRASVATWIFTIARNRRIDGLRKDRQPEPEDLFWGPDSEPDQADVYEMQQENARLGRAIARLPEAQRALIERAFFGDLTHRELAAETGLPLGTIKSRIRLALDRLRQHMS

SEQ ID NO: 3352 - protein, 212 aa, Shewanella loihica PV-4
MQTFVSAGAPDKGSANIKTQPETQVPAELSTWLVRVADARDKQAFTRLFQFFAPKIKRFGIKQLGNEAQAHELVQETMSNVWRKAHLYDGDKGAATTWVYTVMRNAAFDMLRRVKAKAEMNLGDDIWPLEQAQVQSEEEPLHFADHLMEKQMLAYVDSLPEAQRAVVKGVYYQELSQEQLAQQFGVPIGTIKSRLRLALAKLKQQMGDQQHD

SEQ ID NO: 3353 - protein, 220 aa, Shewanella putrefaciens CN-32
MENIQSQSRQNRYHKHISSFTESAMDIDTKAPCVSEPQIELLSTLMLKVANHRDRAAFGYLFTYFMPKIRAFGLQRLNQQGLAMDLVQETMTSVWTKAHLYNADKGSVATWVFTIMRNQCFDMLRRVQHNKEDAYGDDIWPLCDTATSQETQIDHKLTANLLKHLDNLPLAQRQVVQGIYMQELTQQELADALEVPIGTIKSRLRLGLEKLKSFLETPND

SEQ ID NO: 3354 - protein, 168 aa, Rhodobacter sphaeroides ATCC 17025
MRAIRDHRDEAAFAELFQHFAPRVKGFLMKSGSTESQAEECAQDVMATVWQKAHLFDPSRASAATWIFTIARNRRIDGLRKSRQPEPEDLFWGPDAEPDQADVYEMQQENDRLGRAIALLPEAQRALIERAFFGDLTHRELAVETGLPLGTIKSRIRLALERLRQHMS

SEQ ID NO: 3355 - protein, 194 aa, Vibrio cholerae O395
MFNPSPHTFGRQEWLECMEKVKSRDTQAFALVFSYYSPKLKQFVMKHVGSEQVALELVQETMSTVWQKASLFDGQKSSLATWIYTIARNLSYDLLRRQKGRDAYVLADDIWPEDYCPPDLVDHYAPEQDLLKEQVMKFLDRLPEAQQQVIKAVYLEEIPQQDVADMLDIPLGTVKSRLRLAVEKLRLSMDAESL

SEQ ID NO: 3356 - protein, 181 aa, Bradyrhizobium BTAi1
MDWAELIGRVAERGDREAFKALFEHFAPRIKGFLIKSGCNADEAEEIAQSTMVAVWTKAGQFDPSTAGAAAWIFTIARNQRIDVARKAIREGRLSKEIVLDDEADPTLAADQILSRVEDATRVEAAIERLSVEQSTVIRLSFIEERPHSEIAAVLGLPLGTVKSRIRLAMNRLRDLLDDAT

SEQ ID NO: 3357 - protein, 191 aa, Marinomonas MWYL1
MERAIQIEPDEQRVADMLAIAEHRDQAALARLFDYYVPKLRAFCLAAQPGANLMADDIAQEVMIRIWNKAHTYKPESASLNTWVFTLARNARIDYLRKNSRHQSDIDPEYLWQNVVDENADPFKDAQQKRDQERIQQGLDKLPADQKQVLAKVYLEGKTHKEAAEELSLPLGTIKSRVRLALHKLTIYVKR

SEQ ID NO: 3358 - protein, 220 aa, Shewanella baltica OS185
MENIQSQSRQNRYHGPITSLTHSAMDNDIPALKTCEPQADTLITFMLQVADKRDRAAFGHLFQHFMPKIRAFGLQRLNQQGLAMDLVQETMTSVWTKAHLYNAEKGSVTTWVFTIMRNQCFDMLRRVQHNKEDTFGDDIWPLCDATMAQDTLTDHKLTAKLLQHLDALPLAQRQVVQGIYMQELTQQELADALKVPIGTIKSRLRLGLEKLKSFLETHND

SEQ ID NO: 3359 - protein, 222 aa, Parvibaculum lavamentivorans DS-1
MRTKHAVQIGPARAGRQMWRPNLRKLGLMDEGKAPAEVSPGGAEEMAGLIAAIALHGDRTAFARLFGHYAPRVKSYLRRLRVDERLAEDLAQEVMLTVWRKASQFDGTKASAGTWIFTIARNRFIDTVRRERRPDFDPSDPMLQPEEARPADEEMAGAEIGLRVRAALVTLPPDQAEVVELSFLEGLPHSAIAERLDIPLGTVKSRLRLAFARLRPALEDLK

SEQ ID NO: 3360 - protein, 230 aa, Xanthobacter autotrophicus Py2
MDVAEPSLFALPLPPSHRAGTPVGVRPRGRFAVPPAGSPAMSAVQPERRAGADMSALVVAIARTGDREAFAQLFRHFAPRVKAFLMRSGLSANAAEELAQETLLMVWRKASYFDPARAAASTWIFAIARNLSIDLKRRERHISTVDADAADEEADETSGETILMGAERDARVRAALAKLSEEQATIVRLSFFQEKPHSQIAQELGIPLGTAKSRVRLALSRLRTLLEDLK

SEQ ID NO: 3361 - protein, 194 aa, Vibrio harveyi ATCC BAA-1116
MMSESPQKLGRSEWNDYMDKVKARDKDAFAFVFRFYAPKLKQFAYKHVGNEQVAMEMVQETMATVWQKAHLYDGTKSALSTWIYTIIRNLCFDLLRKQKGKDLHIHSDDIWPSDYYPPDLVDHYSPEQDMLKEQVVKFLDILPKNQREVLQAVYLQELPHQQVAELFDIPLGTVKSRLRLAVEKLRHSMHTEQL

SEQ ID NO: 3362 - protein, 189 aa, Dinoroseobacter shibae DFL 12
MALAHKTTMERPLDMEWVSVMLAIRDRQDTAAFARLFRHFAPRIKAFLIKSGASDTLAEDCAQDVMTTVWQKAHMFDPSRASVATWIFTIARNRRIDMLRKERRPEPEELPWGPEPEPDQADVLMLQQESEKLQAALIQLPEKQRILVERCYFGDMSHSEIATQTGLPLGTIKSRLRLALDKLRHELKQ

SEQ ID NO: 3363 - protein, 220 aa, Shewanella baltica OS195; identical to SEQ ID NO: 3358

SEQ ID NO: 3364 - protein, 209 aa, Caulobacter K31
MHVGTSSFTSQARRSLRVTSPEPERDPLIHDRLIEAVALRRDREAFAQLFSYFAPRLKAWLIKSGAAPSAAEDFAQDAMLTVWRKASLFDSRKARAATWIFTIARNRRLDMLRRDARPLPTPEIELTGEAVPRPDDVLSMSEDAERVREALSRLDPQQLEVLRHAFFMESPHSEIARHLNLPLGTVKSRIRNAMIKLRLILEPSQEASR

SEQ ID NO: 3365 - protein, 216 aa, Shewanella woodyi ATCC 51908
MLENEYTNMQKVEGIRHIVEVNNIISKQTQEQVPTELSAWIVLVATKRDKRAFTAIFTFFAPKIKRFGIKQLNTDAMAAELVQETLSRVWNKASLFDPNKGAATTWVYSIMRNAAFDMLRKIKVKNELLLGDDIWPIEAEEYSTSEEFSDHLMDRQIADYVDQLPEAQKLVVKGVYFQELSQEQLAKQLNIPIGTVKSRLRLALAKLKEQVGESHD

SEQ ID NO: 3366 - protein, 195 aa, Rhodopseudomonas palustris TIE 1
MDQLRDGPRPPSAEMADCIVRIAVAQDRAAFETLFRHFAPRLKSYFARRGGDPTLAEEITQETMVSVWRSAAQFDPARASASTWIFTIARNLSIDRLRQAKRPGFDPHDPAFVPDEEEPPDRRLERTETEQRVREVMETLPFNEKSVLMLSFYENQSHSEIAEQLGLPVGTVKSRIRLAFGKLRAALDTTAGEPR

SEQ ID NO: 3367 - protein, 207 aa, Stenotrophomonas maltophilia R551 3
MYPDAASPAFNFDSVRIVSSSQQPSSEPTNWAGDMDGVARLRDRDCFMRIYDHFMPRLCVYLRGLGAPEAVAEELAQECLLRLWLRAADYDPAQAALSTWLYRIARNLHIDRVRRERSWIQVQAAVEYAATADVVERSSAEQFADQARLRQRINELPAVQARLVRMSYFEAKSHGEIAEALGMPLGTVKSHLRRAFLQLQSKVGGAL

SEQ ID NO: 3368 - protein, 203 aa, Alteromonas macleodii  Deep ecotype
MLVGIPLEQSNSTIKPKECATEMSDYLVAVADARCKRSFARVFNYFAPRLRSYALKQMGNEALAMELVQDTMSNVWQKAHLFNAEKGSPSTWIFTIARNIRFDMLRKLQNRKEDVCSDDLWPVLCEQTADVNEAPLDEQVTLEQIGYMFESLPVKQKAVVEAIYIDGKSQQEVADELSIPLGTVKSRTRLALQRLKVMLNDND

SEQ ID NO: 3369 - protein, 220 aa, Shewanella baltica OS223; identical to SEQ ID NO: 3358

SEQ ID NO: 3370 - protein, 252 aa, Agrobacterium vitis S4
MDCREWNFFRAVIQFSQEGVESPMTIIISQAALECHNKRVTAPRLFRRSRLGGRSVPSGANGMIMKAETEDMSSMLAAVARERDVEAFETLFRHYGPRVKAYMARQARDQQAAEELMQETMMVVWNKAALFDPTRGNVSAWIFTIARNLRVSAYRKQNRPEFDPNDPAFVPDEVMPADKDLENRQDAERLHKAMGQLPQEQLELLQRSFFHEIPHSALAKEFNLPLGTVKSRIRMAFAKLRATLEDRSEEDR

SEQ ID NO: 3371 - protein, 163 aa, Clostridium perfringens SM101 uid12521
MNLNEIKELIDKIDSSNIAYFEVKVDNSYIKMDKSLTRNLVEEKKASNIEETEKTDISEEKNESISKVEEVKLQPKEERVQDEDLYLVTSPMVGTFYESPGVGEKSYVSIGSKISSGDVLCIVEAMKLMNEIESEVSGEIIDILVQNGNMVEYGQPLFKVRRA

SEQ ID NO: 3372 - protein, 166 aa, Streptococcus agalactiae 2603
MDIQEIKDLMTQFDESSLREFSFKTSDGELSFSKNEGKAPLVPTMSPMSHQPEATPTIATPVSNEAGEQTKQATEVVSEIPESTVTVAEGDVVESPLVGVAYLASGPDKPNFVSVGDSVKKGQTLMIIEAMKVMNEVPAPHDGVVTEILVANEEVIEFGKGLVRIK

SEQ ID NO: 3373 - protein, 163 aa, Clostridium perfringens ATCC 13124
MNLNEIKELIDKIDSSNIAYFEVKVDNSYIKMDKSLTRNLLEEKKASNLEETEKTDISEEKNESISKVEEVKSQPKEEIIQDEDLYLVTSPMVGTFYESPGVGEKSYVSIGSKISSGDVLCIVEAMKLMNEIESEVSGEIVDILVQNGNMVEYGQPLFKVRRA

SEQ ID NO: 3374 - protein, 168 aa, Oenococcus oeni PSU-1
MDEKTIKDLIEQINQSSIREFDLTVDGVRLYLSKNKNNRESSTSKTADKPASSAQVPLDSNNSDSNDEVSEADKGKAKAKQQEDENTSTINSPLVGVAYLQANPDAESYVKVGDQVKAGDVVCVIEAMKMMTEIKSSVSGTVAEILIDNESMVDYDQPLIKVHTEAKK

SEQ ID NO: 3375 - protein, 152 aa, Leuconostoc mesenteroides ATCC 8293
MSLNIEEIRGLIADLENSSLREFKVVDGEFSLHLSKNKNEAVVNAPVQTPVVAPAAVTSDQAQVAAEPETLKTGTEIVAPMVGTVYLQPKPDAPMFKQVGDKVSVGETVAVIEAMKLMTEIHSEVSGTVAEILVANEEVVDYNKPLYRITTD

SEQ ID NO: 3376 - protein, 155 aa, Lactococcus lactis cremoris SK11
MNISEVKDLMNQFNGSTLREFSWKNADGELSFSKNEGQALVGPQSSAPIAAAFTAQQAAPVAESTEVPVANEIAVEAEGEAVTSPLVGVAYLKPSPDKAEFAKLGDTVKKGQTLLIIEAMKVMNEIPAPKDGIITEVMVSGEDVVEFGQDLMRIK

SEQ ID NO: 3377 - protein, 162 aa, Streptococcus thermophilus LMD-9
MNISEIKDLLAQFDASTLREFSYKNNGEELNLSKNQTSSVTTSPVAPTVEVVASSPQVPVAPVAAPAAVETPATPVEEASAQAAEGEVVESPLVGVAYLSPSPEKPAFVSVGDTVKKGQTLLIVEAMKVMNEVPAPKDGVITEILVANEEVVDYGKGLVRIK

SEQ ID NO: 3378 - protein, 150 aa, Lactobacillus reuteri DSM 20016
MEFKEIQTLMQYFEDSDIRELEINQDSFQLYLSKNKQTHKHEDLITTEKTEQTTSVKKKANEQPTLPSQNITAPLVGTVYLQPTPDADPYVRSGDHVKKGDVVCVIEAMKMMTEIKSPFNGIVTSICVSNEELVEVEQPLFSVQEDKDND

SEQ ID NO: 3379 - protein, 143 aa, Clostridium phytofermentans ISDg
MEIKDIIDLIEAVSSSKLTSFTYIEGETKLSFELNHELLITDASKVVAATAISEQDCILKDTVPCNIITSPMVGTFYCAKGEGEEPFIQVGDKVIKGQVVGIVEAMKLMNEIESPYDGFVEEVLVKNQEMVGFDQKLVRIRPL

SEQ ID NO: 3380 - protein, 144 aa, Slackia heliotrinireducens DSM 20476
MHDEKIRAYAEIMDEMGLTGLEVEEGGAKIRLERGVPQAAAPVVITQQGLAGDGAADAESATPKGELYSVRSPLVGVFYVAPAENAEPFVMPGDRVKKGQTLCIVEAMKLMNEITAEEPGVVEKVCVTNGQMVEYGAELFQIRR

SEQ ID NO: 3381 - protein, 195 aa, Jannaschia CCS1
MYTNDARAGLIALGANLPSGGLPPEISVPKAMARLVERVGGPHSQSRLFHTPAFPPGSGPQFVNAAVKIEWRGHAGELLALLHEIEEEFGRTRAHRWEARVMDLDLIGLGDAILPDAATRANWANLPPERAAQVVPDQLILPHPRLAERGFVLVPLADIAPEWVDPATGLTVAEMLAARPHAELAGIHPVPVAAE

SEQ ID NO: 3382 - protein, 189 aa, Ruegeria sp. TM1040
MAENRSTYLVAMGSNLEDEGTIPLEILQMCLAELSGEGFDLVAVSRFYATPCFPAGAGPDYVNAAIVLRGAFSADETLRRLHKIETKFHRRRQQRWGMRTLDLDLLAVDQEIAPDIQTFSHWHSLPQSEQRTKAPEHLILPHPRVQDRAFVLVPLRDIAPDWVHPVLELSVREMLKRCPASDVAEVRAL

SEQ ID NO: 3383 - protein, 161 aa, Rhodospirillum rubrum ATCC 11170
MIYIALGANLAGPAGSPRDTLDAALVALEDAGVVVAARSAWYRTSPVPPSDQPDYVNGVARLVTDLDPVALLGLLHRLEDQFGRRRGEINAARTLDLDLLDYDELRRTGAPPLLPHPRMAERGFVLFPLREIAPDWRHPVLDQPIDTLIAALAADQAAERL

SEQ ID NO: 3384 - protein, 178 aa, Rhodobacter sphaeroides 2 4 1
MPSAGRFPEGNVSEAISAVASAFQAPFRVSRLFKTPFFPAGAAPDFVNAAMALHLTDDVDPRKILARLHEIEADFGRSRSHRWADRTLDLDLIALDDSVWPDADTQERWRHLPPEEQARRTPDGLILPHPRLQDRAFVLVPLADVAPDWRHPLLGLTVREMLAALPEAERAAAVPLEA

SEQ ID NO: 3385 - protein, 190 aa, Maricaulis maris MCS10
MNTGKQSAPIYIALGANLPLGEWSPRETLARARIALAEAGLGIVSASSDWHSPAWPDPSEPPYVNAVAEIASDQSARAILERLHAIEATFGRKRAVCNEPRPLDLDLIDCRGERTDAPDGLVLPHPRATSRAFVLLPLAEIAPGWSDPVSGQSIIDLIAALPQADRSATYKLQESGKLSPDHLAFEGRGD

SEQ ID NO: 3386 - protein, 163 aa, Paracoccus denitrificans PD1222
MSNILKLPAVVPVAVSRFWSTPAFPAGSGPEYVNAAASFRCDLPPEQLLHELHMIEKILGRSREGRRWQARGLDLDLLAHGDLVLPDAAEQDHWRSLPPQEQPLRAPDRLILPHPRLQDRGFVLAPLAEIAPNWMHPRLGRSVAQMLAALPPEALAGIRPASA

SEQ ID NO: 3387 - protein, 178 aa, Rhodobacter sphaeroides ATCC 17029
MPSAGRFPEGNVSEAISAVASAFQAPFRVSRLFKTPFFPAGAAPDFVNAAMALHLTDDVDPRKILAQLHEIEADFGRSRSHRWADRTLDLDLIALDDSVRPDADTQERWRHLPPEEQARRTPDGLILPHPRLQDRAFVLVPLADVAPEWRHPLLGLTVREMLAALPEAERAAAVPLGA

SEQ ID NO: 3388 - protein, 178 aa, Rhodobacter sphaeroides ATCC 17025
MPFAGGFPEGTVREAIAAVAKAFGANFQASRLYLTPFFPAGDAPDFVNAAMTLHLSDEVGPEAVLRRLHEVEADFGRSRSRRWASRTLDLDLIALGDSVWPDADTQGLWRNLPPEDQARRVPDGLILPHPRLQDRAFVLVPLADVAPEWRHPLLGRTVLEMLAALPAADRAAVVPLEA

SEQ ID NO: 3389 - protein, 138 aa, Acidiphilium cryptum JF-5
MQKIETIHLEAVSSWYRTRPVPPDPTQPDFCNGVVRFSGAPDPVALLEALHEIEARFGRVRSVPNAARTLDLDLIDVNGMVRETGSPILPHPRAHLRTFVLRPLLDVAPDWVHPLLLRPARELFSALPERAEGEIRLW

SEQ ID NO: 3390 - protein, 187 aa, Parvibaculum lavamentivorans DS-1
MMSDIRPHIPGILVALGGNLATVHGSPVKTLEAALAVMPGFGIRVVKCAHLYKTPALSSYVQPDYVNSVVSIETALPPADLLNILHRIEAIFGRVRRERWASRPLDLDLLDYRGMIMPAAGPRGADAGAGKLPLALPHPGIALRGFVLLPLRDVAPEWRHPVTGESVDRLIAALGPGGLAGIERTGS

SEQ ID NO: 3391 - protein, 189 aa, Dinoroseobacter shibae DFL 12
MKIQSFGIIALGANQPLGGRTPKVTLRQACEALADAPLEIVARSRFFATPAFPDPSQPEYVNGCVTVETGLGAKALLKVLHDVEDRLGRARGQRWGARTLDLDLLALGAQVLPDMETYAQWRDLPRSAQVARTPNELILPHPRIADRPFVLVPLMDVAPLWRHPVTGKTASEMLRNLPKSEIDAIRPLE

SEQ ID NO: 3392 - protein, 165 aa, Gluconacetobacter diazotrophicus PAl 5 JGI
MILIAIGANLPRAEGSTPLETCRWAVEHIASIPGVRVVAVSAWYESAPIPPSGQPPYVNGVVAATGELDPAVLLAALQGIEARAGRRRTVANAARPLDLDIIAMGDLVRDAPDPILPHPRADARAFVLLPLRDVAPGWRDPRSGRTVDALVADLPDQQIRRLEAD

SEQ ID NO: 3393 - protein, 130 aa, Escherichia coli BL21 (DE3)
MAENQYYGTGRRKSSAARVFIKPGNGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 3394 - protein, 130 aa, Pseudomonas syringae tomato DC3000
MSATQNYGTGRRKTATARVFLRPGTGNISINNRSLDNFFGRETARMVVRQPLELTETVEKFDIYVTVIGGGVSGQAGAIRHGITRALMQYDETLRGALRKAGFVTRDAREVERKKVGLRKARKRPQYSKR

SEQ ID NO: 3395 - protein, 130 aa, Pseudomonas syringae pv B728a; identical to SEQ ID NO: 3394

SEQ ID NO: 3396 - protein, 129 aa, Chromohalobacter salexigens DSM 3043
MTQQYYGTGRRKTSTARVFLKPGTGKISVNSRELNDYFGRVTGEMVVRQPLELTETTGQFDVYVTVTGGGGSAQAGAIRHGITRALIDYNEDFRRPLRDAGYVTRDARQVERKKVGLRKARRRPQFSKR

SEQ ID NO: 3397 - protein, 130 aa, Haemophilus somnus 129PT
MAENQNYGTGRRKSSSARVFIKPGSGKIVINQRELDVYFGRETSRMIVRQPLELVELTDKLDLYVTVKGGGISGQAGAIRHGITRALIEYDETLRPALRAAGFVTRDARRVERKKIGLHKARRRPQYSKR

SEQ ID NO: 3398 - protein, 130 aa, Enterobacter sp. 638
MAENQYYGTGRRKSSAARVFIKPGSGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 3399 - protein, 130 aa, Marinomonas MWYL1
MSATQYYGTGRRKTSTARVFLKAGSGNLVINNRSIDQYFGRETARMVVRQPLELVDATEKFDVYITVKGGGISGQAGAIRHGITRALMQYDETLRRTLRSAGFVTRDSREVERKKVGLRKARRRPQFSKR

SEQ ID NO: 3400 - protein, 130 aa, Escherichia coli HS; identical to SEQ ID NO: 3393

SEQ ID NO: 3401 - protein, 130 aa, Escherichia coli E24377A; identical to SEQ ID NO: 3393

SEQ ID NO: 3402 - protein, 130 aa, Serratia proteamaculans 568
MAENQYYGTGRRKSSAARVFIKPGSGNIVINQRSLEQYFGRETARMVVRQPLELTDMVGKFDLYITVKGGGISGQAGAIRHGITRALMEYDETLRGELRKAGFVTRDARQVERKKVGLRKARRRPQFSKR

SEQ ID NO: 3403 - protein, 139 aa, Coxiella burnetii RSA 331
MAQAAKKQNLGTGRRKTSSARVFLRSGTGQIIINGLPLDEYFGRETARMVVRQPLVKLDVQSRFDVYATVQGGGDSGQAGAIRHGITRALIQYDEEGGEGGTWRSTLRKAGFVTRDPRMVERKKVGLHGARRGTQFSKR

SEQ ID NO: 3404 - protein, 130 aa, Yersinia pestis Angola
MAENQYYGTGRRKSSSARVFLKPGSGKIVINQRSLEVYFGRETARMVVNQPLELVDMVTKFDMYITVKGGGISGQAGAIRHGITRALMEYDESLRGELRKAGFVTRDAREVERKKVGLRKARRRPQFSKR

SEQ ID NO: 3405 - protein, 130 aa, Escherichia coli C ATCC 8739; identical to SEQ ID NO: 3393

SEQ ID NO: 3406 - protein, 130 aa, Yersinia pseudotuberculosis YPIII; identical to SEQ ID NO: 3404

SEQ ID NO: 3407 - protein, 130 aa, Shigella boydii CDC 3083 94; identical to SEQ ID NO: 3393

SEQ ID NO: 3408 - protein, 130 aa, Salmonella enterica serovar Newport SL254
MAENQYYGTGRRKSSAARVFIKPGNGKIVINQRSLEQYFGRETARMVVRQPLELVDMVEKLDLYITVKGGGISGQAGAIRHGITRALMEYDESLRGELRKAGFVTRDARQVERKKVGLRKARRRPQFSKR

SEQ ID NO: 3409 - protein, 130 aa, Salmonella enterica serovar Schwarzengrund CVM19633; identical to SEQ ID NO: 3408

SEQ ID NO: 3410 - protein, 130 aa, Salmonella enterica serovar Dublin CT 02021853; identical to SEQ ID NO: 3408

SEQ ID NO: 3411 - protein, 130 aa, Escherichia coli O157 H7 EC4115; identical to SEQ ID NO: 3393

SEQ ID NO: 3412 - protein, 130 aa, Dickeya dadantii Ech703
MAENQYYGTGRRKSSAARVFIKPGSGNIVINQRTLEQYFGRETARMVVRQPLELVDMIGKLDLFITVKGGGISGQAGAIRHGITRALMEYDESLRSELRKAGFVTRDARQVERKKVGLRKARRRPQYSKR

SEQ ID NO: 3413 - protein, 130 aa, Dickeya zeae Ech1591
MAENQYYGTGRRKSSAARVFIKPGSGNIVINQRTLEQYFGRETARMVVRQPLELVDMVGKLDLYITVKGGGISGQAGAIRHGITRALMEYDESLRSELRKAGFVTRDARQVERKKVGLRKARRRPQYSKR

SEQ ID NO: 3414 - protein, 130 aa, Pectobacterium carotovorum PC1
MAENQYYGTGRRKSSAARVFIKPGNGNIVINQRSLEQYFGRETARMVVRQPLELVDMVEKLDLYITVKGGGISGQAGAIRHGITRALMEYDESLRGELRKAGFVTRDARQVERKKVGLRKARRRPQFSKR

SEQ ID NO: 3415 - protein, 367 aa, Escherichia coli BL21 (DE3)
MKPIFSRGPSLQIRLILAVLVALGIIIADSRLGTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPATGNAATAPAAPTQPAANRSPQRATPPQSGAQPPARAPGGQ

SEQ ID NO: 3416 - protein, 355 aa, Shewanella oneidensis
MKPIFVRGISNQFRLTLAIILSVILLAANHRLEPARESLSSALSPIQYLASVPSAILDWSSESFATRNMLALQNKELLRQQLLMSERLQRFEHLRQENERLRALLGSPAYQDSRKMVVEVMEVASEPSHHYVVLNRGSRSGVFVGQPVVDAQGVVGQVVQVSEMTSRVLLVSDVSHGLPVRITRNDVRLIANGTGELDEIELRHVAKSTDIRVGDLLVTSGLGNRFPEGYPVARVMKVFTEDGQSYTRVTAQPLAALDRIRYLLLIWPSPDSGVTLPNQIPVPAADHPVEEAKPDAVNGAINPQGEAQGTNATVPNATVPNTTAPNATVPNATAAPRNANGASNAATTQPPAEVH

SEQ ID NO: 3417 - protein, 332 aa, Pseudomonas putida KT2440
MVMSVALMVVDARFDVLKPVRSQMGLVLMESYWITDLPQRAWQGVAGQFGSRTELIAENEKLKTEALLLQGRLQKLAALTEQNVRLRELLNSSALVNEKVEVAELIGVDPNPFTHRILINKGERDGVFLGQPVLDARGLMGQVVELMPYTARVLLLTDTTHSIPVQVNRNGLRAIASGTGNPERLELRHVADTADIKEGDLLVSSGMGQRFPAGYPVATVNEVIHDSGQPFAIVRAIPTAALNRSRYMLLVFSDRRSPEQRATDAAIAQEEADRKGAAPAGQPAATRDQVAPAAGTPAASVTPAAPATPVAQPAAPSAAPATPAAPAQPRRQ

SEQ ID NO: 3418 - protein, 359 aa, Pseudomonas syringae tomato DC3000
MLAVLSVALMVVDARFTILKPVRSQMSMVLMQSYWVVDLPQRLYQGVASQFGSRTELIAENEKLKTEALLLQGRLQKLAALTEQNVRLRELLNSSALVNEKVEVAELIGMDPNPFTHRIIINKGERDGVVLGQPVLDARGLMGQVVELMPYTSRVLLLTDTTHSIPVQVNRNGLRAIASGTGNPERLELRHVADTADIKEGDLLVSSGLGQRFPAGYPVATVKEVIHDSGQPFAIVRAVPTAALNRSRYLLLVFSDGRSPEERAADAAQAQESIDKGLEPTVMATLPPPTPAFPMWPQATVPTFPGSTTTHKPAAQPATPAPAATPAATPAARPAARPAASRPPASTPSNSNAREPIDG

SEQ ID NO: 3419 - protein, 300 aa, Methylococcus capsulatus Bath
MIREGRAIKLAFTKKPAQNFRLLVFAVVSLVLLAADRRGAIGALRGGLDAAVYPLQQFVSAPVRFAEWLRENVSGYASLLEENQRLKEESLRLEARLAKFSALEQENIRLRALLGASIKIGEHFLIAELLSINLVPYEHLVLANKGSNIGVHVGQPVFDARGVVGQVLRVSPVSAEVMLITDPNHAIPVQVERNGLRTIAVGTGRIDRLILPYLSGSADIREGDRLVTSGMGGVFPAGYPVATVVDISNTGSSLAKVSAEPVAPLDRIREVLLVWTRSDVQTRDETGESPSGAAAPHVAH

SEQ ID NO: 3420 - protein, 357 aa, Pseudomonas syringae pv B728a
MLAVLSVALMVVDARFTILKPVRSQMSMVLMQSYWIVDLPQRLYQGVASQFGSRTELIAENEKLKTEALLLQGRLQKLAALTEQNVRLRELLNSSALVNEKVEVAELIGMDPNPFTHRIIINKGERDGVVLGQPVLDARGLMGQVVELMPYTSRVLLLTDTTHSIPVQVNRNGLRAIASGTGNPERLELRHVADTADIKEGDLLVSSGLGQRFPAGYPVATVKEVIHDSGQPFAIVRAVPTAALNRSRYLLLVFSDGRSPEERAADAAQAQESLDKGVEPSVMATLPPPTPAFPMWPQAVVPVFPGSTMTHKPAAQSATPAPAPAATPATPARPAARPAASQPPASRPSTAREPIDG

SEQ ID NO: 3421 - protein, 286 aa, Psychrobacter arcticum 273-4
MTPSIFARQPLVLRMTAVLLIVALILMWFDSKNPEWFNPIRSSSHAAMQPIYELSLLPSYAKHWSSGSLQSKEALRRENMQLKSQLIHAQAKLQQQDYILAQNARLQGILSTTSPEQFDLNLAQVIGTDTNLLRQIVVLNKGAQDGVQVGQTVIDEDGILGQIINVYPNTSRLLLITDERQSVAVTVKRTGQRAIVTGQGIPTSLSLEYVFKTSDVRVGDELVSSGLGERIPAGYRVGRIAHIEDTQADNFRSIKVTPAANFVNNAYVLILQDKLANKDNIGITEP

SEQ ID NO: 3422 - protein, 291 aa, Colwellia psychrerythraea 34H
MNPIFNQGTSPAHRLILVLCCSVALIFFDHKMASFETARGYLQSLVSPLQYMANAPKQMMTWASENIVIRQQLMEENKNFRENELFFHEQVMQLSIVRQENERLRSLLSSPVRGEIKKMFAEILSVDSDPYSHQVVINRGANDGVYEGQPVLDEKGIVGQILHVGVSSSRVILISDISHAIPVRIQRNGLRLIASGSGQIDRLIHNFVPHSADVKEGDLLVTSGLGGKYPEGYPVSRVVFVRADESREFATIYSEPVAQIDRLRYMLLLSKDEAVKPASPLTTKKATVGKS

SEQ ID NO: 3423 - protein, 311 aa, Dechloromonas aromatica RCB
MAGLDHAPPPFFKRGPAPLALLTFYIAVSLAIFVLDLRFKSLELLRQSIALVIDPVQRVAQTPGSLVDYAASYLQGLRALQLENGELKHNQLTTAPNLQRLAQLEVENERLRKLLAVKEREKANGQVTQILYTARDPFSRKVIVDKGQQAGIVAGQPAIDEAGVVGQVTRVFPFSAEITLITDKDQVVPVQVVRSGQRSVVFGLGNGQLELRYMPANADIQIGDILVTSGLDGIYLAGFPVAKVVDIERDSAYSFARIFCVPIAGVENFGEVMVLDPRKALPPAPPESSGRPGSSDKPSLRKKKKTAGKEH

SEQ ID NO: 3424 - protein, 281 aa, Thiobacillus denitrificans ATCC 25259
MAMPGQLMFARRLGPTARLSIWLLLGLACIVIDVRYHALEGLRSGFSLLLQPVRQAMRAPVDVAVELGGFFTRHRLLQKERDALLDERARLRVSENRANELSRENRELRALLQLRSRPGQQLVHAALLYRGHDWFAQRITLDQGADAGLRRGLPVVDAVGLVGQVTRVYPHSSDVTLVSSPDHLTPVYVERTGQRGLAAGGGRGRLELRYMPVHTDIRPGDRLLTSGIDRVYPAGIPVGRIVSVSRLKTSPYLNIEGAPLAGLDRSRAVLVLVARPLERAP

SEQ ID NO: 3425 - protein, 282 aa, Thiomicrospira crunogena XCL-2
MTINLSTTSPQKEGTQFLLFFILSIALMVMDHYSHLLSNFRNVLLTTIDPIERTATLPLDIYNWMQQDYTTINQLQMRNQQLETENLLLKAQQQQMGKLKLEISRLNRLLGTASQMSSSSVQIANVSSYSETPLAQFYTLNKGSLDGVKINQTVIDAKGLIGQITSLTPSSSRVQLITDPDIQVPVRIQRTGQRGILNGLGHNQLSLMFIPNSSSIKEGDLLETSGLGDVFPEGHPVAIVRQVNILKGEPYYEIFARPVADLNLSQKVLILSKKTERDNHVR

SEQ ID NO: 3426 - protein, 298 aa, Nitrosospira multiformis ATCC 25196
MIEISPRFFRHSPSLLARTAFFVMLSLLLMALDSRSKYLGGVREIFSVIVYPLQKLAHMPMAMYDATSELFQHGEIAEENARLKQQHLVDKGQLLRLRALEAENTQLRKLLNTTQRIENKATVAEILRVPHDPFNRKVLLDKGSMAGIESGQVVVDDMGVVGQVTRNYPLASEVTLLTDRDHSVPVQVVRNGLRSIISGTGREGVLELRYMAINTDIQEGDVLVTSGIDGIYPAGLPVAAVSQIERNPNYIFARIICTPASGVNQNRQLLILSTRAPRTGTPAEATKTKPRPQEARRQ

SEQ ID NO: 3427 - protein, 254 aa, Saccharophagus degradans 2-40
MAGIFIYTDWFASLKNQATDVAAPFYWVSDIPAKVEDWADNRVMSRSRLQQENESLRTELLIHKRKLQQMASLAAENVRLRQLLNSAEMIEDRVIIAELIGVSPDPLVHKVIVNRGSNHGVYIGQPLLDANGLMGQVVQVGALSSQVLLITDTTHALPVQINRTGVRLIAEGLGRLDELALRYVPNTTDIEVGDLLVSSGLGQRFPAGYPVAEVVEVQRDPGKAFASVMAKPKAELNRSRHVLLVFDMPPSEGL

SEQ ID NO: 3428 - protein, 310 aa, Methylobacillus flagellatus KT
MPRALEHQHHTGFFVRGPSPIARLLFFSVLSLALIVTDARLNYLIEVRQGFIALLHPLQIIANAPLSLVEDVGAYLHTQTTLAEENTRLRHQALMHAEELQRFQALMAENERLRSLLGAAQVSSQPARLAEILHMGRDPFSHKVVVNLGSRQNIVPGQAAIDEHGVIGQVTRVYPFSSEVTLITDKELSIPVQIERNGLRAIAFGQGRNATLELPSLPANVDIQVGDKLVTSGIDGIYPPGLAVAEIIRVEADGDSPFAHIIGKPIAGIDRHRQLLLVSIPQVERPADSSAVKTNSATQKTTPTKRHVRN

SEQ ID NO: 3429 - protein, 294 aa, Shewanella denitrificans OS217
MKPIFVRGISNQSRLTLAIFLSVALIVANDKLEAPRQSLSSILSPLQYLANLPGLLMDWSSDTLATRDMLQTQNGELQRQQLLMSERLQRFEHLRQENERLRALLGSPVQLAVKKVVAEVMEVASDPFRHYVVLNRGAQDQVYVGQPVVDALGVIGQVIEVSALTSRVLMVSDPTHGIPVRVTRNDVRAVANGTGEIDQIELRHVAKSADIIAGDLLVSSGLGNRFPEGYPVARVMKVSRDEGQNYAVITAQPLAALDRIRYVLLIWPEDLIENETLLEDEQAFSGKDVETSHE

SEQ ID NO: 3430 - protein, 317 aa, Chromohalobacter salexigens DSM 3043
MSSRTLSAEGRPIKPLFSHGPVPSYRMLLCAVLAFTLMFAEHRLSFMEDVRAQLTTVVAPVQWAVSLPSEGLAWAALVFSDQRALVEENQRLRQQLLTLSHRVQRMANLTAENVRLRELLNAAPREDVPYITAELLSLDSDPFTQQMVIGRGRRDGVYVGQPVMDASGLIGQVVAVSAYTSRVLMIADANHAVPVQINRTGRRFIVQGTGKLDTLSVLNVPATADIREGDLLTTSGLGGRFPEGYPVAEVTRVQRDGQHSFADVEARPLAQPERSRHFLLLFPPPSSAAVNSEVDLEAALRLMEGVSGGAGAQEATP

SEQ ID NO: 3431 - protein, 286 aa, Psychrobacter cryohalolentis K5
MTPSIFARQPLALRMTAVLLIVALILMWFDSKNPEWFKPMRSTSHAAMQPIYELSLLPSYAQHWSSGSLQSKETLRRENMQLRSQLIHAQAKLQQQDYILAQNARLQGILSTTRPEQFDLNLAQVIGTDTNLLRQIVVLNKGEQDGVQVGQTVIDENGILGQIINVYPNTSRLLLITDEQQSVAVTVKRTGQRAIVTGQGIPTSLSLEYVFKTSDVRVGDELVSSGLGGRIPAGYRVGRIAHIEDTQADNFRSIDVTPAANFVDNAYVLILQDKLANKNNIGINES

SEQ ID NO: 3432 - protein, 336 aa, Cupriavidus metallidurans CH34 uid250
MDYSPPPLFKQGTSAVARLVIFVTIALVLLIVDARFDAMRNVRQVAATVLMPVERLVLVPRDAIRGVFDYAQSSVELANENRELRRAALEQANASVRQAQLESENNQLRKLLNLTQQSTTPVTPAEILYDARDPYSQRIVIDRGSMQGLRAGYPVIDERGVIGQVTRVSPFQSEVTLLTDKDQAIPVQVVRNGLRSVAFGGSRAGLLDLRFMAASADLQQGDLLVTSGLDGTYPPGLPVAKIVQIERKADTAFSRVYCEPVAGVRSHRQLLVVRYESGLAPRPPEAATSQKAERGSRSAAARAGAEQKADKAATSADKPADTPTAAPAQKPSEPAR

SEQ ID NO: 3433 - protein, 288 aa, Baumannia cicadellinicola Homalodisca coagulata
MNWNRIVLFKYRSVIKPIRGNSMSLRLYLAMIVAIILIIVDNRLDSFTTIRMYMDTVLSPIYLFTNSTVQKLDNLSTIFTTNAKLKQENRALRQELILQKSKQLLLMHYKQENTTLRKLLIAPLHHDEHTILTKVISLQIDPYINQIVIDKGWNNGIYIGQPVISDQGIVGQVIATSKYTSRILLICDTSHAIPIQVLRNNIRGILIGKGCNADLQIEYLPQDLEKIDIHVGDLLVTSGLGGRFPEGYPVAVVSSVKLDLPRTHMLIKAKPIATLQHLHYLLLLWKNK

SEQ ID NO: 3434 - protein, 286 aa, Pseudoalteromonas atlantica T6c
MNSIFLRGPSLHIKLVFALALSAGLIVFDHVFDGFATTRVYLNSVVSPIQYLANLPSEMLNASASRLVSHQQLLEENAELQHDAVVLNGKLQRFVLLQEENDRLRRLLNTPVRGDIRKEVAELMAVDNNPYSHQIVIDRGAIQGVYEGQPVIDDKGIVGQIMQVGSTNSRVLLISDVTHAIPVRVARNNIRMIASGSGSLNELIIQHVPHSADIEEGDLLLSSGLGNVFPEGYPVARITSIVRDEGRPFAQVNAEPVALLDRLKYLLLLWPNNLVGPEQSVPDAEQ

SEQ ID NO: 3435 - protein, 285 aa, Rhodospirillum rubrum ATCC 11170
MKQPTGQTARLTALRVFVQKSAFVALAGLAFAFMLLGKADTVLVERVRATVIDAAAPVLDFMSTPAENVAAIFANLRQLTSIRAENDRLATENDRLMRWQAAARHLEAENEALRGLLTYVPEPKASYVTARVVADTGGTFARSLVVLAGTIHGVNKGQAVISGEGLAGTVAEAGQRSSRVLLLTDINSRIPVLLEDSRVRAILAGDNQDRPQLRFLRDRIAVQPGDRVVTSGDARIFPPGIPIGVVASVDEKKGIRVDLFVEQDRLEVVRIANFGIPNPLSEGAD

SEQ ID NO: 3436 - protein, 351 aa, Haemophilus somnus 129PT
MKPIFSKSPPLGIRLILAVVVSITLILFDGKTSAMINLRGFMETAVGSLYYLANTPRVILDGVSENLIDTNKLQIENKVLREQLREKNADLLLLDHLKVENQRLRLLLNSPLRTDEYKKIGEILTAETDVYRQQVIINQGAKDGAYVGQPVIDEKGVVGQIISVGENTSRVLLLTDVMHSLPVQVLRNDVRVIASGTGRSDELTLENVPRSVDIIKGDLLVTSGLGGRFLEGYPVAIVENISRDSKNYFATITAKPLASIERLRYILLLWPTHEDMRKAQSLTPEDVRKAVQQRLEMQHNSSLYKVKKTPVQEEFFPSNNNTDEYSVDILETLPENLPEQEFLQKEQGDEN

SEQ ID NO: 3437 - protein, 353 aa, Shewanella sp. MR-7
MKPIFVRGISNQFRLTLAIILSVILLAANHRLEPARESLSSALSPIQYLASVPSAILDWSSESFATRNMLALQNKELLRQQLLMSERLQRFEHLRQENERLRALLGSPAYQDSRKMVAEVMEVASDPSHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVMEVLTEDGQSYARVTAQPLAALDRIRYLLLIWPSPDSGVTLPNQLPVPAADRPAEEAKPDAGTGSANPQGAAANASAPSSAAPNATAPNTTVPNTGATPSNTNGAPNAATTQPPAEVH

SEQ ID NO: 3438 - protein, 353 aa, Shewanella sp. MR-4
MKPIFVRGISNQFRLTLAIILSVILLAANHRLEPARESLSSALSPIQYLASVPSAILDWSSESFATRNMLALQNKELLRQQLLMSERLQRFEHLRQENERLRALLGSPAYQDSRKMVAEVMEVASDPSHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVMEVLTEDGQSYARVTAQPLAALDRIRYLLLIWPSPDSGVTLPNQLPVPAADHPAEEAKPDAGTGSTNPQGAAANASAPSNAAPNTTAPNTTVPNTGATPSNANGASNAAITQPPAEVH

SEQ ID NO: 3439 - protein, 310 aa, Alkalilimnicola ehrlichei MLHE-1
MRLVLLALVSVLLMTLDHRQQLADPVRQGLAAVVWPVQQAVSLPIEASQRLGEHLASRQQLVDENRELRRRYLLDQARLQRLQALEMENQRLRDLLGSSGQLGETVLIAELTRVDLDPYSHLIQVDKGSVHQVTVGQAVLDAEGVMGQVDRVGTHGAMVRLITDPSHAIPVEVNRNGLRTIALGTGDLNRLELGSVPINADIQSGDLLVTSGLGGVFPRGYPVAEVERVVLDPGEPFARVSARPLAALDRSRKMVLVQGGALGRMPDLPAVEAPAVPSASEPAPAPGAVPPEEAPDAASPPAAVPGEEAQ

SEQ ID NO: 3440 - protein, 320 aa, Shewanella frigidimarina NCIMB 400
MKPIFVRGVSSQFRLTLAIILSVALLMTNNRLDPIRQSLSSVLSPLQYLANVPGVMLDWSAEAFATRNMLELQNKELLRQQLVMSERLQRFEHVRQENERLRALLGSPVHMDSRKMVAEVMEVASDPFRQFVVLNHGSQTGIYVGQPVVDAQGVVGQVVEVSEFTSRVLMVSDTTHGIPVRVTRNDVRAIANGMGDIDQIELRHVAKSTDIIVGDLLVTSGLGNRFPEGYPVARVISVSRDDGQSYAVIYAQPLAALDRIRYVLLIWPDETKPFTLPNDVQELIKEAADKAAATANSSEPQPQPQPVETTTTPVTSEVNQ

SEQ ID NO: 3441 - protein, 330 aa, Pseudomonas aeruginosa UCBPP-PA14
MLAVLSVSLMVVDARFDYLEPVRSKLGMVLTPFYGLAEMPVRAWEGVRDQFSSRSELIAENERLKAESLLMQRRVQKLAALTEQNVRLRELLNSAALVDDKVLVSELIGVDPNPFTQRIMIDKGENDGVFVGQPVLDASGLMGQVVEVMPYTARVLLLTDTTHSIPVQVNRNGLRAIAVGTGNPERLELRYVADTADIKEGDLLVSSGLGQRFPAGYPVATVKEVIHDSGQPFAVVRAVPTAKMNRSRYVLLVFSDSRTPEQRANDAAEAQEEADKKAAAGAQAPQPAAQPAAAPSPATPAAQGAAQQPAAAPAPAPTQPAAPAANGGRR

SEQ ID NO: 3442 - protein, 307 aa, Magnetococcus MC-1
MLPLWSLIRLHRQRLTAATFLLLAVFLLFVLRADSPGVLAFKGVLANLLGGMQRLVLSPVEATRAAGQRLQELGHLDEENLRLKRLLANVGPMQLQLDEALKENRRLRQILRMSVDPHYTYTVARVVGDSSSAFSRVLLVNAGAQEKVRPDTPAVSPAGVVGRVVAVGTRRSTVLTLHDINSRVPVQVQRSRLRAMVAGTNSSTLELRFVVKGGDILVGDLLITSGTGGVFPKGVGVARVTSLNPNADGLFMQATARALVDLDRLEELRLMLPVVDAEPLSEGEEATITDRTDLRPLGLLPEGTNTP

SEQ ID NO: 3443 - protein, 353 aa, Shewanella sp. ANA-3
MKPIFVRGISNQFRLTLAIILSVILLAANHRLDPARESLSSALSPIQYLASVPSAILDWSSESFATRNMLALQNKELLRQQLLMSERLQRFEHLRQENERLRALLGSPAYQDSRKMVAEVMEVASDPSHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVMEVLTEDGQSYARVTAQPLAALDRIRYLLLIWPSPDSGVTLPNQIPVPAADHPAEEAKPDAGNGNANPQGAAANATVPSNAVPNSTVPNTTAPNAAAAPSNANGASNAATTQPPAEVH

SEQ ID NO: 3444 - protein, 309 aa, Shewanella amazonensis SB2B
MKPIFVRGVSNQFRLTLAIILSVLLIVANDRLTPVRQSMATLLSPLQYLANVPGDMLDGFAEMLATRTMLERQNAEMLRQQLMMSERLQRFEHLRQENERLRTLLGSPLHMDARKMVAEVMEVASDPFHQQIVINRGTQNGVYVGQPVLDAQGIVGQVVEVSAITARVLLMSDTSHAIPVRITRNDVRMIVNGTSELDEVELRHVAKSTDVKVGDLLVTSGLGRRFPEGYPVARVTVVERDDAQSYAKVMAQPLAALDRIRYLLLIWPDAGNNPVNTEAVEGTTVDDVNAPAQNEPATEAVPTAAEEAQ

SEQ ID NO: 3445 - protein, 326 aa, Psychromonas ingrahamii 37
MKTIFTRGPSFLLRLSIVVVFSVFLFVADSNFNLFASSRIYLNSLVSPVQYVADLPEKLFSAISASVMTRHELKARNQQLEKDNLHLKADRLLLTQLENENKQLRELLSSNRTFTNKRMITEVMSLRSDPFSHQLLIDKGAVNGVYVGQPVINEDGVVGQVSQVGSTTSRVLLIVDVSHGIPVRVQRNDLIAVLHGSGDWNRLNVPFVQSNADLKEGDLLVTSGLGGRFPAGYPVATISHVNYQEGAAYADVSATPVAPLHRSRYLLLLWNEDQYNESDLSKDRLTTSAALATENADNSKTSPDSLNTLETDKKIEPLESKNVIVQ

SEQ ID NO: 3446 - protein, 306 aa, Acidovorax avenae citrulli AAC00-1
MPIGTLERTAPSFFKQGPSPRARFALCGALALFLMVADARFHVTEPLRKAIAVALYPVQWVMLQPVEFVGGGIAYLRTMESAQAEVDTARRNMVAMAQRANQAEQLLQENERLRKLLQLRDRLQTPAKAAQVIYDAADPYTRRVMIDQGQMAGIVLGSPVMDESGMLGQVTRVHPLLSEVTLLIDRDQAIPVMNLRTGARGVAYGDPVIAHGGGMELRFMPSNADVQEGDLLTTSGVDGLYPPGLPVARIVRVERRADSAFARIYCAPLAQAQGARHVMVLQPLDAGLPERPPATEPAPARKGGRR

SEQ ID NO: 3447 - protein, 305 aa, Acidovorax sp. JS42
MPLGTLDRSAPTLFKQGPSPLSRLTLYSALALFLMVADARFHLTEPLRKAVSTALYPLQWLMLQPVEFADKGAGYFQSLQAAQQGMDDAQRTMAQMAVRAGEADQLLRENAELRQLLALRERLTTEATAAQVIYDTADPYTRRVMVDRGQLAGVEPGSPVMDASGVLGQVTRVFPMLSEVTLLIDRDQAIPVLNLRTGARSVAYGDPVAGHGGGMELRFTPGNADVQEGDLLTTSGVDGLYPAGLPVARVLRVERRADSAFARIYCAPVAQMYGARHVMVLKPVVADLPPRPEPEPAAPKRGGRK

SEQ ID NO: 3448 - protein, 311 aa, Verminephrobacter eiseniae EF01-2
MPQGTLERGAPPLFKQGPSALSRLALFSALALFLMVADARFGLTEPLRQAVAAALYPLQWLMFKPMEFASQGSAYFRSLQTAQQALDAERRKMALLGQSAQQAAQLALENRRLRQLLALRARLQIPALAAEVLHDTADLHTRRVVIDRGRIDGVQTGAAVIDQAGVLGQVTRVFALDSEVTLLIDRDQAIPVLNIRTGVRGVAYGDPYGDPVTRRGAGMELRFMPANADVREDDLLTTSGVDGLYPPGLPVARVVRVERGADSAFARIYCLPLAQVQGSGHVLVLQRLTDQRLSQPAPERPESADKPGARR

SEQ ID NO: 3449 - protein, 281 aa, Halorhodospira halophila SL1
MRLVLLATVSILLMSLDHREHLVEPVRETVSGVVYPLRFVVDAPFSIAERVSERLATRHQIMEENRQLRDRHLEYQERLQRMHSLERENERLRDLLGSSERLETEVAIAQLMRVELDPHTHLVEIDRGSRQGVFVGQPVLDANGVMGQVDRVGAHSASVRLISDPSHAIPVENNRNGLRTVALGSGDPQRLELANVPGNADLREGDLLTASGLGGAFPRGYPVAEVTSVEVEAGEPFARVTARPAAELDRSRKLLLVSVAENADDQAGDDEAADNESEDAS

SEQ ID NO: 3450 - protein, 243 aa, Marinobacter aquaeolei VT8
MYWLGNAPYSFADWFSGLFVSRDDLQQENEELKTRLLILERRALKYAALASENNELRRLLNSSEVLDDRVIVGEVVGVSPDPFSHEIIINKGESDGVTTGQAVLDAEGLMGQVIQTSQFTSRVLLVSDSSHAVPVEVVRNGLRSILLGNGETDELDLVHVPDTADIREGDMLVSSGLGGRFPRGYPVAEVSSIVKEPGEPFVTIQAAPKARLNQSRLVLIVFQPEERSVPENGQAAPDNEEAN

SEQ ID NO: 3451 - protein, 338 aa, Shewanella baltica OS155
MKPIFVRGISNQFRLTLAIILSVALLVANHRLDPVRQNLSSVFSPLQYLASVPGAALDWSSESFATRNMLALQNKELLRQQLLMSERLQRFEHLRQENERLRALLGSPAYLDSRKMVAEVLEVASDPFHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVMEVLTEDGQSYARVTAQPLAALDRIRYVLLIWPSPDSGVTLPNQPTVPAADHSLIENSSKIGSASPAEGTSADATKPVTAPAATATVAKPATETTPPATEVHQ

SEQ ID NO: 3452 - protein, 293 aa, Shewanella loihica PV-4
MKPIFARGISNQFRLTLAIVLSVILLVANDRLEPVRQSISSVLSPLQYVANIPGAILDWSAESIATRNMLAKQNKQLLRQQLLMSERLQRFEHLRQENDRLRALLGSPVHMDSKKMVAEVMEVASDPFRHYVVLNHGARSGVFVGQPVVDAHGVVGQVVEISELTSRVLLISDVTHAIPVRVTRNDVRLVAQGIGELDELELRHVAKSTDLRVGDLLVSSGLGKRFPEGYPVARIMTVERDDGQSYATVTAQPLAALDRIRYLLLIWPDGNQSEQAEPIEAGADAQPQAEETP

SEQ ID NO: 3453 - protein, 311 aa, Polynucleobacter necessarius asymbioticus QLW P1DMWA 1
MQHSAPPLFRQGIPALLKLIVCLSISIALMLIDFRFKALDPIRNNVNWILRPLEYVMMAPRNAFEASSDYFTTRSTLDQENQVMKARQAELSLLANQSEFLMVENQNLRELMALQKQVPFKTLPVEILFNPPNPISQRIVINRGSNDGLKLGNPIANDSGILGQVVRLYERSAEVSLLEDRDFAVPVQVARNGLRAAVFGAGRGNPLELRYLPVASDLEVGDILLTSGIDGVYPPGFAVAVISKIERNADKNSSNVFCVPVAAVNRYRQALALLYDPQFDAKAASNNTKSATGAPLTNNPGRRQTRARGMQ

SEQ ID NO: 3454 - protein, 338 aa, Enterobacter sp. 638
MKPIFSRGPSLQFRLILGVLVALGVIIADSRLGMFSQIRTYMDTAVSPFYFVSNGPRELLDSVSQTLSSRDQLELENRALRQELLLKNSELLMLGQYRQENARLRELLGSPLRQDEQKMVTQVISTVNDPYSDQVVIDKGSVNGVYEGQPVISDKGVVGQVVAVAKLTSRVLLICDATHALPIQVLRNDIRIIAAGNGCTDDLQLEHLPANTDIRVGDVLVTSGLGGRFPEGYPVAVVSSVKLDTQRAYTVIQARPTAGLQRLRYLLLLWGADRNGTNPMTPEDVHRVANERLMQMMPQVLPAPDSMGPPAPVPAPATGLTQPTSDAPPPPQLSSGGQ

SEQ ID NO: 3455 - protein, 328 aa, Pseudomonas mendocina ymp
MAHKEQVIKPLFAKGPSLGIRLLVFAVLSAVLMVVDARFEALKPLRSQMGLVLTPFYWLADLPVRAWDGATQQISSRSELMAENEKLKAEALLLQRRLQKLAALTEQNVRLRELLNSAALVDEEVLVGELIGVDPNPYTHRILIDKGEKDGVFLGQPVLDARGLMGQVVEIMPYTSRVLLLTDNTHSIPVQVNRNGLRAIAVGTGNPERLELRHVADTADIKEGDLLVSSGMGQRFPAGYPVATVKEVIHDSGQPFAIVRAVPTAALNRSRYLLLVFSDQRTPEQRANDSAEAQEAADREAERAREQGEQKPAEGDAPVTPAAAQETN

SEQ ID NO: 3456 - protein, 334 aa, Shewanella putrefaciens CN-32
MKPIFVRGISNQFRLTLAIILSVILLVANHRLEPARQSLSSVLSPVQYLASFPGALLDWSSESFATRNMLALQNKELLRQQLLMSERLQRFEHLRQENERLRALLGSPAYQDSRKMVAEVLEVASDPSHHYVVLNHGARSGVFVGQPVVDAQGVVGQVVQISEMTSRVLLLSDVSHGLPVRITRNDVRLIANGTGENDEIELRHVAKSIDVRVGDLLVTSGLGNRFPEGYPVARVMEVLTEDGQSYARVTAQPLAALDRIRYLLLIWPSSDSGVTLPHQMPVPAADQPEEAKPDPNTINSAPNTQGSANTPQGAATNANATTGAVTTPPPAEVH

SEQ ID NO: 3457 - protein, 296 aa, Vibrio cholerae O395
MKPIFGRGPSLQLRLFFAVMLSASLMLADSRLGAFSHVRFLLNSLVAPIQYAADLPRVLFDDFYDSISSHQQLRENNQLLKREVLTLKSNLLLLEQYKEENQRLRKLLGSSFLRDEKKVVTEVMAVDTSPYRHQVVIDKGRVDGVYEGQPIINEKGIVGQVTFVAAHNSRVLLLIDPNTAIPVQNIRNDIRVIASGNGQTDQIQLEHIPTSTDIEVGDMLVTSGLGGVYPEGYPVAIVSQVDKDTRREFASIKADPVVEFDRLRYLLLIWPNEDRLQKVMQADPQVLLEEEANAQQ

SEQ ID NO: 3458 - protein, 330 aa, Pseudomonas putida F1
MSVALMVVDARFDVLKPVRSQMGLVLMESYWITDLPQRAWQGVAGQFGSRTELIAENEKLKTEALLLQGRLQKLAALTEQNVRLRELLNSSALVNEKVEVAELIGVDPNPFTHRILINKGERDGVFLGQPVLDARGLMGQVVELMPYTARVLLLTDTTHSIPVQVNRNGLRAIASGTGNPERLELRHVADTADIKEGDLLVSSGMGQRFPAGYPVATVNEVIHDSGQPFAIVRAIPTAALNRSRYMLLVFSDRRSPEQRATDAAIAQEEADRKGAAPAGQPAATRDQVAPAAGTPAASVTPAAPATPVAQPAAPSAAPATPAAPAQPRRQ

SEQ ID NO: 3459 - protein, 306 aa, Psychrobacter PRwf-1
MPTSIFAQYSLSLRKTAAVLLVAMILMLLDSKNPDWFTPIRDTSHSAMQPIYQMSVLPSFVSHWADGTLMSKEALRRENVQLHAQLLHAQAKLQQQDYVLAQNARLQGILSTTKPDQYDLNLAQVIGTDTNPLKQIVVLNKGSNDGVEVGQTAIDENGILGQIINVYPNTSRLLLITDELQSVSVTVRRTGQRAIVSGEGTPSSLKLDYIFKTSDIRVGDELISSGLGGRFPAGYRVGRIEYINPEQNDNFMNIEVTPAADFVNSSYVLIMQDSKHSPRYSDDSFTGSLELTQAPYVPPSRPIDEP

SEQ ID NO: 3460 - protein, 329 aa, Pseudomonas aeruginosa PA7
MVLAVLSVSLMVVDARFDYLEPVRSKLGMVLTPFYGLAEMPVRAWEGVRDQFSSRSELIAENERLKAESLLMQRRVQKLAALTEQNVRLRELLNSAALVDDKVLVSELIGVDPNPFTQRIMIDKGENDGVFVGQPVLDASGLMGQVVEVMPYTARVLLLTDTTHSIPVQVNRNGLRAIAVGTGNPERLELRYVADTADIKEGDLLVSSGLGQRFPAGYPVATVKEVIHDSGQPFAVVRAVPTAKMNRSRYVLLVFSDSRTPEQRANDAAEAQEEADKKAAAGAQAAPPAAAPAPAPASPAPQGGATPAAGAPAAPAQPAAPTAPAGGRR

SEQ ID NO: 3461 - protein, 267 aa, Marinomonas MWYL1
MSSTRFVVLVILSMAMIIADVRYSVFSQARPYLTLLVTPIQVVVNTPQKMLNWAGEHLASREGLVKENQSLQAEILLLRSRQQRLDSLQAENVRLRELLDASQRVDEKIVMAEVIGFDQNAYSHKLMIDKGFSSGAYVGQPVLDATGVLGQVVETAAYSSRVLLIADASHFVPVQLTRTGFRGILRGTGNLKRLELMSVPRSVDIKKGDILTTSGLDKRFPSGYPVGVVRSVKYTQGKAYADVDVVPLAQLGRSRHVMLIEKPKAGR

SEQ ID NO: 3462 - protein, 336 aa, Shewanella baltica OS185
MKPIFVRGISNQFRLTLAIILSVALLVANHRLDPVRQNLSSVFSPLQYLASVPGAALDWSSESFATRNMLALQNKELLRQQLLMSERLQRFEHLRQENERLRALLGSPAYLDSRKMVAEVLEVASDPFHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVMEVLTEDGQSYARVTAQPLAALDRIRYVLLIWPSPDSGVTLPNQPTVPAADHSLIENSSKIGSASPAEGTSADTTKPVTTPAATVAKPATETTPPATEVHQ

SEQ ID NO: 3463 - protein, 331 aa, Yersinia pseudotuberculosis IP 31758
MKPIFSRGPSLQLRLFFAIIAAIVLVIADSRLGTFVKIRTYMDTAVSPFYFLANGPRKILDNVSDTLATREQLELENRALRQELLLKNTDLQLLGQFKQENNRLRELLGSPLRQDEQKMVTQVMSSGTDPYSDHVVIDKGSNSGVYEGQPVISDRGVVGQVVAVSKFTSRVLLICDASHALPIQVLRNDIRVIAAGSGCSDDLLLEHLPSNTDIRVGDVLVTSGLGGRFPEGYPVAVVSSVKVDNQRAYTVIQARPTADLQRLRYLLLLWGADRNGDMPMPPDEVRRVANERLAPMMSQVLPSADAMGPPAPAASTPAGATPGVVTPGVSP

SEQ ID NO: 3464 - protein, 296 aa, Vibrio harveyi ATCC BAA-1116
MKPIFGRGPSLQLRLFFAVIVSASLMLADNRLDTFSNVRYLLNSMVAPIQYAANMPRSMFDGMFERLNTRQALIEGNRNLKREVLRLKSELILLDQYKEENQRLRKLLGSSFVRDEKKVVTEVMAVDTSPYRHQVVIDKGRIDGVYVGQPVINEKGIVGQVTFVAAHNARVLLLTDAKNAIPVQVIRNDIRVIASGNGEVDEIQLEHIPTSTDIQVGDLLVTSGLGGIYPEGYPVATVTNVDHDTRQEFASIKAEPVVEFDRLRYLLLIWPNEDRQHKVLQSNVEEGSEQEVTDGQ

SEQ ID NO: 3465 - protein, 367 aa, Escherichia coli HS; identical to SEQ ID NO: 3415

SEQ ID NO: 3466 - protein, 367 aa, Escherichia coli E24377A
MKPIFSRGPSLQIRLILAVLVALGIIIADSRLGTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPTTGNAATAPAAPTQPAANRSPQRATPPQSGAQPPARAPGGQ

SEQ ID NO: 3467 - protein, 298 aa, Shewanella sediminis HAW-EB3
MKPIFARGISNQFRLTLAIILSVILIVANNRLDPVRKSVSSVLSPLQYVANVPGALLDWSAESLATRNMLTKQNKELLRQQLLMSERLQRFEHLRQENDRLRALLGSPVHMDSKKVVAEVMEVASDPYHQYVVLNHGAMSGVFVGQPVVDAQGVVGQVVQVNELTSRVLLISDATHGIPVRVTRNDVRLVVKGTGVLDELELSYVSKSTDIRVGDLLVSSGLGNRFPEGYPVARVMSVVKDDGQSYANVIAQPLAALDRIRYLLLIWPDEQDESLSKDELLNIENTSESTKQTAEVSQ

SEQ ID NO: 3468 - protein, 334 aa, Serratia proteamaculans 568
MKPIFSRGPSLQLRLFLAVIVAICLIVADSRLGTFVKIRNYMDTAVSPFYFLANGPRKVLDSVSETLATRQQLELENRALRQELLLKNSDILLLGQFKQENARLRELLGSPLRQDEHKMVTQVISTGSDPYSDQVVIDKGSDNGVYEGQPVISDKGVVGQVVAVAKVTSRVLLICDASHALPIQVLRNDIRVIAAGSGCADDLQLEHLPNNTDIRVGDVLVTSGLGGRFPEGYPVAVVSSVKVDNQRAYTVIQARPTAGLQRLRYLLLLWGADRNGDMPLPPDEVHRVANERLMQMMPQVLPPADAMGPQQPLPAPVTGVAVPQTAAPAAGVTQ

SEQ ID NO: 3469 - protein, 295 aa, Shewanella pealeana ATCC 700345
MKPIFARGISNQFRLTLAVIMSVILLVANDRLEPVRNSLSSLLSPLQYVANIPGALLDLSAESLATRNMLAKQNKELLRHQLLMSERLQRFEHLRQENDRLRGLLGSPVHMDAKKVVAEVMEVASDPFRQYVVLNHGSRNGVFVGQPVVDAQGVVGQVVQVSELTSRVLLLSDTTHGIPVRITRNDVRLMAFGTGVLDELELRHVAKSTDVRVGDLLVSSGLGKRFPEGYPVARVMSVEKDDGKNYATVIAQPLAALDRIRYLLLLWPDIESDGKDLTPPEEIEEVLKASQESTQ

SEQ ID NO: 3470 - protein, 336 aa, Shewanella baltica OS195; identical to SEQ ID NO: 3462

SEQ ID NO: 3471 - protein, 292 aa, Coxiella burnetii RSA 331
MNKLIFKRSSMPGLRTLIYMGLAIALIVLDQKALFFQKIRADLALVVLPLQYLVSVPIKTIHWIAINVTTQQELVADNARLRAHELLLESKLQKLLALERENAQLWTLLKSTAHVGGARVAVAQLLAVNLDPNLQQIIVDKGMRNHIYVGQPVLDAYGVVGQVIHAGLLTSKVMLISDPKSAVPVQDYRNGIRALALGMGSSGKLLLINVPDTSDIQKGDLFVSSGLGLRYPVGYPVGVVTELERDPTKRFATITLQPSAHLDQSQQVLMTWPNKASLAQDVHQELNLKEKE

SEQ ID NO: 3472 - protein, 331 aa, Yersinia pestis Angola; identical to SEQ ID NO: 3463

SEQ ID NO: 3473 - protein, 325 aa, Pseudomonas putida GB 1
MSVALMVVDARFDVLKPVRSQMGLVLMESYWITDLPQRAWQGVAGQFGSRTELIAENEKLKTEALLLQGRLQKLAALTEQNVRLRELLNSSALVNEKVEVAELIGVDPNPFTHRILINKGERDGVFLGQPVLDARGLMGQVVELMPYTSRVLLLTDTTHSIPVQVNRNGLRAIASGTGNPERLELRHVADTADIKEGDLLVSSGMGQRFPAGYPVATVNEVIHDSGQPFAIVRAIPTAALNRSRYMLLVFSDRRSPEQRATDAAIAQEEADRKGNAPAGQPAATGEQAAPAVPATPAAPATPPAQSAAPAAAPVTPAAPAHTRRQ

SEQ ID NO: 3474 - protein, 367 aa, Escherichia coli C ATCC 8739
MKPIFSRGPSLQIRLILAVLVALGIIIADSRLRTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPATGNAATAPAAPTQPAANRSPQRATPPQSGAQPPARAPGGQ

SEQ ID NO: 3475 - protein, 333 aa, Pseudomonas putida W619
MVVDARFDLLKPVRSQMGLVLMESYWITDLPQRMWQGVAGQFGSRNELIAENEKLKTEALLLQGRLQKLAALTEQNVRLRELLNSSALVNEKVEVAELIGVDPNPFTHRILINKGERDGVFLGQPVLDARGLMGQVVELMPYTARVLLLTDTTHSIPVQVNRNGLRAIASGTGNPERLELRHVADTADIKEGDLLVSSGMGQRFPAGYPVATVNEVIHDSGQPFAIVRAIPTAALNRSRYMLLVFSDRRSPEQRATDAALAQEEADRKDAASPAQPGANGEPAAPVTPAPATPAPATPAVPATAVPAPPAAAPAAAPASPAAAPAAPAQPRRQ

SEQ ID NO: 3476 - protein, 331 aa, Yersinia pseudotuberculosis YPIII; identical to SEQ ID NO: 3463

SEQ ID NO: 3477 - protein, 298 aa, Shewanella woodyi ATCC 51908
MKPIFARGISNQFRLTLAIILSVILIVANNRLDPVRKSVSSVLSPLQYIANVPGALLDWSAESLATRNMLAQQNKELLRQQLLMSERLQRFEHLRQENDRLRSLLGSPVHMDAKKIVAEVMEVASDPFHQYVVLNHGARSGVFVGQPVVDAQGVVGQVVQVSELSSRVLLISDVTHAIPVRVTRNDVRVVANGTGVLDELELKYVSKSTDIRVGDLLVSSGLGNRFPEGYPVARVMSLVKDDGQNYANVIAQPLAALDRIRYLLLIWPDEPASEALEDETAMILSAAKKAAEKAEVGE

SEQ ID NO: 3478 - protein, 316 aa, Xylella fastidiosa M12
MPSYPGFSLASRSPAVVSTIRLLTYLTLAIVLVVLDSRGAWLSQLRQRANWLAQPVWALAGLPGWFGGQLSERAISNARLVNENRQLRNQLLIANARLTRLQTAARDNAQLRELLNFAEHHGLDVQLAPILDVDLDPTRQRLVLDAGSRDGVSVGQTVIDAGGLMGQVIEVTPLHSIVLLLTDPDHAVPVTVARNGVRLIVYGRGDRLELRNIPLSSGVKIGDVLITSGLGARFPAGFPVGNISALHPDDSHAFLVGEITPAAKLDRGRNVLLLRLGASMSPGGGGSLTSRSIIDSNSESHSTNLGASRVIKEPQQ

SEQ ID NO: 3479 - protein, 367 aa, Escherichia coli SMS 3 5; identical to SEQ ID NO: 3415

SEQ ID NO: 3480 - protein, 312 aa, Leptothrix cholodnii SP 6
MPLGTLDRSPPPFFRQGPSALTRLVFFASLAVFLMAADTRLGLTGPLRTAAAVALHPVERALLAPVDALSTVGAYFDGITVARQQADAAQARLTQQAERTLQVDRLLQENTRLRALLELRAGLTYRSHAAEILYDAADPYTRKVVIDRGENVGILRGSPVINDAGVLGQVTRIYPLTAEVTLLIDRDAAIPVLNTRTQLRNVAFGDPDSAGMELRYAAANTDVKVGDVLSTSGLDGVYPPGLPVARVASLERRTQTDFARIVLQPVAQADGVRHVLVLDPMSTQLPVRPEAAASAAGRDKDALSLRKSTPRR

SEQ ID NO: 3481 - protein, 281 aa, Polynucleobacter necessarius STIR1
MLIDFRFKALDPIRNNVNWVLRPLEYVMMMPRNAFKATSEYFTTRSTLDQENQVMKAHQAELSLLANQSEFLMVENQNLRELMALQKQVPFKTLPVEILFNPPNPISQRIVINRGSNDGLKLGNPIANDSGILGQVVRLYERSAEVSLLEDHDFAVPVQVARNGLRATVFGAGRGNPLELRYLPVASDLEVGDILLTSGIDGVYPPGFAVAVISKIERNVDKNSSNVFCVPVAAVNRYRQALALLYNPQFDAKAPANTKSTTGTPLTNTPGRRQTRARGMQ

SEQ ID NO: 3482 - protein, 316 aa, Xylella fastidiosa M23
MPSYPGFSLASRSPAVVSTIRLLTYLTLAIVLVVLDSRGAWLSQLRQRANWLAQPVWALAGLPGWFGGQLSERAISNARLVNENRQLRNQLLIANARLTRLQTAARDNAQLRELLNFAEHHGLDVQLAPILDVDLDPTRQRLVLDAGSRDGVSVGQTVIDAGGLMGQVIEVTPLHSIVLLLTDPDHAVPVTVARNGVRLIVYGRGDRLELRNIPLSSGVKIGDVLITSGLGGRFPAGFPVGNISALHPDDSHAFLVGEITPTAKLDRGRNVLLLRLGGSMSPGGGGSLTSRSIIDSNSESHSTNLGASRVIKEPQQ

SEQ ID NO: 3483 - protein, 361 aa, Shigella boydii CDC 3083 94
MKPIFSRGPSLQIRLILAVLVALGIIIADSRLGTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPTTGNAATAPAANRSPQRATPPQSGAQPPARAPGGQ

SEQ ID NO: 3484 - protein, 407 aa, Stenotrophomonas maltophilia R551 3
MPPYAGPPVASRSGDAASPLRLLAYLALAITLIVLDDQAGWLARLRGQANSLVQPVWALAGLPGKLGNQVKDSAASHSQLVTENRELRNQLLLANARLTRLQTAALDNAQLRELLNVAERSGLDVQLAPILDIDLDPVKQRLVLDAGSREGVHVGQAVIDVGGLMGQVISVTGSTSTVLLLTDPDHAVPVTVARNGVRLIVYGRGDKLELRDIPLSAGVEVGDEIVTSGLGGRFPAGFPVGTITGLRPDDTHAFLVGELKPAAQLDRGRDVLLLRPGAAIRIPPELRLQLEETAPGGPAAGGTVPAATAPATTTPAPAPATPAPTVGRSPAPSASPTVAPASPASSTVVPAAGRQQSPSATRNAAPASFLNPAPAARPLEQQGGSTPASAPVVPAAGRQPTTPEAQR

SEQ ID NO: 3485 - protein, 350 aa, Salmonella enterica serovar Newport SL254
MKPIFSRGPSLQIRLILAVLVALGVIIADSRLGTFSQIRTYMDTAVSPFYFISNGPRELLDSVSQTLASRDQLELENRALRQELLLKNSDLLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPPAPVPDPATGITQPSAGQAAPVSTQPSPSGATTPPARAPGG

SEQ ID NO: 3486 - protein, 350 aa, Salmonella enterica serovar Heidelberg SL476
MKPIFSRGPSLQIRLILAVLVALGVIIADSRLGTFSQIRTYMDTAVSPFYFISNGPRELLDSVSQTLASRDQLELENRALRQELLLKNSDLLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPPAPVPDPATGITQPSAGQTAPVSTQPSPSGATTPPARAPGG

SEQ ID NO: 3487 - protein, 350 aa, Salmonella enterica serovar Schwarzengrund CVM19633; identical to SEQ ID NO: 3486

SEQ ID NO: 3488 - protein, 277 aa, Alteromonas macleodii  Deep ecotype
MLSVTLIFVDHKMDGFKSTRVYLNSLMSPLQYIANLPGLMLSESAQRLTSQEQLLTENQKLNNQLLLMSEKLQQFDVIENENAQLRELLQAPVRESSRKMVAELMAVDKNPYSQQVVINKGAIDGVYPSQPVIDDKGIVGQVMEVGSTNSRVLLLADVTHAIPVRSLRNDIRFIATGSGALNELYLEHVPHSVDIQEGDTLISSGLGKVFPEGYPVATVTQVVRDESRPFARVIATPLANLDRLRHLLLLWKKTNPERDVKDETKGEMVNEEESTDA

SEQ ID NO: 3489 - protein, 350 aa, Salmonella enterica serovar Agona SL483; identical to SEQ ID NO: 3486

SEQ ID NO: 3490 - protein, 279 aa, Acidithiobacillus ferrooxidans ATCC 53993
MPALFFPRRYPPLLRVAVLMLLTVFVSVSSEKHPNMGNVSLTIAYPVQWISMQGARLWRQTDHYLQSRAALESENVRLRAELVHAQPKLLEADILRDENRQLLALLDSIPHPPGKVAVAQIIAQNLAPGSQLLVANLGTRAGVFVGQPVLAAGGVAGQVVRVSPESSEVALLSDLDSSIPVKPAGSDTPLLVDGTGNLDSLTVPFQPRNTPLKVGDKLVTSGLGGRYPAGLNVGTISAVIHNGDQPFAQIAVRPAVHLGRLGTVLMLWVNPASQPAAAP

SEQ ID NO: 3491 - protein, 350 aa, Salmonella enterica serovar Dublin CT 02021853; identical to SEQ ID NO: 3486

SEQ ID NO: 3492 - protein, 285 aa, Aliivibrio salmonicida LFI1238
MTPIFGRGPSLQLRLFIAVMVSASLMLADSRLNAFSDIRYLLNSFVSPIHYAANLPRTMFDGMYERFNSRNALMFENQKLKQDMFIQNSNLLLLEQLKQENSRLRDLLGSPFIRDEKKLVTEVMAVDSAPYTHQVMIDKGQVDGVYEGQPVISDKGIVGQINYVGAHNSRVLLLTDPNNAIPVQVVRNDIRVIASGKGNLNLMQLEHIPTNTDIEIGDLLVSSGLGGRYPEGYPVGYISSIDNNNKRPFASIELETAVEFDKLRYLLLVWPTEIEGKIKEVTNDE

SEQ ID NO: 3493 - protein, 367 aa, Escherichia coli O157 H7 EC4115
MKPIFSRGPSLQIRLILAVLVALGIIIADSRLGTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPTTGNAATAPAAPTQPAANRSLQRATPPQSGAQPPARAPGGQ

SEQ ID NO: 3494 - protein, 292 aa, Thauera sp. MZ1T
MSLVGHQPPPIFRRGPAPLARLFVFVALCLVLLVADLRFRYLEVLRNALSVVTYPLQMAASTPADVVRNASRYFGTLVDVQLENAELRRHQLGAGERLLRFEQLEQENLHLRELLQMSQRVQTKSIAADILYNAPDPFARKVILDRGTQQGVEAGLAVLDANGVIGQVTRVHPVQSEVTLLTDRNQSIPVSVVRNGVRGVLYGVGRGMLEMRHVLAEVDIQPGDRLVTSGLDGIFVPGLPVATVTRVDRDQDAFARIECEPLAAIERSVQVLVIGRAAYPPPPPPPEPAGGR

SEQ ID NO: 3495 - protein, 336 aa, Shewanella baltica OS223
MKPIFVRGISNQFRLTLAIILSVALLVANHRLDPVRQNLSSVFSPLQYLASVPGAALDWSSESFATRNMLALQNKELLRQQLLMSERLQRFEHLRQENERLRALLGSPAYLDSRKMVAEVLEVASDPFHHYVVLNHGSRSGVFVGQPVVDAQGVVGQVVQVSEMTSRVLLLSDVSHGLPVRITRNDVRLVANGTGELDEIELRHVAKSTDIRVGDLLVTSGLGNRFPEGYPVARVLEVLTEDGQSYARVTAQPLAALDRIRYVLLIWPSPDSGVTLPNQPTVPAADHSLIENSSKIGSASPAEGTSADTTKPVTTPAATVAKPATETTPPATEVHQ

SEQ ID NO: 3496 - protein, 279 aa, Acidithiobacillus ferrooxidans ATCC 23270; identical to SEQ ID NO: 3490

SEQ ID NO: 3497 - protein, 286 aa, Thioalkalivibrio HL EbGR7
MRLALLALFSIGLMWADHRHQHLQEFRSAVAMLVYPVQAGVNLPVQAGAWVLEQLRSHQTLVEDNRRLREEQLHLNALMLRFEALEEENARLRELLDTSVRLRDPLMAAEIMAVDLDPFRQQLVINRGRVHGAYPGQPLINAQGVVGQVLESHPLHSIVLLISDPSHALPVLVNRTGLRTLAVGTGNPQLLELRYIPPAEDLEPGDIISTSGLGGRFPADYPVAQVTRVERIPGESFARVEARPLARLDRSREVLLLRPVNGNATERPAEIGAEAPAAESAPEDRP

SEQ ID NO: 3498 - protein, 305 aa, Diaphorobacter TPSY uid29975
MPLGTLDRSAPTLFKQGPSPLSRLTLYSALALFLMVADARFHLTEPLRKAVSTALYPLQWLMLQPVEFADKGAGYFQSLQAAQQGMDDAQRTMAQMSVRAGEAEQLLRENAELRQLLALRERLTTEATAAQVIYDTADPYTRRVMVDRGQLAGVEPGSPVMDASGVLGQVTRVFPMLSEVTLLIDRDQAIPVLNLRTGARSVAYGDPVAGHGGGMELRFTPGNADVQEGDLLTTSGVDGLYPAGLPVARVLRVERRADSAFARIYCAPVAQMYGARHVMVLKPVVADLPPRPEPAPAAPKRGGRK

SEQ ID NO: 3499 - protein, 318 aa, Azotobacter vinelandii DJ
MRLLVLVVLAATLMVVDARFDTLKPVRSQLGLVLTPFYWLADLPVRIWDGVNQQFSSRSELLAENEKLKAEALLMQRRLQKLAALTEQNVRLRELLNSAALVDEKVLVGELIGVDPNPFTHRILIDKGERDGVFLGQPVLDARGLMGQVVEVMPYSARVLLLTDTTHSIPVQVNRNGLRAIAVGTGNPERLELRHVADTADVKEGDLLVSSGMGQRFPAGYPVAVVSEVIHDSGQPFAIVRAVPTAALNRTRYMLMVFSDPRSPEQRASEAAQAQEAHDRQLAEQAKKQDAKPSAEAAPAPAPAQPARPAPASAGGAR

SEQ ID NO: 3500 - protein, 414 aa, Dickeya dadantii Ech703
MKPIFSRGPSLQLRLFFTVIIAIVMIFADSRLGTFVKIRTYMDTAVSPFYFLANGPRQILDNVSATLTSREQLVRENAALRQELLLKNSDLQLLGQFRQENVRLRELLGSPLRQEEQKMVTQVLSSGTDPYSDQVVIDKGASEGVYEGQPVISDKGVVGQVIAVGQFTSRVLLICDVSHALPIQVLRNDIRVIAAGNGCTEDLQLEHLPNNTDIRVGDVLVTSGLGGRFPEGYPVAVVSSVKVDTQRAYTVIRARPTAELQRLRYLLLMWGVDKNSRVALPTDDVHKVANERLMQMMPHVLPSPDMGPPAPSGTPAQAPDFVGPPAPPARSAPAVQERRSRSSQNPTTSSQNTPAQESSARAATAPGTPAQNASGRTMSTQNAPTQNTPTQNTPSERRQPSAASPGASSSGGNR

SEQ ID NO: 3501 - protein, 383 aa, Dickeya zeae Ech1591
MKPIFSRGPSLQLRLFLAVITAIVIIFADSRLGTFVKIRTYMDTAVSPFYFLANGPRAMLDNLSANLTSREQLERENTALRQELLLKNSDLLLLGQFRQENARLRELLGSPLRQEEQKMVTQVLSSGSDPYSDQVVIDKGNVNGVYEGQPVISDKGVVGQVVAVGQFTSRVLLICDASHALPIQVLRNDIRVIAAGNGCTEDLQLEHLPNNTDIRVGDVLVTSGLGGRFPEGYPVAVVSSVKVDTQRAYTVIQARPTAELQRLRYLLLMWGVDSNSRTALPQDEVHRVANERLMQMMPHVLPSPEEMGPPAPASANTSSPDFVGPPAPPAKAAPAKATPPKTNGAAQSKPANTATPRNTTSPAVNQTAPSPQGTSPAAPGGSR

SEQ ID NO: 3502 - protein, 327 aa, Pectobacterium carotovorum PC1
MKPLFSRGPSLQLRLFLAVVTAIVVIVADSRLGSFVKIRTYMDTAVSPFYFLANGPRQVLDNMSASLATREQLGLENTALRQELLMKNSDLLMLGQLKQENARLRELLGSPLRQDEQKMVTQVMSAGTDPYSDQVVIDKGQTNGVYEGQPVISDKGVVGQVVAVGQFTSRVLLICDVSHALPIQVLRNDIRVIAAGNGCADDLQLEHLPNNTDIRVGDVLVTSGLGGRFPEGYPVAVVSSVKADTQRAYTIIQARPTAGLQRLRYLLLLWGVENNSNTSLPPAEVHRVANERLMQMMPQVLPSPDDMGPPLPPDTAAPTVEPQRGRQ

SEQ ID NO: 3503 - protein, 298 aa, Nitrobacter winogradskyi Nb-255
MSSGLTGSVLTGDAIPACVRKRFQNNGSGLASSWRRYVAAGHRIQSLSSTAPSYYLFAMPTLIAGLFTFLFLYLLLQLLRAANPAVLARAIRLAGGIIAFGMAAFIGSRGELAVALPLALLGVGLLGWSSSGMSFFARLFGAGMQRTAHGHTSQVRSRFLEMVLDHASGRLGGWIIDGPDAGRSLDDFDLPRLLAMMTGFDAESCALLEAYLDRRFPAWRHNAQGDPAGGRSRASPGGKMTDEEAYQILGLQPGAGNDEIRRAHRGLMKKLHPDQGGSTYLAARVNAAKDTLLRTHRS

SEQ ID NO: 3504 - protein, 252 aa, Nitrosococcus oceani ATCC 19707
MRPIVLLALLGLIGAILLRRWIANTPRPVAIRAMRRIGIALIVGIFLLLTATGRLPWIMALLGALAAGVARLLPLLRFVPLLQRLWAYRHANAGFGNQSAGTADPQQSTAEARFVRMTLDHETGEMSGEVLAGTFAGKPMDALDLSDLTQLLLECQAADEKSAALVRAYLERVYGEDWQAQANAQRQGNSSPGQAEMTPEEAHQILGLAVGASEQEIIAAHRRLMQKVHPDRGGSDYLAAKINQAKEILLGK

SEQ ID NO: 3505 - protein, 244 aa, Rhodopseudomonas palustris HaA2
MASMTLIVGVVAVFVLYMLLQMVRTANPAVLARAIKVAGGIVTLAAALFTGVKGQLAVAIPLGLFGAGLLGWAPMGNAGFGRLGGVFGSAGRRSPGQTSQVRSSALEMTLDHESGAINGRILTGAHAGRSLDAFDLSELAAMMAGFDAESCALLESYLDRRFPAWRQNAQGDAAGRRGSQPSGSKMTTEEAYEILGLKPGAGPDDIGRAHRALMKKLHPDQGGSTYLAARVNAAKDTLLRTHRS

SEQ ID NO: 3506 - protein, 245 aa, Rhodopseudomonas palustris BisB18
MEAMPTLIAGVVAVIVLYSLLQMFRAANPAVLARGIKIGGGVVTLAVAAFTGIKGELAVAIPLGIFGAGLLGWAPFGSGAFGNLGTLFGSRGKRSAGQTSRVVSQYIEMMLDHDSGALSGRFLAGPQAGRALDEFDLPQLAAMIPALDAESCALLESYLDRRFPAWRQNAQGERAGGQSRETSSGKMTDEEAYQILGLKPGAGRAEIGQAHRTLMKKLHPDQGGSTYLAARVNAAKDTLLRTHRS

SEQ ID NO: 3507 - protein, 242 aa, Rhodopseudomonas palustris BisB5
MPTLIAGVIAVFVLYTVLQMVRSANPAVLARAIKIAGGIVTLAAALFTGVKGELAVAIPLGLFGAGLLGWAPMGNAGFGRLGGLFGSAGRRSSGQSSRVRSSYLEMTLDHESGAISGRLLAGPQAGRSLDEFDLPELAAMMTGFDAESCALLESYLDRRFPAWRQHAQGDPAGGQGRQTSSGKMTTEEAYQILGLQPGAGPDEIGRAHRTLMKKLHPDQGGSTYLAARVNAAKDTLLRTHRS

SEQ ID NO: 3508 - protein, 261 aa, Nitrobacter hamburgensis X14
MCRRDRFQQSLSPVAPTYYLSAMPILIAGLLAFVFLYLLVQLLRAANPAVLARAIRLAGGIVALAVAAFTGIKGELVVALPLGIFGAGLLGWSPSSASFLGRLFGARTQPSVGKTSQVRSQFLDMVLDHDSGRLGGWIVAGPDAGRSLDDFDLPQLVAMMTSFDAESCALLESYLDRRFPAWRQNAQGDPAGGRSRASSGGKMTNEEAYQILGLQPGAGGDEIRRAHRGLMKKLHPDQGGTTYLAARVNEAKDTLLRTHRS

SEQ ID NO: 3509 - protein, 231 aa, Mesorhizobium BNC1
MTSPLFLIGLLVVLAFAAYAFSRASPAAIAAAVRLAGPTLVALCGLALMLAGRAGVGGTLLSLAAAWLGTVRLSQRRKRSAGTRSSVRSAALEMELDHDSGSLEGTVLAGRFEGRKLGELPLDDLLLLHAELAEDEESLQLLETYLDGRFPVWRERVQTNHDRRQRGAPASGPMSEEEAYKILGLEVGASAAEIRKAHRRLMQRLHPDMGGSAFLAARINEARDVLLSDHR

SEQ ID NO: 3510 - protein, 253 aa, Psychromonas ingrahamii 37
MLVFIALIAVIIIGYITVGYIRTLKREQRKKVGAKAGVLAFIATLILLTVTGKLYILAALGTGLVVFAKRLLPFLRYFPFFKGLYQKAKTKQSSGSSKHSTVETSLLKMTFDHESGEVDGELLDTVSKGKYLSEFDLPDLISLYILAGKEYPDAIEILAAYLDRKYGADWREAANAGNGYQESGQKSRGSDSSKMTVIEAYAVLGLDNNATEEDIIKAHRKLMLKLHPDKGGSNYLAAKINQAKDLLVSSKEK

SEQ ID NO: 3511 - protein, 238 aa, Bradyrhizobium BTAi1
MTLIAGAVAVITLYLLLQMFRNANPAALARAIKVAGGIGCLAAAAFTGIKGELVVAIPIGLFGAGLLGWSPAGLGSFGNMFGLGSQRSGGQGSRVRSQFIEMTLDHDSGRVEGRFVAGAHAGRALDEFDLAQLAATIPSLDADSVALLETYLDRRFPGWRQNAQGDAAGRQRRAAASSKMTDEEAYQILGLQPGAGRDEIGRAHRALMKKLHPDQGGSTYLAARVNEAKDTLLRTHHG

SEQ ID NO: 3512 - protein, 242 aa, Xanthobacter autotrophicus Py2
MISLIAGALLLIIGLYGLKIWTKADPKVLMAILMRSLAYAALLGAAGALAMGRFGAAIPLAAVGIGLLGRLDPQGVGGYLGSLFRKRGAPQVSKVRTQLLEMELDLASGEMKGVVVSGPDAGTTLDALDVPALLAMRRICDPQSLALLEAYLDRRAPAWREHAQTDAGGGNMGAGESVRAGSDAMTEEEAYQILGLEPGADTEAVRAAHRALMKRLHPDLGGSSYLASRINRAKDVILRKHG

SEQ ID NO: 3513 - protein, 242 aa, Rhodopseudomonas palustris TIE 1
MPTLIAGAIAVFVLYTLLQMFRSANPAVLARALKISGGIVMLAAALFTGVKGELAVAIPLGLFGAGLLGWTPLQNAGFGNLGGLFGGLGGRSRGQASTVRSTYLEMVLDHDSGAMTGRILAGPNAGRSLDEFDLGQLAAMLAGFDAESCALLESYLDRRFPAWRQNAHGDAAGGQRSQASGSKMTTEEAYEILGLQPGAGPDEIGRAHRTLMKKLHPDQGGSTYLAARVNAAKDTLLRTHRS

SEQ ID NO: 3514 - protein, 240 aa, Methylobacterium sp. 4-46
MIPLGLGVLVLTGLWWLGRNASTANPATLAKLLRRLGGLLALAAAALLFLRGRFDAAILLGLFGGSLLGWRQMPALPFGLGGAAAPRAAGTASRVRSATVEMELDHDTGALRGRVLTGPLAGRDLDTLGLPDLRSLLAAARAGDPEGEKLLEAYLDRRFAGWREDAERDADPRPGGAAQPGPMAEDEAYQILGLQPGASAEEVRRAHRTLMKRLHPDQGGSDYLAARVNAAKDRLLNRHR

SEQ ID NO: 3515 - protein, 243 aa, Methylocella silvestris BL2
MIYLIVAFLMLWLSLAGLRAFANANPATLARVISRGGGIALLVFAAFLMARGAVSIALGFGGLGLWLLKGGRGPLLSLFGWPSAARRSGASARVSCVRSAMIEMQLDHETGKMRGVILAGEDEGRQLDSLTRPQCEVLYELCRRDDPEGARLLEAYLDRRFAGWSHAGQAQGDSRSGEAGRRAGAMTQDEAYEVLGLAKGASREEVVRSHRSLMKKLHPDHGGTTDLAARVNEAKEVLMRRHP

SEQ ID NO: 3516 - protein, 241 aa, Methylobacterium nodulans ORS 2060
MIALGLGVLVLVGLWWLGRQATNANPTLLARVLRRLGGWLALAVAAVLFLRGRFDMAIALGLIGGWLLGWSQMPALPFGLGQQGPAPRSPGSTSRVRSMMIEMELDHETGAMRGRVLAGPRAGQALDALPLPDLLALLATCRAGDPDGARLLEAYLDRRFAGWREHAEGDADARPGAAPQPGAMTEEEAYQILGLERGASVEDVRRAHRTLMKRLHPDQGGSDYLAARVNAAKDRLLNRHR

SEQ ID NO: 3517 - protein, 584 aa, Frankia CcI3
MQVHRYDAVIVGAGGAGMRAAIEAGTRCRTAVLTKLYPTRSHTGAAQGGMCAALANVEEDNWEWHTFDTIKGGDYLVDQDAAEIMAKEAIDAVLDLEKMGLPFNRTPEGRIDQRRFGGHTRDHGKAPVRRSCYAADRTGHMILQTLYQQCVKHDIEFFNEFYVLDLLLQKGAAAGVVAYELKTGEIHIFQAKSVVFATGGFGKVFKVTSNAHTLTGDGMGLAFRRGIPLEDMEFFQFHPTGIWKMGILLTEGARGEGGILRNKDGERFMERYAPTIKDLAPRDMVARAIYTEIRAGRGCGPDADHVYLDLTHLPPEHLDAKLPDITEFARTYLGIEPYNDPIPIQPTAHYAMGGIPTNVDAQVLADNDTVVPGLYAAGEVACVSVHGANRLGTNSLLDINVFGRRAGIAAAEYANANAQHVDLPENPASFVEDLLGRLRAGAGTENAAAIRRELQESMDVNASVYRTEATLKQALSDISGLKTRYQRVGVSDRGRRYNTELLEAVELGFLLDLAEVLVIGAMARNESRGGHSREDYPNRDDVNFMRHTMAYRSGPLVAASPEAEIRLDYKPVVMTRYQPMERKY

SEQ ID NO: 3518 - protein, 583 aa, Deinococcus geothermalis DSM 11300
MHHRYDVLVVGAGGAGLMAALYAAKGNVSVACISKLYPTRSHTGAAQGGIGAALGNVSEDHWEWHMFDTVKGGDYLTDQDAAEIFAKDIIEAVYELEHMGLPFSRLPNGKIAQRKFGGHTRDFGKAAVERSCYAQDRTGHMILQTLYQQNVKAGTTFYNEFHVTDLILENGRCCGVVAYHLATGEIHTFHAKAVILAAGGYGRVYKITSNALTLTGDLMSIYYRKGLPLEDMEFYQFHPTGLAKLGILVTEGIRGEGGILRNSSGERFMERYAPTIKDLAPRDIVSRSIITEIREGRGVGRDKDAVYIDLTHLPREVIEVKLAEITDLARTYLGQDPVKDLVAVQPTAHYAMGGIPTDVNGLCLADGQGTKVEGLYAAGEQACVSLHGANRLGTNSLGDLIVFGRRAGIAAALYARQAEYAEMPEHPERDTVEMIARLRNASGKDSPAVIRKELQESMMNNVGIFRNGPDMEKQVEIIKELKERYQNVAVTDPGARYNSDLIEAMELGFLLDCAEAATASALNRKESRGAHDREDYPERDDQNWLKHTMAYKDLSRPGNVVIGYKEVALKGYTRAFEPKPRVY

SEQ ID NO: 3519 - protein, 584 aa, Mycobacterium MCS
MLIEHRYDVVIVGAGGAGMRAAVEAGPRARTAVLTKLYPTRSHTGAAQGGMCAALANVEEDNWEWHTFDTVKGGDYLADQDAVEIMCKEAIDAVLDLEKMGMPFNRTPEGRIDQRRFGGHTRDHGKAPVRRACYAADRTGHMILQTLYQNCVKHDVEFFNEFYALDITLTETPGGPVATGVIAYELATGDIHVFHAKAIVFATGGSGRMYKTTSNAHTLTGDGLGIVFRKGLPLEDMEFHQFHPTGLAGLGILISEAVRGEGGRLLNGDGERFMERYAPTIVDLAPRDIVARSMVLEVLEGRGAGPNKDYVYIDVRHLGEDVLEAKLPDITEFARTYLGVDPVKELVPVYPTCHYVMGGIPTTVHGQVLRDNTTIVPGLYAAGECACVSVHGANRLGTNSLLDINVFGRRAGIAAANYALGHDFVDLPERPAEMVVNWVGDILSEHGNERVADIRGALQQSMDNNAAVFRTEETLKQALTDIHALKERYSRITVQDKGKRYNSDLLEAIELGFLLELAEVTVVGALNRKESRGGHAREDYPNRDDTNYMRHTMAYKEGTDLLSDVRLDYKPVVQTRYEPMERKY

SEQ ID NO: 3520 - protein, 599 aa, Arthrobacter FB24
MQVHKYDVVIVGAGGAGMRAAIESGQRARTAVLTKLYPTRSHTGAAQGGMCAALANVEEDNWEWHTFDTIKGGDYLVDQDAAEVMAKEAIDAVLDLEKMGLPFNRTPEGRIDQRRFGGHTRDHGKAPVRRACYAADRTGHMILQTLYQNCVKHNVEFYNEYYVLDLLTVEEDAVREDGTPYKQKRVAGVVSYDLASGELHVFQAKSVVFASGGAGKVFKTTSNAHTLTGDGMGIAFRRGIPLEDMEFFQFHPTGLAGLGILLSEAARGEGAILRNSEGERFMERYAPTIKDLAPRDIVARSMANEVREGRGCGPNKDYVLLDLTHLEPAHIDAKLPDITEFARTYLGVEPYTEPVPVFPTAHYAMGGIPTNITTEVLQDNDTVVPGLYAAGEVACVSVHGSNRLGTNSLLDINVFGKRAGIAAAEYAKTADFVDLPADPEAYTIELLDIARNGTGDEKVAVIRKELQDTMDANMQVFRTADTLNQVLRDIESFEERYKRISVQDKGKRFNLDLLEAVELGFLLELAKVMTVAALHREESRGGHFREDFPERDDEKFMKHSMAYKDDHAPADGSAEAIAGIRLATKPVVFTRYEPMVRKY

SEQ ID NO: 3521 - protein, 584 aa, Mycobacterium KMS; identical to SEQ ID NO: 3519

SEQ ID NO: 3522 - protein, 584 aa, Mycobacterium vanbaalenii PYR-1
MIVEHRYDVVIVGAGGAGMRAAVEAGPRARTAVLTKLYPTRSHTGAAQGGMCAALANVEEDNWEWHTFDTVKGGDYLADQDAVEIMAKEAIDAVLDLEKMGMPFNRTPEGRIDQRRFGGHTRDHGKAPVRRACYAADRTGHMILQTLYQNCVKHDVEFFNEFYALDITLTETASGPVATGVVAYELATGDIHIFHAKAIVFATGGSGRMYKTTSNAHTLTGDGLGIIFRKGLPLEDMEFHQFHPTGLAGLGILISEAVRGEGGRLLNGEGERFMERYAPTIVDLAPRDIVARSMVLEVLEGRGAGPNKDYVYIDVRHLGEDVLEAKLPDITEFARTYLGVDPVKELVPVYPTCHYVMGGIPTTVNGQVLADNTTIIPGLYAAGECACVSVHGANRLGTNSLLDINVFGRRAGIAAANYALGHDFVDLPENPAEMVVGWVGDILSEHGNERVADIRGALQQSMDNNAAVFRTEETLKQALTDIHALKERYSRITVQDKGKRYNSDLLEAIELGFLLELAEVTVVGALNRKESRGGHAREDYPNRDDTNYMRHTMAYKEGTDLLSDIRLDYKPVVQTRYEPMERKY

SEQ ID NO: 3523 - protein, 584 aa, Mycobacterium JLS; identical to SEQ ID NO: 3519

SEQ ID NO: 3524 - protein, 584 aa, Mycobacterium gilvum PYR-GCK
MIVEHRYDVVIVGAGGAGMRAAVEAGPRVRTAVLTKLYPTRSHTGAAQGGMCAALANVEEDNWEWHTFDTVKGGDYLADQDAVEIMAKEAIDAVLDLEKMGMPFNRTPEGRIDQRRFGGHTRDHGKAPVRRACYAADRTGHMILQTLYQNCVKHDVEFFNEFYALDITMTETPSGPVATGVVAYELATGDIHVFHAKAIVFATGGSGRMYKTTSNAHTLTGDGLGIIFRKGLPLEDMEFHQFHPTGLAGLGILISEAVRGEGGRLLNGDGERFMERYAPTIVDLAPRDIVARSMVLEVLEGRGAGPNKDYVYIDVRHLGEDVLEAKLPDITEFARTYLGVDPVKELVPVYPTCHYVMGGIPTTVNGQVLSDNTTVVPGLYAAGECACVSVHGANRLGTNSLLDINVFGRRAGIAAANYALGHDFVELPESPAEMVVGWVGDILSEHGNERVADIRGALQQSMDNNAAVFRTEETLKQALTDIHALKERYSRITVQDKGKRYNSDLLEAIELGFLLELAEVTVVGALNRKESRGGHAREDYPNRDDTNYMRHTMAYKEGSDLLSDIRLDYKPVVMTRYEPMERKY

SEQ ID NO: 3525 - protein, 590 aa, Mycobacterium tuberculosis F11
MICQHRYDVVIVGAGGAGMRAAVEAGPRVRTAVLTKLYPTRSHTGAAQGGMCAALANVEDDNWEWHTFDTVKGGDYLADQDAVEIMCKEAIDAVLDLEKMGMPFNRTPEGRIDQRRFGGHTRDHGKAPVRRACYAADRTGHMILQTLYQNCVKHDVEFFNEFYALDLALTQTPSGPVATGVIAYELATGDIHVFHAKAVVIATGGSGRMYKTTSNAHTLTGDGIGIVFRKGLPLEDMEFHQFHPTGLAGLGILISEAVRGEGGRLLNGEGERFMERYAPTIVDLAPRDIVARSMVLEVLEGRGAGPLKDYVYIDVRHLGEEVLEAKLPDITEFARTYLGVDPVTELVPVYPTCHYLMGGIPTTVTGQVLRDNTSVVPGLYAAGECACVSVHGANRLGTNSLLDINVFGRRAGIAAASYAQGHDFVDMPPNPEAMVVGWVSDILSEHGNERVADIRGALQQSMDNNAAVFRTEETLKQALTDIHALKERYSRITVHDKGKRFNTDLLEAIELGFLLELAEVTVVGALNRKESRGGHAREDYPNRDDVNYMRHTMAYKEIGADKEGPELRSDVRLDFKPVVQTRYEPKERKY

SEQ ID NO: 3526 - protein, 585 aa, Chlorobium phaeobacteroides BS1
MQVVYHDVIIVGAGLAGLRAAVELSGKHDVAVLSKLHPLRSHSGAAQGGISAALGNAEKDSSEWHAYDTIKGSDYLADQYAVEVMCNDAPRAIIELEHLGVPFSRFEDGHIAQRPFGGHTKNFGEAPVRRTCYAADRTGHVCLHTLYEQAVKDKVFFYDEYQVLDLCMADGAVNGVVAIELKTGRFLLFHARAVMFATGGYGKAWKTTSNAFANTGDGLGIVLNNGIPLQDMEFVQFHPTGLYPLGILITEAARGEGGVLRNADGERFMERYAPTIKDLAPRDIVSRSIYDELKEGRGAGPMKDHVLLDLTALSREAIAEKLPEIESFSRIYLGIDPSVTPIPVSPTCHYAMGGIPTDVNGRVLIDAQGKELPGFWAAGEVACVSVHGANRLGSNSLLDLIVFGRRAGKDINRFLDRVLLKPRPLDTGALEKVSRKIEGLLGRKEGETVAAVRTDLQKVMMDKVSVFRNEHGLAAAVEELAVLQGRAAGIRVKDQSKVFNTEILEALELQHMVNYSKAVALCALKRQESRGAHSRDDYPLRDDENHLKHSLFFLKENGEAVYEQKPVDLSLASTRPEFVPKERKY

SEQ ID NO: 3527 - protein, 584 aa, Prosthecochloris aestuarii DSM 271
MDVVYHDVIIVGAGLAGLRAAVELAGSADVAVLSKLHPLRSHSGAAQGGISAALGNVEEDNPDWHAYDTIKGSDYLADQYAVQVMCNDAPRAIIEMEHLGVPFSRLDDGRIAQRPFGGHTRNFGQAPVRRTCFAADRTGHVCLHTLYEQSLKQGVRFYDEIQVLDLCMEDGSVNGVVAMELLTGRIVLMHAKAVMFATGGYGKAWKTTSNAFANTGDGLGIVLRNGLPLQDMEFVQFHPTGLYQLGILITEAARGEGGILLNGNGERFMERYAPSIKDLAPRDIVSRSIYDELKAGRGAGPEKDHVLLDLTSLSHEKIASRLPEIESFAKVYLGIDPSRAPIPVLPTCHYAMGGIPTSVDGRVLGDAEGREVPGFWAAGEVACVSVHGANRLGSNSLLDLIVFGRRSGKDIAQFLKKSGPALPLDMHAADRVKGVISTLLDRQSGESVAAVRRDLQRVMMDDVSVFRQESCLADAVSKLRELQQRASLIRVRDRTRNFNQELTDALELQHMVNYSLTVALSALNRRESRGAHSREDYPDRDDANWLKHSMCRMDEEGGVQLFDRPVDLSLAAANPVFVPKERKY

SEQ ID NO: 3528 - protein, 599 aa, Arthrobacter chlorophenolicus A6
MQVHKYDVVIVGAGGAGMRAAIESGQRARTAVLTKLYPTRSHTGAAQGGMCAALANVEEDNWEWHTFDTVKGGDYLVDQDAAEVMAKEAIDAVLDLEKMGLPFNRTPEGRIDQRRFGGHTRDHGKAPVRRACYAADRTGHMILQTLYQNCVKHNVEFYNEYYVLDLLTVEEDAVREDGTSYKQKRVAGVVSYDLATGELHVFQAKSVVFASGGAGKVFKTTSNAHTLTGDGMGIAFRRGIPLEDMEFFQFHPTGLAGLGILLSEAARGEGAILRNSDGERFMERYAPTIKDLAPRDIVARSMANEVREGRGCGPNKDYVLLDLTHLEPAHIDAKLPDITEFARTYLGVEPYTEPVPVFPTAHYAMGGIPTNIETEVLQDNDTVIPGLYAAGEVACVSVHGSNRLGTNSLLDINVFGKRAGVAAAEYAKTAQFVELPENPLDYTTELLDIARNGTGDEKVAQIRKELQDTMDANMQVFRTADTLNQVLSDIASFEERYKHINVQDKGKRFNLDLLEAVELGFLLELAKVMTVAALHREESRGGHFREDFPDRDDEKFMKHSMAYKDDHAPADGSAEAIAGIRLATKPVVFTRYEPMVRKY

SEQ ID NO: 3529 - protein, 583 aa, Actinosynnema mirum DSM 43827
MQFHKYDVVIIGAGGAGMRAAIESGQRARTAVLTKLYPTRSHTGAAQGGMCAALANVEEDNWEWHTFDTIKGGDYLVDQDAAEIMAKEAIDAVLDLEKMGLPFNRTPEGKIDQRRFGGHTRNHGEAAVRRACYAADRTGHMILQTLYQNCVKHGIEFYNEFYVLDICMTETEDGPVCTGAVAYELATGEIHVFQAKSVVFATGGFGKVFKTTSNAHTLTGDGMGIVFRKGLPLEDMEFYQFHPTGLAGLGILLTEGARGEGAILRNASGERFMERYAPTIKDLAPRDIVARSMALEVLEGRGAGPNKDYVLLDCTHLGAEVLETKLPDITEFARTYLAVDPVTEPVPVYPTAHYAMGGIPTNVLGEVLRDNDNVIPGLYAAGECACVSVHGANRLGTNSLLDINVFGRRAGIAAAEYALAHEHVDLPENPAAGVEAQVALALSEHGHERVADIRTELQATMDANASVYRTEDTLKTALNDVQALKERYQRITVQDKGKRFNTDLLEAVELGFLLELAEVLVVGALARKESRGGHAREDYPTRDDTNFMRHSMYYKQGEGLSAEIRLDYKPVTFTRYQPMERKY

SEQ ID NO: 3530 - protein, 600 aa, Beutenbergia cavernae DSM 12333
MQTHSYDVVIVGAGGAGMRAALESSSRARTAVLTKLYPTRSHTGAAQGGMCAALANVEEDNWEWHTFDTVKGGDYLVDQDAAEVMAKEAIDAVLDLEKMGLPFNRTPDGKIDQRRFGGHTRNHGDAPVRRSCYAADRTGHMILQTLYQQCVKAGVEFFNEFYALDLLLTADPQDPDGDPQVAGVVAYELATGEIHVVRAKSVVFATGGAGKVYKTTSNAHTLTGDGMAIAYRRGLPLEDMEFFQFHPTGLAGLGILLSEAARGEGAILRNSDGERFMERYAPTLKDLAPRDVVARAMANEVREGRGAGPNKDYVLLDLTHLEPAHIDAKLPDITEFARTYLGVEPYTEPVPVYPTAHYAMGGMPTTVEGEVLRNNTDIVPGLYAAGEVACVSVHGANRLGTNSLLDINVFGKRAGITAAEYAAGATLAELPDDPAGRVVAQLEAMRTRPVGEKVADLRRALQETMDVNAQVFRTEASLKQALVDIQQLQERYGHVAVQDKGRRYNLDLLEAAELGFLLDLAEVVVTGALARNESRGGHYREDYPQRDDTNFMRHTMAYRVATTGAEGAEAVDAAGIGPHEVRLDYKPVTLTRYQPMERKF

SEQ ID NO: 3531 - protein, 591 aa, Brachybacterium faecium DSM 4810
MQTHTYDVVIVGAGGAGMRAALESSKRARTAVVTKLYPTRSHTGAAQGGMCAALANVEDDNWEWHTYDTVKGGDYLVDQDAAEVMAKEAIDAVLDLEKMGLPFNRTPEGKIDQRRFGGHTRDHGEAPVRRSCYAADRTGHMILQTLYQNCVKQDVEFFNEYYVLDVLMTGDPRTDEGVRASGVVTYELATGEIHVFKAKSVVFASGGFGKIFKTTSNAHTLTGDGPAMAFRRGIPLEDMEFFQFHPTGLAGLGILLSEAARGEGGILRNSDMERFMERYAPTLKDLAPRDVVARAMANEVREGRGAGPKKDYVYLDLTHLEPSHIDAKLPDITEFARTYLGVEPYTDPIPVFPTAHYGMGGIPTNIRGEVLRNATDVIPGLYAAGETACVSVHGGNRLGTNSLLDINVFGRRAGIAAAEHADEVDMPELPEDVELPTVELLQRLRDRPATEDRIADIRLELQELMDANVQVFRTDETCRRALAGIAELKKRYETVAIQDKGRRYNLDLMEAVELGFLLDLAEIVALGALHRKESRGGHFREDFENRDDVNFLEHTMAYRTLPDEEGIEGTPIRLGTKPVVITRYEPKERTF

SEQ ID NO: 3532 - protein, 595 aa, Micrococcus luteus NCTC 2665
MQVHKYDVVIVGAGGAGMRAAIEAGQRAHTAVLTKIYPTRSHTGAAQGGMCAALANVEEDNWEWHTFDTVKGGDYLVDQDAAEVMAKEAIDAVLDLEKMGLPFNRTPEGKIDQRRFGGHTRDHGKAPVRRACYAADRTGHMILQTLYQNCVKHNVEFYNEFYVLDLLLVEEDAVREDGTAYKQKRTAGVVSYELATGEIHVFQAKSVIFATGGAGKVYKTTSNAHTLTGDGMAIAYRAGLPLEDMEFVQFHPTGLAGLGILLSEAARGEGGILRNADGERFMERYAPTIKDLAPRDIVARSMAEEVRQGRGAGPNKDYVLLDLTHLEPSHIDEKLPDITEFARTYLGVEPYTEPVPVFPTCHYFMGGIPTNIKAEVLQDNDTVVPGLYAAGEVACVSVHGSNRLGTNSLLDINVFGRRAGIYAAEYAAQADWVELPEGGELPTVEHIENLRSATGSERVADIRAELQESMDADMQVFRDEDSIRRALAKIEELRGRYENVSVQDKGHRFNLDLLEGMELGYLLDIAEAMTLAALGRKESRGGHYREDYPDRDDENFMAHTMIYRDETAEMEGVKGIRFETKPVVVTRYQPMERKY

SEQ ID NO: 3533 - protein, 593 aa, Catenulispora acidiphila DSM 44928
MAPQIHTYDTIIVGAGGAGMRAALESSKRSRTAVLTKLYPTRSHTGAAQGGMCAALANVEDDNWEWHTYDTVKGGDYLVDQDAAEIMCKEAIDAVLDLEKMGLPFSRTPEGKIDQRRFGGHTKDHGKAPVHRSCYAADRTGHMILQTLYQNCVKQEVEFYNEFYVLDLLLHEDADGTKYAAGVVALELATGEIHIFRGKAVILATGGFGKVFKTTSNAHTLTGDGMGIVWRRGLPLEDMEFYQFHPTGLAGLGILLTEGARGEGGILRNADGERFMERYAPTIKDLAPRDIVARSMVLEVRDGRGAGPNKDYVYLDLTHLPAEQIEEKLPDITEFARTYLGVEPTTELVPVYPTAHYAMGGVPTNISGEVLADNDTVVKGMYAAGEVACVSVHGSNRLGTNSLLDINVFGRRAGINAAEYAVGAELQPLPSEPEQAVVSMVEGLRNSTGHERVAQIRSELQTTMDQNAGVYRNDETLAQAEKDVKELQRRYRDVAVQDKGKRFNTDLLEAVELGFLLDLAEILVLGARNRTESRGAQAREDYPTRDDVNWQKHTMAYREKDGEGDAGSDQNYRIRLDYKPVIVTRYQPTERKY

SEQ ID NO: 3534 - protein, 595 aa, Saccharomonospora viridis DSM 43017
MQFHKYDVVIVGAGGAGMRAAIEAGQRARTAVLTKLYPTRSHTGAAQGGMCAALANVEEDNWEWHTFDTIKGGDYLTDQDAAEIMAKEAIDAVLDLEKMGLPFNRTPDGKIDQRRFGGHTREHGKAAVRRACYAADRTGHMILQTLYQNCVKHGIEFFNEFYVLDIALTDTADGPVASAAIAYELATGEIHVFQAKSIIFATGGFGKVFKTTSNAHTLTGDGMGIYLRKGLPLEDMEFYQFHPTGLAGLGILLTEGARGEGAILRNASGERFMERYAPTIKDLAPRDIVARSMVLEVLEGRGAGPNKDYVLLDCTHLGEEVLETKLPDITEFARTYLGVDPVKEPVPVYPTAHYAMGGIPTNVHGEALRDNENIVPGVYAAGECACVSVHGANRLGTNSLLDINVFGKRAGIAAAEYANSRDFAELPDDAAKTVETMVNHLRSSTGGERVVDIRNELQATMDANAAVYRTEDTLKQALTDVQSLKERYGRISIMDKGQRYNTDLLEAIELGFLLDLAEVLVNAALARKESRGGHAREDYPDRDDVNFMRHSMSYKILPEKDDPDAQLGLPGFRADLRLDYKPVTFTRYEPMERKY

SEQ ID NO: 3535 - protein, 609 aa, Jonesia denitrificans DSM 20603
MQFHQYDVVIVGAGGAGMRAALEASTEVRTAVISKLYPTRSHTGAAQGGMCAALANVEEDNWEWHTFDTVKGGDYLVDQDAAEIMAKEAIDAVLDLERMGLPFNRTPEGRIDQRRFGGHTRNHGEAAVRRACYAADRTGHMILQTLYQNCVKQNVEFFNEFYVLDLIVDHDLSAGDVPVGEEVTATGVVAYDLATGEIHIFQTKAVVFATGGAGKIYKTTSNAHTLTGDGMALALRRGLPLEDMEFFQFHPTGLAGLGILLSEAARGEGGILRNGQGERFMERYAPTIKDLAPRDIVARSMANEVREGRGAGPNKDYVLLDLTHLEPAHIDAKLPDITEFARTYLGIEPYTEPVPVYPTAHYAMGGIPTTIDSEVLRNPNDVVKGLYAAGEVACVSVHGANRLGTNSLLDINVFGKRAGRAAAAYAKTASFVDLPDQAASWVVGQLEELRSRPDGERVADIRKTLQETMDANAQVFRTEESLTQALADIRTLQERYSRVSVQDKGKMFNTDLLEALELGFLLDIAEVTVIAALNRRESRGGHFREDFPDRNDEAYMHHTMVYRRPLDSSVSGNITDEAFSHVSEFDDYKVVLGAKPVVQTRYEPMERKY

SEQ ID NO: 3536 - protein, 583 aa, Nakamurella multipartita DSM 44233
MQFHRYDVVIVGAGGAGMRAAIESGQRARTAVLTKLYPTRSHTGAAQGGMCAALANVEDDNWEWHTFDTVKGGDYLVDQDAAEVMCKEAIDAVLDLEKMGLPFNRTPEGRIDQRRFGGHTRNHGEAAVRRACYAADRTGHMILQTLYQNCVKLGIEFYNEFYVLDLLLSKTDEGETCTGAVAYELATGEIHVFQAKSVVMATGGAGKIFKTTSNAHTLTGDGLGIVFRKGLPLEDMEFFQFHPTGLAGLGILISEAVRGEGGILRNAQGERFMERYAPTIKDLAPRDIVARSMVMEVREGRGAGPNKDYVLLDVTHLGKEVLETKLPDIAEFSRTYLGVEPLDEPVPVFPTCHYVMGGIPTNIAGQVLRNNTDVVPGLYAAGECACVSVHGSNRLGTNSLLDINVFGRRAGIAAAEHALASDFVQVPDNPEALVIEMVTKLRESTGKEKVAEIRTTLQATMDLNAAVYRTEATLKEALNDVRVLKERYSRVSIQDKGQRYNTDLLEAIELGFLLELAEILVVGALVRTESRGGHAREDYPNRDDANWMRHTMAYKQGNELTADIRLDYKPVVQTRYQPMERKY

SEQ ID NO: 3537 - protein, 875 aa, Staphylococcus epidermidis RP62A
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICERYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEEALKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIISVDGSAGDLYLGAIETVNAEHSEEFDQFMTWSEEIARLQVRMNAETPQDIKAGYDFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGVTCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRQFNQWEIDYVSCSPFRVPGAILATAQSQAEESER

SEQ ID NO: 3538 - protein, 884 aa, Moorella thermoacetica ATCC 39073
MASKKYVYLFSEGKADMRLLLGGKGANLAEMTNIGLPVPQGITITCEACNEYNRLGQQFPEGLEEEVAARLKDLEAINGKKLGDPENPLLVSVRSGAPVSMPGMMDTILNLGLNDNSVKGLAAQTGDERFALDCYRRFIQMFGNVVLGIEHNDFEAVLEKHKERLGVKFDHELTPDALREVIAEYKDVVKSRSGRDFPQDPREQLYMAIRAVFDSWNNPRAIVYRKINKIPDDLGTAVNVQTMAFGNMGPTSGTGVAFTRNPSTGEKGIYGEYLINAQGEDVVAGIRTPKPISSLKEEMPEVYRQFEDICQLLEKHYRDMQDIEFTIEKGKLFILQTRNGKRTAAAAVKIAVDMVNEGLITKEEAVLRVDADQLIQLMHRRIDPSAKLEVVAKGLPASPGAASGQVVFDADDAEKMGLDGQKVVLVRTETTPDDIHGIVQAQGVLTARGGMTSHAAVVARGMGKPAVTGCDAIKIDVENKRFFIGDLVVKEGDVISIDGSTGNVMLGEVPLIDPQLTGEFETILEWADSFRRLKVRANADTPEDARRSREFGADGIGLTRTEHMFMQVDRLPVVQQMILAKTKEERQAALDKLLPMQQGDFYGILKAMEGLPVTIRLLDPPLHEFLPNIEELLVDVTRLQATNGDSKELEEKQALLREVRARHEFNPMLGHRGCRLGITYPEIYAMQVRAIFQAVAQLVKEGVKVLPEVEIPLVIHVNELQRLHAMVDEVAAAVKKETGVDFDYKVGTMIEMPRACATADEIAREAEFFSFGTNDLTQTTFGFSRDDAEGKFLHQYVDEKILKEDPFIVLDRDGVGKFMKMAVELGRSTNPKLEIGICGEHGGEPSSVEFCHQIGLNYVSCSPFRVPVARLAAAQAALKEKKGK

SEQ ID NO: 3539 - protein, 880 aa, Syntrophomonas wolfei Goettingen
MSKKYVYLFEEGNSNMRQLLGGKGANLAEMTLIGLPVPAGFTITTEACNEYLTAGHKFPDGVLEQVFTALERLELDSGKSFGKKNNPLLVSVRSGAAVSMPGMMDTILNLGLNDESVQGLASLTGDSRFAYDCYRRFIQMFSDVVLGVEHARFDEVMERYKRKLALIFDYEIPSSELQSIIEEYKEIVEQEKGFAFPQDVREQLTMAIQAVFDSWNNQRAIVYRRLNKIDDELGTAVNVQCMAFGNMGLDCGTGVAFTRNPSTGERELYGEFLVNAQGEDVVAGIRTPTPIDRLKEELPGVFQQFLDTCQKLETHYRDMQDIEFTVEKGKLYMLQTRSGKRTARASVRIAVEMVNEGLITVEEALLRVDAEQINQLLHRQIDQSVKLDAIAKGLPASPGAACGKVLFDADLAEKMGGAGEKVVLVRSETTPDDIHGIIYAQGVLTARGGMTSHAAVVARGMGKPCVCGCEAIKIDSGNRQFIVNGIVVKEGDVITIDGASGNVMLGEVPMIEPTLSDEFALLLQWANQIKKLAIRANADTPQDAARAREFGAEGIGLCRTEHMFMAAERLPIVQQMILAENLEDREEALSQLLPFQRDDFYGILKAMAPHPVTIRLLDPPLHEFLPHPETLLLEIAEMKHQQIKGKVLLEKEELLKKVHSLSEANPMLGHRGCRLGLTYPEIYCMQARAIFEAMVQLQKEGIDCFTEVEIPLVMDIAELSLLKAEIMGVYEQVKKENNCELDFTVGTMLELPRACIMADEIAREAEFFSFGTNDLTQTTFGFSRDDAEGKFIPIYLEKKIIKDNPFAVLDRKGVGSLMRLAVEKARSVKKDILMGICGEHGGEPSSIEFCHIVGLDYVSCSPYRIPVARLAAAQASLLNN

SEQ ID NO: 3540 - protein, 885 aa, Desulfotomaculum reducens MI-1
MATQKYVYAFSEGRADMKSLLGGKGANLAEMTNIGLPVPPGFTITTEACKEFYIAGRKFPEGLEQELETKVDWLEQTLNKKFGDPNGPLLVSVRSGAVISMPGMMDTVLNLGLNDQTVIGLATSSGNARWAYDCYRRFIQMFGNVVLDIEHHKFEGILEEQKHKRNVQFDNQLTSEDWQEVIGKYKAIVQKETGREFPQDPKEQLHKAIFAVFNSWENDRAIVYRKIHKISDDLGTAVNVQAMVFGNMGDDCGTGVAFTRNPSTGEKLLYGEFLTNAQGEDVVAGIRTPQPIAKLADEMPDVYQQFARTCTLLENHYKDMQDIEFTIERNKLWMLQTRNGKRTAQAAIRIAVEMVEEGIIDKEMAINRVDPNQLDQLLHRRIDPNAKLEVVAKGLPASPGSASGAVVFNADLAEKLNKQGQKVILVGTETTPDDIHGMVAAQGILTSRGGMTSHAAVVARGMGKPCVCGCEAIRIDSENKQFFVGNITVKNGDIVSIDGSTGDVILGEVPMIEPDLSAEFLKLLQWADNIRTLEVRANADTPEDAAKAREFGAQGIGLTRTEHMFMALDRLPIVQEMILANDIEERAAALAKLLPMQEGDFYGILKAMEGLPVCIRLLDPPLHEFLPNAEELAVEITQLKLTNGEPAKIQQKEDLLRKVRSLSEFNPMLGHRGCRLGITWPEVYAMQARAIFQATARLVKEDCKIDPEVEIPLVIELKELAYLRKLVEDVAEEVKKETGVDFHYSVGTMIEIPRAALLADEIASQAEFFSFGTNDLTQTTLGFSRDDAEGKFMQPYIEKKILNDNPFIVLDRKGVGKLMQWTVENARRVKPDLLIGICGEHGGEPSSVEFCHMIGLNYVSCSPYRVPIARLAAAQAAVINKDQSK

SEQ ID NO: 3541 - protein, 896 aa, Gluconacetobacter diazotrophicus PAl 5 JGI
MTKWVYSFGGAANEGGAGMRDLLGGKGANLAEMAAIGLPVPPGFTITTEVCTRFYENGRAYPEDLRAQVEAALAGVEASLGLRFGDPAAPLLVSVRSGARVSMPGMMDTVLNLGLNDETVAGLAAASGDARFAWDSYRRFIQMYGSVVLGVSHHRFEDLIEETKRATGVQDDTKLTDQDWQEVVTGYKEIVLRETGAPFPTDPHAQLWGAIGAVFGSWMNPRAHTYRRLHDIPADWGTAVNVQAMVFGNMGADCATGVCFTRDPSTGENVFYGEYLINAQGEDVVAGIRTPQPMSQARAHDGELSMERALPEAYRELLAVRDILERHYRDMQDIEFTVQNNRLYMLQTRTGKRTAAAALRIAIAMAEEGLITHEEAIRRVPPSSLDQLLHPTLDPDAPRTMLSRGLPASPGAAAGAIVFSAEDVEIRAARGEDVILVRIETSPEDVHGMHAARGVLTTRGGMTSHAAVVARGMGRVCVAGAGGIHVDYRARTLSVGATMLHEGDWITLDGATGEVFAGRVATIEPTLSGDFSTLMGWADSVRRMKVRANAETPDDARTARHFGAEGIGLCRTEHMFFAPDRIGFMRQMIMAGDAAARIRAIDALLPFQREDFKALFRIMAGLPVTIRLLDPPLHEFLPHGEAELAELAAALGESPEAVAARRAALSEANPMLGHRGCRLGLTYPELYAMQARAIIEAAIAVSAESGQPVVPEIMIPLVGMDSELRRTRATVEQAAAEALEAAGVSLDFSIGTMIELPRAALTADRIAQDADFFSFGTNDLTQTTFGLSRDDSGTFMPFYLEHDLIPRDPFISIDQEGVGQLVAMGAERGRRTRPGLKLGVCGEHGGDPASIGFFESVGLDYVSCSPFRVPIARLAAAQAALAGRADPVASSRVASS

SEQ ID NO: 3542 - protein, 886 aa, Kytococcus sedentarius DSM 20547
MTGGATKYTYDLSEGDISMKPLLGGKGANLSEMIKLGVPVPDGFTVTTAACIDTMNNGGQWPAELWGQVEDSLARFEERAGRRLGDPAQPLLVSVRSGAVISMPGMMDTILNLGVSDETVGSLASEFGERFAWDTYRRFIQMYGDVVEGVPHHAYEDALSALKAERGVENDTDLSAEDLKGLVETFKQVSRDHMGAEFPTDPKEQLKRAVNAVFSSWGTPRAGVYRKANGIPDDLGTAVNVMQMVFGNRGETSATGVCFTRNPSTGAQELYGEFLVNAQGEDVVAGIRTPKPLAEMESVLPEAYGQLLDTMRRLEEHHGDMQDIEFTVEDGKLYLLQTRNGKRTAPAAFKIAVDMVNEGKLDKAGALKRIEPMQLDQLLHPAIDPSHGQEPVTKGLNASPGAAVGEVVFDAETAAERGKAGEKVVLVRWETTPDDIAGVIVAQGVLTAHGGMTSHAAVVARGMGKPCVAGASKIKIDTEGKKLTIGDTVLAEGDMITLDGSTGEVYAAALDLVPPQLNEDFNTIVGWADEIRRLDVRTNADTGADAAKAREFGAQGIGLCRTEHMFMEADRLPAVRKMILSESDEARTQALAEILPLQQEDFEAIFDAMTGLPVTVRLLDPPMHEFLPNLVDQALLVQRLEIEGRGDDDAELSEARTLLAQVKKLTEQNPMLGTRGVRLALLYPEIPAMQTRAIVRAALASKQRGNDPHVEIMVPIVAYAEELKRMRAIIEDTVAEELEAAGEELDYTIGTMIELPRAAVTADQIAEHADFFSFGTNDLTQTGVGISRDDAEGAFLAHYVDDDIVPGNPFASIDVDGVGGLVRIGAEKGRSTKADLKLGVCGEHGGDPASIALFEELGLSYVSCSPYRVPIARFAAARAVLDAQEK

SEQ ID NO: 3543 - protein, 912 aa, Eggerthella lenta DSM 2243
MTEEVKRVYAFGKDAQGNNVTEGNTSMKAILGGKGANLAEMANIGLPVPPGFTITCQTCMEYANAGNAWPEGALGTIQEYREDLEARMGKKIGDAEDPLLVSVRSGAPMSMPGMMDTVLNLGLNDQSINGLIKQTDNPRFAWDSYRRFIQMFSNVVMNLDGDLFENAITAMKHARGAASDTDLTAEDLQELVAEFKQIFAENVDAAAYPSLVVDGAVQFPQDPSVQLQLAIEAVFGSWNNPRATLYRKQNKIADDLGTAVNVQSMVFGNKGNTSATGVAFTRNPANGEKEFYGDYLVNAQGEDVVAGIRNTSPIAELKDVDGLEEAGRELEEVFVTLENHFRDMCDIEFTIEQGKLWMLQTRVGKRTAAAALHIAIEMEKEGLISKEEAVMRVDPEQLDQLLHPQFDKNASYDVVAKGLNASPGAAVGEAVFSAADAVAVAEAGRKCVLVRWETNPDDLAGMIAAEGILTSHGGKTSHAAVIARGMGAPCVCGVEALRIDAEKKQASVVGTDIVIKEGDMISIDGTTGSVVLGAVELVLPEMTGDLDTILEWADEFRTLGVRANADNPEDAELSRGFGAEGIGLCRTEHMFLGDRKQIIQTFILNEDPAVREKAVGELLAAQTGDFLGMFRAMDGLPVIVRLLDPPLHEFLESPRALDVEIAKLEAAGGDKALIAEKRMLMEQIDGMSEANPMLGLRGCRLGIVYPILPVMQVRAIATACAELQKEGLNPKPEIMIPLVSVVAELEKLRKVAEDTIAEVAAEQGVELDIPVGTMIELPRAAVTADEIGAVADFFSFGTNDLTQTTFGFSRDDVEAEFVPQYLAERLLPYNPFATIDPGVAKLVEMGVELGHKGNPDLVCGVCGEHGGDPDSVKTFHTIGLDYVSCSPYRVPLARLAAGQAALAEKMGDGRDK

SEQ ID NO: 3544 - protein, 903 aa, Cryptobacterium curtum DSM 15641
MAEEVKRVFAFGKDANGNNVTEGNTSMKAVLGGKGANLAEMANIGLPVPPGFTISCQTCMEYANAGNVWPEGVLDVIHEYRSDLEARAGKKIGDAQDPLLVSVRSGAPISMPGMMDTVLNLGLNDESINGLIVQTENPRFAWDSYRRFIQMFSNVVMGLDGDLFENAISMKKNLRGVRSDTDLTADDLQELVEEFKRIFAENVDAAAYPDLAHNGVATFPQDPTVQLKLAIEAVFGSWKNPRAVLYRQKNKIDDNMGTAVNVQCMVFGNKGDTSATGVAFTRNAATGEKEFYGDYLVNAQGEDVVAGIRNTSPIAELKHTPGLEEAGRELEEVFVLLEQHFRDMMDIEFTIEQGKLFMLQTRVGKRTAAAALRIAIDMEKEGLITKEEALKRVEPEQLDQLLHPQFDKNASYDVLARGLNASPGAAVGEIVFSSADAVAVSEAGRKCVLVRWETNPDDLAGMIAAEGILTSHGGKTSHAAVIARGMGAPCVCGVDALKIDAEKKEITVAGSDVVLHEGDMISIDGTTGTVVSGAVELVMPELTGDLDTILEWADEVRVLGVRANADNPEDAQLSRDFGAEGIGLCRTEHMFLGDRKQLIQQFILNDDEDIRTECVHKLGELQTGDFLGMFRAMDGLPVIVRLLDPPLHEFLENPRALDVEIAHMEEQGASAESVAEKRALMAQIDSWAEANPMLGLRGCRLSILFPQLPDMQVRAIATAAAALKKEGLDPHPEIMIPLVSFESEIESLRAKAEAVIAEVEAEQGVQLEIPIGTMIELPRAALIADQIARHADFFSFGTNDLTQTTLGFSRDDAEAKFLPRYLEEHLLKRNPFATIDDGVAELVRMGCEKGCSANPKLACGVCGEHGGDPESIMKFAQVGPDYVSCSPYRVPIARLAAAQAALV

SEQ ID NO: 3545 - protein, 876 aa, Anaerococcus prevotii DSM 20548
MTNKYVYNFNEGNMSMRALLGGKGANLAEMTNLGIRVPYGFTITTEACTRFYKEDKKLWDDLNKEVTEHIKDLEKANEKTFGSTEDPLLVSVRSGAPISMPGMMDTILNLGLNDDAVIGLAKKTDNERFAYDSYRRFIQMFADVAMELDKNNFEKLLTAKKEAKGVKLDTELDANDLKELVEEYKAKYKELMGEDFPQEPREQLDLAISAVFRSWGNERAILYRKLNDIDDAMGTAVNVQSMVFGNMGDSSGTGVAFSRNPATGENVLFGEYLINAQGEDVVAGVRTPQEIATLEKAMPEVYKEFFETSEKLEAHYKDMQDMEFTIQDGKLFLLQTRNGKRTAQAAVKVAVDLVEEGLIDEKEAVLRVNPKDLDGLLHPTFTKEAEDKNEPIAKGLAASPGAAVGKIAFSAKEAAKRAADGEAVILVREETSPEDLEGMVSAKGILTARGGMTSHAAVVARGMGKCCVAGAGELHVDEYEHTVRIGDLVLTGEDTISIDGSTGAIYKGSLETQPPQLHGAFGTFMGWVDKFRDMKVRTNADTPRDVAQALNFGAEGIGLCRTEHMFFKEDRIFQVRKMILASDLETREAALEKILPMQEDDFYQIYSLMKERPVTVRLLDPPLHEFLPKGENEIKDLALELNIQPARVKERIAELQEVNPMLGFRGLRLAIIYPEIAKMQARAIIQAAIHCHEDGVKVVPEIMIPLSSDVVELSKVKETVKEEIEKVFEEKGKKIDYLLGTMIEIPRAAITADEIAEVTDFFSFGTNDLTQMTFGLSRDDAGKFLPAYIEKDIFEKDPFQVLDQKGVGFLVETAVEKGRKANDKLHIGICGEHGGEPSTVKYLYGVGLDYVSCSPYRVPIAKLAAAQAAIENPRNK

SEQ ID NO: 3546 - protein, 909 aa, Slackia heliotrinireducens DSM 20476
MAENVKRVYAFGKDAQGNNVTEGDKDMKYILGGKGANLAEMAVIGLPVPPGFTITCQTCMEYANAGNTWPEGALDEINKYRQDLEERMGKRIGDADDPLLVSVRSGAPMSMPGMMDTVLNLGLNDESIKGLIKHTENPRFSWDSYRRFIQMFSNVVMGLDGDLFENAITTKKLVKGAKSDTDLTAEDLEELVAEFKQIFSDNVSAEDYPLLVVDGKVQFPQDPDTQLRLAIEAVFGSWNNPRATLYRKQNKIADDLGTAVNVQTMVFGNKGNTSATGVAFTRNAADGTNEFYGDYLVNAQGEDVVAGIRNTSPIAELKEVEGLQEAGRELEGIFGILENHYRDMMDIEFTIEQGKLWMLQTRVGKRTAAAALKIAIDMEKEGLITKEEAIQRVDPEQLDQLLHPQFDKNATYDVVARGLNASPGAAVGEAVFSAADAVEAKAEGRKTVLVRWETTPDDLAGMIAAEGILTSHGGKTSHAAVIARGMGAPCVCGVEALRIDAEKKEAAIAGTDIVIREGDMISIDGTTGILVLGAVDLVMPELTGDLDTILAWADEVRTLGIRANADNPADAQLSRDFGAEGIGLCRTEHMFLGDRKQIIQTFILNEDQEVREEAVAKLFEAQKGDFYGMFKAMDGLPVIVRLLDPPLHEFLESPRALDVEIAKLEATGGDAAVIAEKRALMEKIDSFAEQNPMLGLRGCRLGIVYPILPVMQVRAIATAMAELKKEGLDPKPEIMIPLVSTVNELAKLRAVAEQTIAEVEEAEGVKLEIPIGTMIELPRAAVTADEIGTKADFFSFGTNDLTQTTFGFSRDDVESEFVPQYLAEKILPYNPFATVDPGVAKLVKMGVELGHVGNPDITCGVCGEHGGDPDSVKIFHSIGLDYVSCSPYRVPLARLAAAQAALKDTGKDK

SEQ ID NO: 3547 - protein, 920 aa, Atopobium parvulum DSM 20469
MSEKHVYSFGKDHAGNDVTEVAGASVEEAKWIVGGKGANLAEMSKIGLPVPPGFSITCQTCVAYSNNGNVWPEGVTDEIDAAMATLEERMGKKLGDAEDPLLVSVRSGAPFSMPGMMDTVLNLGLNDESVQGLIKQTGNERFAWDSYRRFVQMFSGVVMGVSGQLFEDAIAAKKAEKGVKLDTELDANDLRDLVTWFKGIFAANVDVKEHPEVSKNGYAVFPSDPYLQLRLAEQAVFGSWMNDRAILYRKQNKIPDELGTAVNVQVMVFGNKGETSATGVAFTRNPADGTNERYGDFLINAQGEDVVAGIRNTEPIADLVKVSALKEAGEELFHVFEILEDHYADMMDIEFTIENGKLWMLQTRVGKRTALSALKVAIQMYEEGRITKEQAVSRVAPEQLDQLLHPQFDPNAEYKTIAKGLNASPGAAVGAAVFSSADAEAFAEAGKPCILVRWETTPDDLHGMVAAEGILTSHGGKTSHAAVIARGMGAPCVCGVDTLRIDAANKRFTVADSGLVVNEGDVISIDGTTGDVILGAVELVQPELSGDLQTILAWADEVRLDESRGRVIGVRANADNPTDAQTSVDNGAEAIGLDRTEHMFLGERKHLIQDFILADSEDVKQLAIEQLGRAQKGDFLGMFKVMDGKDVVVRLLDPPLHEFLDSPRELDVEIARDEEQGKDTAAKRALLAKFDAFQEANPMLGLRGCRLGLVYPELNVMQVRAIASAAAELKRVGLDPRPEIMVPLVGFEEELIQVREEVEQTIKQVADEYGVELNIPVGTMIELPRAAIMSEEIAKHADFFSFGTNDLTQTCLGFSRDDVESAFMPLYLERKIVKTNPFATLDKGVAELVRMGVEGGRKGNPNLTIGVCGETGGDPESIHMYYNLGLDYVSCSPYRVPIARLAAAQAKIQANGGPQKIATK

SEQ ID NO: 3548 - protein, 887 aa, Desulfotomaculum acetoxidans DSM 771
MSKKYVYLFKEGNADMRSLLGGKGAGLAEMSNIGLPVPPGFTITTEACNEYYESGLDFPEGMLGQVWASLKVIEDQTGKEFGSPTNPLLVSVRSGAVFSMPGMMDTVLNLGLNDTTVQALVANSQDERFAMDCYRRFIQMFSDIVMGIEHYEFENVLVNTKETLGVKYDNEIDAATMRGVVEEFKKVVKRESGREFPQDPKEQLVMAIKAVFSSWNNDRAIYYRKINNIPGHLGTAVNVQSMAFGNMGGDCGTGVAFTRNPSTGEKALYGEYLINAQGEDVVAGIRTPQPISKLKEEMPAVFQQFVDTCLLLEKHYKDMQDIEFTIERGKLYMLQTRTGKRTAPAALRIAVEMVNEGLIDKNTAVQRIDPAQLDQLLHRRIDPNASVEVLAKGLPASPGAASGKVVFSADEAEQMADDGEKVILVRMETTPDDIHGMVKAQAILTSRGGMTSHAAVVARGMGKPCICGCEAIKIDYAKEEFAVGSRVFKKGELISVDGGTGRVIAGEIPMIDPELNDDFVTMLYWADEIRTLGVRANADTPEDAEKARAFGAEGIGLTRTEHMFMAQDRLPVVQQMIMSDTLEEREAALAKLLPMQQGDFYGILKAMQGLPVTIRLLDPPLHEFLPNIEDLMVEITTLKLTNGDPEVIKKKETILKKARALHEFNPMLGHRGCRLGISNPEIYAMQVKAIFYATAQLIKEGVDAKPEVMIPLVIHAKELQVLRDQAAAIAEEIKVETGVDLPVSIGTMIEIPRAALTADEVAEYAEFFSFGTNDLTQTTLGFSRDDAEGKFMHYYIEKKILEENPFVSIDQTGVGKLVNIACELGRKARPNIKLGICGEHGGEPRSIEFCHNTGLTYVSCSPFRVPIARLAAAQAAAKERSAAGVDK

SEQ ID NO: 3549 - protein, 462 aa, Porphyromonas gingivalis W83
MQKQQTLKDKFCLQGKGLHTGLDIHITFCPAPEESGYKIKRVDLEGQPVIDAIADNVHSTRRGTVLKKGEVSVSTIEHAMAALYALGVDNCLIEVDAPEFPILDGSAEPYVSEIKRVGLVEQETPRDYYIIKKRMEVSDPESNSKLILLPDDEFTVDVHIAFPSKVLSNQFASLETLSDFEEQIAGARTFVFVREVQMLLEANLIKGGDLDNALVIYDEPLAQDRLDALSDMMGVERKQVNELGYINNKPLIYDNEPARHKLLDVLGDLALIGKYIRGRIIATCPGHSINNKMARLIRKEIKQNEAQAPVYNPNKEPIMDINRIKELLPHRYPFLLVDKIIEVGPDYIVGVKSVSGNEPFFPGHFPGEPVMPGVLQVEAMAQVGGLLVLNTLTEPSSYSTYFLMIDKVKFRRKVVPGDTLVFKLRMISEIRRGVANMRGLAFVGEQLACEAEFMAQIIQNKE

SEQ ID NO: 3550 - protein, 462 aa, Cytophaga hutchinsonii ATCC 33406
MYTKQHTIKAPVKVSGVGLHTGAQVNLTFVPAPINHGILFKRVDLPDQPVVECDVDNVVDVSRGTSIEKNGARINTVEHALAALVGLQIDNILIELDGPEIPIMDGSSLPFIEAINAIGLEEQNALRNFFEVPHGIFFQDAEKNIELAALPLDDYRVTVMVDYNSPVLGSQHATLNNINQFEKEIASCRTFCFLHELEMLHKQNLIKGGDLNNAIVIVDRIVKDDELDSLAKLFGKDKVEVKKEGILNNIELRYKNEPARHKLLDVVGDLALVGRPLKAQIMAARPGHASNVAFAKKLKRVMMDSRQKAPHYDITQPSVLDVNQIYKLLPHRYPFKLVDKIVHLDENMIIGVKNVTINEPFFEGHFPGNPVMPGVLQIEAMAQTGGIFVMQSVPDPENYWTYFLSIESAKFRRMVVPGDTLVFKCELTAPIKRGIAKMQGQAYVGGNLVCEASLTASIVKKK

SEQ ID NO: 3551 - protein, 465 aa, Flavobacterium johnsoniae UW101
MEIMVKQKTIKNEISLTGVGLHTGKEVTMTFKPAPINNGFTFVRVDLQGQPVIEADANYVVNTQRGTNLEKLGVKIQTPEHVLAAVVGCDLDNIIIELNASELPIMDGSSKYFVEAIEKAGIEEQDANRNVYVVKEVISFTDEATGSEILVMPSDEYQVTTMVDFGTKVLGTQNATLKSLSDFKDEIASSRTFSFLHELESLLEHGLIKGGDLNNAIVYVDKEISESTMENLKKAFGKDEISVKPNGVLDNLTLHYPNEAARHKLLDVIGDLSLIGVRIQGKIIANKPGHFVNTQFAKKLAKIIKIEQRNHVPVYDLNQEPLMDIHKIMSMLPHRPPFLLIDRIIEMSDRHVVGLKNVTMNENFFVGHFPEAPVMPGVLIVEAMAQTGGILVLSTVPDPENYLTYFMKIDNVKFKHKVLPGDTLIFKCELISPIRRGICHMQANAYANGKLVTEAELMAQIARKQ

SEQ ID NO: 3552 - protein, 446 aa, Opitutus terrae PB90 1
MKQRTLAREVSIKGSALHTGDPVTLTMKPAPVDHGIVFKRTDLHGSPELRPRVDQVTDLVRATTIQSGHAKIHTVEHVLSALHGCGIDNVLLEMDASEPPIMDGSARPFVNLILQAEPVEQDKDREYFELDAPVSVTRGNSSIIALPSDVLKISCTSADDRGIHTQHLSLTIDPEVYQTQVAAARTFTIYEDIEELLKLGKIRGGSLDCAVVIRGDKIISKEPLRFKDEFVRHKILDIIGDVMLLGLPLKAHIVATRPGHAINAELTKAIYQKLLERKQGGTKKKEKPVAPTMLLTDETSLDIRRILDTVPHRYPFIMVDRVLEIKGPDELVALKNVTINEPYFQGHFPGNPVMPGVLQIEAMAQAAGILMLRKISSEGKTALFMSCDKVKFRRAVRPGDQLLIQVKMTKSRGNRIGVAEGQCSVNGQVVSSAELMFTVIDETDVE

SEQ ID NO: 3553 - protein, 464 aa, Candidatus Amoebophilus asiaticus 5a2
MQTKQHTIQAPVTFSGVGIHSDCTATVTCLPAGPDHGIKFQRTDIEGQPIVEAIVDHVVDVTRSTTLRHNNAYVDTVEHLLAAIGGLEIDNMLIQLDGPEVPILDGSSMPFVKAFQEVELTNQGVPRRFFQINESVVYANESQGIELSAFPLDDYKISVMIDYEVDKLHNQHAFLGKISDFAKEIAPSRTFAFLSEIQSLYEHGLIRGGNLDNALVIIDKEMSASELENLAKIFNKKEIKLAEGGVLNNVKMYFPNEPARHKLMDLVGDLLLVGRPIKGHIVAHKPGHASNVAFARKLRKMMLQQENVTIPTYDPNIEPILDIKKITKMLPHRYPFQLVDKIIHLEQRTVTGIKNVTINEPFFQGHFPNNPVMPGVLQIEAIVQTGGVLVLSSVPDPENYSTYFLAIENCRFRRMVLPGDTLIMHCELLSEIKRGIVKMRGRAFVGNKLACEAIMTAQIVKQTE

SEQ ID NO: 3554 - protein, 462 aa, Capnocytophaga ochracea DSM 7271
MVKQNTLSKEITLEGIGLHTGKQVKMVLKPAPVGNGFTFVRTDLEGNPVVEADATYVASTERGTVLEKKGVKIQTCEHILAALVGMDLDNVIIELNSSEPPIMDGSSKYFVEAIEKAGITPQDAERDEYIVKQVITYVNEETGSEITLIPAEEYQVTTMVDFGTKILGTQNAYLNKLSEFKTEIADARTFSFLHELEALLDHGLIKGGDLNNAIVYVDKEISDSTMQKLKKIFNKDNISVKPNGVLDNLTLHYPNEAARHKLLDVIGDLALVGTRIRGKVIATKPGHFTNTQFAKKLSKIIKNERRNNVPSIDINQPPLLNTTDIMKLLPHRSPFLLVDKIFELSDKHVVGLKNVTMDEPFFVGHFPGAPVMPGVLQIEAMAQTGGVLILSTVPDPENYLTYFMKIDNVKFKVQVVPGDTLIFKLELLTPIRRGICHMQAYAYVNGKLATEAELMAQIVKVK

SEQ ID NO: 3555 - protein, 469 aa, Pedobacter heparinus DSM 2366
MNVKQKTIKNEVSVQGVGLHTGANVTLTFCPAPENHGFKFQRTDLPGNPVVDADCDNVTDTARGTTISQNGASVSTVEHVMASLVGMDLDNVLMKLDGPETPIMDGSAIQFLDALESAGIQIQEKDREYFQIPHNIAYTEPDRKVEIVAMPLDDYRFTCMIDYNSPVLGSQHAGITSIAEFKKEIASCRTFCFLHELEYQLQNNLIKGGDLNNAIVIVDKEVTKEELDHLAKIFKRKAIEVAPQGILNNMELRHQNEPARHKLLDMIGDLALVGVHLKGHIMAARPGHAANVAFAKKIKAAIKKEKNKKVQHVYDPSVKPLYDTVQIMDILPHRQPFLFVDKVLELSKTHVVGVKNVTMNEEFFKGHFPGAPVFPGVIQIEAMAQTGGILVLSTVPDPQNYLTLFLKIDNVRFRAQVLPGDTIIFRCDLMEPIRRGIAQMKGVGMVGGKVVVEAEMMAQIVKVKETETT

SEQ ID NO: 3556 - protein, 463 aa, Dyadobacter fermentans DSM 18053
MNEKQQTISKSVSVTGVGLHTGVVATMTFVPAPANHGYKFQRVDLPDQPIVDADVDNVVDLSRGTTIEQNGARIHTVEHTLAALVGLQIDNVLIQLDGPEPPIMDGSSIKFVDALLDAGIEEQNAYRNYFEVPEYVHYKNKDKDTELVALPLSDYRLTVMVDYNSTVISSQHASLNDITLFKDDIASCRTFVFLHELEALYKQNLIKGGDLTNAIVIVDREVRDGELDHLSQLLNKPKVSVDKSKGILNNVDLHYPNEMARHKLLDLIGDLALVGRPIKAQILAARPGHAANVALAKKIKKLIKSGKGDIPQYDPNKAPVFDINQIGQLLAHRYPFQMIDKIIALDENSVVGVKNVTINEQFFLGHFPGNPVMPGVLQLEAMAQTGGILVLSSVPDPDNYWPYLIGIDACRFRRNVFPGDTVIFKCEFTSPMKRGIVKMSGRGYVAGQLVCEADMIASLVKKK

SEQ ID NO: 3557 - protein, 471 aa, Chitinophaga pinensis DSM 2588
MDNQQSSNQHTIKDPVTISGVGLHTGAHVNMTLKPATPGYGIKFQRVDLPGQPVVKADVDYVVDTSRSTTLEHNGARVSTIEHIMAALVGTGVDNVHIEIDGPEIPIMDGSSYPFIQKIEEAGIAEQDAKKIWYTIDTNISFYDDKKNVEMVALPAVDYRITCMIDFNSPILGTQHANLNSLQDFKQEVAPCRTFVFLHELEYLISNNLIKGGDINNAIVIVDKAVSEEQLGHLAKVFNREHISVAQREGILNNIQLHFPNEPARHKLLDIVGDLALVGVPIKAHIIANRPGHASNVEFARKIKQYIKKNKHIKDMPVYDPSKPAVFDVPRIERTLPHRFPMLLVDKIIDLTDTQVVGIKNVTFNEPFFQGHFPSNPVMPGVLQVEALAQCGGILALSTVPDPHNYDTYFIKIDNCKFKQKVVPGDTMILKMELLSPIRRGIVEMRGTVFVGNKVVTEGDLTAQIIKTRES

SEQ ID NO: 3558 - protein, 428 aa, Clostridium perfringens SM101 uid12521
MFIDTAKIFVKSGDGGHGSVSFRREKYVPLGGPDGGDGGKGGDVTFVVDPGMTTLLDFKYKRKFVAGRGQDGQGSKCYGRDGENLTIKVPMGTIIRDVETNKVMADLSHRDDTYTICRGGKGGKGNCKFCTPTRQAPTFAEPGMPGEERWVALELKLLADVGLLGFPNVGKSTLLSVVTKAKPKIANYHFTTLKPNLGVVAVPGIEPFVMADVPGIIEGASEGVGLGLDFLRHIERTRLLIHVVDISGVEGRDAVEDFKRINEELKNYSVKLWDRPQIVVANKCDMLFDEEIFENFKAEVNKMGFDKVFKMSAATSQGVEEVIKEAARMLKDIPVTDLEIPEDERFIPEDKKFTYTINPIEEDGLKVYVVEGSFVDRLLLAVNVNDPDSLRYFHKVLNNKGIFHELREMGIEDGDMVRLNDFEFEYLL

SEQ ID NO: 3559 - protein, 428 aa, Clostridium perfringens ATCC 13124; identical to SEQ ID NO: 3558

SEQ ID NO: 3560 - protein, 424 aa, Clostridium thermocellum ATCC 27405
MFVDRARIYIKAGDGGDGAISFHREKYISKGGPDGGDGGKGGDVIFVVDEGLRTLQDFRYKTRYRAEDGQNGGSSNCSGRSGEDLIIKVPPGTLVKDEQTGRILADLVKPGKKVVIAKGGKGGAGNQHFATPTRQVPSFAKPGEPGEELWVILELKLLADVGLIGFPNVGKSTILSMVTAAQPKIANYHFTTINPNLGVVNIDAENAFVMADIPGLIEGAHQGVGLGHEFLKHIERTKLLIHVVDISGSEGRDPVQDFEVINEELKKYNPVLCERPQIIAANKMDVTGAEENLEKFRKVIEPRGYKIFPVSAASNKGLKELIYYAAQKLKELPDTVLVNDQDNEVVYTAVEEEPFNIRKENGVFVVEGSWVQRLVRSVNFDNYESLQYFQRAIRRKGIVDALESMGINEGDTVRMYDLEFEYFR

SEQ ID NO: 3561 - protein, 429 aa, Clostridium phytofermentans ISDg
MFADSAKIFIRSGKGGDGHVSFRREIFVPAGGPDGGDGGKGGNVIFEVDEGLNTLGDFRLKRKYSAGDGENGQKKRCSGKDGEDLIIKVPEGTIIKETETGKVITDMSHENRREVILRGGRGGKGNQHYATPTMQVPKYAQPGQKAMELNVTLELKVIADVGLVGFPNVGKSTLLSRVTNAKPKIANYHFTTLNPNLGVVDLDGADGFVIADIPGLIEGASEGIGLGHEFLKHIERTRVIIHLVDAASTEGRDPVEDIEKINHELSSYNEGLLLKPQVIAANKTDVLYGEEEEEAINKIKEAFESKGIKVFPISAVSGQGVKELLYYVSDLLKTVDATPIVFEKEYFPEENLVMSEPYTVEYNETEEVYVVEGPRIERMLGYTNIDTEKGFEFFQKFLKENGILDQLEELGIGEGDTVRMYGLEFDYYK

SEQ ID NO: 3562 - protein, 424 aa, Desulfitobacterium hafniense DCB 2
MFYDQAKIYVKGGDGGAGAVAFRREKYVPEGGPSGGDGGRGGKVIFIADEGLRTLVDFRYKRHYKADRGEHGQGKNMHGKSGEDMSVRIPVGTVVKDADTGEILADLIEHGQKVVVANGGRGGRGNARFMSNTNKAPTVAENGEPGEERNLLLELKLLADVGLVGFPNVGKSTIISRISAAKPKIADYHFTTLVPNLGVVELEDGESFVVADIPGLIEGAHTGAGLGHEFLRHTERTRLILHVLDIAGSEERDPLEDFQIIAEELRQYSQELANRPILIVANKMDIPGAEENLQRLTEKLGEDYRIFPVSAATGEGLKELVYAAAKALPEIPAPQIFVRDEEQHKLTQASAPHRFELTREGDFFVVSGKEVEKHVQMTMFDREDGLYRFQNILKAMGIERALLDEGIKVGDKVRIAGIEFEWEE

SEQ ID NO: 3563 - protein, 426 aa, Halothermothrix orenii H 168
MFVDEVEIKVKGGQGGNGVVSFRREKFEPMGGPDGGDGGDGGNVILRVDEGLNTLADFRYQRHYEAERGYHGSGKNKHGRSGEDLVLKVPPGTVVYDADTDELLADLTEDGEEYIVAHGGKGGRGNARFKKSTRKAPRFAEKGEPGEERSIRLELKLVADVGLIGFPNVGKSTLISVVSEARPKIANYHFTTLKPNLGVVALSEYKSFVMADIPGLIEGAHQGVGLGDEFLRHIERTRLLIHIIDISGIEGRDPLEDFKTINRELEKFNEKLSSRPQIVALNKIDLPGARENVERVQPVLEEKGYKVFPISAATKEGVKELIYYTGDLLKELPVERKIAKEDRIVIKPDFADEEENIVVEKKNGIYEVSGRLVEKYVIKTDFNNDAAVKRLLRVLQHHDLNELLRDKGVKNGDTVKIGPMEFEYME

SEQ ID NO: 3564 - protein, 425 aa, Clostridium cellulolyticum H10
MFRDSAKIYVKAGNGGNGMVSFHREKYIAAGGPDGGDGGKGGDVIFVVDEGLNTLIDFRYKKNFKAEPGQDGGTSNRSGKNGEDLIIKVPLGTVVKDELTDMVLVDLIKPGQTCVIAKGGRGGKGNQHFATPTRQVPNFAKSGDLGEEYSLILEMKMIADVGLVGYPNVGKSTILSMVSAAKPKIANYHFTTLVPNLGVVQIEHGKSFVIADIPGLIEGAHEGVGLGHQFLRHVERTKLLVHVVDVSGVEGRDAVEDFDTINSELQKYNQVLSTRPQIVAANKMDIPGAEENYKAFKEELEKRGYKVFGISAATNKGLKELLYAVSETLKTLPDTILLDETQNEEVVYKVQEEKPFEIHIEDGVYVIEGKWLRKVLGSTNITNYESLQYFQRALKKKGVITALEEMGIQEGDTVRIYDTEFDYTR

SEQ ID NO: 3565 - protein, 426 aa, Anaerococcus prevotii DSM 20548
MIDYARVSLKAGDGGNGAVAWRREKYEPNGGPAGGDGGNGGSIIIKATRNLSTLDEFRYKTKYKAQNGEAGGKKKKFGKKGDDLIIKVPVGTLVREANSEVIIKDLNKDGEEYVIAKGGRGGRGNVHFKNSIRQAPRFAELGRSGQEIEVIFELKILADVGLVGLPNVGKSTLISVISKARPKIANYHFTTIDPNLGVVNIDSERSFIVADIPGLIEGASDGSGLGHDFLKHVERCRVLVHLVDISGIEGRNPIEDFKMINEELKLYNEKLAQKPMIIAMNKSDLDFNKNSDEFINEFSDKYDIYKISAATTEGIKELVDAISELLAKSDIKEFDPMEEVDTEFLEKYYDREIEYDLNFRKENDIFVVDGKRVDKLLEKVDLEDYDGKMYFEKTLREMEVFDKLKEMGIQEGDSVAFGDLVFEYYE

SEQ ID NO: 3566 - protein, 759 aa, Pseudomonas syringae tomato DC3000
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELTLFQNALEGVRNDMRTLSAKLATQLRPEERALFDVYLMMLDDASLGSEVTNVIKTGEWAQGALRSVVSEHVKRFELMDDAYLRERASDVKDLGRRLLAYLQEERQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPGSVKGH

SEQ ID NO: 3567 - protein, 759 aa, Pseudomonas syringae pv B728a
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELALFQNALEGVRGDMRTLSAKLATQLRPEERALFDVYLMMLDDASLGSEVTDVIKTGQWAQGALRSVVSEHVKRFELMDDAYLRERASDVKDLGRRLLAYLQEARQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPSSVKGH

SEQ ID NO: 3568 - protein, 756 aa, Saccharophagus degradans 2-40
MLNDLRSIVQEVYAATDLSSVLEIIVRRVKSAMNTEVCSVYLRNETGAYTLMATDGLNREAVGRVTLAKNEGLVGLVAAREEPINLDDAESHPKYQYFAETGEERFSAFLGTPIIHQRQVMGVLVVQQAAKRRFDEGEEAFLITMSAQLAGVIAHAEATGTLRAMGSKSAVRFNGVPGASGVAIGECVVVSPVADLNAVPYATCDNIEEELAFFSRSLAAVREDVKRLGQSLENLLNKEERVLFDAYLGMLDDTSLAREVTEKISMGLAAPYAWSEVILDHVKTFSAMPDAYLRERASDVRDLGSRVLAYLQETTQKELVYPEKTILVGEDLTPSMLAEVPVGQLAGLVSVRGSSNSHIAILARSMGIPTIMGAVDLPFTKLNGREMVVDGYRGSVYIDPGEALLQSYQAILEEDLQLVAGLQSIKNLPCETSDHHRVALWVNTGLLADTMLSIERGAEGVGLYRTEVPFMLRDRFPSEEEQRLVYREQLEAFAPHPVTMRTLDVGGDKSLPYFPIEEENPFLGWRGIRVTLDHPEIFLGQVRAMLKASVGLDNLRIMLPMITNIAEVEIAQMLIHRAYDELLEEGYDVQMPPLGVMIEVPAAVYQAKELAARVDFISVGSNDLTQYLLAVDRNNPRVADLYHSLHPAVLRALRKIVKDAHSQGVPVSICGELAGEPAAALLLVAMGYDVLSMNATNLLKVKSVVRAVTLEQAETLLAEVMSLPDAESINRCLEAAFRHAGLNRMLRPDLGDDANI

SEQ ID NO: 3569 - protein, 748 aa, Serratia proteamaculans 568
MLTRLREIVEKVAAAASLTDALDLLVNETCLAMDTEVCSIYLADNDRRCYYLMATRGLKKPRGRAIALAFDEGIVGLVGRRAEPINLADAQSHPSFKYIPQVKEDRFRSFLGVPIIHRRQLLGVLVVQQRELRQFDESEESFMVTLATQMAGILSQSQLNAIFGQYRQTRIRALAASPGVAVAEGWQDSSQPSLDQVYKASTLDTASERERLTQALEEAGAEFRRFSKRFAASSQKESAAIFDLYSHLLNDARLKRELFAEIDAGSVAEWAVKQVIEVFAAQFASLQDTYMRERASDLRALGQRLLFHLDDTTQGATQWPARFVLVADELTATLLAEMPQDRLVGVVVRDGAANSHAAILVRAMGVPTVMGADIQPALLSQRLLIVDGYRGELLVDPEPVLVQEYQRLISEELELSRLAEDDVEQPAQLKSGERVQVMLNAGLSPEHEKLLGGRVDGVGLYRTEIPFMLQSGFPSEEEQVAQYQGMLQMYPNKPVTLRTLDIGADKQLPYMPISEENPCLGWRGIRITLDQPEIFLIQVRAMLRANAGTGNLGILLPMITSLEEIDEARRLIDRAGREVEEVLGYEIPKPKLGIMLEVPSMIFMIPHLAGRIEFISVGTNDLTQYLLAVDRNNTRVASLYDSLHPSMLQVLKLIAVQARAVGLQVSLCGELAGDPMGALLLVGMGYRNLSMNGRSVARIKYLLRHIELSDAEVLAQRVLNAQMTTEVRHQVAAFMERRGMGGLIRGGK

SEQ ID NO: 3570 - protein, 759 aa, Coxiella burnetii RSA 331
MNMLKILRQITQEVNAAPNLEQALKLVVVRLCEALPADACSLFICDDVHGEYVLMATQGLNSKQVGKLRLKFGEGLIGLVGEREEPINLADAPLHPAYKHRPELGEEDYHGFLGIPIIEQGELLGILVIQQLESHHFAEEEEAFCVTLAIHLAAEIAHARAKGALEKLGARKRRRRKTETVLYGVPGSSGVAIGTAMIVYPPADLDAVPDQEITDIEAEVSDFEAALAAARDEIQTLQARAKNSLSVAENALFDAYLRLLDSRTFINEVIHEIKEGQWAQGALKRIIKKHVLHFESLEDPYLRERAADFRDLGRRILAHLQFSEQEELEYPKNTILVSEEVTATSLIEVPQDRLRGVISGTGSSNSHVAILARALGLPAVMGVRGTPLFKLGEQEIIVDGYNGQIYLSPSAEIKKEFKALAEEEQQLDEELQALRELPAETKDGHALALYVNTGLAIEGGLSLSVGAEGVGLYRTEMPFMIRDRFPSEEEQRIMYRQLLNTFAPRPVIMRTLDIGGDKTLPYFSVEEDNPFLGWRGIRVTLDHPEIFLQQVRAMLHASEGLNNLSVLLPMITSINEVETATRMINQARDELIEEGINVELPSVGLMIEVPATVYQAFELAKRVDFLSVGSNDLIQYLLAVDRNNPRVANLYDGLHPAVLQALKIVVKAGHRAGKPVSICGEMAGDPLAVILLLAMGFDTLSMNARILPRVKWVIRNFEMAHAKELLDEALKMDDPKDIRLLMEHTLEEAGLGGLIRAGR

SEQ ID NO: 3571 - protein, 746 aa, Yersinia pestis Angola
MRLREVVEKVAMATGLTEALELLVNETCLAMDTEVCSIYLADNDRRCYYLMATRGLKKPRGRTITLAFDEGIVGLVGRLAEPINLADAQSHPSFKYVPQVKEERYRAFLGVPIIYRRQLLGVLVVKQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQVLAARVLTAQMTTDVRHLTAAFMERRGLGGLIRGGK

SEQ ID NO: 3572 - protein, 748 aa, Yersinia pseudotuberculosis YPIII
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPQVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQALAARVLTAQMTTDVRHLTAAFMERRGLGGLIRGGK

SEQ ID NO: 3573 - protein, 748 aa, Salmonella enterica serovar Heidelberg SL476
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPASPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 3574 - protein, 748 aa, Salmonella enterica serovar Schwarzengrund CVM19633
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 3575 - protein, 748 aa, Salmonella enterica serovar Agona SL483
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 3576 - protein, 748 aa, Salmonella enterica serovar Dublin CT 02021853
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 3577 - protein, 748 aa, Dickeya dadantii Ech703
MLTRLREIIEKVAATARLSDALEILVNEICLAMDTEVCSIYLADHDRQCYYLMATRGLKKPRGRTITLAFGQGIVGLVGERAEPINLADAQRHPSFKFIPAVREQHFRSFLGVPIIHRRQLLGVLVVQQREHRQFDKNEESFMVTLATQMAATLSQSQMKALFGQYRQTRIKALPAAPGVAIATGWQDRSQPSLELVFPASSLDSDRERARLLAAIGEAGVEFRRFSKRFSASAQKESAAIFDFYIHLLNDARLKRELLQEIDTGSVAEWAVKVVIERFAAQFASLQDTYLRERAGDLRALGQRLLFHLGDNAQNSAQWPERFILVADELTATLLAEVPHDRLAGVVAYDGAANSHAAIIVRAMGIPTLMGADIQPDLLHQRLLILDGYRGELLVDPEPVLVQEYQRLLSEENELTRLAEDNVSCPAELKSGERVEVMLNAGLSSEHEKRFINLVDGVGLYRTEIPFMLQNGFPSEEEQVAQYEAMLRLYPSRPVMLRTLDIGADKQLPYLSISEENPCLGWRGIRVTLDQPEIFMIQVRAMLRANAQVGNLSILLPMINCMDEIDEARRLIDRAAREVEEMLGVPQPRPRIGIMIEVPSVLFMLPHLASRIDFVSVGTNDLTQYLLAVDRNNPHVGSLYDSLHPAVLQALNMVVTLCRQHGLSVSVCGELAGEPMGALLLIGLGYRTLSMNGRSVARIKYLLRRIGQHEAQQLALKVLNAQTASEVRQWVSIFIEERGLGGLIRGGR

SEQ ID NO: 3578 - protein, 748 aa, Pectobacterium carotovorum PC1
MLTRLREIVENVAATARLSDALDILVNETCQAMDTEVCSIYLADHDRQCYYLMATRGLKKPRGRTVTLAFGQGIVGLVGQRAEPINLADARAHPSFKYIPAVKEQHFRSFLGVPIIHRRHLLGVLVVQQREHRQFDKNEESFMVTLATQMAAILSLSQIKTLFGQYRQTRVKALVAAPGVAIAPGWQDCTQPSLEQVFPASSLDSERERSRLTQALEDATAEFRRFSKRFSASAQKESAAIFDLYSHLLNDARLKRELFQEVDAGNAAEWAVKLVIERFAAQFTNLQDTYLRERAGDLRALGQRLLFHLDDNAQIMGQWPERFILVADELTATLLAELPPERLAGVVVYDGAANSHAAILVRAMGIPTLVGADIQPDLLHQRLLIIDGYRGELLVDPEPVLVQEYQRLLTEENELTRLAEGEMEQPAVLKSGERIQVMLNAGLSAEHEKRFINQVDGVGLYRTEIPFMLQSGFPSEDEQMAQYQSMLQLYPTRTVMLRTLDIGADKPLPYLPISEENPCLGWRGIRITLDQPEIFLIQVRAMLRANAHIGNLSILLPMISSLDEISEARRLIDQAAGEVEELLGFPQPKPRIGIMIEVPSMLFLLPHLASRIDFVSVGTNDLTQYLLAVDRNNAHVASLYDSLHPAMLQALNMIAVECERHNIPLSVCGEMAGEALGALLLTGLGYRSLSMNGRSVARIKYLLRQITLAESQALVQQLLGAQSAAEVRQWAAIFMEERGLGGLIRGGR

SEQ ID NO: 3579 - protein, 89 aa, Rhodoferax ferrireducens T118
MTEAKKSLKRTLVGKVVSDKRAKTVTVLIERRVKHELYGKIVGKSSKYHAHDETGEYKLGDIIEITESRPISKTKNWVATRLVQKAAVV

SEQ ID NO: 3580 - protein, 89 aa, Polaromonas JS666
MTEAKKSLKRTLIGKVVSDKRAKTVTVLVERRVKHELYGKIVSLSSKYHAHDEKGEYHTGDVIEITESRPISKTKNWVVTRLVEKAAAV

SEQ ID NO: 3581 - protein, 89 aa, Acidovorax avenae citrulli AAC00-1
MTEAKKSLKRTLVGKVVSDKREKTVTVLVERRVKHPIYDKIVIKSSKYHAHDENSEYKLGDTIEITESRPLSKTKNWVATRLVQKAALV

SEQ ID NO: 3582 - protein, 89 aa, Acidovorax sp. JS42
MTEAKKSLKRTLVGKVVSDKRAKTVTVLVERRVKHPIYDKIMIKSSKYHAHDENGEYKMGDTIEITESRPLSKTKNWVATRLVQKAGLL

SEQ ID NO: 3583 - protein, 89 aa, Polaromonas naphthalenivorans CJ2
MTEAKKSLKRTLIGKVVSDKRAKTVTVLVERRVKHELYGKIVSLSSKYHAHDEKGEFKTGDVIEITESRPISKTKNWVVTRLVQKAEIV

SEQ ID NO: 3584 - protein, 89 aa, Verminephrobacter eiseniae EF01-2
MTEAQKSLKRTLIGKVVSDKRQKTVTVLVERRVKHELYGKIIARSSKYHAHDEKGEYKLGDMIEITESRPLSKTKNWVASRLVQKAGLL

SEQ ID NO: 3585 - protein, 90 aa, Methylibium petroleiphilum PM1
MTTQETVKNTRTLVGRVVSDQRSKTITVLVERRVKHELYGKIVARSRKYHAHDENNEYKLGDLVEIAEGRPISKTKAWVVTRLVEKARVV

SEQ ID NO: 3586 - protein, 89 aa, Delftia acidovorans SPH-1
MTEAKKSLKRTLIGKVVSDKRAKTVTVMVERRVKHPIYDKIMIKSSKYHAHDEQGEYKLGDVVEITESRPLSKTKNWVATRLVQKAALV

SEQ ID NO: 3587 - protein, 98 aa, Leptothrix cholodnii SP 6
MSEAQTAVAAAAPAVKNTRTLVGKVVSDKRAKTVTVLVERRAKHELYGKIVARSRKYHAHDENGDYKMGDVVEISESRPLSKTKNWVVTRLVEKARAV

SEQ ID NO: 3588 - protein, 89 aa, Diaphorobacter TPSY uid29975; identical to SEQ ID NO: 3582

SEQ ID NO: 3589 - protein, 89 aa, Variovorax paradoxus S110
MTEAKKSLKRTLIGKVVSDKRAKTVTVLVERRVKHELYGKIVAKTSKYHAHDEKGEYKLGDTIEITESRPISKTKNWVVTRLVEKAVLV

SEQ ID NO: 3590 - protein, 247 aa, Chromohalobacter salexigens DSM 3043
MTGAPFTGLLLLLLAHLAGDFLLQSAAWVHDKQVRGHRSTALYLHAGIHGGLACLALLVGGQPVGAAILGAAFITVTHFGIDVLKSQAPSERIGYFIADQALHVGVLVLTWLWLTGDAAWLALATGWLLRPEVLLVALAYGVVMRPFSILIAMIMRRWSHGVDNSGTLADAGARIGMLERFLVLTFVLADQLVPIGFLLAAKSVLRFGDLREDRDRKLTEYVLLGTMLSFSLTITLGILVAQWRHAM

SEQ ID NO: 3591 - protein, 239 aa, Pseudoalteromonas atlantica T6c
MVLFLLMIAAHILGDFYIQKDSWVTCRNNHHFASWGLGKHVLSHVVLLTTAIWLAGFLTAQGWIAIVVIGFSHLLIDVWKSYQPNKLSYFLLDQFFHIVIIALAALALSGIGLAEIKTQLYLLLKVKYVAITCAYVIACRPVSIAITIALDNYTAQLADKQTGLASAGRWIGYIERCLIISFVLIGQFAGVGFLLAAKTIFRFGDLTKEKDMKLTEYMMLGTLLSFSCALLLGWWVNRL

SEQ ID NO: 3592 - protein, 245 aa, Cytophaga hutchinsonii ATCC 33406
MDNYVFFTEEQGNILIRLLLAHLLSDFVFQTKKMVAGKSWFSRYLIAHAAIVYLCTALFTGWWVIAFVIAASHYIIDGLKIEAQKKMFAGELVLFVTDQILHIAILIFLWAYQFDLMHLLFNMFTASLNDYTISLVMLGYLIVTTPAGYVIAFTTKNMMKENSESGNNERGGKNIGIYERIIILTFVLLGQYEAIGFLITGKSIIRFVNKDEHIRSEYVLLGTMMSYMFAIVTGVLIKLLLADYN

SEQ ID NO: 3593 - protein, 272 aa, Shewanella frigidimarina NCIMB 400
MFDFFSVLIPFLLIHTICDFYLQTDRWVEAKKARTYRSPELYLHATLQGVALLVPAMALGIDWRSTVCLIVIVAVSHFIIDLWKVTTPKGDKLAYFVIDQALHVSVLAAIAFHVADGASIEAVLQHERFSDGVLVVFAYVLILKPTSIVIGAVLNKYPIVNSAMDTDTDAVTDTDGVAEPVSDKTANVSGLVAGGELIGYLERLLILTFMLVGSYAAVGFVLAAKSIFRFGELNQSANRSMTEYVLIGSLISVVITTLIGVLVSLGVGIKFK

SEQ ID NO: 3594 - protein, 238 aa, Flavobacterium johnsoniae UW101
MILFVKLFLGHLLGDFIWQPNSWVADKEIKKHKSIYLYVHIFLHGILAAILAGEISFIPYAVLIAVTHGIIDLIKLNFQKKKNKRTWFVADQIAHILILIGVVFLYENKTVPNFWTNNEFWIFLTGILLLTKPASIFIKTIISIWAPESKIDNQDNSLIAAGNYIGILERLFVFGFILTNHFEAIGFLLAAKSIFRFGDLKEAKDRKLTEYVLIGTLISFGAAILAGLIVQALLLQLP

SEQ ID NO: 3595 - protein, 257 aa, Serratia proteamaculans 568
MDLSYLPLLIWLLIAHLLADFPLQPRSWVEDKIRHRAGSRFLLLHALLHGVLAAWVVAVFALLYGGISSAQVLFALLVIAISHWLTDLLKVTLLTRLSQARGFLLDQGLHLTVIVLLWLLLTPNALALISVLASAAARWQSGLLLLAYLLIYMPMGILMGQLLARWTPQMPPSAKADNDSLLRAGKQIGYLERTLILTFVLIGQIPAIGFLLAAKSIFRFGDLRQSDDKMRTEYVLLGTLFSFTLTIMLGLLVKKLL

SEQ ID NO: 3596 - protein, 241 aa, Caulobacter K31
MLETLVALLTAHVLADFLVQTDAMVAAKDTPKGMAQHIACVVILAGLAIGSLNPPVLGVIFITHLAMDLTKTHLMQKMAGWLSFTLDQVVHLAVIVALAVIWPDVARQGFWGQLPADLQSLYYSGLIIAAGLTVAVLVGGIVMDMMMRSIVTKIGETPKGIDGGGRLIGWLERALIFFFIVYGQPEGVGLLLGAKSILRFGDIQQAKEQAHTEYVIIGTMLSFGWALIVAVVSKAAVAHWR

SEQ ID NO: 3597 - protein, 280 aa, Alteromonas macleodii  Deep ecotype
MLADNLDTSMVTTIEQPELLVGLLLAHILADFYFQPFAWVKQRNERHALALPLYIHTLIHGVFAGAVLLLLSENISLTTIGVGAIIIAVSHFKIDVIKSYCVQSTTAFVIDQIAHVVVLLGVFLYATDQWQYVLSALRQLSAGDLVITLAYLAVLKPSSIVIKQLLSPWSSEVLSSNTQTTHPNDPPTISTEAQQTLSLAGQRIGYLERVLMLTFVLLNQFSAIGFLIAAKSIFRFGDLTKHQDRKLTEYVLLGTFTSVAMTLVIGLLCAAALGRLPIKP

SEQ ID NO: 3598 - protein, 277 aa, Pedobacter heparinus DSM 2366
MELNLLLRLLVAHLLTDFIFQPKSWVKDREEKQGKSIKLYLHVLVTTVFAYIFSGQYNNWVIPLVIFVSHLIIDYIKSKVNKDNFNYFIADQLAHLLVIVLLSVSFSWNCKAVLSFANDTFGNYKFWILVAGYLFVSWPLGIIIGKATQKWRDQITRESILNSAPTLPGIDISEPAENQSEEQPQPLAEVIKSGEEQELGLASAGKWIGICERVMILTFVLMGQYTAIGFLMTAKSILRFSEKEANTQLKTEYVLVGTLVSFATSAMIGVLMNLTLK

SEQ ID NO: 3599 - protein, 247 aa, Dyadobacter fermentans DSM 18053
MKEFLLLLLAHILVDFYWQPTRWVTDKKEKKYKSRYLYFHTLLVIIVSYIALHQWKNPLPAILLGIAHGVIDLVKISFDKKGSLTWFIADQAAHLATIALTAVILTSSIPIGFQSFITWINTPKTLATVSGALLSLSPVSFLVGILTRPWREELSKLAPDADDNLANAGRWIGMSERLLIFVFVLVNQYSAIGFLIAAKSLLRYNDKATDTGIPPAYISKKSEYVLVGTLMSYTCAIAVALAAKMLR

SEQ ID NO: 3600 - protein, 127 aa, Candidatus Methanosphaerula palustris E1 9c
MLYQYLLYLILLVGYIIILWPSGYAIRRFLENFEFENKFKKDETGLNSSQKHAGTYIGYFERFLILIFMLTDQFVAIGFLITAKSIFRFEKSPRGIVEYFLMGTLMSYAIAISVGEIMQYLIIMIQS

SEQ ID NO: 3601 - protein, 76 aa, Shewanella sp. MR-7
MSNITINIDAPFLRYAEYAKRTGTTVDNVRYLVKVGKLPIRPKQSPKEDPMINMVALFAEAAALCGTQTIQANHIS

SEQ ID NO: 3602 - protein, 66 aa, Shewanella baltica OS155
MNQIALQIATPYVTFEQYATLSGIPFNTVREMAKTGRLPLRPKDRPKEKPLINMLALTREAMEQKY

SEQ ID NO: 3603 - protein, 73 aa, Enterobacter sp. 638
MTPNISITLNTPHVTIERYSELTGLPVDTINDMLADGRLPRHRLRKDKKREKVMINIVALTVDALSDCNVTIN

SEQ ID NO: 3604 - protein, 70 aa, Vibrio cholerae O395
MLTYEVAPESPYVTCEKYSVISGLPMGTIRQYIAEGRIIIKPKTKTKEKPLVNMVAMHEIAAREAMQVLG

SEQ ID NO: 3605 - protein, 73 aa, Escherichia coli HS
MRPNISITLTTPHVTIERYSELTGLSIDTINDMLADGRLIRHRLRKDKKREKVMINIAAMTVDALSECNLNLN

SEQ ID NO: 3606 - protein, 73 aa, Escherichia coli C ATCC 8739; identical to SEQ ID NO: 3605

SEQ ID NO: 3607 - protein, 76 aa, Yersinia pseudotuberculosis YPIII
MPSNITISLTTPHVTKERYSELTGLSIRVIESMLDDGRLSTYRHRLKKDGGREIVLINLAALTIDAISSHEIKFSH

SEQ ID NO: 3608 - protein, 139 aa, Methanosarcina barkeri fusaro
MNSELINSGLMNLMILLPFQVFAEKKGVSRIVAEGREGSFGLLPHRLDCVAALEPGILTYETELEGEVYVAVDEGVLIKTGQDVLVSVRDAIFGTELSQLQEAVEKEFLTLDETEQKIRSVMVKLETGLIRRLAEFQNV

SEQ ID NO: 3609 - protein, 151 aa, Burkholderia pseudomallei 1710b
MGAELRVTIATPARVCVDDLPIVSLRAEDASGAFGIRAGHVDFVTLLRASVVRWRTADGATHYAALDGGVLRVTRGARIEIACRDAVLGESLAELEAVVRGVRATQLDEKRRARVDETRLHAQAVRRLLTYLRPEHAKDGVHAPLKPETLE

SEQ ID NO: 3610 - protein, 126 aa, Pelobacter carbinolicus
MRLRVQTPAERILDCPVTKVVAEGLNGSFCLRPRHVDLVSAVVPGLFYYETAEGQGHYIALDRGLLVKRETLVSVSVRNAVAAGELEDLLEVVQLRFKALDEQERVVRSAVARLESDFLRRFMELS

SEQ ID NO: 3611 - protein, 129 aa, Chlorobium luteolum DSM 273
MRLELLLPFGVFSVTEKVTRIVAETNCGSWGFLPGRRDCVASLVPGILEYETLESGVSFVAVDCGILVKKGSDVVVSVRQAVGGVELGALEKAVKEDFLELDEHERTMHSALARLESSFIRRYVEFYHD

SEQ ID NO: 3612 - protein, 130 aa, Nitrosospira multiformis ATCC 25196
MDLKILLPFSVFMEKARVDRIVVETVDGSLGLLPHRLDCVAALVPGILIFETRSEGEIYVAVDEGILVKVSAQVTVSVRNAVEGTNLAVLHETVDREFLNLDERAKSIRRTMAKMESGLIRRFIELHHER

SEQ ID NO: 3613 - protein, 151 aa, Burkholderia thailandensis E264
MAAELRVTIATPARVCVDDLPIVSLRAEDASGAFGIRAGHVDFVTLLRASVVRWRTADDAMHYAALDGGVLRVTRGARIEIACRDAVLGESLAELEAVVRGVRETQLDEKRRARVDETRLHAQAVRRLLTYLRPEHAKDGMLAPMKPETLE

SEQ ID NO: 3614 - protein, 129 aa, Rhodoferax ferrireducens T118
MNLKVLLPFHIFAEKSGVSRIVAETREGSFGLLPHRLDCVAALTPGILIFETAAEGEVYVAVDEGVLVKIGPDVLVSVRRALGGKNLDKLRDAVEQEFLTLDEREQSVRSVMAKLEAGFLRRFASFQHE

SEQ ID NO: 3615 - protein, 151 aa, Burkholderia xenovorans LB400
MSKDALRLTIATPSRVWFDAVEIVSLRAEDASGSFGIRIGHADFVTQLTSSVVRWTGTDNVLRYCAVNGGVLLVSGGATVSIACREAIPGDSLEGLEAIVRSRHADEDEAARRARVDQMRLHARAVRQMLRYLRPRAGADGANPAGTGATL

SEQ ID NO: 3616 - protein, 139 aa, Burkholderia xenovorans LB400
MSPTLRLTISTPASLLVNAQAIVALRAEDGSGSFGILPGHADFLTVLTPCVLRWRGTENIRRFCAVEEGVLRVSEGHSVTIACRSGMLGDSLAALEAQIETARARTLDTARNARVEQTRLHAQAVRQLLRYLRPSRGDA

SEQ ID NO: 3617 - protein, 129 aa, Pseudoalteromonas atlantica T6c
MDVNILLPYQVFATLGDVTNLVIETPSGSHGILPQRLDCISPLVPGILTYQQGAQQSQFIAIDQGIMVKTGAQVMISVRRAIRGSSLQKLQQAVKQEFLALDQEQQALRTVLAKLESGFLKQFSALSKH

SEQ ID NO: 3618 - protein, 146 aa, Rhodobacter sphaeroides 2 4 1
MSLTLRVTTPLAAVLEEEGLASIRAEDASGGFGLLPGHVDLLTVIEAGVLRFRRPEGPWHFCAIRGGVLRATGGRLVTVACREAVPGEDLARLEAGLKRQAEAADQAARRARGEQVRLHANAIRSLMRHLDRAPGADLSGIVEAFE

SEQ ID NO: 3619 - protein, 136 aa, Shewanella frigidimarina NCIMB 400
MQSAHMNLKILLPYKVFAEQKNVVRIVAVTHQGSFGILPHRLDCVASLTAGLLVFEYDGADEVYVAIDEGVLVKTGFDVLISVRNAIGGLALSELHQAVEQEFMHLDEQEQQLRSVLIKMESNFMRRLTEFHHDRV

SEQ ID NO: 3620 - protein, 133 aa, Psychromonas ingrahamii 37
MAAQIQLKILLPYATFAEKLDVERIVAETNLGFIGILPNRLDCSAVLTAGIFCYQCKNKAEVFIAVDQGILVKTGFNVLVSVRRAIGQADLSRLHALVKKEFLVVDENEKRLQATMVKLETGFLRQLGNFQHQ

SEQ ID NO: 3621 - protein, 131 aa, Polaromonas naphthalenivorans CJ2
MSMNLKILLPFRIFAEKTAVSRIVAETQAGSFGLLPQRLDCVAALTPGILIYETASDGEVFVAVDSGVLVKSGAEVLVSVRRAMGGANLGELRQAVEQEFLTLDEHEQNVRAVMAKLETGFLRRFATFQHD

SEQ ID NO: 3622 - protein, 146 aa, Rhodobacter sphaeroides ATCC 17029
MSLTLRVTTPLAAVLEEEGLASIRAEDASGGFGLLPGHVDLLTVIEAGVLRFRRPEGPWRFCAIRGGVLRATGGRLVTVACREAVPGEDLARLEAGLKRQAEAADQAARRARGEQVRLHANAIRSLMRHLDRAPGADLSGIVEAFE

SEQ ID NO: 3623 - protein, 151 aa, Burkholderia mallei NCTC 10247; identical to SEQ ID NO: 3609

SEQ ID NO: 3624 - protein, 151 aa, Burkholderia pseudomallei 668; identical to SEQ ID NO: 3609

SEQ ID NO: 3625 - protein, 151 aa, Burkholderia pseudomallei 1106a; identical to SEQ ID NO: 3609

SEQ ID NO: 3626 - protein, 150 aa, Bradyrhizobium BTAi1
MNLTVTTPLAIIAKADHVVYVRAEDDTGAFGILRGHADFLTALAISVLSWRDEGGGEHHIAVRGGMLAVHDGNAITIATREAVADDDLHRLETEVLASFRRRSEDEVTARTDAQRLYLAAIRQIYRFLRPDRPVPVPRLAGPMSQEGLES

SEQ ID NO: 3627 - protein, 138 aa, Marinomonas MWYL1
MPQAYMTLKVLLPHKVFSEEQKVLRIVATTPQGAFGILPNRLDCVASLSAGILVIEVEGEEEAYIAVDEGVLVKTGADVRISVRNAMNGMGLEDLRHALEDEFIQLDEQEQKMRSALTKMESGFVQRLVAFKQDASLS

SEQ ID NO: 3628 - protein, 136 aa, Dinoroseobacter shibae DFL 12
MTMATEMRVYLRLPSRIMFDGSAVRLRGEAPNGSFGILPNHVDLVTPLVSSVLLIAQADGTERIFGIDEGLLVKKGHRVEVAVRRAVETDDLDQMRDIVRDSFAGLEDEERAARAALSRLEADMVRRFASLRKAQG

SEQ ID NO: 3629 - protein, 153 aa, Beijerinckia indica ATCC 9039
MSAALHLSITTPSAVLIDQADIVSLRAEDESGGFGILPGHADLLTVLRASVVRWHARDDIIHYCVVRSGVLTVTEGQRIAIACRQGTTGDDLTRLEEDVAAMRAEEVDAGRRARVEQLRLHAHAVRQLMHYLHPGQTVDAEIMGAAVQDTEEI

SEQ ID NO: 3630 - protein, 143 aa, Burkholderia phymatum STM815
MTDPTLDLTIATPAQVVVDGLPIASLRAEDESGGFGIHAGHEDMVTLLSASVVRWTTPDGHAHCCAVDGGVLIVSNGAAVSIACREAVQGESLQRLEANVHGVRAAQLDAMRRARVEQTRLHAHAVRQMLRYLRPQRARGVGE

SEQ ID NO: 3631 - protein, 152 aa, Burkholderia phytofirmans PsJN
MTGARLTLTLATPSRAWFDAVEIISLRAEDESGSFGIHVGHADFVTLLTPSVVRWICADGVTRYCAVDGGVLLVSRGTQVSIACREAIPGDSLESLEEAVRRHHAVEDDAARRARVDQLRLHARAVRQMLRYLCPRSGADGADDAATGVMPQ

SEQ ID NO: 3632 - protein, 139 aa, Rhodopseudomonas palustris TIE 1
MRLRIVTPLSVVVEEDGVLVVRAEDATGSFGILPGHADFLTNLAISVVSWKNGNGIRHCCAVRRGVLSVSGGQDVAVATREAVLGDDLATLGETVLARFRADIEAERTEHVETTRLQLNAIRQIMSHLRSDRRGARIFS

SEQ ID NO: 3633 - protein, 134 aa, Prosthecochloris aestuarii DSM 271
MSSDSMRVELLLPFRIFLRRDRVRRIVVETSKGSYGLLPNRLDCVMILVPGIFTYETEAEGEAYVAVDRGILVKTGPQVFVSVHHATGGVDLGELEEAVKRDFLAIDEREQSVRTVLAKLESGFIRQFAEFHNE

SEQ ID NO: 3634 - protein, 146 aa, Azotobacter vinelandii DJ
MSLPLRLRIVTPQQVLVDCTDVVAFRGEDASGGFGLLPGHVDYLTVLVPTVLRWRRAGGEQGFCAVHGGVLSLSGGELRVACREGIVGERLEQLEAQVREARETRRDSARRARVEHLRLHTQAVRQLVRYLRAEGETPFDPEGEPR

SEQ ID NO: 3635 - protein, 135 aa, Desulfomicrobium baculatum DSM 4028
MPQPTFMRLKILLPFGIFAEKTGVSRIVAETREGSLGLLPHRLDCVAALAPGILVYENEAEGEVYVAVDEGGLVKTGPDVFVSVRNAVGGKDLALLRETVEQEFLDINEREQVVRSVMAKMESGFIRRLAEFHHE

SEQ ID NO: 3636 - protein, 492 aa, Flavobacterium johnsoniae UW101
MKNIKITLSLLLVISLSSCDEFLSEIPDNRTQIDTPEKISELLVTAYPSKSYAVIGETMSDNVFDSEMTSSDVDNRQSFNWEMQTQLGPDTEADFWNACYEAIAASNQALVAIDELGSPESLNPQKGEALIARAYNHFMLVSYWSQRYNPSSAATDLGVPYVTKPEGALLAQYKRNSVKEVFDLIEQDIIEGMKYITNNYKEPKYHFNIDAAKAFACRFYLIKGDWDKVLEYSKGLGSKPTTLRDYVAFNAAASAQKPLEYSKAEQPTNLLVAYPNSTARRGYTNRFYLSDNRSDEILGSDTNIWGKPWLIYTSSFYENNVLIPKFYEYFKYTNVTAGIGEAYTGVVLLSNDEFFLNRIEAYVMKNQFAEANAGLEYLFSLRTQGYNAATDKITEANIAAMYPVIADEYTPFYTLSPLQASYIKAIAEARRREYIQEGLRWFDIKRFNLVVEHITKENGKAVRTNVLVKDDKRRALQIPQRASDNGIEKNPR

SEQ ID NO: 3637 - protein, 497 aa, Capnocytophaga ochracea DSM 7271
MNTPMKNILYTTTRIVAIGLLFASCDKFLDEVPDTRTEIDTPEKVQELLVSAYPDALYMDIAETMSDNAGDKISLTETSILNTELYQWKDSKETRQDAPTFYWGAAWGAIASANHALEAVEKLGGGSSLNYLKGEALVARAYAHFMLGLLWCKPYNPATASSDLGLPYVTAAEKVVFAKYTRLSVEEYYKAIEKDLEEGLPLIDNTSYSKPKFHFTKEAAHIFATRFYLVKGEWAKVIAHANEALGSNPAAKVRDINKINTLTTLQRQAQYSSTSEPSNALITGASSVYQRNLSRNKYGMTATLSVYLSQRSLHPLDMPWAYDFQGGNENIQNIPKYQEYFKVNNVSAGTGYPYGMATLLLYDEALLNRMEAYVMTGQTAKFIEDLKVYLPFKTGETLDVNNITETALNTKYNGKGTELSPAYTLNTPQRQMLQCLLDLRRIEFVFEGLRWFDIKRFGLKVIHQKGNQTLELNKGDLRRELQIPEDALAAGITPNPR

SEQ ID NO: 3638 - protein, 481 aa, Pedobacter heparinus DSM 2366
MKKYTIYFFLFMAIAGVGCNKYLDHAPDDRTKLNTPTKVAELLVTAYPRGNAVLLSESMSDIPAFVSALGIDFPVNQNGYYWKDVEAVDQDSPTYYWNACYTAIATANQALDAIEKASDPQQYAAQKGEALVARAYAHFMLVTFFSKCYDPATAETDPGIPYVTTPESVVFKSYERKTVAYTYQQIEKDLLEGIPLIQDKYTVPAYHFTRKAAYAFACRYYLFKKNMDKVIEYANLTFPANNFADNVRPWKSYAAYNVQELETAYMNAGNPGNLLIGETVSRLARNYKRPIYSISQNRLRIILAPVGVTFTALPIYSNSSTYYYLIKFAEHFVRTSINASSGTGYTMVPLLTTEEVLLNRAEAYIVQGKYTEALADMNTMISTRVTAYSPSANDLTEAKIKSYYANVTTDTKQAYINALLDIKKAEFVHEGMRWLDILRHKLPVVHRDAAGNEFNLAAEDKRKVLQIPSQVTLSGVEQNPR

SEQ ID NO: 3639 - protein, 496 aa, Dyadobacter fermentans DSM 18053
MIIRNDMTTIKKIKTIVLILPLLALAGCEDFLSKEPDSTRAIINTPKQVSQLLTTAYPQAGYIVFSEGMSDNVADKGVGEDDKTNRASFFFEVVEATVDEQDSPDQYWAECYRAISVANEALDIISKVADPDKYNAQKGEALLARAYAHFMLVNYYCQFFDPQQSNNSPGVPYVTVPEDVVIKQYERGTVAGVYQMIEKDLLEGLPLISDGSYTVPKYHFNIAAANAFASRFYLVKRDYQKVLQYANAAIPANSLAENLRPWNTTYSSLSPEELFRLYSRANQNANLLLIETSSTYGRYVANYRYGLTYPKWQEISDSERIITGNAGWTYPLYYRGENNYFIPKLTEYFVRESVNAEIGLPYVMLPAFTVEEVLFNKVEANAYLGNSAASLADLNTYVSKRVDNYDASEHKVTAASMQSYFRKNNVRDNIVETVLAFKRVEFVQEGMRWFDIQRYKRTVTHEARNGSVISVPAGDNRRVLQIPQTAALSGIAQNPR

SEQ ID NO: 3640 - protein, 482 aa, Chitinophaga pinensis DSM 2588
MQRKALYILLAILPSVTGCKKYLDQQPDSTWTQLDTPEKVSQLLGTAYPQANYMTFCEAMSDNVADKGTGVDVRTNRDPFYFDDVQNINQDSPEYYWAAAYTAIAAANNALIACENAKDTAAYSRQKGEALVARAYAHFMLVNIFSRSYDATTANADMGIPYVTEPEEVVFKQYDRKTVAYVYDQIEKDLLAGLPLIRDDKYKVPKYHFNQKAAYAFAARFYLYKRDYQKVITYADMAFTTGQAVSYLRPWNTSYVFLSPLELFNIYSNSSENANFLLVETNSSYGRNLAQYRFGMNFPMYRAIMGSNVTGGDWCFPAYTYGTADYFIPKLSEYFVKESVNATIGYIYTMVPLFTAEEVLFNRAEANAQLGNTTAVLADLNTYAGTRITNYDASADVVTLAKCKSYYGLSDSKGALLNAVLDFKRAEFVQEGTRWFDLMRYKVPVTHVTSQGQTMILGADDPRRVFQIPVSAKTSGLPLNPR

SEQ ID NO: 3641 - protein, 484 aa, Chitinophaga pinensis DSM 2588
MTKFFTRASIIAGCLIAMAGCNKYLDKSPDSTWTELDSPAKVSQLLGTAYPQANYIVFAEAMSDNVEDKGAGVTDRTNLDPYFFNDVSATEQDSPEYYWQACYAAIAAANNALKACEAAPDKSRYTAQKGEALVARAYAHFMLVTFFSKFYDEATAATDPGIPYVTEPEKVVNKQYERKTVAYTYQMIEKDLLAGLALISDENYAVPRYHFNKSATYAFATRFYLFKKDYQKVLEYANQVFPNNDLASNMRPWNTTYKTLSPAAIWDTYAKATEKANLLLVETQSMYGRYVAQYRYGLTYNKQIEILGSNVSGGSYAYPLYYYGTRDYFVPKLTEYFVKASVNATIGDPYVMIPLFTTEEVLFNRAEANAYLGNNNDVLTDLNLFASKRITNYNAASHRITQTKIRTYYGITDVRGGLLQTILDFKRAEYVQEGHRWFDIQRYKAAVTHYTDKGAKMVLETGDKRRVLQIPSSATNSGITLNPR

SEQ ID NO: 3642 - protein, 484 aa, Chitinophaga pinensis DSM 2588
MKKITYYIIAATLITAAGCKKYLEQSPDQRTQLNSVEKVAELLATAYPQADYATFTEAASDNAADKGTGGFLTEQINTNPYFFRDVTEREQGSPTNYWNACYQSIAACNQALEAIAKADNPEDYNAQKGEALVARAYNHFMLVTLFSKVYNATTAAQDPGIPYVTTPEKIVNAKYERKTVAFVYEQIEKDLLTGLPLLDNTAYKVPKYHFNKAAANAFAARFYLFKKDYQKVITYSNNVFPGGNFKTNLRPWVTVYSQLTGTEMEAIYTKASETANLLLVEAPSNWARSVASYRYGLRTDLVYGLYGDPNVTTGSWVQPLYYRGSTENWLILKFREHFVRSSANADIGVPYTIFPLFTAEEALFNRAEANIHLGNNTAAKKDLDDYASMRIENYNSDFRITDTKLRTFYKTSDIKTALINALLDFKRAEFMQEGTRWFDILRYDLPVTHTSVTGESATLTANDPRRLFQLPQEVVLAGIQQNPR

SEQ ID NO: 3643 - protein, 404 aa, Dehalococcoides ethenogenes 195
MEIGQFELSELEKKTREELLDIAKEMGVNGVTALKKQDLVMRLIQVYTESQGNVFCSGILEIMPDGYGFLRQASLLPSSSDIYVSQSQIPPFRSSYRHGNRAGTPCQAGKILQSSAGGSHQPPNGQTPPQFWCFSSHFPPPYKPGNYAARTCHPPYKPDSPHRPGTARPYRFPAQSRQDHHFEKYSQCNRYQLRYTYNGSPYRTPGSNRYAPPRTGSYGRHLRTGGKPDPGSRTGTGTGKAYGGKRQRRLYPAGRYYPPYPCLQSGHAFIRPHPFWRYPGRPPPRQEILRGCPQYRRGRFAYHHCHLSGRNRQPHGPYLRRIQRHRQHGTSSGAPPGRTPCLPCPGHLPFKHPPGTPAGKLQAGTAFAEDGGYHRRQPLYRGRARAGPPAPLQECLPGPPERNV

SEQ ID NO: 3644 - protein, 425 aa, Deinococcus geothermalis DSM 11300
MTEPQTVPLPFHELQQKILPELHLIAAQNGIENYRKLKKEALALAILERQAEAEGQVLARGFLDISPDGYGFLQSDLLDPASRSVLVTAGVIKQFHLRTGDEVIGRARRPRENERYGTLVQVEAVNGLDPETARKRPRFDDLTPTFPDRQLVLEDPQMDDGLSLRVVDLLVPIGRGQRALIVAPPKAGKTTLLKKIANSIVKNYPDVTVMVLLVDERPEEVTDFRESVQGAQVIASTFDEPPQHHVRVAEFVHERARRIVEEGGHVVILLDSITRLARANNLVTPPTGRTLSGGLDSNALHWPKRFLGAARNIREGGSLTILATALVETGSRMDDVIFEEFKGTGNAELVLSRRLEERRIFPALDILKSGTRREELLLQPEVLKKMWLLRKVISDMDPADAMEMLLSRMGKTRNNVEFLQSLAGG

SEQ ID NO: 3645 - protein, 429 aa, Moorella thermoacetica ATCC 39073
MNTAELESKTMVELYRIARELNLSGYSRMRKKELVFEIAKALAQKEQQEHQEEAREEQLQAQGILEILPDGYGFLRPFGYLASGDDIYISASQIRRFDLRTGDKVAGLVRPPKDNERFFALLRVEKVNGENPETAAERLHFDALTPIYPSERYTLETANGDPSARIIDLIAPIGKGQRALIVSPPKAGKTVLLKKIANAIKTNYPEVELMILLIDERPEEVTDIERSVRGEVISSTFDEFPENHVKVADMVLERAKRLVEHKKDVVVLLDSITRLARAHNLVVPPSGRTLSGGVDPTALYKPKRFFGAARNIEEGGSLTIVATALIETGSRMDEVIFEEFKGTGNMELILDRRLAERRIFPAIDVKRSGTRREELLLSREELELVWNFRRVSSGMGPVEVTETLIDAMKKTKSNQDLLRALPALFPREH

SEQ ID NO: 3646 - protein, 450 aa, Desulfotomaculum reducens MI-1
MAENDRPVMTQAQLEAKTMQELYGIARELEIPGYYKFRKKEIIFEISKLQSKQSGVSYAGGVLEILPDGYGFLRPSTYVPSNDDIYVSNSQIRRFDLRTGDMVYGQVRKPKDNERYYGLLRVEQVNGARPELAAERMHFAGLTPLYPQDRIRLQTTPDKISTRIIDLISPLGKGQRGLIVAPPKAGKTILIKEIANSITANHPEIELFILLIDERPEEVTDIERSVKAEVVSSTFDEPPENHVKASDMVLERAKRLVESGRDVVILLDSITRLARAHNLVIPPSGRTLSGGVDPAALHKPKRFFGAARNMEEGGSLTILATALIETGSRMDDVIFEEFKGTGNMELILDRKLADRRLFPAIDIQRSGTRREDLLLSKEELDYVWSLRKVIAGMSSIEALESLLDRLKNTRANDEILHDFKPKTRVQPLNPNLDVSQPPGQKRPYRRKIQE

SEQ ID NO: 3647 - protein, 424 aa, Dehalococcoides BAV1
MEIGQFELSELEKKTREELLDIAKEMGINGVTALKKQDLVMRLIQVYTESQGNVFCSGILEIMPDGYGFLRQASLLPSSSDIYVSQSQIRRFGLRTGDMVIGQGRPAKPGEKYYSLLRVEAINDLNPEMAKRRPNFGALVPTFPDRLINLETSPTELATRLINLIAPIGRGQRGLIVSPPKAGKTTILKNIANATATNYNDIHIMVVLIGERPEEVTDMRRHVRGEVMAATFDEPVENQTRVAELALERAKRMVESGKDVFILLDGITRLTRAYNLAMPSSGRTLSGGIDPVALHPAKKFFGAARNTEEGGSLTIIATCLVETGSRMDDLIYEEFKGTGNMELHLERRLAERRVFPALDIPRSSTRREELLLGDNYKQVQLLRRMVAIIADDANHFTEVNERLLDRLRRSKNNAEFLANLQKEM

SEQ ID NO: 3648 - protein, 492 aa, Candidatus Desulforudis audaxviator MP104C
MSATALENKTLAELQNLAKELKIPAYYRYRKKELIAEIERIQQDLRPTREASPPEAEPVPVPPTALVEQRRQEPREAALHYHPQTQPYPPPHHDTGRMLPDRSRLFQAQGYLEILPEGYGFLRPSQFLPSNDDIYVSASQIRKFDLRTGDLVSGQVRPPKDTEKYLALLRVETVNGEEAALAGRRRHFDELTPLYPQERLTLETSPDRIAARIIDLISPLGKGQRGLIVAPPKAGKTTLLKEIANSITSNHPEVVLMILLIDERPEEVTDIQRSVKAEVIASTFDEPAENHVRVTEMVLERAKRLVEHKKDVAILLDSITRLGRAYNLVVPTSGRTLSGGVDPAALHKPKRFFGAARKIEEGGSLTILATALIETGSRMDEVIFEEFKGTGNMELILDRRISERRIFPAIDVQRSGTRKEELLLTSDELELMWYFRKTTNQMSSSDAMEHLIEEMRRTRSNRDLLRNFQAFKQAAGGPPEGWMMPGPPIHRK

SEQ ID NO: 3649 - protein, 546 aa, Eggerthella lenta DSM 2243
MSETEATTEAPAAAPVKRRSTSVKAKTQGKAEGAATPGRNSSATRTPRKSVKAGGAQQQQPQGGSNNRRQNASNAGKQNNGGSNRQKQGGGQNRQNNSQNQRRQRRQHDNNRGNREVQPSVSREELAKLKVAELREKAAELNLDVTGLKKAELVEAVFEASVKAEGFIEVSGILDILADGYGFLRTQGYLPSETDCYVGLSTIRRNGLRKGDLVSGQTRPARENEKYAAIQKVTAVNGTPVEELGSRVRFGDLTPVYPDECLVMEHGKNTVTARVIDLVSPIGKGQRGLIVSPPKAGKTTILKDIAAAISANNPEVHLMCLLVDERPEEVTDMERSIKGEVISSTFDMPTENHIAVSELVIERAKRLVECGKDVVVLLDSLTRLARAYNLAQPASGRILSGGVDSTALYPPKRFLGAARNIEHGGSLTILASALVDTGSKMDEVIFEEFKGTGNMELKLDRNLADRRIFPAIDPVASGTRKEDLLLEPQEAPLIWAVRRILANTNSTERAMDMLIKSLKQTETNQEFLVRTAKKAQHTKADGSLEF

SEQ ID NO: 3650 - protein, 638 aa, Cryptobacterium curtum DSM 15641
MSDSETTDSVPEKPATPTRRKRTTASKSKDESPSTQTRRRRTGTEDLSDAAPSPSRRRRSSAADENASADAASARSTRRAASKDADQSAPNKVDEGTSPSQPAQQHRRRTRRIETGTDAPAAHESAIPASERQDSSSTGERRPKGRVKRHQSQNRFERGDNRSDNRTGNAARSGTNSSRSNGNGNRQQGNGNGQNRRQQRYNRPDNASASPKLSIEDLSKLKVAELREKADALDIDWKGLLKADLVKAVYDATLKKDGFVEAEGVLDVLADGYGFLRTEGYLPSEHDVYVGTSLIRRQHLRKGDRITGQIRPARSGEKYGALQRLYTVNGIPADEVGERPRFKDLTPVYPDERLVMEHGRTSITSRVIDLAAPIGKGQRGLIVSPPKAGKTTVLKQIAASIAQNNPECHLMCLLVDERPEEVTDMQRSVHGEVISSTFDMPAENHIAVAEMVIERAKRLVEMGKDVVILLDSITRLARAYNLAQPASGRILSGGVDSTALYPPKRFLGAARNIEFGGSLTILASALIDTGSKMDEVIFEEFKGTGNMELKLDRNLADRRIYPAIDPVASGTRKEDLLLDQQEAPLIWAVRRILANMNNTERSMDMLIKSLKQTETNQEFLLRTAKKAQGRRLEDNLEL

SEQ ID NO: 3651 - protein, 685 aa, Slackia heliotrinireducens DSM 20476
MSDNLTPEETAPEAVEAPKKRTARRTAKKTAEAVPEATTQEVSADAEPVKKPRRRTVKKADEASAAETPATEAPAEEAPKRRGRPRKAVAEPATAPAAEAPATETPAEEAPKRRGRPRKTAVKENPTAEAAPEAAPEVAPEAAPAMAEPAAQPETAADSADVAPAPTAAEAEAEERPLPKRRPRARAHTVETKSSEAAADAQAQGESQPAADSSDGKRQQFQKQNKQNKQQGKQNNKQQQNGKQQRRQRRNNAQPTGPSVSLEELNELKVAELREKAELLGVDFAGLKKASLVEAVFEATKKAEGIFEVEGILDILQDGYGFLRTGGYLPGENDIYVGTALIRRNGLRKGDYVKGQTRPARDNDKYAALQTIHSVNGKSLDDLAGRPRFGDLTPVFPDEILKMEHGRNTTTARVIDLVSPIGKGQRGLIVSPPKAGKTTILKDIAAAISVNNPEVHLMCLLVDERPEEVTDMQRSIKGEVIASTFDMPTENHIVVSELVIERAKRLVEDGQDVVILLDSLTRLARAYNLAQPASGRILSGGVDSAALYPPKKFLGAARNIEGGGSLTILASALIETGSKMDEVIFEEFKGTGNMELKLDRNLADRRIFPAIDPVQSGTRKEDLLLNPQEAPLIWAVRRILANMNNTERATDMLIKSLRQTKDNQEFLIRTAKKAQTTRNMDNMEL

SEQ ID NO: 3652 - protein, 436 aa, Desulfotomaculum acetoxidans DSM 771
MNQSDLEAKTMVELYKIAKELEIVGYSKLRKKELIFEIIKIKTEKTGLLFASGVLEILPDGYGFLRPFKYHPSYDDIYVSASQIRRFDLRTGDRVGGQVRKPKDNERYFALLRVEQVNGIDPQVAAERIHFDGLTPLYPQERITLETSSERKSTRIIDLIAPLGKGQRGLIVAPPKAGKTILLKSIANSITTNHPEIVLIILLIDERPEEVTDIERSVNAEVVSSTFDEPPENHVKVADMVLERAKRLVEHKKDVVILMDSITRLARAHNLIVPPSGRTLSGGVDPAALHKPKRFFGAARKLEEGGSLTILATALVETGSRMDDVIFEEFKGTGNMELVLDRRLAEKRIFPAIDVQRSGTRKEELLLTKDELELTWFFRKNIHGLNPWDAMEMMMEKIRGTQNNAELLQNFKQSRKATPGRLNNPEIPTNNTRKIL

SEQ ID NO: 3653 - protein, 434 aa, Alicyclobacillus acidocaldarius DSM 446
MDIRELEEKKLTELYKYAREFQIPHYGSMKKKELIFAILKAQAERDGLMFAEGVLEIMPEGYGFLRPVGYLPSQEDIYVAASQIRRFDLRTGDLVSGKVRPPKENERYFGLLHVEAVNGYSPEVAAERLHFAALTPLFPSKRIVLETTPENLATRLIDLFAPIGFGQRGMIVAPPKAGKTVLLKEIAHSIATNYPDVHLFVLLIDERPEEVTDMQRSVKGEVIASTFDEVPENHIKVSELVLERALRLVEHKQDVVILLDSLTRLTRAYNLVVPPSGRTLSGGIDPAAFHRPKRFFGAARNVEEGGSLTILATALIDTGSRMDDVIYEEFKGTGNMELHLDRRLAEKRVFPSIDIRRSGTRREEALMPKEELEKVWAIRKSMGDNQDFTEMFLRKFRHYKTNKEFLDSLSLNRVERKPVASAEKPAAQPVTSET

SEQ ID NO: 3654 - protein, 87 aa, Ralstonia solanacearum
MKKRLVLLISAGMFLAGNALAQDTMKKDEMGKDAMGQSGSMAKDTMGKDHKSKSHTKKMHEKGGMSKDAMGKDAMGKDSMGKDSTKQ

SEQ ID NO: 3655 - protein, 93 aa, Dechloromonas aromatica RCB
MKTITSSIFAACLMLVGSSAFADDMMKKDAMSNDGMAKDGMKKETMSKDHMAKDGMKKDAMTKDGMKKDAMKKDGMAKDPMAKDAMGKDEMKK

SEQ ID NO: 3656 - protein, 93 aa, Polaromonas JS666
MNKLTATLLATCMAIGSVSAFAADEMKKDAMGKDAMAMDGMKKDAMSHDAMAKDGMKKDAMGKDAMAKDGMKKDAMSHDAMAKDGMKKDEMKK

SEQ ID NO: 3657 - protein, 83 aa, Polaromonas JS666
MKTLTASLLSACMLFAGASAMAQDAMKKDDMKKDAMGKDAMAKDAMKKDHMAKAGMAKDGMKKDAMGKDAMGKDAMAKDEMKK

SEQ ID NO: 3658 - protein, 107 aa, Serratia proteamaculans 568
MREGNTMKKLFAVMMCSALMLGSIGANAADSMSKDAMKKDNMGQMSHDGMAKDGMKKDAMKKDCMGKDCMKKDSMSKDAMKHDGMKKDSMAKDGMKKDEMKKDAMGK

SEQ ID NO: 3659 - protein, 104 aa, Delftia acidovorans SPH-1
MTKLTTTLLATCLALAGATTAFAADEMAKDGMSNGAMSKDSMSKDGMKKDSMAKDGMKKDSMSKDGMKKDSMSKDGMHKDGMHKDGMSKDGMKKDSMGKDAMSK

SEQ ID NO: 3660 - protein, 77 aa, Burkholderia phymatum STM815
MKRLMTAVCFATLAMGTTAAFAQASGAMSNDAMSKDAMSHDAMKKDTMSHDTMKKNSKTKKHDAMGMDHPASGAMSQ

SEQ ID NO: 3661 - protein, 100 aa, Gluconacetobacter diazotrophicus PAl 5 JGI
MSIRNIAIAAAFSSVVALGGVAHAQDAMSHDAMAPKQMAPNSMAHDSMPKNGMAHNTMAPNAMSHNGMSHDSMKKHGGMAHHGMKKDAMAAPQDSMAKPN

SEQ ID NO: 3662 - protein, 98 aa, Gluconacetobacter diazotrophicus PAl 5 JGI
MSIRHLMVAAAIWSNIAVVGTAVAQDSMSRDAMAHDGMARNAMSHDKMAPNAMSQDAMRKHADTTRHGMEKNAMSGESMSHDGMMMAPSHENGMSRPN

SEQ ID NO: 3663 - protein, 83 aa, Variovorax paradoxus S110
MNKLTATLFATCIAFAGASAFAADDMAKDGMAKDSMAKDGMKKDSMAKDAMSKDGMKKDGMSKDGMKKDGMSKDAMGKDEMKK

SEQ ID NO: 3664 - protein, 300 aa, Acidovorax sp. JS42
MPVMRSTPDAGSSQRAVHAWLLLLPALVLLVAFTHWPTLATLIDSFHSTPRGGRAGVWVGLENYAAMVDDPVFWQAVRNNLWFAGATIPLSIGLALIMALWVNERMVGRTWVRMAYFTPTVLPMIAVANVWLFFYTPQYGLLEQITSLLGLPSRNWLGDPATALACVTVVAVWKEAGFFMIFYLAALQTLNPSLKEAAAIEGASRWYFFRRVQWPLLMPTTLFVLVNAVINAFRLVDHLFILTRGGPDNASTLLLYHLYEVGFKFWDTGYAAALTVVLVVALAGVALVQFFVFDKRVHYQ

SEQ ID NO: 3665 - protein, 290 aa, Mycobacterium tuberculosis F11
MRDAPRRRTALAYALLAPSLVGVVAFLLLPILVVVWLSLHRWDLLGPLRYVGLTNWRSVLTDSGFADSLVVTAVFVAIVVPAQTVLGLLAASLLARRLPGTGLFRTLYVLPWICAPLAIAVMWRWIVAPTDGAISTVLGHRIEWLTDPGLALPVVSAVVVWTNVGYVSLFFLAGLMAIPQDIHNAARTDGASAWQRFWRITLPMLRPTMFFVLVTGIISAAQVFDTVYALTGGGPQGSTDLVAHRIYAEAFGAAAIGRASVMAVVLFVILVGATVVQHLYFRRRISYELT

SEQ ID NO: 3666 - protein, 296 aa, Opitutus terrae PB90 1
MIAWKQSQRRAAPWFLLPALALLGVFVVWPLLRALGWSFTNADLLAVERATWVGAGNYSDLLTDPRFRQAFANTALFAVMVVPVQTALAFALALWVNRPEPAWRWLRTAFFVPVIVAMPVLAVLWTMLYQPTQGDQTGLINAALGWLGVPPQAWLRDPALALPALAFMSVWQGVGLQMLVFVAGLQQVPRELLDAARIDGAGGWQRLVHVVLPSVRNTVVFVVTVTTILAFRIFVQPYLMTRGGPGNRTVSIIQSIYEMTFLDQDLGHACAAALLFLLLVAALTLLQRRWLKEDRG

SEQ ID NO: 3667 - protein, 288 aa, Methylobacterium sp. 4-46
MRPSLRPLLPYGLLLPSLIFLALFTYWPVAEVLWDATHAVSRRTTRFVGLDNFAALFADPSFRTSLLQTGLYALLTVVPSLVLAVALALALDGGGRLRALLRAAFFLPVMIPLVGAAALFLFLPGTGLIDYHLAKLGLSGANWLGDPDLALLSIAALTVWKNAGYYMLFVLAGLQAIPAELREAALLDGAGPWQRLRFVILPALRPTLAFVLVIALLNVVTQVDHVFVLTRGGPSDATKLFLLYIYEQAVERYDGGRAAAATVVMLAILIALTAASLRRVERRSEEAP

SEQ ID NO: 3668 - protein, 300 aa, Diaphorobacter TPSY uid29975
MPVMRSTPDAGSSQRAVHAWLLLLPALVLLVAFTHWPTLATLIDSFHSTPRGGRAGVWVGLENYAAMVHDPVFWQAVRNNLWFAGATIPLSIGLALIMALWVNERMAGRTWVRMAYFTPTVLPMIAVANIWLFFYTPQYGLLEQITSLLGLPSRNWLGDPATALACVTVVAVWKEAGFFMIFYLAALQTLNPSLKEAAAIEGASRWYFFRRVQWPLLMPTTLFVLVNAVINAFRLVDHLFILTRGGPDNASTLLLYHLYEVGFKFWDTGYAAALTVVLVVALAGVALVQFFVFDKRVHYQ

SEQ ID NO: 3669 - protein, 292 aa, Beutenbergia cavernae DSM 12333
MSTRRRADTAAAYALLTPSLIGVGLFLLVPVVIVIGISFTRWDLVSPPQWVGLDNYVYIFGWPTFRNSLWVSVLFTALTIPTTIALGLILAVAINRRLPGTNALRVLYVLPWVCAPLALGVVWRWIFDPTNGALNALLGRRVEWLTDLNLALPSVAFVQVWSSVGYVSLFFLAGLQQIPNQVYEAARLDGASAPRTLWSITVPLLRPTMFFVLVTSIISSFQVFDSIYAMTRGGPGVPGRTDVIAARIYDEAFVALRLGRAAAMAVVLFAVLVTITLLQQRYFRRRITYDMS

SEQ ID NO: 3670 - protein, 287 aa, Brachybacterium faecium DSM 4810
MNSRRPLLGWLLVGPSLIGVAAFMILPVVLAFVVSLFRWDLLGTRRFIGLENYQTLITGGALGNSLLVTGIFTLISVPVSLAIGLLLATQLVRTLPGSAIVRVLVVIPWVCAPLALGVVWKWIFQPSVGALNQILGVRIEWLTDPSLALPAVAFVAIWQNVGYISLFFQAGLTRIPDSIYEAARIDGAAPWQSMLYMTIPLLRPTTFFLAVTQVVASFQVFDMVFALTGGGPQHRTEVIASLIYNEAFVASRLGRASAVAVILFLLLVVITLIQQRWFSKRITYDMS

SEQ ID NO: 3671 - protein, 416 aa, Ralstonia solanacearum
MKFPYEWQIGWRYTRASKRASRNSFISFISLISMLGIALGVAALIVVLSVMNGFQKEVRDRMLSVLSHIEIMAPGSLPDWQRTANEAMQNKEVVGAAPYVGAQAMITRDDAVRGVLLRGVSPADEPKVSDIAKDFKSGTIDDLRPGEFGIALGAEMARGLGVRQGDKVTLVAPQGTITPAGVLPRLKQFTVIGTFESGHYEFDSSLALINMEDAERLFRLTGPTGVRLKLVDMQRAPQVAEALSRTLTGELYIRDWSRQNKNWFAAVQTEKKMMFIILTLIIAVAAFNLVSTLVMTVTDKQADIAILRTMGAQPGSIMKIFIVQGVAIGFIGTLLGVLFGTLIAYNIDVIVPAIEHLFGVQFLPKDIYFISELPSDPRVNDIATIGLISFVLASVATLYPSWHASRVNPAEALRYE

SEQ ID NO: 3672 - protein, 416 aa, Ralstonia eutropha JMP134
MKFPYEWQIGWRYTRASKRASRNTFISFISMISMLGIALGVAALIVVLSVMNGFQKEVRDRMLSVLSHIEVIGPSALPDWQRTAAEAMRNKEVIGAAPYVAAQAMLTREDAVRGVLLRGVDPAEEPKVSDIGKQFKAGHMESLQPGEFGIALGNELANAMGVQVGDKITLLAPQGTITPAGVLPRLKQFTVVGVFSSGHFEFDSALALVNIRDAETLFRMTGPTGVRLKLADMQRAPQVANELAGTMSGELYLRDWSKQNRNWFAAVQTEKRMMFIILTLIIAVAAFNLVSTLVMTVTDKQADIAILRTMGAQPGSIMKIFIVQGVAIGFIGTLLGVAGGTLIATNIDVIVPFIERLLHVQFLPRDIYFISELPSDPRVNDIATIGIISFVLATLATLYPSWRAARVNPAEALRYE

SEQ ID NO: 3673 - protein, 416 aa, Cupriavidus metallidurans CH34 uid250
MNFPYEWQIGWRYTRASKRASRNTFISFISMISMMGIALGVAALIVVLSVMNGFQKEVRDRMLSVLSHIEVIGAAPLTDWQKTAAEALRNKEVVGAAPYVAAQAMMTREDVVRGVLLRGVDPAEEPKVSDIANQFRAGSMNALAPGGFGIALGSELANALGVRVGDKVMLVVPQGTITPAGMLPRLKQFTVAGVFSSGHYEFDSALALINIGDAETLFRQSGPTGVRLKLQDMQRAPQVAQELAGTMSGDLYLRDWSKQNRNWFAAVQTEKRMMFIILTLIIAVAAFNLVSTLVMTVTDKQADIAILRTMGAQPRSIMKIFIVQGVAIGFIGTLLGVLGGTLIATNIDVIVPFIERILHVQFLPKDIYFISELPSDPRMNDIATIGIISFVLASLATIYPSWRASRVNPAEALRYE

SEQ ID NO: 3674 - protein, 427 aa, Ruegeria sp. TM1040
MAATAPFSRFEWMIAWRYLRARRSEGGVSVMTWISLIGITLAVFALIATLAVRSGFRSEFVGTILGANAHATVYAHGTVTAAGTLDRRITDYAALAEAVGQVPGVLQAAPLIKGQVMASRGDRNAGVQVYGIHAEDLAKIPGVAQSDVAYGDLGRFDDGIALGSGVARTLGLGIGDKVKLISPNGVKTAFGTSPRVNAYEVVYVFTAGRYDIDNTRAYLPFAEAQSYFNREGVADEIEVMVADPEAVDQYVLPLLQAAGQGYGVWSWRDSSGGFLRALEVEDNVMFVILSILVLIATMNIVSGLIMLVKNKGRDIGILRTIGLSEGSVMRVFFICGSITGVIGTVLGVILGCLFAIYIDPIFSFVNYVMGGGVWDPSIRGIYALPAELRAGDVISAVSLSLGLSFVVTIFPARRAARLNPVEALRYE

SEQ ID NO: 3675 - protein, 428 aa, Rhodobacter sphaeroides 2 4 1
MADRTRPFAAFEWMIAWRYLRARRAEGGVSVMTWISLVGITLAVFALIATLSVRAGFRAEFVDTILGANAHVTVYSAGRITETGQLIRGFEDYDPVAARVAAVPGVLRAAPVVKGQVMATANGASSGVEVFGMRQADLATIPRIGIGAEHVGDIERFDEGIALGSGVAQELGVSVGDRVRLISPDGVKTAFGTSPRVSAYEVVYVFTAGRYDIDRTRVYMPLAEAQSYFNREGLADEIEVMVEDPEAVDAMAPALMQAAGEGSMLWTWRDSAGSFLRALTIEDNVMFVILSILVLIASMNIVSGLIMLVKNKGRDIGILRTMGLTEGSILRVFFLCGASTGLIGTAAGVALGCLFTIYIDPIFSLVNYLSGGGVWDPSIRGIYALPAKLQWADVLSAVALSLGLSFFVTLIPARRAARMNPVEALRYE

SEQ ID NO: 3676 - protein, 433 aa, Paracoccus denitrificans PD1222
MASTAPFSRYEFMIAWRYLRARRAEGGVSVMTWISLIGITLGVMALVATLAVRAGFRAEFVDTILGANAHSTVYYAPTQVYNELTEETYVTQGRIEDYDALAARIAQIPGVTRAVPAVRAQVMARQGDAAALGDVHGITLDALGGMAGIADPESASGSLDDFDQGIAIGIGMARNLGVRIGDRLQLVAPDGAKTPFGTTPRVESFEVVYIFSAGRYDVDQARIYMPLAEAQSFFNREGLADEIGVYVADPERVDDWTMPLLQVLGERGQIWTWRDASGSFLAALDMEDDVMFIILSILVLIASMNITSGLIMLVKNKGRDIGILRTMGLTEGSVLRVFFLCGAFTGVIGTIAGVVLGVLLSLNVDHIMAALNMLTGGNAWQPEVRGIYQLTAELRGWDIFRAAALSLALSFIVTIFPARRAARMNPVEALRYE

SEQ ID NO: 3677 - protein, 417 aa, Burkholderia mallei SAVP1
MKLPYEWQIGWRYTRAGKRTTGNGFISFIALVSMLGIALGVAALIVVLSVMNGFQKEVRDRMLSVLAHVEIFSPTGSMPDWQLTAKEARLNRSVIGAAPYVDAQALLTRQDAVSGVMLRGVEPSLEPQVSDIGKDMKAGALTALAPGQFGIVLGNALAGNLGVGVGDKVTLVAPEGTITPAGMMPRLKQFTVVGIFESGHYEYDSTLAMIDIQDAQALFRLPAPTGVRLRLTDMQKAPQVARELAHTLSGDLYIRDWTQQNKTWFSAVQIEKRMMFIILTLIIAVAAFNLVSSLVMTVTNKQADIAILRTLGAQPGSIMKIFVVQGVTIGFVGTATGVALGCLIAWSIPWLIPMIEHAFGVQFLPPSVYFISELPSELVAGDVIKIGVIAFALSALATLYPSWRGAKVRPAEALRYE

SEQ ID NO: 3678 - protein, 428 aa, Rhodobacter sphaeroides ATCC 17029
MADRTRPFAAFEWMIAWRYLRARRAEGGVSVMTWISLVGITLAVFALIATLSVRAGFRAEFVDTILGANAHVTVYSAGRVTETGQLIRGFEDYDPVAARMGAVPGVLRAAPVVKGQVMATANGASSGVEVFGMRQADLATIPRIGIGAEHVGDIERFDEGIALGSGVAQELGVSVGDRVRLISPDGVKTAFGTSPRVSAYEVVYVFTAGRYDIDRTRVYMPLAEAQSYFNREGRADEIEVMVEDPEAVDAMAPALMQAAGEGSMLWTWRDSAGSFLRALTIEDNVMFVILSILVLIASMNIVSGLIMLVKNKGRDIGILRTMGLTEGSILRVFFLCGASTGLIGTAAGVALGCLFTIYIDPIFSLVNYLSGGGVWDPSIRGIYALPAKLQWADVLSAVALSLGLSFFVTLIPARRAARMNPVEALRYE

SEQ ID NO: 3679 - protein, 417 aa, Burkholderia mallei NCTC 10247; identical to SEQ ID NO: 3677

SEQ ID NO: 3680 - protein, 417 aa, Burkholderia pseudomallei 668
MKLPYEWQIGWRYTRAGKRTTGNGFISFIALVSMLGIALGVAALIVVLSVMNGFQKEVRDRMLSVLAHVEIFSPTGSMPDWQLTAKEARLNRSVIGAAPYVDAQALLTRQDAVSGVMLRGVEPSLEPQVSDIGKDMKAGALTALAPGQFGIVLGNALAGNLGVGVGDKVTLVAPEGTITPAGMMPRLKQFTVVGIFESGHYEYDSTLAMIDIQDAQALFRLPAPTGVRLRLTDMQKAPQVARELAHTLSGDLYIRDWTQQNKTWFSAVQIEKRMMFIILTLIIAVAAFNLVSSLVMTVTNKQADIAILRTLGAQPGSIMKIFVVQGVTIGFVGTATGVALGCLIASSIPWLIPMIEHAFGVQFLPPSVYFISELPSELVAGDVIKIGVIAFALSALATLYPSWRGAKVRPAEALRYE

SEQ ID NO: 3681 - protein, 417 aa, Burkholderia pseudomallei 1106a; identical to SEQ ID NO: 3680

SEQ ID NO: 3682 - protein, 428 aa, Rhodobacter sphaeroides ATCC 17025
MAGRTRPFAAFEWMIAWRYLRARRAEGGVSVMTWISLVGITLAVFALIATLSVRAGFRAEFVDTILGANAHVTVYSAGQVSETGQLIRGFDDFDPVAERLRTVPGVVRAAPVVKGQVMATASGRSSGVEVFGMRQADLATIPRIGHGSGHVGDVGRFDEGIAIGSGVAQELGVTVGDRIRLISPDGVKTAFGTSPRVSAYEVVYVFTAGRYDIDRTRIYMPLAEAQSYFNREGRADEIEVMVTDPEAVDAMGPALMQAAGEGSMLWTWRDSAGAFLRALTIEDNVMFVILSILVLIASMNIVSGLIMLVKNKGRDIGILRTMGLTEGSILRVFFLCGASTGLIGTALGVVLGCLFAIYIDPIFSLVNYVSGGGVWDPSIRGIYALPARLQWQDVLSAVSLSLALSFFVTLIPARRAARMNPVEALRYE

SEQ ID NO: 3683 - protein, 420 aa, Geobacter lovleyi SZ
MALPFELKIGLRYLKAKRKSTFISIITFISTAGVTLGVMALIVVLAVMTGFERDLKEKILGTNAHLVVIRSGAPMDDYRSMMERLQQLPGVEAVTPFIYNQVMLSTGRHVSGVVLRGIDPASDKKVTRLSRTIVQGTMDSLDPPRGSDADPGIMIGRELAKHLNLFLGDRVNVVSPTGTITPLGMMPKLKPFKVTGIFNTGMFEYDSTLAYVSINQAQKFFDLGDTVTGIQLKVADVYATTELAKKINRTYGPDLYARDWMQMNRNILFALKTEKVVMFIILTLIVLVAAFGIASTLFMVVMEKTRDIAILKTMGARSGSIMKIFVLEGLIIGVVGTVLGVLSGLLISFNLEPIINLVQKVTGKNFFSKEIYYLDHFPSHVVMSDVLIISVTAILISFLATLYPAWQASRMLPAEALRYE

SEQ ID NO: 3684 - protein, 377 aa, Pseudomonas syringae tomato DC3000
MDSSAAFSNPTKLRADLLRGRLDVSVDSSTIAPDSLFGFAERRNPKRAFLFVSRVLGRHIPARPSVMLKSFQDLAHKIPVDLPGPVLVIGMAETAVGLGAGVHRAYSETHSDALYLVSTRHPTGTELFARFEEEHSHASAHLIHLPADPALRDMMLGARSLVLVDDEASTGKTFINLHQALVEAGLSKIERVVTCVLTDWSAGAVSTSMGAVAEQVSLLQGSYSFDEDVSAPLPDMPEVGTVAMGDWPLLTANDWGRMGVLAVADTLAPGLTVNKGERVLVVGTSEFVWRPFLLAERLEKAGADVHFSSTSRSPIALGHAIDHALSFSDNYGLGIPNFLYNVRPGQFDRVLICTETPRQAVPAELIEALNAEVICDE

SEQ ID NO: 3685 - protein, 377 aa, Pseudomonas syringae pv B728a
MDSSAAFSNPTKLRADLLRGRLDVSVDSSTIAPDSLFGFAERRNPKRAFLFVSRVLGRHIPARPSVMLKSFQDLAHKIPADLPGPVLVIGMAETAVGLGAGVHRAYSATRADALYMVSTRHPTGSALFARFEEEHSHASAHLIHLPVDPTLREMMLGARSLVLVDDEASTGKTFINLHQALVDAGLSKLERVVTCVLTDWSAGAVSTSMGAVAEQVSLLQGSYSFDEDSSAPLPEMPEVGTVAMGDWPLVTANDWGRMGVLSVADTLAPGITVKKGERILVVGTSEFVWRPFLLAERLEKAGADVHFSSTSRSPIALGHAIDHALSFSDNYGLGIPNFLYNVRPGQFDRVLICTETPRQAVPAELIEALNAEVICDE

SEQ ID NO: 3686 - protein, 423 aa, Psychrobacter arcticum 273-4
MSNKQHSTTITLPRGTLDLTYQTNAASGNNDLKESSRYQLEDLLDFAQRINPKRAFLFVSKVLGRHIPVAPSTMRDAFTDLANLVPDDLPEPILVIGMAETAVGLSAGVHQALQTRYPQALLLNSTRHAQHDNDNTNNLLTTFSEDHSHASQHLIYQSADKVTQAQLLASKTLIMVDDEASTGNTCVNVVTALRNAGLMQLQQVHLTTLVDWSLNQNQTDAKADDTIASRLPNIDFYRHHLLSGAWKWTDAPNPEPIIMPSVDTTEAGSQALAHTGHWGRFPTLDSTDGFANYLASFQTTFAIFDGQTAFDNAQLPQKILVLGSNEFVWLPFLLAEWLEQNADTVIDNQVIKFSALTRSPIALGGGISTMLSFHDNYGLGMTNFAYNVDPSNWDLIVLCVETSADGVDAMWQDLDNVLIVSPK

SEQ ID NO: 3687 - protein, 372 aa, Nitrosococcus oceani ATCC 19707
MSHTIHLAAGTLTIEVHQALLPLHDLLDFASRINPKRGYLFVSKVLGKHIPCQPSRMRDIYNRLALSLLEIPGPAIFIGMAETATGLGAGVADSLVRRTQRCDIVFQHTTRHSLPVSEWMRFDEAHSHAPEHILYLPLPVFRERFSQAQTLVLVDDEISTGRTLRELSYRVIQALPHIRQIMLVSIVNWLSPAQKQVFQENVNRPVSFVSLLEGVFSFIPNLEFSPSLPGKARLFQPARHACQQTGRRGIEIGEKFQVSNGPYPKERKVSVVGTGEFQFQPFLWAEQLERKGFDVLFQSTTRSPIRVGGPIGESLSFKDEYGGGIHTYLHNPPRGREVIIAYEFAELARNHNLPEQLGGSIWGAAANTGWDG

SEQ ID NO: 3688 - protein, 375 aa, Burkholderia 383
MESHVGPTCLRAQLKRGLLEIRVDAAALPPANLFGFAERRNPKRAFLFVSKVLGRHIPARPSIMAASFERLAAGIPADLPGPVLVIGMAETAVGLGAGVHRAYRADRPDSVYLTSTRHPLGTEVFARFDEEHSHASAHLIHVPVDPEIRDLMLKARSLVLVDDEASTGKTFLNLHRALVEAGLSNVERVVTCVLTDWTAGTVRQSIGEPVTAVSLLTGSYRFHEDQSAPLPDMPNVGAVSMSAWPLSPRHDWGRLGVRDVDDTLAPDVQVQPGEKVIVVGTGEFVWRPFLLAERLERSGADVHFSSTTRSPIALGHAIEHALSFPDNYGLCIPNFLYNVKPGQFDRVLICTETPAQALPAALVEALKAEVIVDER

SEQ ID NO: 3689 - protein, 386 aa, Rhodospirillum rubrum ATCC 11170
MTFIDSPLSQTIALAGGDLHVAVARSDLPLGALCGFASRRNPKRPFLFVSKVLGRHLPVRPQVMRMVHRRLAAKLPANLPGPVVAIGMAETAICLGQGVFEAWRGGSGREDGLFIHSTRYRLRQGLLSTFEESHSHATSHLIHQPAAALDRALCAACRTLVLVDDEASTGATFVALVEANRAAMPNLARIVCVTITDWMGAAKRAEITAAMPVPTTFVSLLEGGYTFEARTVTPPAMPNVTGDGAFKDDLIPVNWGRLGLRRPRPLPAAALAIRAKAGERVLVLGTGEFVFPPFQLARRLSAMGADVRVQATTRSPILEGGDIDGVIDFADAYGDGIPNFLYSTRPGDYDRVLVCYETPPSTAQTALIAALGAEPVFFNAIGGPRT

SEQ ID NO: 3690 - protein, 360 aa, Psychromonas ingrahamii 37
MNYNFETQAGLISLDVLKTKKPVEELLTFACRQNPKRSFMLVSKVLGRYVPTKPNVMREVYDSLSESLGEDQLTYVVSLAEAATGLGGGVADSLARAQQENVYFQHTTRHKLNRPLWFSLDEAHSHAVNHMFYAPKTALLEGIIQSKRLVIVDDEITTGRTIKLLISGLLKYLMNIEEIVIISLVNLVDRKQSLSITDFNIPIRYVSLMEAQISMVKKDTFKPELPGNADTGLCEAQSSDELGRCAMLMPYSGGLPSITSSKEMTIIANGEHQYIPFLIAERHEQAGCNVLYQSINRSPLLLGESIEKKLSFSFDSSKVEHYLYNFEEGNRDVYVLLENESARESHEFASLYPLTKCEVF

SEQ ID NO: 3691 - protein, 384 aa, Polaromonas naphthalenivorans CJ2
MRRVTLPTGLMEIKVDAGPFRLDDLIGFAARANTRRGFLFLSKVLGKHWPVTPRLMHAIHTELAARVPANLPGPVIFIAMAETAIGLGQGVFEAYKTMHPQREALFLHTTRYHVGGMPIIEFEEAHSHAPRQFLHRPGDVGLQHILLSARALVLVDDEASTGNTFLNLSAACRALNPAIEHIHLAAITNFMGREVNEALSGRFGLPVTVGAALSGEYAFTVGQLQQADGAAQRFEAHVDRGASACFGRLGLDRPLNQPAALAGRLSAGIAPSERVLVLGTGEFMHMAFLLGRALEACGTNVVVQSTTRSPILQWGAVGHILKFSDNYGEGVENFVYNVEPGQYEHVFICHETPPNAALQQLAKAVKGRLFHFLSESHCEEIPVR

SEQ ID NO: 3692 - protein, 426 aa, Psychrobacter PRwf-1
MTCDSKHPPTDSLSYQQKRVELPRGTLDLSYRLSGEHSYQLDDLLGFAQRINPKRAFLFVSKVLGRHIPVSPQIMRQAFSHLAHTVPDNLPEPIVVVGMAETAVGLSAGVHQALQARYPNALLLNSTRHAQQQASLLTTFSEDHSHASTHLIYQSDEPHIQAQLMASKTLIMVDDEASTGNTCVNVVSALREAGLTELEQVHLVTLVDWSLGQADNDDHIALRLEGIAFERHHLMAGDWQWTDAPDPQPITMPSVDTTDAGSQPLLATGNWGRQPTLDSTEGFAHFLARFKQAYQRARGIDVVSDPFIKDSGTTDNAQSTRILVLGSNEFVWLPFLLAEWIEQQALTTSQSRAQVSFSALTRSPIALGGAIDAVLSFQDNYGLGMTNFVYNVVPEQWDIIVLCVETPTESVDALWHNLDNVIVVSP

SEQ ID NO: 3693 - protein, 378 aa, Yersinia pseudotuberculosis IP 31758
MMTTQPPVYRRELSGGTLTVIPNSSNIPLDSLFDIAERRNPKRAFLFVSKVLGRHIPVSPATMRNVYRQLAERFPADLPGPVLFIGMAETAVGLAAGVFQELRGTVAEPVFLTSTRHPVDGDLLCEFKENHSHATDHLLYLPSDPVLRARLQRARSVVLIDDEATTGNTFINLLQALRDANLNGLEKVVAVTLTDWSGSALTERCPLPVTTVSLITGEWNWSPIPDAPVPVMPACNVTARGKVAITDKQNWGRLGMDETRADIGHKVHVLAGEKVLVLGTSEFVWQPFLLAERLEHAGANVKFSSITRSPIAQGHAINSIIAFSDNYGLGIPNFLYNVAHQHFDRIIVCVETPAESIDPTLIEQLRTVAPCVEVIAYE

SEQ ID NO: 3694 - protein, 378 aa, Yersinia pestis Angola; identical to SEQ ID NO: 3693

SEQ ID NO: 3695 - protein, 378 aa, Yersinia pseudotuberculosis YPIII; identical to SEQ ID NO: 3693

SEQ ID NO: 3696 - protein, 380 aa, Escherichia coli O157 H7 EC4115
MSDILEDMIYRRTLSCGTIQVTRDQGEVSLDDLFDIAERRNPKRAFLFVSKVLGRHIPVPPSVMRQAYRQLASQFPSTLTGPVLFIGMAETAVGLGAGVFDEVRHQHRESVYLTSTRHPVDGTLLCEFKEEHSHATDHLIYLPDDEEKRRRVTNARTLVLIDDEATTGNTFINLLSALRNTGKLQHIEQVIAVTLTDWSGNALSERTPLPVTSVSLVSGQWGWTPLPDAPVPDMPKVNVTSRGEWDIQGKQSWGRLGMLAPAADLGHEVSVHKGERILVLGTGEFVWEPFLLAERLEAAGAQAFYGSTTRSPVAVGYAIESAISFTDNYGLGIPNFVYNVAHQQFDRILVCTETPAESIDTQLLKALAEVAPVVEIVTYE

SEQ ID NO: 3697 - protein, 120 aa, Thiobacillus denitrificans ATCC 25259
MRKLHQLITACALGTIALTGNALAAEPAKEPSGKELAFNNKKGNCLACHGMPTVPDAVSTGMYGPPLIAMSARYPDKAKLRAQIWDATVANPSTTMIPFGKHGVLTEAEIDKVTDFVYGL

SEQ ID NO: 3698 - protein, 144 aa, Magnetococcus MC-1
MKPFRFLALVLAVLLLGIGGMTGAQAEEGIAQPLTDKPGDPANGKALAMARSKGNCIACHWLPEATFPGNAGPNLYEAIRHNERSTAWIRQKIVNPKVDNPDTLMFTFYDSTGKQNLLKAWEGKPVLEAQEVEDVIAYLLSLRN

SEQ ID NO: 3699 - protein, 157 aa, Paracoccus denitrificans PD1222
MSSHLWHAAVVAMAIATPAICETAPKDVDYAEGAVEASLTGVPGNPEEGVRVMTTNALGNCVACHQIGALPDVEFPGTIAPPLDGAADRWTEAQLRGIVANAKMTFEGTFMPAFYKGEGFVRPGDGFTGKAGTEPLAPILNAQQIEDVVAFLVTLKE

SEQ ID NO: 3700 - protein, 150 aa, Polynucleobacter necessarius asymbioticus QLW P1DMWA 1
MRRGRALAVLMLVALNLSQVAAQGNSSIVAGEITNPLTASPGDPLRGRTIVASRQTGLCLLCHSGPFPEERFQGNLAPELSQSVARYTVPQLRARIVDASYFNSQTIMPAYYRTEHLNRVAPKFAGLTILNEQEIEDVVAFLATLNTSKP

SEQ ID NO: 3701 - protein, 156 aa, Rhodobacter sphaeroides ATCC 17025
MRHQYLLGVVAACLALPALALTGPHDLQFADGALAESLTGQPGDPAAGATVMTTRPLGNCVACHEIPTMADVPFQGDVGPSLAGVANRYSEAQLRGIVANAKMTFEGSVMPAFYKNSGYIRPGDGFTTKPAPADLQPILTAQEIEDVVAYLLTLKE

SEQ ID NO: 3702 - protein, 135 aa, Bradyrhizobium BTAi1
MLSATARGDEPIRLDIVDYAIPKSLTGAPGNAEAGKKVFLTRTLGNCLACHQVSALKSEEFHGEFGPSLDGVATRYNTAQLRLIVADPKRIFTDTVMPAFYKNDGLNRVRPEFVGKSVLTAAQVEDVVAFLETLK

SEQ ID NO: 3703 - protein, 160 aa, Dinoroseobacter shibae DFL 12
MKRQALIGTIAGLAFATGPATAEIMAEQVAFTEYGEIEQSLSGTPGDPAAGREVMASRALGNCVACHMVSDMSDIPFHGEVGPMLDGAGDRWTEAQLRGIVANAKMTFEGTIMPSYYKKSGYIRPGNAFTGKAATPEQLETLLTAQQVEDVVAYLMTLTE

SEQ ID NO: 3704 - protein, 158 aa, Methylobacterium populi BJ001
MRRPITAFALAGLCVLATAAGAETASTGLAPFKVVAVDGSDAIPEPLTDKPGNAAAGAKVVVNRRQGNCLGCHQVSSLSTESFHGEIGPSLDGVAERWDAAHLRMIVVNPKHVFTEATVMPAFYRIEGLHRVRPEFQGKPILTAQQVEDVVAYLTTLK

SEQ ID NO: 3705 - protein, 181 aa, Methylobacterium nodulans ORS 2060
MKHPSPMRSRPAPGSMREPSCLHRQRGTARLGPVGSRHGTPALAALLLTLLPALAPATIEGDAIPEPLAGARGDPVRGRAIATDPRRGLCTLCHAGLGGRAEGDVGPNLARVGARLTPGQLRLRLVDGRVLNPDTIMPSYYRVEGLTRVGAAWRGKPILEADEIEDVIAYLATLRGEGETR

SEQ ID NO: 3706 - protein, 152 aa, Yersinia pseudotuberculosis IP 31758
MQIWVDADACPNVIKEVLFRAADRTGMMVTLVANQPLKTPPSKFIRTVQVASGFDVADNEIVQRVEKNDLVITADIPLAAEVIEKGGIALNPRGERYTPDTIRERLNMRDFMDTMRASGIQTGGPNTLNQRDRQQFANELDKWLQQARNQAK

SEQ ID NO: 3707 - protein, 152 aa, Serratia proteamaculans 568
MMQIWVDADACPNVIKEVLFRAAERTAMSVTLVANQPLRTPPSKHIHTLQVAAGFDVADNEIVRRCEKGDLVITADIPLAAEVIEKGAVALNPRGERYTPDTIRERLNMRDFMDTLRSSGIQTGGPNTLNQRDRQQFANELDKWLQQAKRAQ

SEQ ID NO: 3708 - protein, 152 aa, Yersinia pestis Angola; identical to SEQ ID NO: 3706

SEQ ID NO: 3709 - protein, 152 aa, Yersinia pseudotuberculosis YPIII; identical to SEQ ID NO: 3706

SEQ ID NO: 3710 - protein, 149 aa, Dickeya dadantii Ech703
MPSIWVDADACPNVIKEVLFRAAERTSTQLTLVANQPLKVPPSRFIATLQVAAGFDVADNEIVRRAEPGDLVITADIPLAAAVIEKHAVALNPRGERYTPDTIRERLTMRDFMDTLRASGIQTGGPAALNQRDRQQFANQLDKWLQQQA

SEQ ID NO: 3711 - protein, 150 aa, Dickeya zeae Ech1591
MTAIWVDADACPNVIKEVLYRAADRTATRLTLVANQPLRTPPSPYIHSLRVSAGFDVADNEIVRRVQPGDLVITADIPLAAEVLAKHAIALNPRGERYTPDTIRERLTMRDFMDTLRASGVQTGGPAALNQRDRQQFANELEKWLRQQQA

SEQ ID NO: 3712 - protein, 150 aa, Pectobacterium carotovorum PC1
MQIWVDADACPNVIKDVLFRAADRTQTQVTLVANQTIKVPPSRFIRTLRVSSGFDVADNEIVRRVEAGDLVITADIPLAAEVIEKGGAALNPRGERYTPDTIRERLNMRDFMDTMRASGIQTGGPSALSQRDRQQFANELDKWLHQAKKP

SEQ ID NO: 3713 - protein, 427 aa, Desulfovibrio desulfuricans G20
MTRYAVIADDLTGAGDTGVQFAKAGLRTRILTHNWSAEDLNGVDVAVVQTESRAMPPQEAYAAVKQAAQRLQAAGVQPLYKKVDSTLRGQIGPEIDAVMDVWGLELALLCPAFPENGRTLIGGYLLAGGEPVSRTSIGADPVSPVRQSHIPSLLAAQSSRPAIGLSLAEMTRGDSYLESIFTEARRRSAIIVADAADPQDIALLESLVARFAPRALFVGSAGLAAPVAARLAQSSAGRRPVVTVVGSVNPVSRGQLKQLQHEGTGLLLVTADELLLDDRHWQTALRAKAETLAAMLRRGEDVAVATPGNREEVQDLLERGAGIGLERRPLTARVAARTTQVVHEALALLQDGEKPSGLVLTGGDMAHAMLAHLNTAGMDLIAEVSPGIPVGRLSGGHADGVKVVTKAGGFGTQGALVQAVRTLRELD

SEQ ID NO: 3714 - protein, 409 aa, Rhodoferax ferrireducens T118
MSALADSLFILADDLSGAADCAMGAAKSGLKSIVLFNPAIAEQAQVIAIDADCRYRPAAEAGAINVALWQAQATSERLFYKKIDSTLRGNFAAEMAALTRAGVAIVAPAFPATGRTTQNGRVFVKGVPLEQTEIWANESIPGQADIVAMLRSAGISATNITLPGVRNKLRDEISRLVAGKTVQAIVCDAEEEADLAAIAAASVGLPVYWVGSAGLATHLPQAAGLVGQAASPRLAVSGPIVTVVGSLSAVSRQQAQVLESHADFAVFVPTPALLRTGETHPLWQSLRDQIGEALSAGRDVMIRTGLEEHNDLTYGHALCESLGSLVLPLAPAIGALIATGGETARALLPTFGTHALQLIKEVEPGVPLSLALGKQQIPVITKAGAFGSPAALLKSYSELARIRSGNVVA

SEQ ID NO: 3715 - protein, 416 aa, Rhodopseudomonas palustris BisB18
MAHGWLILADDLTGAADCAIAFGRRGRAAAVTWGEADAAQDHQLPVLAYDAASRGLSAADAARRHAEVLTQLAAAERILFKKIDSTLRGQPAAETAATLSYLKSRLGGAFGVFAPAFPATGRTTIDGRIVVGGQPLEQAEVWQRDHSYPTADLVDVLASAGVRGEKVTLAAIRGGELRAVFAKLSRQGDVVAVCDAETDQDLHLIADASLPASPSTFFIGSGGLAHALAGLEAEHAVAPLRIPTSAHGTLIVVGSLAGASRSAACKLVATGTVAHFPVTPQTLLNDGGGRAELALAVMQRLSGGGDALVEIVMNDHPDMALGPKLAQRLAETLQSVAPSIGAFAATGGETAAALLARFGVNGIRLADEIEPGVSLGLTLGRLSVPIATKAGAFGDEQSLIRISERLAAVRTKGSFS

SEQ ID NO: 3716 - protein, 410 aa, Cupriavidus metallidurans CH34 uid250
MTWLIIADDLSGAADCAIGFAAHGARAVVTLDVADSVGIADAEIVAADVDSRRMTPEDATTSNIDAWHRGDGRHRRLYKKIDSTLRGNWAAETVALQPLAGLAIIAPAFPATGRTTRGGRMFVNGQPLEDTDIWRLEGLNGHADMVALLAARGLATALLPLDVVRAGAPAVLAELRARQADGIAAVVCDAETEQDLVTLADASNQLDTPAYWVGSGGLARSLSTVAQVTRAETTSPVTYHQGPVLTMVGSMSGISGKQAAYLCERARMEALVVAPQTLRDGPGHPAWTTTRQSITNCLSAGRDLLLSIGRDDAFDPAEGPRLSTALAQLALPSFEHVGGLIATGGETARAMLGAAGIAALALRHEVEPGVPLSDTIESLPGAPARRVATKAGAFGTEAALWLAWQAMRQN

SEQ ID NO: 3717 - protein, 425 aa, Burkholderia cenocepacia AU 1054
MNALAPHAARLLIVADDLSGAADCAVAGLRHGLTAMVVLDAAHAAAAPHGVDILSIDVDSRRLPKDVAARRTVDAVASLSNAGTRLYKKVDSTLRGNFAAEVAALTSRAGMAIVCPAYPASGRTTIDGRQWVRGVPVEASEYWRNEHIPGTADLVALLSAEDLRVAYTAIGTVRDNANALTAHLRELQSDRVQAVVCDAESDDDLQRIARASAALDGVFWVGSAGLAPGVIEALGPPHGASGPTAGGPHSKGPVLTVVGSMSSISHAQLDCLKANAGTHLVALEVSVCALDDTRSDVTTVASDALRGGRHVVVSLSQARRGDVNDGLLFSTRLAALLAPAVRHAGAIIATGGETARALLTAAGASALRVVDEIEDGMPLLECRLHGNALPVVTKAGGFGQPESIYHAWRRLANTGEPADTAQPNQ

SEQ ID NO: 3718 - protein, 390 aa, Rubrobacter xylanophilus DSM 9941
MRFAIVADDLTGAMDSGVQLAAAGYATAVALQGAPLPPAPDLDAVVAETGSRALPPGEAAARVRAAVGALRKAAILYKKVDSTLRGPVGAEVEAALAASGRERALISPAFPAAGRTTRGGVQLLCGEPVERTGFARDPRTPVRASGLRRLIPGVGAVLGTGELADPSRVRRALRRHRLLVADAETDAHLEALVRAVPDPSQVLWVGSAGLARALAARYPGPRPAPEGPLPAAERVIAAVGSRNEVAVGQRELLAAAPGVVEAVVGEGGGGAVQEAARALEAGACCALLRPPEAAGGPEAVLRALGEAAAGLVRSLPGAGLILTGGDTAAAVARELGAGGIRVLRELEPGVPVGVLLGPHPCPVVTKAGGFGRPGTLLEALGLLLGERSPA

SEQ ID NO: 3719 - protein, 430 aa, Moorella thermoacetica ATCC 39073
MEQISIIADDLTGANDTGVQFCQHGFRTMVIIDAANVERVGQDKDVWAINTDTRHLAAPEAYQRVYEITLKLKKAAISRVYKKIDSTLRGHPGAELEAVMDAWQADLALVVPAYPANRRLVVDGHLLISEGMETAAASVSLTPGDARAALCHIPTVLQGEMGRRVGQINLATVRQGVKELVAALEAARTNSQVLVLDAADEEDLRNIARAISRFQRDVIVAGAAGMAAHLPLAWNLKPVPNNPLNKKGAILLVAGSRNPVTAAQVQRLAEVSACQAVKVETEAILTGEPAVEIERVLQEVTTQDAGAGLIIIAVDSLFQTIDRDRVSNSGSKAIALALGTITSRLLNMRRISALVVTGGDTAVHVCRALEARGINLAADLLPGIPLGYLEGGRGDGLPIVTKAGGFGSPDSLIKVNEFLQQRMKSEMELV

SEQ ID NO: 3720 - protein, 425 aa, Burkholderia cenocepacia HI2424; identical to SEQ ID NO: 3717

SEQ ID NO: 3721 - protein, 432 aa, Burkholderia multivorans ATCC 17616 JGI
MSMLIIADDLSGAADCAIGFASAGYRTVVTLDVPTQGLDATVADVIAADTDTRRLTPAEAAQRTSAAWRALREPGRRLYKKIDSTLRGNWAAEVAALQPLAGLAIVAPAFPATGRTVLGGRVFVRGEPLETTDTWKLENAGRTADLHAMLAQNGVSTAQLDVDALRESSQTLIARIAAVAASGTEALVVDAETNDDLIALARATAQMDDALFWVGSGGLAREIASVESLFDARAARTGAAASQRQPRHAPVLALVGSLSAVSERQCAMLRERAGMMELTVPPAVLRGGERHADVPQWQARIGDALRTGADLLLRIGSDDAFDPAEGALLSATLAALVKPHFAVLGGLIATGGETARAMLSAVGVGSVELIEEIEAGVAVGKPIGASVCQPHLRIVTKAGAFGTDHALFAAWRYLRETPAASVRAGARSHGSA

SEQ ID NO: 3722 - protein, 425 aa, Burkholderia cenocepacia MC0 3
MNALAPHAARLLIVADDLSGAADCAVAGLRHGLTATVVLDAAHAAAPPHGVDILSIDVDSRRLPKDVAARRTVDAVASLSSAGTRLYKKVDSTLRGNFAAEVAALTSRAGMAIVCPAYPASGRTTIDGRQWVRGVPVEASEYWRNEHIPGTADLVALLSAEDLRVAYMAIGTVRGNANALTAHLRGLQSDRMQAVVCDAESDDDLQRIARASAALDGVFWVGSAGLAPGVIEALGPPHGASGPTAGGPHSKGPVLTVVGSMSSISHAQLDCLKANAGTHLVALEVSVCALDDPRSDVTTVVSDALRGGRHVVVSLSQARRGDVDDGLLFSTRLAALLAPAVRHAGAIIATGGETARALLTAAGASALRVVDEIEDGMPLLECRLHGHALPVVTKAGGFGQPESIYHAWRRLANTGEPADTAQPNQ

SEQ ID NO: 3723 - protein, 427 aa, Burkholderia ambifaria MC40 6
MNANAVAQHAARLLIVADDLSGAADCAVAGLHHGLTAMVLLDTEHAPAPTNGVDILSVDVDSRRASKDEAARRNVAAIESLSHSDTRIYKKVDSTLRGNVATEVAALASHLGMAIVCPAYPASGRTTRDGRQWVRGVPVEASEYWRNENIRGKADLVALLCAEHLRVAYAAIGTVRAEPGALAACLREMQSEGAQAVVCDAESDDDLQRIARASATLDNVFWVGSAGLAPAVIEALEPRRGIAEPAAAGDDPQGPVLTIVGSMSSISHAQVEYLKANAGASLVALEVAVSALDDPRSDVTTAVCNALRHGRHVVVSMSQTQRGDVNDGLLFCNRLASLLAPAVRHAGAIIATGGETARALLIAAGASALRVVDEIEDGMPLLECRLQGKTFPVVTKAGGFGQPGSIHHAWRRLANEGKTANTAQTNL

SEQ ID NO: 3724 - protein, 356 aa, Opitutus terrae PB90 1
MIVVLADDISGAAELAGAALRRGFSAEVQTSFQPDTEAEVVCVDTDSRSLAPQAAEAVVAAIARQVAAARPDWVYKKCDSVLRGHVRRETQAVMAALNRRRAVLVPANPSRGRVVRNGEYFVGEQPLDQTEFARDPEHPRTTARVAELLGGELTGVVVPNTETPGDVDAHAFGLDETTLPVGGVDFFEALLRRRGAARAAVSAGSAASAGNGSVLVVCGSAAAWSVRRAEARARGVAVFPQPHDVAAICAAWRAARTALIGIGDGPATSGRSPGELVSALAGTVVEVVRRIETDRLLLEGGATAAAVVRALGWTRLRACEVAASGVGVFTPAGTVRPRVAIKPGSYSWPVEIWPGR

SEQ ID NO: 3725 - protein, 419 aa, Burkholderia phymatum STM815
MKILIIADDLSGAADCAIGFASAGHRTVVTLEATCMPAHDGADTIAVDTDTRRLTPQDAATRTAAAYAEMSARGQRLYKKIDSTLRGNWAAEVAGLQALAGMAIVAPAFPATGRTVRDGRVFVHGEPLEQTATWKLEHAGQPAGIAAQLEAVGLTTERLDAQALADEPETLAVCIGAMAANGVQALIVDTHSERALRALARATLRSDAPFFWVGSGGLAREIAALDSRVDPAGRGPGNTTFPGGPILILVGSLSAVSERQCAMLRERGGVKELIVPPAVLRAGATHRDWHVLQEQIGVSLKADVDLLLRIGRDDAFDPAEGAQLSAALAALVEPHFTRTGGVIATGGETARAMLAAARIGNLQLLAEVEAGVAVARPLDATRTHCPGVVTKAGAFGTDHALYAAWLTLRNQTERDVVPH

SEQ ID NO: 3726 - protein, 423 aa, Salmonella enterica serovar Newport SL254
MKMMVIADDFTGSNDTGVQLAKKGARTEVMLSASQKPSRRADVLVINTESRAMPADQAASAVYAALSPWCETSPAPLVYKKIDSTFRGNIGAEVTAAMRASQRKLAVIAAAIPAAGRTTLEGKCLVNGVPLLETEFASDPKTPIVSSRIAEIVALQSEIPVYEVFLQDVRRGGLSALLTAYAAEGEGIIVVDAVEERDLTLIAQAACEQPSMPLLVGAAGLANALPVELFMQDRQRLPVLVVAGSMSEATRRQVDNALCRGRAEVVDIDAARMVSDSAEQEIASVVEQACALLSQHRHTILRTSRRAEDRQLIDALCEKSAMSRQQLGERLSQRLGVVTLNIIEQARIGGLFLTGGDIATAVAGALGAEGYRIQSEVAPCIPCGTFVNSEIDDLPVITKAGGFGSDSTLCDALYYIEEMYCGD

SEQ ID NO: 3727 - protein, 423 aa, Salmonella enterica serovar Schwarzengrund CVM19633
MKMIVIADDFTGSNDTGVQLAKKGARTEVMLSASQKPSRRADVLVINTESRAMPADQAASAVYAALSPWCETSPAPLVYKKIDSTFRGNIGAEVTAAMRASQRKLAVIAAAIPAAGRTTREGKCLVNGVPLLETEFASDPKTPIVSSRIAEIVALQSELPVYEVFLQDVRRGGLSALLTAYAAEGEGIIVVDAVEERDLTLIAQAACEQPSMPLLVGAAGLANALPVELFMQDRQRLPVLVVAGSMSEATRRQVDNALCRGRAEVVDIDAARMVSDSAEQEIASVVEQACALLSQHRHTILRTSRRAEDRQLIDALCEKSAMSRQQLGERLSQRLGVVTLNIIEQARIGGLFLTGGDIATAVAGALGAEGYRIQSEVAPCIPCGTFVNSEIDDLPVITKAGGFGSDSTLCDALYYIEEMYCGD

SEQ ID NO: 3728 - protein, 423 aa, Salmonella enterica serovar Agona SL483
MKMMVIADDFTGSNDTGVQLAKKGARTEVMLSASQKPSRRADVLVINTESRAMPADQAASAVYAALSPWCETSPAPLVYKKIDSTFRGNIGAEVTAAMRASQRKLAVIAAAIPAAGRTTLEGKCLVNGVPLLETEFASDPKTPIVSSRIAEIVALQSEIPVYEVFLQDVRRGGLSALLTAYAAEGEGIIVVDAVEERDLTLIAQAACEQPSMPLLVGAAGLANALPVELFMQDRQRLPVLVVAGSMSEATRRQVDNALCRGRAEVVDIDAARMVSDSAEQEIASVVEQACALLSQHRHTILRTSRRAEDRQLIDALCEKFAMSRQQLGERLSQRLGVVTLNIIEQARIGGLFLTGGDIATAVAGALGAEGYRIQSEVAPCIPCGTFVNSEIDDLPVITKAGGFGSDSTLCDALYYIEEMYCGD

SEQ ID NO: 3729 - protein, 423 aa, Salmonella enterica serovar Dublin CT 02021853; identical to SEQ ID NO: 3726

SEQ ID NO: 3730 - protein, 399 aa, Methylobacterium nodulans ORS 2060
MSIKVAVLADDLSGGNSVGAEFARQGLATLVARVSEVDAAVRYGPEIIVVTTDTRNRSPEEADAITRDALTRAVTLQPAYLFKKLDSLLRGPIAVEAAATMAAAGADSALVVTASPPTGRTTRAGRQLVDGRPLLDVIAALDPGASLATDEVGSFFLACGRPLRHLDLDTVRAGEIKTGEWSGRITIADCETQSDLDRTVSAAIAADVRLFFGTYGMGASIARLLGRNAGMPVLVIAGSLSEATHRQVLALREEGECTLLSVDAPSTSEEARRALSAGRDVVLCARPDTLGPSAARLLAPPTRAAASAMEERIARCAEPLLGLVSGLIVSGGSTADTLLVLMGAHGLVLSGSELLPGVPVARILGGSHDGLRCVTKPGSFGTDDALCVARRFVRDRRMS

SEQ ID NO: 3731 - protein, 388 aa, Pedobacter heparinus DSM 2366
MIAVIADDFTGAAEIGGIALRQGWNAIIDTRVQKGTETDILIIATNTRSKPPQEARKTIRELTLQLLSLSPEIIYKKIDSVLRGNVGEELLEQMAVSQKRRALLIPANPSLKRVIKDGIYYYEGLPLKDSTFARNVKHQIGSSRVIDLMGDGAGKDTVVISRAELMPDKGLIIGNTTDEADLDHWAGRVDEETIMAGGSSFFNALLRKIKVHPYTDPAGFAFGKKVIYVCGSAFPLSRSVVEDARQAGQYVSYMPSRMFCKPAEKSAYMAHWEREILKGVQQSGTVIVAINVIEEPRVENLSSELGKTIATVIANVMQGVQLEELVIEGGATASAIIEKLEYRKFHPTQELAPGVIRMKVEENKSLHLTMKPGSYTWPSSIWKYSHKP

SEQ ID NO: 3732 - protein, 422 aa, Dickeya dadantii Ech703
MLVVADDFTGANDAGVGLALYGAQVNVLFDAARIGAVSSGDAIVINTDSRALDAAVAGERTAQSVRGWREHGVEGWMVKKVDSTLRGNPGAETEAALHAAGVSLALVAPAAPSLGRVTRGGNVWVHDRLLTDTEFASDPKTPVRSSSVGERLAEQTALRQARVSLSELRQNGLAARLQRLSDQGVRLVVLDAENQQDLDLIVQAAGQLAAKPLLVGSAGLSDALARHLYRRVGNASRALLAVIGSMSEIAQKQIQMACRRPDVALVDIDIDALLAVSYPAALARWCEQAAATLASGHHCLIRTCLDDSQRFEIDGLCQRHGMARQQLGDTISQRLGELTRQIVGRQQPGGLYLSGGDIAIAVANALQANGFHIKGQIASCVPWGRFLDSVVGDIPVMTKAGGFGDEATLLDVLRFIEEKVSE

SEQ ID NO: 3733 - protein, 428 aa, Dickeya zeae Ech1591
MPDGRDLTRIMVVADDFTGANDAGVGLALQGARVNVMFDATAIHTGQADDALVVNTDSRAVTASLAAERTAQAVALWRKTGARGWIVKKVDSTLRGNPGAEIEAALNAADLSLALIAPAAPALGRITRDGQVWVHGVLLTDTEFASDPKTPVRSASIGERLAEQTALAQATLSLHEVRADSLAAQLQQLSDSGVRLVVLDAECQQDLERIVEAAARLAEKPLLVGSAGLSEALAQSLAFPTPCRALLAVIGSMSEIAQLQIKAVSQRPDVELIDLDIAGLLAADEGMLAQTGRQAAAVLAAGRHCVIRTCRDDNQRFEVDSLCQRYGMSRQQLGETISRRLGELTRRIVQRQRPGGLYLSGGDIAIAAATALRASGFRIKGQIASCVPWGRLLDSLVGDIPVMTKAGGFGDEATLLNVLRFIEESVCE

SEQ ID NO: 3734 - protein, 442 aa, Pectobacterium carotovorum PC1
MSNVQQSAEQVLVVADDFTGANDAGVGLAQHGARVSVVFDVNKLHADLLGDAVVINTDSRAARDDVASQRTAEAVAAWQAAGGQGWIIKKIDSTLRGNLGAEIAAALSAAEVPVALIAAASPMLGRVTCKGEVWVNGRLLTDTEFASDPKTPVTSASIAARLAEQTALPMAEIHLDDVRQANLAHRLQQLADEGVRLIILDTDVQDDLEKIVDAASALPFRPLLVGSAGLSEALANAQDFTRKTAKPLLAIVGSMSDIAQKQITAAKLLSNVTLVEIDINALFSPHSSTVMASQCEEAVTALLNGHHCIIRTCHNENQRFEIDARCQQLGLSRQQLGETISHYLGELTRNLVQALDSLTADGTHQRELGGLYLSGGDIAIAVATALGATGFQIKGQIASCVPWGYLLNSVVGTTPVMTKAGGFGNETTLLDVLRFIEEKVSE

SEQ ID NO: 3735 - protein, 546 aa, Shewanella oneidensis
MTIKKKVLAAATAVALAITPTANSFDPTYEASCLSRFDPKEVLLGYQKRWIADESPLKIGEKSRRTGLTWAEAADASLTAGAARGQGGTNHFYVGSNKEMAREFIDAAAMWAKVFDKAAGEIQEEMFVDDGQEGKEILTFAIYFSSGFKIQALSSNPSNLRGMQGNVTIDEAAFHERLAEVLKAALALTMWGAKVRLISTHNGIDNLFNELINDSRAGKKDYSIHRITLDDACAEGLYQRICQIRGIEWSQAAEDDWKAKLLKATATEEDALEEYFCVPKSGGGSYLSRALIESRMASVEHSGPVVRLEKKNDFGEWPEGLRTAEIADWCSSELLPILLTLDQSRPHVFGEDFARSGDLTVIDVGEIAQDLHIKTKLQVELKNIPFRQQEQILFYIVDRLPRLRGGAMDARGNGQALAEYARDRYGSEVIECVMLSESFYREQMPRFKSHFEDALLTIPRDDDTRTDLQALVINNRGTPCLGDVRTGKEKERHGDAAISLFLMVYATTLDGAPIEFTPIPKSDHRNPNAHASAHEDDDHQLQRGCW

SEQ ID NO: 3736 - protein, 595 aa, Methylobacillus flagellatus KT
MAENSINSEPVEISQGEKKDLLDLVVEKQQDRGLGHAGSDIPHILLPYQARWHTDMSPVRLGRKSRRIGWSWGCMAAEGALEAARDSGGMSQYYMGYNLGMAAENIGDALKFAQIYGVAASSISVFRDRETMTVKDQERGVIGESKQDITRFKITFKSGHVYEALSSAPWNWRGRQGHARIDEAAFHRNLREVVKGALAFLMWGGRVDIVSSENGEDSEFHALVRDIEAGKLDWSMHKVDFDEAVAEGLYQRICLVKGEVWTREKEQEWRDKIFSSYSNQEDANEELLCIPKKGSGLYMPRFLVEQCQDDSIPRLSLAKGEAYVTDPNRLVETERWCKEVLKPVIDNMDHGKRSVYGQDFGRSGDLSVIWVLQEKSASEWTTAFELSLRNLPFDVQALIRDYILDNIPHFQHASFDARGNGQSHAEGAVQRYGEYRITCVMATASWYAEWFPRYKSAYEAKAITVVGGEDVITDHRRVILQAGRPKMDDGRDKGTDGGYRHGDSAIAGVMAWHAASQEGQPAAGATVESQPEIFKAPRIGRLGRWLHKTLLIDLRPVARFLSLGRACVANLFFNGFMNLHKAVFAGQERSADGLV

SEQ ID NO: 3737 - protein, 525 aa, Polaromonas JS666
MHPLGHRAHFGEPRSGFILSTTPPLLQSDANSTDAPPPVLLPYQQRWVADDSQFKIGEKSRRIGFTWGEASDDVLIAAKEGGTNVFYIGPTQDMALEYIEACAMWARVFNFAASQVQEGIFDDEDKDIKTYKIDFPASGRRILALSSRPTNLRGKQGVIVIDEAAFHPDLQGLLKAAMAMLIWGDKVRVFSSHNGLDSPFNELIIDVRSGRRKGVVHRVTFMEAVAEGLYKRVCMRRRIPWTAEGEKEWVSDVYGFYGDGATEELDVVPSQSGGAYLTMALIERQMSAETPLIRGKWKSEFNIQPDWEREAEIQRWCEEHLEPVLMALPKHLWHSFGEDFGRVGDLTVMIVLQEQPNLDKRVVLHVELSNCPFKQQEQILKFIIDRLYRFRAGALDRTGNGAYLSEVAVQKYGATRIEGIHLSETWYLENLPRTKAALEDNTLSGIPKDSQVRDDLRALRVINGIPKLPAVKTQKGDGEKLQRHGDSAVALVMADYAMRREVVPIEFQALGVARASSSMADYMGG

SEQ ID NO: 3738 - protein, 521 aa, Vibrio cholerae O395
MNYEFREQDVLLPYQKRWIADESPLKIAEKSRRTGITWAEAADAALTASKSKAAGGTHHFYVGSNKEMAREFIDAVAMWAKAFNYAAQDVQEEVFLDDDGNKEILTFVVYFASGFKVQALSSNPSNLRGMQGCVTIDEAAFHERLAEVLKAALALTMWGAKVRLISTHNGVDNLFNQLIQDSRAGKKRYSIHTITLDDACRDGLYKRICQVKGKTWTQEAEDQWKRDLLRDTATEEDALEEYYCVPKNGGGAYISRGLRERAASLADAPVISFTGSAAFNNAGEAERMRTMQEWLVENVGPQLQALPKGLRHALGEDFARNGDLTSFAPITVETDTKRTVPFLVELKNVPFKQQEQALYYICDRLPRRDGIKLDARGNGQYLAEQARYRYGAEVEEVILSVAYYRENMPKFKAAFEDDEIKLPKHEDVITDLGQIKIYRGVPGIDDSRTKGSDGNKRHGDSAVAIFLAYLASKADITRYELHTIKANADETQRRFFGTAEENNRFDDMPHASDLRGKGIRL

SEQ ID NO: 3739 - protein, 546 aa, Shewanella baltica OS185
MTIKKKVLVAATAVALAITPTASSFDPTYEASCLSRFDPKEVLLGYQKRWIADESPLKIAEKSRRTGLTWAEAADASLTAGAARGQGGTNHFYVGSNKEMAREFIDAAAMWAKVFDKAAGEIQEEVFVDEGQDGKEILTFAIYFASGFKVQALSSNPSNLRGMQGNVTIDEAAFHERLAEVLKAALALTMWGAKVRLISTHNGIDNQFNELINDSRAGKKDYSIHRVTLDDACNEGLYKRICQVRGIEWSQAAEDDWKAKLLKATATEEDALEEYFCVPKSGGGAYLNRALIEARMASIADSGPVVRLKKDDAFGQWPEGLRAAELLKWCEDELKPVLDSLDPARPHCFGEDFARSGDLTVIDVGEIAQDLHIKTKLQVELKNIPFRQQEQILFYIVDRLPRLRGGAMDARGNGQALAEYAQDKYGSEVIACVMLSESFYREQMPRFKSHFEDGLLTIPRDDDTCTDLRALSINRRGTPCLGDVRTGQEKERHGDAAISLFLMVYASTLDGAPIEFTPIPRSDHRNPNAAASAHEDDDHQTQRGCW

SEQ ID NO: 3740 - protein, 546 aa, Shewanella baltica OS195
MTIKKKVLAAATAVALAITPTASSFDPTYEASCLSRFDPKEVLLGYQKRWIADESPLKIAEKSRRTGLTWAEAADASLTAGAARGQGGTNHFYVGSNKEMAREFIDAAAMWAKVFDKAAGEIQEEVFVDEGQDGKEILTFAIYFASGFKVQALSSNPSNLRGMQGNVTIDEAAFHERLAEVLKAALALTMWGAKVRLISTHNGIDNQFNELINDSRAGKKDYSIHRVTLDDACNEGLYKRICQVRGIEWSQAAEDDWKAKLLKATATEEDALEEYFCVPKSGGGAYLNRALIEARMASVTDSGPVVRLKKDDAFGQWPEGLRAAEILKWCEDELKPVLDSLDPARPHCFGEDFARSGDLTVIDVGEIAQDLHIKTKLQVELKNIPFRQQEQILFYIVDRLPRLRGGAMDARGNGQALAEYAQDKYGSEVIACVMLSESFYREQMPRFKSHFEDGLITIPRDDDTSTDLRALSINRRGTPCLGDVRTGQEKERHGDAAISLFLMVYASTLDGAPIEFTPIPRSDHRNPNAAASAHEDDDHQTQRGCW

SEQ ID NO: 3741 - protein, 517 aa, Thioalkalivibrio HL EbGR7
MNVPARVPATHEAAAPPPVLLDYQQAWIADDSQLKVSEKSRRTGLTWAEAADDVLIAAAAKRAGGMNVYYIGYNQDMAIEYVEACAMWARAFNHAASAVEEGIWDDASDDKHIKTFTIRFPDSGHRIVALSSRPANLRGKQGVVVIDEAAFHDRLGELLKAALALLIWGGKVRVISTHNGDKNPFNQLIDDIRSGRRRGSVQRITFREAVAQGLYRRVCLRLGETWSAEAEAEWVAGVYAFYGEAAREELDVVPSEGEGNYLPRALIESRMVPAPVLRLRKDDEFKHWHKAAREAEIRDWCEEQLKPLLLALPDDLWIAFGQDFGRTADLSVIIPLVIGQDLVRRAPFVVELANMPFEQQRQVLFYLCDRFPRFQAGALDATGNGAYLAEVTAQAYGAHRVEEIKLSQGWYRENMPVLKAAFEDGDIELPRDSHLVDDLRAIRKVDGVAMVPRNSRQEGRHGDAAIALALAYYASRRDPAPIEFQAAPARRDRWDEVAGDGFDMLDDINAAGGDGAW

SEQ ID NO: 3742 - protein, 547 aa, Agrobacterium vitis S4
MTGPVSKEEWAKARRFSTDAVLGLVGKEGLGKALLPYQSRTVGLLESSACKVLFVEKSRRIGLTWGFASYAALRAARAKSAGGMDVMYISYSQEMTREFIDACAMWARAYSLAAMEMEEFVFEDKTEDGDRSIQAFRIRFASGFEVLALSSAPRTLRGKQGVVMIDEAAFVDSLPELLKAALAFLMWGGQVVVCSTHNGAENEFNLQIQNILGGRNKYDHIKIDFDDALRDGLYERICLVTNQEWSPENEADWREDIIDFYGDGADEELFCVASMGSGAWLTSPLIEARMTSDAPVLTLDLPDNYLHLSELERAKLLAPFMEELDEALDKLDPALMHAFGFDFARVADLSVGKLLAIDKKLNRKSALTVELRKVPGDEQKQITEKILRRAPRLVGAAFDATGMGWTVAEDMGRLFGLRDKDNEGGLVHAIKFSQDWYRIHMPPLKTAFEDAAISISKNADHLSDLRLVKVIRGIPMVPEARTGEKNKKRHGDYAIALALAHFASRMQWCEFDYQPAPPSASRSSETPSRDDERPFRMSSLRNKRGGF

SEQ ID NO: 3743 - protein, 260 aa, Desulfovibrio desulfuricans G20
MKQVFFVFLVFFFGLPVVVLALYAAAPGWSWPHLLPQDFSARAVQYLWQQRAEIGRHIGTSLWYALLTTGLSFVLCLAPARHFARCTFRGRALLEALLLAPALVPVMTFSMGVHHVFIITGLADTVTGVVLVLTVFCYPYMLRALTAGFASFGEGYDLCARNLGAGWWLRLTRVELPLLAPAVVAGASVVFLVAFSDYFLVFLIGGGVVPSFTGYLFPLLASSDRALASALSLVFLVIPVVLFVLVELLVARVYRRRGMY

SEQ ID NO: 3744 - protein, 278 aa, Yersinia pseudotuberculosis IP 31758
MSRTTNGRLVVTISLVFFAIANLLWLGLPFGMAILWSLVDPQYPWSYPDIFPQVLSFNRWLLVWEKTSLSEALINSYTIAPVVAATSLLLSLPTAYAFGRMRFRGKAVAEMLTLIPLVMPGMIIGIFFSAMLMNLNISNPFFSIVLGHTVLTLPYSIRIMSAGFKAVPQDLIDASRDLGAGIWGTFCNAYLPLLKPSFLAALIFCLVKSLEEFSIAYVLGAPDFITVPTILYSFLGYSFVRPDAAVVSMILVIPNVILMIIIEKLLKGNYLSQSTGKA

SEQ ID NO: 3745 - protein, 278 aa, Yersinia pestis Angola
MSRTTNGRLVVTISLVFFAIANLLWLGLPFGTAILWSLVDPQYPWSYPDIFPQVLSFNRWLLVWEKTSLSEALINSYTIAPVVAATSLLLSLPTAYAFGRMRFRGKAVAEMLTLIPLVMPGMIIGIFFSAMLMNLNISNPFFSIVLGHTVLTLPYSIRIMSAGFKAVPQDLIDASRDLGAGIWGTFCNAYLPLLKPSFLAALIFCLVKSLEEFSIAYVLGAPDFITVPTILYSFLGYSFVRPDAAVVSMILVIPNVILMIIIEKLLKGNYLSQSTGKA

SEQ ID NO: 3746 - protein, 278 aa, Yersinia pseudotuberculosis YPIII; identical to SEQ ID NO: 3744

SEQ ID NO: 3747 - protein, 281 aa, Desulfovibrio vulgaris  Miyazaki F
MPVGRADSRPGSRPGSRPASRSGSRLFLTLLWLLFGLPLPVLALWAAAPGWAWPDLWPAVLGGRTAAFVLAHRQSIAGVLASSTVYSLAVVAVTLCTCLAPARLLAFGRFRGRAALEGLLLAPALLPAMGFALGLYGTLVRLGLADTPAGVVLVLSVVSYPYMLRALASGFEAVGPDYGRCAANLGAGPLLRLLAVELPLLLPAAVAGGSVVFLVAFSDYFLVQLVGGGVVASFTGYLFPVLQSPDRGLAAMLSLVFLVVPVTLFVLVEGLVLAVYRRRGM

SEQ ID NO: 3748 - protein, 288 aa, Agrobacterium vitis S4
MMAVLELAPPATARRRMFRPEDRILVTIGLFGSLALAIALPLALMFIWSIADGWQPPHVLPQVYTASRWASVLSDQGLLQAMATSLGIAFTVTFATALIALPTAWAMARFPFRLKRLVEIFILAPVIIPGLVVAVGIGQVFLALGLAYSVAGVIIVQIVGTLPLMIRLMTATLETIPDELIHAARSLGAGTVGIVAHIILPLAVPGLLAGGLMSFIGSFEEFDKSFIVGAPVVQTLPIKLYMYLDPYSMQLPLAAIVSFILLLPALIVFIIAGRILRDDLMAAGMGKI

SEQ ID NO: 3749 - protein, 278 aa, Dickeya dadantii Ech703
MMGRDNMACVNRVLLVALLLLGVVWMVLPFAMAILWSLVDPSHPWAYPDVLPRVLSLARWRLMWNSTSLPDAMINSYLLAPAVALASLLLALPAAYAFGRLDFPGKSLAQLLTLLPIAWPGFVIAIFLSALLMRLGLYSRFLGIFIGHTVLFLPYAIRILSVAFALVRQDLIDAARNLGAPRRIVLCTAYWPTLKSGVLAALIMVFILSIEEFSVSYIIGAPDFITVPTILYSYLGYNFIRPNAAVVSLILVVPNVLLMLVMERLMRNVSTSVFVSKG

SEQ ID NO: 3750 - protein, 277 aa, Dickeya zeae Ech1591
MQQTAVNRLNRLLVALFLLLGCVWFILPFAMAVLWSLVDPAHPWAYPDVFPPVLSLLRWRDLWNNTSLPDALLHSYLLAPLVTLTCLLLAMPTAYALGRLSFPGKGVAQVLTLLPIVLPGFVVAVFFSSLLMQLGIYSRFLGIFLGHTVLFLPYAIRIMSVSFSQVRQDLIDAARNMRASRWRVFRVAYWPSLQSGAMASMIMVFILSIEEFSVSYIVGAPDFITVPTILYSYLGYNFIRPNAAVVSLILVLPNVVLMLLMERCLKHVPTSAFVNKG

SEQ ID NO: 3751 - protein, 271 aa, Desulfohalobium retbaense DSM 5692
MRPLAKQNRWYHILFFLGVVVLFCSPVVVLVLSSIGPHWQFPHLWPQEVSWEPLNTLWNQRLPLLRHLSSSIGYSLATVATTLLMCLTPAATLAHSHFRGKTLLEGLLLTPALVPPMTYAMGLHVAFLHTGLADTFAGVVLVLSLFSFPYMLRPLVAGFEQMGTSYGQCARNLGASRLRTALEIELPLLLPSILAGGSVVFLVAFSEYFLVFLIGGGSVESFTGFLVPLLQSSNRALASACTLLFLLVPLMLFAASEGVVAAYWRKRGAPI

SEQ ID NO: 3752 - protein, 430 aa, Enterobacter sp. 638
MKVLVIGNGGREHALAWKAAQSPRVSTVFVAPGNAGTALEPTLQNVAIGVTDIPALLNFAQSEKIDLTIVGPEAPLVIGVVDAFRAAGLTIFGPTEGAAQLEGSKAFTKDFLARHKIPTGEYQNFTEVEPALAYLREKGAPIVIKADGLAAGKGVIVAMTLEEAEAAVQDMLAGNAFGDAGHRIVIEEFLDGEEASFIVMVDGEHVLPMATSQDHKRVGDADTGPNTGGMGAYSPAPVVTDEVHQRTMDRIIWPTVKGMAAEGNTYTGFLYAGLMIDKQGNPKVIEFNCRFGDPETQPIMLRMKSDLVELCLAACEGKLDEKTSEWDDRASLGVVIAAGGYPGDYRNGDEIHGLPLEEVDGGKVFHAGTKLADDDRVLTNGGRVLCATALGNTVAEAQKRAYALMADIHWDGSFSRNDIGYRAIAREQGE

SEQ ID NO: 3753 - protein, 428 aa, Yersinia pseudotuberculosis IP 31758
MNILIIGNGGREHALGWKAAQSPLADKIYVAPGNAGTALEPTLENVDIAATDIAGLLAFAQSHDIGLTIVGPEAPLVIGVVDAFRAAGLAIFGPTQAAAQLEGSKAFTKDFLARHNIPSAEYQNFTDVEAALAYVRQKGAPIVIKADGLAAGKGVIVAMTQEEAETAVNDMLAGNAFGDAGHRIVVEEFLDGEEASFIVMVDGENVLPMATSQDHKRVGDGDTGPNTGGMGAYSPAPVVTDDVHQRVMDQVIWPTVRGMAAEGNIYTGFLYAGLMISADGQPKVIEFNCRFGDPETQPIMLRMRSDLVELCLAGTQGKLNEKTSDWDERPSLGVVLAAGGYPADYRQGDVIHGLPQQEVKDGKVFHAGTKLNGNHEVVTNGGRVLCVTALGETVAQAQQYAYQLAEGIQWEGVFCRKDIGYRAIARGK

SEQ ID NO: 3754 - protein, 427 aa, Serratia proteamaculans 568
MNILIIGNGGREHALAWKAAQSPLADKVYVAPGNAGTALESNLENVAISATDIPALVAFAQSHDIGLTIVGPEAPLVIGVVDAFQAAGLKIFGPSQAAAQLEGSKAFTKDFLARHNIPSAEYQNFTEVEPALAYLRSKGAPIVIKADGLAAGKGVIVAMTLQEAEDAVQDMLAGNAFGDAGHRIVIEEFLEGEEASFIVMVDGENVVPMATSQDHKRVGDGDTGPNTGGMGAYSPAPVVTDEIHQRAMDQIIWPTVRGMAAEGNTYVGFLYAGLMISADGQPKVIEFNCRFGDPETQPIMLRLRSDLVELCLAGAEGKLGEKTSEWDERPALGVVLAAGGYPGDYNNGEVIQGLPQQESADGKVFHAGTRMQGNDVVTSGGRVLCVTALGESVAQAQQRAYQLAEGIQWPGSFSRKDIGYRAIARGK

SEQ ID NO: 3755 - protein, 428 aa, Yersinia pestis Angola
MNILIIGNGGREHALGWKAAQSPLADKIYVAPGNAGTALEPTLENVDIAATDIAGLLAFAQSHDIGLTIVGPEAPLVIGVVDAFRAAGLAIFGPTQAAAQLEGSKAFTKDFLARHNIPSAEYQNFTDVEAALAYVRQKGAPIVIKADGLAAGKGVIVAMTQEEAETAVNDMLAGNAFGDAGHRIVVEEFLDGEEASFIVMVDGGNVLPMATSQDHKRVGDGDTGPNTGGMGAYSPAPVVTDDVHQRVMDQVIWPTVRGMAAEGNIYTGFLYAGLMISADGQPKVIEFNCRFGDPETQPIMLRMRSDLVELCLAGTQGKLNEKTSDWDERPSLGVVLAAGGYPADYRQGDVIHGLPQQEVKDGKVFHAGTKLNGNHEVVTNGGRVLCVTALGETVAQAQQYAYQLAEGIQWEGVFCRKDIGYRAIARGK

SEQ ID NO: 3756 - protein, 428 aa, Yersinia pseudotuberculosis YPIII
MNILIIGNGGREHALGWKAAQSPLADKIYVAPGNAGTALEPTLENVDIAATDIAGLLAFAQSHDIGLTIVGPEAPLVIGVVDAFRAAGLAIFGPTQAAAQLEGSKAFTKDFLARHNIPSAEYQNFTDVEAALAYVRQKGAPIVIKADGLAAGKGVIVAMTLEEAETAVNDMLAGNAFGDAGHRIVVEEFLDGEEASFIVMVDGENVLPMATSQDHKRVGDGDTGPNTGGMGAYSPAPVVTDDVHQRVMDQVIWPTVRGMAAEGNIYTGFLYAGLMISADGQPKVIEFNCRFGDPETQPIMLRMRSDLVELCLAGTQGKLNEKTSDWDERPSLGVVLAAGGYPADYRQGDVIHGLPQQEVKDGKVFHAGTKLNGNHEVVTNGGRVLCVTALGETVAQAQQYAYQLAEGIQWEGVFCRKDIGYRAIARGK

SEQ ID NO: 3757 - protein, 428 aa, Dickeya dadantii Ech703
MNILIIGNGGREHALAWKAAQSPLADKVYVAPGNAGTALEPALENIHIPATDIPALLNFALQNDIGLTIVGPEAPLVIGVVDAFRAAGLKIFGPTQAAAQLEGSKAFTKDFLARHQIPTAEYQNFTEIEPALAYIRRKGAPIVIKADGLAAGKGVIVAMTLEEAENAATDMLAGNAFGDAGHRIVVEEFLDGEEASFIVMVDGEHVLPMATSQDHKRVGDNDTGPNTGGMGAYSPAPVVTDDIHQRVMEQIIWPTVRGMASEGNIYTGFLYAGLMISAEGQPKVIEFNCRFGDPETQPIMLRLRSDLVELCLAACDGKLDEKTSDWDERPSLGIVLAAGGYPAEYRTGDVISGLPTQDMADGKVFHAGTRLNGDDVVTNGGRVLCVTALGNSVAQAQQRAYELANPIKWQGSFCRTDIGYRAIDREKA

SEQ ID NO: 3758 - protein, 429 aa, Dickeya zeae Ech1591
MNILIIGNGGREHALAWKAAQSPLADKVYVAPGNAGTALEPALENVNITATDIPALLDFARQNAIGLTIVGPEAPLVIGVVDAFRAAGLKIFGPTQAAAQLEGSKAFTKDFLARQHIPTAEYQNFTEIEPALDYIRRKGAPIVIKADGLAAGKGVIVAMTLEEAENAATDMLAGNAFGDAGHRIVVEEFLDGEEASFIVMVDGEHVLPMATSQDHKRVGDQDSGPNTGGMGAYSPAPVVTDDVHQRVMDQIIWPTVRGMAAEGNVYTGFLYAGLMISADGQPKVIEFNCRFGDPETQPIMLRLKSDLVELCLAACDGKLDEKTSDWDARPSLGVVLAAGGYPGDYRTGDVISGLPTQEATDGKVFHAGTKLNGDDVMTNGGRVLCVTALGHSVADAQQRAYELAKPISWEGSFCRSDIGYRAIAREQKA

SEQ ID NO: 3759 - protein, 428 aa, Pectobacterium carotovorum PC1
MNILVIGNGGREHALAWKAAQSPLAKRVYVAPGNAGTALEAALTNVDIAATDVPALVAFAQENHIDLTIVGPETPLVIGVVDAFQSAGLKIFGPSQAAAQLEGSKAFTKDFLARHNIPTAEYQNFTEVEPALAYVRSKGAPIVIKADGLAAGKGVIVAMTLQEAENAIEDMLAGNAFGDAGHRIVVEEFLDGEEASFIVMVDGKNVLPMATSQDHKRVGDKDTGPNTGGMGAYSPAPVVTDEIHQRVMDQVIWPTVNGMAAEGNTYVGFLYAGLMISADGQPKVIEFNCRFGDPETQPIMLRLRSDLVELCLAACDGTLDQKDSVWDERPSLGVVLAAGGYPADYNTGDVISGLPQQDAEDGKVFHAGTKLNGINVVTNGGRVLCVTALGNTVAEAQQRAYEIAAGIQWQGVFCRKDIGYRAIEREQA

SEQ ID NO: 3760 - protein, 422 aa, Colwellia psychrerythraea 34H
MFQPISIFIGLRYSRSKSHTGFVSFITFFSTVGILLGVAALITVVSVMNGFEGELKKRILGIVPHVIVSDFSTIDTGTDQEKSWQNLREELLTQPNVLRVTPFLESEALIQSTKGLQGVLVQGIMPKFEQKNIVSTHMVAGSMENLSTQSYSLVLGQSLANKLQVSLGDEVRLVLPNKSVFTPMGRIPVQRVFTVAGIFHIGSQVDDAMVYVDSRYGAKLLRRTGDGIDKLRLYLDDAFNAKTVVKNLEQKQQNTEHSKTLDSINFSTWDESQGALFSAVKMEKNMMWLMLSLIVAVAAFNIVSALVMVVVEKQAEIGILQTLGLARIEVIKIFITQGMVNGLWGVSLGGLLGVILALNLNSILLVVGVNLFGFGMQDLPIKLEWFDVLTIILSALAMSFLATLYPAYQASTTQPAQVLRNE

SEQ ID NO: 3761 - protein, 411 aa, Shewanella denitrificans OS217
MKNFGVSFFIGYRYWRAKKANAFASFLTLFAVSGIFLGVVALILVSSVMNGLEGQLKQRILGAIPQLTLVNDAGFSQWQQDIAVIEALPQVLGAVPTVTTQAMIQSVDNIGAAQVYGIFPEQEAALSAKIGSVYSDAFGTLEANQYHIVLGVELARKLNVNIGDKIRLLSGDGVVYSPIGPVPSQRKFVVAGLFETGSQVDAGVAYVHYQDARRLMRLESLSINEVRLYLTDPFLAPDLSQQAISLMAQQGIEVHSRDWRADFGQLFAAVKMEKSMMSLMLSLIVAVAAFNIVSALVMMVVDKTADVAVLKTQGLSTQAVMNIFIVQGLLNAVIGLSSGLLVGILLALNLNPILNQFGVSILGTGQSLPVALSLEQLSLIAVGTLIITLLATLYPAFTAARVQPASALRYE

SEQ ID NO: 3762 - protein, 397 aa, Baumannia cicadellinicola Homalodisca coagulata
  misc_feature (82)..(82): Leucine or Isoleucine
MYQPLALYIGLRYMCRQVSNGRFISLLSTIGIILGVMALVTILSIMNGFERVLENNVLRFIPQALLTTKNGCLNPLSAPFFXKEDILKDKGVIGIAPFTTGDVILQSPNSFAMGIILGINSSDSEPLANYLVDTHISQLSPGKYHIILGQKLADKLGVKYNDKIRIIVPSVSQFTPLGRIPSQRLFTVIGTYITNSEVDQYQILVNQQDASHLMHYPSGYVTGWRLWLQQPLKVDSISKIQCLPNELIWKDWRERKSELFHAIHMEKNIMGLLLSLIVVVAAFNILTSLCMIVREKKSEVAIFATQGLQFYQIMPVFMIQGVSAGIIGALVGAILGVLLANTLNYFPLFHNNTLPINIEPLQIVTIIILTTVLAWLSTIYPSWCAVTKNVVELLRDE

SEQ ID NO: 3763 - protein, 410 aa, Shewanella baltica OS155
MNPGFPFYIGYRYWRARKANAFASFITLFAVSGIFLGVAALIVVSSVMNGLEGQLKQRILGAVPQLTVYSEAPLVDWTEQASALKALPGVLGVTPSVSTQAMVQSAASIRAVQVYGVFPELAEKLSSVAQHTYSGAFEQLTSGDYKVILGSELARQLKVAPGDTVRLLSGDGVVYSPLGPVPSQRKFLVSGIFEMGSQVDAGVAYIHYQDAKRLMRQPSEAIDQLRLYLADPFSAPALAPKVQDILAKQGVKATTSDWRDTYGHLFGAVKMEKNMMSLMLSLIVAVAAFNIVSALVMMVVDKTTDVAVLKTQGVTTPAVMGIFVVQGSLNAVLGLVLGLAVGILITLNLNGIMTTLGISILGVGQSLPVKLELMQLSVIVIGTLLVTLLATLYPALRAANVQPATALRYE

SEQ ID NO: 3764 - protein, 399 aa, Enterobacter sp. 638
MYQPVALFIGLRYMRGRAADRFGRFVSWLSTIGITLGVMALVTVLSVMNGFERELQNNILGLMPQAVLSSTNGSINPQQLPESAVKLQGVNRIAPLTTGDVVLQSARSVSVGVMLGIDPAQKDPLTPYLVNVKQTDLAPGQYNVILGEQLAGQLGVNRGDQLRVMVPSASQFTPMGRLPSQRLFNVIGTFAANSEVDGYQMLVNIQDASRLMRYPLGNITGWRLWLNEPLKVDVLSEQKLPEGTKWQDWRERKGELFQAVRMEKNMMGLLLSLIVAVAAFNIITSLGLMVMEKQGEVAILQTQGLTPRQIMAVFMVQGASAGIIGALLGAVLGALLASQLNNLMPIIGILLDGAALPVAIEPLQVVGIALVAMAIALLSTLYPSWRAAATQPAEALRYE

SEQ ID NO: 3765 - protein, 410 aa, Shewanella putrefaciens CN-32
MNLGIPFYVGYRYWRARKANAFASFITLFAVSGIFLGVAALIVVSSVMNGLEGQLKQRILGAVPQLTVYTSTPLNDWTEQANVLKALPGVQGVTPSVSTQAMVQSAANIRAVQVFGVFPELAAKLSVIAQHTYSGAFDELVAGQYKIILGSELARQLKVNPGDTVRLLSGDGVVYSPFGPVPSQRKFLVSGIFEMGSQVDAGVAYIHYQDAKRLMRQPSEAIDQLRLYLDDPFSAPALSPKVQDILLKQHIEATTSDWRDTYGHLFGAVKMEKNMMSLMLSLIVAVAAFNIVSALVMMVVDKTTDVAVLKTQGLTTPAVMGIFIVQGSLNAILGLVLGLGVGILLTLNLNGIMSTLGISILGAGQVLPVKLELTQLSVIVVGTLLVTLLATLYPALRAARVQPATALRYE

SEQ ID NO: 3766 - protein, 410 aa, Shewanella baltica OS185
MNPGFPFYIGYRYWRARKANAFASFITLFAVSGIFLGVAALIVVSSVMNGLEGQLKQRILGAVPQLTLYSEAPLVDWTEQASALKALPGVLGVTPSVSTQAMVQSAASIRAVQVYGVFPELAEKLSSVAQHTYSGAFEQLTSGDYKVILGSELARQLKVAPGDTVRLLSGDGVVYSPLGPVPSQRKFLVSGIFEMGSQVDAGVAYIHYQDAKRLMRQPSEAIDQLRLYLADPFSAPALAPKVQDILAKQGVKATTSDWRDTYGHLFGAVKMEKNMMSLMLSLIVAVAAFNIVSALVMMVVDKTTDVAVLKTQGVTTPAVMGIFVVQGSLNAVLGLVLGLAVGILITLNLNGIMTTLGISILGVGQSLPVKLELMQLSVIVIGTLLVTLLATLYPALRAANVQPATALRYE

SEQ ID NO: 3767 - protein, 407 aa, Shewanella pealeana ATCC 700345
MNLSLSFYIGYRYWRSRKANAFASFITIFSVSGILLGVAALIVVSSVMNGLENQLKQRILGAVPQLTVHSQTAIENWPSQVEKLSQLPGVQGATPSISTQAMVQSPSNIGAAQVYGIYPEQEKTLLNTTKRVYSGDFDALESGKYRVILGAELARTLDVAPGDKIRILSGDGVVYTPLGPVPSQRKFTVAGVFEMGSQVDATLAYVHHDDAQRLMRQKAGEVKELRLYLDDPFNAAKMAPEVVAQFATPVTTTDWRDTYGHLFGAVKMEKNMMSLMLSLIIAVAAFNIVSALVMMVVDKTTDVAVLKTQGLTTANVMGIFMIQGSLNAVIGLISGVAVGSLLTLNLNTITQALGISILGAGQNLPVQLELSQLTWIVVGTLVMTLVATVYPAIRAANVQPAAALRYE

SEQ ID NO: 3768 - protein, 410 aa, Shewanella baltica OS195
MNPGFPFYIGYRYWRARKANAFASFITLFAVSGIFLGVAALIVVSSVMNGLEGQLKQRILGAVPQLTLYSEAPLVDWTEQASALKALPGVLGVTPSVSTQAMVQSAASIRAVQVYGVFPELAEKLSSVAQHTYSGAFEQLTSGDYKVILGSELARQLKVAPGDTVRLLSGDGVVYSPLGPVPSQRKFLVSGIFEMGSQVDAGVAYIHYQDAKRLMRQPSKEISQLRLYLADPFSAPALAPKVQDILAKQGLKATTSDWRDTYGHLFGAVKMEKNMMSLMLSLIVAVAAFNIVSALVMMVVDKTTDVAVLKTQGVTTPAVMGIFVVQGSLNAVLGLVLGLAVGILITLNLNGIMTTLGISILGVGQSLPVKLELMQLSVIVIGTLLVTLLATLYPALRAANVQPATALRYE

SEQ ID NO: 3769 - protein, 410 aa, Shewanella baltica OS223
MNPGFPFYIGYRYWRARKANAFASFITLFAVSGIFLGVAALIVVSSVMNGLEGQLKQRILGAVPQLTLYSEAPLVDWTEQASALKALPGVLGVTPSVSTQAMVQSAASIRAVQVYGVFPELAEKLSSVAQHTYSGAFEQLTSGDYKVILGSELARQLKVAPGDTVRLLSGDGVVYSPLGPVPSQRKFLVSGVFEMGSQVDAGVAYIHYQDAKRLMRQPSEAIDQLRLYLADPFSAPALAPKVQDILAKQGVQATTSDWRDTYGHLFGAVKMEKNMMSLMLSLIVAVAAFNIVSALVMMVVDKTTDVAVLKTQGVTTPAVMGIFVVQGSLNAVLGLVLGLAVGILITLNLNGIMTTLGISILGVGQSLPVKLELMQLSVIVIGTLLVTLLATLYPALRAANVQPATALRYE

SEQ ID NO: 3770 - protein, 401 aa, Dickeya zeae Ech1591
MYQPVALFIGLRYMRGRAADRFGRFVSWLSAIGITLGVMALVTVLSVMNGFERELENSILGLMPQALITTPQGSLNPQTLPASSLSALKGVNRIAPLTTGDVVLQSARSVAVGVMLGINPDEQEPLASYLTKAASLQQLQPSQYQVILGEQLANQLGVKPGDHVRLMVTGASQLTPMGRVPSQRLFTVAGTFYAHSEVDGYQLLVNQQDASRLMRYAPGSITGWRLWLDQPLTVDTLSQQALPAGTAWKDWRERKGELFQAVRMEKNMMGLLLSLIVAVAAFNIITSLGLLVMEKQGEVAILQTQGLTQRQIMAVFMVQGGGAGVVGALVGAILGMVLASQLNTLIPMLGLLIDGGALPVQIQPLQVIAIALVAMLLALLSTLYPSWRAAATHPAEALRYE

SEQ ID NO: 3771 - protein, 400 aa, Pectobacterium carotovorum PC1
MYQPVALFIGLRYMRGRASDRFGRFVSWLSAIGITLGVMALVTVLSVMNGFERELEDNILGVMPQAVISTPQGSLNPALIPASSLDSLDGVTRIAPLTTGDVVLQSARSVAVGVMLGIDPDEQEPLSRYLVNVKQQQLQPGQYQVILGEKLAAQLEVKAGDQIRMMVTSASQLTPMGRIPSQRIFTVVGTFAANSEVDSYQLLVNQQDASRLMRYPANHITGWRLWLEKPLSVDTLSTQTLPEGTVWKDWRERKGELFQAVRMEKNMMGLLLSLIVAVAAFNIITSLGLLVMEKQGEVAILQTQGLTQRQIMAVFMVQGGSAGVIGALLGALLGTLLASQLNTLMPILGVLLDGAALPVDIDPAQVVTIAISAMVIALLSTLYPSWRAAAVQPAEALRYE

SEQ ID NO: 3772 - protein, 876 aa, Escherichia coli BL21 (DE3)
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLAAGSLKVGDAVQADVDEARRARIRLNHSATHLMHAALRQVLGTHVSQKGSLVNDKVLRFDFSHNEAMKPEEIRAVEDLVNTQIRRNLPIETNIMDLEAAKAKGAMALFGEKYDERVRVLSMGDFSTELCGGTHASRTGDIGLFRIISESGTAAGVRRIEAVTGEGAIATVHADSDRLSEVAHLLKGDSNNLADKVRSVLERTRQLEKELQQLKEQAAAQESANLSSKAIDVNGVKLLVSKLSGVEPKMLRTMVDDLKNQLGSTIIVLATVVEGKVSLIAGVSKDVTDRVKAGELIGMVAQQVGGKGGGRPDMAQAGGTDAAALPAALASVKGWVSAKLQ

SEQ ID NO: 3773 - protein, 874 aa, Shewanella oneidensis
MYQTTAALRSAFLEFFRSNGHQVVDSSSLVPGNDPTLLFTNAGMNQFKDVFLGMDKRSYTRATTAQRCVRAGGKHNDLDNVGYTARHHTFFEMLGNFSFGDYFKEDAIRFGWTFLTEVLMLPKERLCVTIYQTDDEAFEIWNKKIGVAAENIIRIGDNKGAPYASDNFWQMGDTGPCGPCTEIFYDHGDHIWGGRPGSPEEDGDRFIEIWNIVFMQYNRQASGEMLPLPKPSVDTGMGIERIAAIMQGVHSNYEIDIFRALIAKAAEIIGVADLSNKSLRVIADHIRSCAFLVADGVMPSNEGRGYVLRRIIRRAVRHGNKLGATEAFFYKLVPTLIDVMGDAAKGLAETQVIVEKALKAEEEQFARTLERGLGILDSALNELQGDTLDGETVFKLYDTYGFPVDLTADVCRERNIIVDEAGFEAAMAEQRSRAQAAGNFGADYNAALKIDAETAFCGYSELTGNAKVTALYLNGESVPAINTGDDAVVVLDVTPFYAESGGQVGDKGVLMAQGIEFTVNDTQKFGQASGHKGTLTAGSLSVGQVLEAKVDKKLRHRTQLNHSVTHLLHAALRQVLGTHVTQKGSLVDPERLRFDFSHFEAVKPFELKQVEELVNTQIRRNHELKVAEMAIDEAKEKGAMALFGEKYDSQVRVVTMGDFSIELCGGTHVGRTGDIGLFKITSEGGIAAGVRRIEAVTGAAAMAYVAQQQAELEEAASLLKADAHSVVTKLKVQLDKMKQLEKEMQQLKDKLAAAASADLAGDAVVVNGVNVLIKKLEGVEAGALRGLQDELKQKLKSAIIVLGVAQEGKVNLIAGVSNDLIAKIKAGELVAMVATQVGGKGGGRPDMAQAGGSQPENLDAALSQVLPWITERLA

SEQ ID NO: 3774 - protein, 875 aa, Geobacter sulfurreducens
MTGKEIRARFLKFFADRGHAVVPSSPLIPHNDPTLLFANAGMNQFKDCFLGLEKRDYVRACSSQKCVRAGGKHNDLENVGRTARHHTFFEMLGNFSFGDYFKKEAIAFAWEFLTKDLGLDKDRLYVTVYTDDDEAADIWHLQEGVPRERIYRFGEKDNFWAMGDTGPCGPCSEIFWDNGPEVGCGSPDCAVGCDCDRYMEIWNNVFMQFNRSADGVLTPLPKPSVDTGMGLERISTVMQGVKSNYDTDLFQGIIGHVEKLSGKRYRHSEKDDVSMRVMADHVRATTFLICDGVLPSNEGRGYVLRRIMRRAARHAKMLGFAEPVICRMVEAVNAMMGDAYPELLEREEYIRKVIRAEEERFAETLDRGLAILNEAVADLKNEGRTVIPGETLFRLYDTFGFPTDLTADIVRSEGFTIDEDGFEACMERQREQAREHWKGSGEEGIAEVHKTLHSRGVRSRFTGYEARTAYSPVTVLLKGGAEVAEATAGDRVEIITDATPFYGESGGQVGDTGTISTGSAHVEVTETLRPFPDLIVHRGTVVEGTIRQGDACDLKVAPGRDATARNHTATHLLQSALRQVLGDHVKQSGSLVGPDRLRFDFTHFAAMTPEEIRRVEEIVNSCIMANDDVHAREMALDEAMEIGATALFGEKYGDTVRVVRVGEVSMELCGGTHVHAAGDIGFFKILSEAGIAAGVRRIEALTGMGALRHVQQLEDERKEIAALIKAEGGDNVERLQRLLTRQKDMQREIETLESRLNAARSADLLADVREVNGVKVLATLAEVDDPKKLRELADTLKDRLGSGVVALGCVKEGKANLLVAVTKDLTGRVKAGDLIRQLSPIIGGSGGGKPELAQAGGTLPDKLGEALGKVCELVP

SEQ ID NO: 3775 - protein, 867 aa, Methylococcus capsulatus Bath
MTSAELRARFLKFFADRGHTVVASSSLVPVNDPTLLFTNAGMVQFKDVFLGREHRPYVRAASAQRCVRAGGKHNDLENVGYTARHHTFFEMLGNFSFGDYFKREAIVYAWEFLTEVLMLPPERLWITVYAEDKEAERIWLEEVGVDPGRFTRIATSDNFWSMGDTGPCGPCSEIFYDHGPSVAGGPPGTPEEDGDRYVEIWNLVFMQYERAGDGTLTPLPKPSVDTGMGLERLAAVMQRVRNNYDIDLFRNLVKAAAELAGTTDLAQSSLRVIADHIRSCAFLVTDGVLPSNEGRGYVLRRIIRRAIRHGYKLGIREPFFYKLVGPLCAEMGQAYPELVEARPRVEQVLDKEEERFAETLEQGMKILDVAIRDLGSPVISGDTAFQLYDTYGFPVDLTADVAREHGLQVDMAGFERAMEAQRERARAASHFSVDYSQEIHLDVACEFTGYRNAVEDTRIVALLRDGQAVDRLEAGEDGVVVLEKTPFYAESGGQVGDRGVIRSDSAVFEVADTRKQGSDLILHRGKLREGALLRGAVCRAEVEQSLRLATALNHSATHLLHAALRRVLGEHVTQKGSLVDPERLRFDFSHFEPVSPEQLDEIERLVNREIRRNAEVTAEVMAKDAAMRLGAMALFGEKYGDDVRVLRIGDFSTELCGGIHARRAGDIGLFKIVSESGVAAGVRRIEAVTGAAAVEAVEATERLLRRLAERMKAGRDTLEERLDQMFEKNRALERELERLKAKTAGAAGADLASRAVDIAGVKVLAARVDEADARMLRELVDQLKDRLGSAAIVLAAVEGGKVSLVAGVTRDQTGHIRAGDLVNSVATRIGGKGGGRPDLAQAGGNRPEELQGALDGVPEWVRRMLNA

SEQ ID NO: 3776 - protein, 873 aa, Nitrosococcus oceani ATCC 19707
MKSSAELRKIFLDYFRHQSHEIVPSGPLVPANDPTLLFTNAGMVQFKEVFLGREVRAYHRAASAQRCVRAGGKHNDLENVGYTARHHTFFEMLGNFSFGDYFKREAIGYAWELLTEVLKLPPERLWVTVFKEDDEAANIWLQEIGVSPERFSRCGAEDNFWSMGETGPCGPCSEIFYDHGPEIEGGPPGSPEQEGDRYTEIWNLVFMQYDRGKEGRLSPLPRPSVDTGMGLERLAAVMQGVHDNYNIDLFRNLIAAITALSGIQNQEQTSLRVIADHIRSCVFLIVDGIQPSNEGRGYVLRRIIRRAIRHGHKLGLRDPFFYRLVEPLVQEMGEAYPELFRLQSQVERVLKLEEERFNETLEQGLKILEQDIIDLSDAVIPGETIFRLYDTFGFPVDLTADIARERKLTLDMKGFEQAMAKQRKRARAASRFKIEYGSELQMDLETEFTGYEQLRGEGQIAALFRLAETMETVEQLSAGESGMVVLDRTPFYAEAGGQVGDRGTLRGSNGLFNVTDTHKQGAAHVHLGEVRLGQLRVGDSIQSEVDRKYRTPTRLNHSATHLLHAALREVLGEGVIQKGSLVASDRLRFDFSHLEAVQSGQLRQIEHLVNAKIRANLPVETQIMPLQQALDAGVMALFGEKYGEQVRVLRMGDFSMELCGGTHVDRTGDIGLFKIINEMGVAAGIRRIEAVTGEAALSWVEEGEVCLEALMGRLKASRNSAVDKLEQLQQQTRQQEKELQRLKAKLATTGGADLSIQAQEIRGIKVLAARIDGVDSKTLRATVDQLKGKLITAAVVLGTVVEDKVVLIAGVTNNATSRIKAGDLVNFVAEQVGGRGGGRPDMAQAGGRNPDKLDAALDLVPKWVEGQLTSGAQ

SEQ ID NO: 3777 - protein, 882 aa, Pelobacter carbinolicus
MTGNEIRSRFLKFFQDHGHTVVPSSALIPHNDPTLLFINAGMNQFKDVFLGREKRDYVRATSAQKCVRAGGKHNDLENVGQTARHHTFFEMLGNFSFGDYFKKEAIDHAWKFLTEEMGLPKDKLWVTVFREDDEAYDIWRDQQGIPEERLIRMGEKDNFWSMGDTGPCGPCSEILIDQGESMSCGDECGIGKCDCDRYLELWNLVFMQFNRDADGTMTPLPKPSIDTGMGLERITAVMQGVQSNYDCDLLRGIIAHVEELSGKRYGDNAEHDMSMRVIADHSRATAFLIADGVLPSNEGRGYVLRRIMRRAARHAKMLGFADPVLYRTATFVLQSMAEAYPEPAQRADYVAKIVKIEEERFIQTLDNGLRILTEEVERLKAANATVLPGDVAFKLYDTFGFPLDLTADILRGENVTIDEDGFEACMEEQRQKAREHWKGSGEEAISGIYRQLAEEGARTDFTGYGELTGQSEILAILLDGQPVSSAPAGAKVEIVTAATPFYGESGGQTGDCGTLAAGDAEVTITDTKKPLPELFVHVGEIAAGTLQTGETATLTVDRERRQATALNHTATHLLQAALVEVLGEHVKQAGSLVTPERLRFDFIHFSAMSAEELERVETLVNCRIRENAGVDTREMDHEQAVAEGATALFGEKYGDKVRVVRVGDISMELCGGTHANASGDIGLFKILQETGIAAGVRRIEAVTGAKALQVVRDQERTLDDLASLIKTDRPQLEARLRKLLERQKELEREIESLQGKLNADQAGDLLQQATEIDGISVVCGRVDNLDGKALRELADQVRDRLSSGVLILGSAHEGKAGLLVAVTKDLTKRLQAGALVKQLAAMVGGGGGGRPDLAQAGGSKPEQLDEALASVPQRISEALNAA

SEQ ID NO: 3778 - protein, 876 aa, Geobacter metallireducens GS-15
MTGNELRARFLKFFEDRGHTVVPSSLLIPHNDPTLLFANAGMNQFKDCFLGMEDRGYTRATSSQKCVRAGGKHNDLENVGRTARHHTFFEMLGNFSFGDYFKKEAIAFAWEFLTKDLGLDKDRLYVTVYTDDDEAADIWHHQEGVPRERIFRFGEKDNFWSMGDTGPCGPCSEIFWDNGPEVGCGSPDCTVGCDCDRYMEIWNNVFMQFNRSADGTMTPLPKPSVDTGMGLERICTVMQGVKSNYDTDLLQGVIRHVERLSGKRYRENEKDDVSMRVIADHARATTFLICDGVLPSNEGRGYVLRRIMRRAARHAKMLGFAEPVLYRTVDAVNEMMGGSYPELLEREEYIKKVIRAEEERFAETLDRGLAILNDAVAQLKGEGKTVIPGETLFRLYDTFGFPTDLTADIVRAEGFTIDEPGFEACMGRQREQAREHWKGSGEEGIAAVHKELHNRGVRSVFVGYDEKCSYAAIGSILRGGSEVAEAKAGEDVEIITDRTPFYGESGGQAGDTGTISTGSAHVRVTGTIRPYPDLIVHRGTVVEGTIKTGEACDLKVASVDRDATARNHTATHLLQTALRRVLGEHVKQAGSLVAPDRLRFDFTHFAAMTPEEIRRVEEIVNTFIMENDTVHAREMAVEEAMESGATALFGEKYGDRVRVVKVGEVSAELCGGTHVRAAGDIGSFKILSEAGIAAGVRRIEALTGMGALRHIQELEDEKRQIAALMKAEGGDNIDRLQKLLARQREMQREIETLQGQLNAAKSGDLLADVREVNGVKVLATKVEVDDPKKLRELADTLKDRLGSGVVALGCEKDGRANLLVAVTKDLAGRIRAGDIIRQLAPVIGGSGGGKPELAQAGGSQPDMLAEALGKVYGLIG

SEQ ID NO: 3779 - protein, 864 aa, Thiomicrospira crunogena XCL-2
MTSAELRKAFLDFFVKQGHTAVHSSPVVPGNDPTLLFTNAGMVQFKETFLGQETREYKRATSVQRCIRAGGKHNDLENVGYTARHHTFFEMLGNFSFGDYFKREAIQYAWTFLTEELGLPEEKLWITVFEEDREAEDIWLKEMGVSAERFSRCGAKDNFWSMGDTGPCGPCSEIFYDHGADVAGGPPGSPDEDGDRYIEIWNLVFMQFDRSEDGTLTPLPKPSVDTGMGLERLAAVMQNQHNNYDIDLFQAIVKKASELTGEKDLANSSLRVIADHIRSCAFMVVDGVLPSNEGRGYVLRRIIRRAIRHGYKLGQTDIFFYQLVPTLVEQMGEAYPELVKEQANVERALKLEEERFAETLENGMKILEEDIAQLSGSVISGSTAFKLYDTYGFPLDLTADVARERNLSVDEAGFEQEMEAQRARARSASNFGAQSKNKVDYTGSTHFIGYEQDEAEAEIAAIFVDNVSVEKASEGQEAIVILNQTPFYAESGGQVGDQGSLTEGMNSFHVDNCQKQGAAFLHIGKVTAGSISVGQTILAHIDVKARRASERNHSATHLLHAALRTVLGTHVGQKGSLVQPERLRFDFSHFEPISAEQLLEIEQLVNHNIMLNAQVMMEEMDIEAAKAKGAMALFGEKYGDVVRVVDMGDFSIELCGGTHVNWTGEIGPFRITSESGIASGVRRIEAVTGEAAWQTIYDMEKSLLNIAANLKTDKPQVESKVAQLVTEQKELEKQLKQLQSKLASSQGDDLASSVTEVNGVNVLAAELEGADVNTLRETLDKLRDKLEPAAIVLAAVDGDKVSLVAGVSKSITGNVKAGELVNHVAQQVGGKGGGRPDMAQAGGKDPSKLKEALASVKEWVATVA

SEQ ID NO: 3780 - protein, 874 aa, Methylobacillus flagellatus KT
MKSNQIRQAFLDYFASKGHQIVSSSSLVPAGDPTLLFTNAGMNQFKDVFLGFDKRPYTRATSSQKCVRAGGKHNDLENVGYTARHHTFFEMLGNFSFGDYFKRDAIHYAWELLTQVFKLPADKLTVTVYAEDDEAYDIWTREIGVPAERVIRIGDNKGARYASDNFWMMGDTGPCGPCTEIFYDHGEHIPGGPPGSPDEDGDRFIEIWNNVFMQFNRDEQGVMHPLPKPSVDTGMGLERIAAVLQGVHSNYEIDLFQNLIKAAARVTNTTDLDSPSLKVLADHIRACSFLIADGVIPGNEGRGYVLRRIIRRAIRHGYKLGARQAFFHLMVSALVNEMGDAYPELKSGEERITSILRQEEDRFFETIEHGMAILEAELEEMAKTGNHVFNGETAFKLHDTFGFPLDLTADVCRERGVSVDSAAFDAAMARQKEQARAAGKFKMAANLEYTGNATTFHGYDTLEAQGKVLALYKDGSAVPALNEGELGVVVLDNTPFYAESGGQVGDQGILKGAEGIFQVEDTQKIQASVFGHHGVLSTGTLRVGDEVSARVDLLSRHRTMRHHSATHLMHKALRAVLGSHVQQKGSLVDPDKTRFDFSHNAPVTADEIRRIEDIVNAEILANTPTLARVMPIDEAQKTGAMMLFGEKYGDEVRVLDIGTSRELCGGTHVSRTGDIGLFKIVSESGVAAGVRRIEAAAGDVALRHIQQQQQLLADAAASFKVPAIELAGKISQTLEQIKALEKELARLKSKLASSQGDELASQAVNIGGIKVLAATLEGADANTLRETMDKLKDKLKTAAIVLASVNGDKVSVAAGVTTDTTARIKAGELVNFVAAQVGGKGGGKPDMAMAGGSDPSQLPRALASVAGWVEERLK

SEQ ID NO: 3781 - protein, 868 aa, Chromohalobacter salexigens DSM 3043
MKSADIRQAFLTFFEEHGHTIVPSSSLVPANDPTLLFTNAGMVPFKDVFLGRDPRPYVRATSAQRCVRAGGKHNDLDNVGYTARHHTFFEMLGNFSFGDYFKRGAIRFAWTFLTERLGLPADKLWVTVHVSDDEAERIWKDEIGIDPARFSKLDEDNFWQMGDTGPCGPSSEIFFDHGPEVAGGPPGSPEEDGDRYIEIWNLVFMQFDRDSAGTLNPLPKPSIDTGMGLERVAAVLQGVHSNYEIDLFQNLLNAASEATGYDDTSAPSLRVIADHIRSCAFLITDDVLPSNEGRGYVLRRIIRRAIRHGHKLGAREPFFHTLVAALDAEMGAAYPELRKARPRIEKVLLKEEEQFARTLDHGMGLLTEALETLDGEVLPGETVFKLYDTYGFPFDLTADVCRERGVTLDEVGFQRELEAQRERARAASQFGADYTAALDLEGETAFTGYERLEDEARVTALVDREGNALAALEAGQHGVVVLDRTPFYGESGGQAGDTGYLEADGMRFQVTDTQKQGGHHLHHGVLVEGRLDVGASVTPRVDASLRAATMRNHSATHLLHEALRQVLGEHVQQKGSLVTAERLRFDVSHFEAMTRAQLDEVERIVNAQILANAATRIEHMTLDEAKAKGAAALFEAKYADSVRVLTIGADDFSIELCGGTHVARSGDIGCFHILSEAGVAAGVRRIEAVTGEGALAYFRDQEAKVARVAEQLKAKPEQVEARLEATLERNRTLEKELERLKAKLASATSGDMLADVREVAGVKLLAKQVEGVGGKELRGLLDQLKNKLGSGVIVLGVAGDEKVSLIAGVTDDLTARLKAGDLVKHVAEQVGGKGGGRADMAQAGGSRPQALPDALASVPSWVEARLGE

SEQ ID NO: 3782 - protein, 865 aa, Pseudoalteromonas atlantica T6c
MSKSTAQIRQAFLNFFADKGHQKVSSSSLVPSDDPTLLFTNAGMNQFKDVFLGTEQRKYTRATSSQRCVRAGGKHNDLENVGYTARHHTFFEMLGNFSFGDYFKHQAIGYAWSFLTEVLKLPKDKLLVTVYSEDDEAFDIWHNDIGIPKEKIIRIATSDNFWSMGDTGPCGPCSEIFYDHGEHIWGGPPGSPEEDGDRFIEIWNLVFMQFNRQANGDMLPLPKPSIDTGMGLERISAIIQNVHSNYEIDIFQNLIKATAKIVGVTSLEDKSLRVVADHIRSCSFLISDGVMPSNEGRGYVLRRIIRRAVRHGNKLGANGVFFYKLVAALATEMGDAYPELNEQRAVIEKVLRVEEEQFSRTLERGMLILNDALNELEGKVVPGDVVFKLYDTYGFPADLTNDVAREKGLSIDEEGFEQAMAEQRKRAQKASNFDVDYNEQLRSDLESIFVGYEHEDNTATITELFFKGQSVNELAAGAEGTVILDESPFYAEAGGQAGDTGTLVTDAGGFSVKDTVKLGKAIAHKGAALSKLSVGDSVLAKVNGVRRHAIKLNHSATHLMHAALKSILGEHVNQKGSLVQADRLRFDFSHFEAMSKEQVLAVETMVNEQILANHPLQTQLMGLEQAKEAGAMALFGEKYDDDVRVVSMGSFSMELCGGTHVERTGDIGLFKIISESGIASGVRRIEAVTGLTALQHVQQQTFELSSISAVLKTDVNSAGERVVQLIEQTKTLEKEVAKLKQEIANSAGSDLLSQINEINGVKVLSYHVQGIESGALRTMIDDLKNQIGSGVILLGLATGDKVSLIAGVTKDLTHKVKAGELVNFVAQQVGGKGGGRPDMAQAGGSQPENLDTAIASVSEWLQERL

SEQ ID NO: 3783 - protein, 874 aa, Shewanella sp. MR-7
MYQTTAALRSAFLEFFRSNGHQVVDSSSLVPGNDPTLLFTNAGMNQFKDVFLGMDKRSYTRATTAQRCVRAGGKHNDLDNVGYTARHHTFFEMLGNFSFGDYFKEDAIRFGWTFLTEVLKLPKERLCVTVYQTDDEAFEIWNKKIGVAAENIIRIGDNKGAPYASDNFWQMGDTGPCGPCTEIFYDHGDHIWGGRPGSPEEDGDRFIEIWNIVFMQYNRQASGEMLPLPKPSVDTGMGIERIAAIMQGVHSNYEIDIFRALIAKAAEIIGVTDLSNKSLRVIADHIRSCAFLVADGVMPSNEGRGYVLRRIIRRAVRHGNKLGATEAFFYKLVPTLIEVMGDAAKGLADTQVIVEKALKAEEEQFARTLERGLGILDSALNELQGDTLDGETVFKLYDTYGFPVDLTADVCRERNIIVDEAGFEAAMAEQRSRAQAAGNFGADYNAALKIDAETAFCGYSELTGNAKVTALYLNGESVPAINAGDDAVVVLDVTPFYAESGGQVGDKGVLVAQGIEFAVSDTQKFGQASGHKGTLTAGSLSVGQVLEAKVDKKLRHRTQLNHSVTHLLHAALRQVLGTHVTQKGSLVDPERLRFDFSHFEAVKPAELKQVEELVNTQIRRNHELKVAEMAIDEAKEKGAMALFGEKYDAQVRVVTMGDFSIELCGGTHVGRTGDIGLFKITSEGGIAAGVRRIEAVTGAAAMAYVAQQQAQLEEAAALLKGDTQSVVAKLKVQLDKMKQLEKDMQQLKDKLAAAASADLAGDAVVVNGVNVLIKKLEGVEAGALRGLQDELKQKLKSAVILLGVAQEGKVNLIAGVSNDLVGKVKAGELVAMVAAQVGGKGGGRPDMAQAGGSQPENLDAALSQVLPWITERLA

SEQ ID NO: 3784 - protein, 874 aa, Shewanella sp. MR-4
MYQTTAALRSAFLEFFRSNGHQVVDSSSLVPGNDPTLLFTNAGMNQFKDVFLGMDKRSYTRATTAQRCVRAGGKHNDLDNVGYTARHHTFFEMLGNFSFGDYFKEDAIRFGWTFLTEVLKLPKERLCVTVYQTDDEAFEIWNKKIGVAAENIIRIGDNKGAPYASDNFWQMGDTGPCGPCTEIFYDHGDHIWGGRPGSPEEDGDRFIEIWNIVFMQYNRQASGEMLPLPKPSVDTGMGIERIAAIMQGVHSNYEIDIFRALIAKAAEIIGVTDLSNKSLRVIADHIRSCAFLVADGVMPSNEGRGYVLRRIIRRAVRHGNKLGATEAFFYKLVPTLIEVMGDAAKGLADTQVIVEKALKAEEEQFARTLERGLGILDSALNELQGDTLDGETVFKLYDTYGFPVDLTADVCRERNIIVDEAGFEAAMAEQRSRAQAAGNFGADYNAALKIDAETAFCGYSELTGNAKVTALYLNGESVPAINAGDDAVVVLDVTPFYAESGGQVGDKGVLVAQGIEFAVSDTQKFGQASGHKGTLTAGSLSVGQVLEAKVDKKLRHRTQLNHSVTHLLHAALRQVLGTHVTQKGSLVDPERLRFDFSHFEAVKPAELKQVEELVNTQIRRNHELKVAEMAIDEAKEKGAMALFGEKYDAQVRVVTMGDFSIELCGGTHVGRTGDIGLFKITSEGGIAAGVRRIEAVTGAAAMAYVAQQQAQLEEAAALLKGDTQSVVAKLKAQLDKMKQLEKDMQQLKDKLAAAASADLACDAVVVNGVNVLIKKLDGVEAGALRGLQDELKQKLKSAVILLGVAQEGKVNLIAGVSNDLVGKVKAGELVAMVAAQVGGKGGGRPDMAQAGGSQPENLDAALSQVLPWITERLA

SEQ ID NO: 3785 - protein, 869 aa, Alkalilimnicola ehrlichei MLHE-1
MKSSAEIRNAFLEFFEHRGHTVVPSSPLVPANDPTLLFTNAGMVPFKDVFLGKEQRGYTRACSSQRCVRAGGKHNDLDNVGYTARHHTFFEMLGNFSFGDYFKREAIEYAWEFLTRTIGLPAERLWVTVYEEDDEAADIWLNEIGVDPERFGRIGAADNFWSMGDTGPCGPCSEIFYDHGPEVPGGPPGSPEEDGDRYVEIWNLVFMQYDRDAEGRLAPLPMPCVDTGMGLERLAAVVQGVHSNFEIDLFRRLIGAAAALAGLPEDSDNASLKVIADHIRACAFLITDGVVPANDGRGYVLRRIIRRAVRHGYKLGIDEPFFHRLVQPLADEMGGAFPELPERQALVERLLLQEEQRFRETLEQGLKLLEEDLRQLTGAEIPGETVFKLADTYGFPVDLTADIARERDLTLDMAGFEACMAAQRERARAHSQFKVQHGEGEQFEGESHFIGYDQLEGHGEVLALFRDGRSVQTLSAGEEGMVILDQTPFYAESGGQVGDQGVLETAGGEVFEVRDTLKQGEGHGHLGRLREGRIHVGDRLRAQVDAETRWATALNHSATHLLHAALRGVLGTHVQQKGSLVAPDRLRFDFAHYEAPSTEQLEQIERIVNDEIRANRAADIEHMAYDDAIETGAMALFGEKYGDQVRVLRFGEFSIELCGGTHVERTGDIGLCKLISEGGVAGGVRRIEAVTGDRAVMWVQRTEQRLVQVAETVKASPDNAAVRVAQLVDRLKGQEKELERLKQKLASQAGSDLAGQAVDIGGVKVVAARVDADNKALRDTVDQLRNKLGTAVIVLGAVAGDKVRLVAGVSKDCTDRIKAGDLVRQVAEQVGGKGGGRPDFAQAGGEQPEHLETALASVESLVRDALGLE

SEQ ID NO: 3786 - protein, 878 aa, Magnetococcus MC-1
MNGNEIRKRFVAFFQQHGHTHVESSSLVPRNDPTLLFTNAGMVQFKSLFLGEERRDYSRAVSAQKCVRAGGKHNDLENVGRTARHHTFFEMLGNFSFGDYFKEEAIRLGWRFVTEDLGIDAQRLLVTVYSEDDEAYAIWTQQIGLPADKVIRIPTTDNFWSMGDTGPCGPCSEIFYDYGDTVAGGPPGSEDEDGDRFVEIWNLVFMQYDRSSDGTLTPLPKPSIDTGAGLERLASVLQGKTNNYDTDLFQPLIKAAAALAGVDDTTCSAEQLVSLRVIADHIRSVSFLIADGVLPSNEGRGYVLRRIMRRGMRHGRLLGLEQPFMHKLVETLGALMGDTYPELTAQRKTLAMVIETEEKRFAATLGTGLKHLEEAVAGLRMGDVLDGKTLFTLYDTFGFPLDLTADILRDREIGVDQEGFSACMKEQRERARAAWSGSGEASLGALYHPLLERVGASEFLGYVHESASASVVALIKNGAEVESLTAGDEGSVVCNQTPFYGESGGQVGDRGVIQLANGARFTVTDTQKPLPDLIVHHGKMVTGTVHLGDHAELQVDGATRQAIRLHHSATHLMHHALRAVLGEHVKQAGSHVSAERLRLDFSHFQGMSEEELRAVEDRVNGAILSNVSQETAVMTPQEAVAAGAMALFGEKYGDEVRVVRIGDSMELCGGTHVSRSGDMGIFHILSESAVAAGVRRLEAVCGGRARAIFRGDQEALKAAAALLKTQPNKLAEGIERLLGKQKELEKSLEKLQSAQAGGMVEALLEQAVEVGGIKLLAVEVKGVDGKALREMVDQVKDKLGSGVILLALGGDKVSLVAGVTKDLAGKRVKAGDLMAFAAAMVGGKGGGRPDMAQGGGTEVAAIPTMLTAIPGWLQEQLG

SEQ ID NO: 3787 - protein, 874 aa, Shewanella sp. ANA-3
MYQTTAALRSAFLEFFRSNGHQVVDSSSLVPGNDPTLLFTNAGMNQFKDVFLGMDKRSYTRATTAQRCVRAGGKHNDLDNVGYTARHHTFFEMLGNFSFGDYFKEDAIRFGWTFLTEVLKLPKERLCVTVYQTDDEAFEIWNKKIGVAAENIIRIGDNKGAPYASDNFWQMGDTGPCGPCTEIFYDHGDHIWGGRPGSPEEDGDRFIEIWNIVFMQYNRQASGEMLPLPKPSVDTGMGIERIAAIMQGVHSNYEIDIFRALIAKAAEIIGVTDLSNKSLRVIADHIRSCAFLVADGVMPSNEGRGYVLRRIIRRAVRHGNKLGATEAFFYKLVPTLIEVMGDAAKGLADTQVIVEKALKAEEEQFARTLERGLGILDSALNELQGDTLDGETVFKLYDTYGFPVDLTADVCRERNIIVDEAGFEVAMAEQRSRAQAAGNFGADYNAALKIDAETAFCGYSELTGNAKVTALYLNGESVSAISAGDDAVVVLDVTPFYAESGGQVGDKGVLVAQGIEFAVSDTQKFGQASGHKGTLTAGSLSVGQVLEAKVDKKLRHRTQLNHSVTHLLHAALRQVLGTHVTQKGSLVDPERLRFDFSHFEAVKPAELKQVEELVNTQIRRNHELKVAEMAIDEAKEKGAMALFGEKYDAQVRVVTMGDFSIELCGGTHVGRTGDIGLFKITSEGGIAAGVRRIEAVTGAAAMAYVAQQQAQLEEAAALLKGDTQSVVAKLKAQLDKMKQLEKDMQQLKDKLAAAASADLAGDAVVVNGVNVLIKKLEGVEAGALRGLQDELKQKLKSAVILLGVAQEGKVNLIAGVSNDLVGKVKAGELVAMVAAQVGGKGGGRPDMAQAGGSQPENLDAALSQVLPWITERLA

SEQ ID NO: 3788 - protein, 878 aa, Pelobacter propionicus DSM 2379
MTGSEIRRRFLTFFAERGHTIVPSSGIIPKNDPTLMFANAGMNQFKDCFLGMEKRDYTRACSSQKCVRAGGKHNDLENVGRTARHHTFFEMLGNFSFGDYFKKEAIAFAWEFLTRDLKLDKNRLYVSVYTDDQEAADIWHQQEGVPLERIFRFGEKDNFWSMGDTGPCGPCSEIFYDQGEAAGCGSPDCTVGCDCDRYMEIWNNVFMQFDRSTDGVLTPLPKPSVDTGMGLERISAVMQGVTSNYDTDLIQGIIRHVERLSGKTYGKDERDDVSMRVIADHARAVTFLICDGALPSNEGRGYVLRRIMRRAARHAKMLGLADPMLCHMVDAVRDMMGAAYPELVEREEYIKKVILAEEQRFAETLDRGLAMLNDEVARMRAAGSTVIPGDVLFRLYDTYGFPIDLTADIVESEGFTIDEAGFEQCMERQREQAREHWKGSGAEGIGRVYKELYSRGIRGEFVGYDGLSALSPVLAIIRDGVEVESATAGETIELVTESTPFYGESGGQKGDCGSISTGNSHLEVSGASRPYSDLIVHHATVREGIIRKGDGADLRVSRPERSATARNHTATHLLQAALRRVLGEHVKQAGSLVSPDRLRFDFIHFTAMTTEEIRRVETLVNGFVMDNQPVVITQMDMASAIEAGATALFDEKYGDNVRVVRAGEVSMELCGGTHVRATGEIGLFKIITETGIAAGVRRIEAQTGGGALSFVRQMEDEQRALAGLLKAEGGNLPERLEKLLARQREMQREIESLQGKLNAAASGDLLSGVEEVGGIKLLAAEVRVEDVKALRDLSDTLKERIGQGVIVLGAAIGGKANLLVAVTRELSGTVKAGDLVKKLAPLVGGSGGGKPELAQAGGSRPENLAEALAAARQVLAEQ

SEQ ID NO: 3789 - protein, 900 aa, Shewanella amazonensis SB2B
MSPKFLSAARGRGCGLSYQAYPTQDVFMYQTTAALRSAFLEYFRQQGHQVVDSSSLVPGNDPTLLFTNAGMNQFKDCFLGMEKRSYVRAATAQRCVRAGGKHNDLDNVGYTARHHTFFEMLGNFSFGDYFKEDAIRFAWEFLTGTLKLPKEKLCVTVYHTDDEAFDIWNKQIGVPAENIIRIGDNKGAPFASDNFWQMGDTGPCGPCTEIFYDHGEHIWGGRPGSPEEDGDRFIEIWNIVFMQYNRQSDGTLDPLPKPAVDTGMGIERISAIMQGVHSNYEIDIFQKLIAKAAEIIGVSDLENKSLRVIADHIRSCAFLVADGVMPSNEGRGYVLRRIIRRAVRHGNKLGATDTFFYKLVPTLIEAMGDAAKELKATQTIVEKALKAEEEQFARTLERGLGMLDAALADLKGDTLDGETVFKLYDTYGFPVDLTADVCRERNLKVDEEGFNAAMAEQRSRAQAAGQFSADYNAALKIDTATDFCGYTELAAESKVVALYRDGESVDAAEAGAVLVVVLDNTPFYAESGGQVGDKGQLLAEGVEFNVADTQKFGQGIGHKGQLALGSIKVGDSLKAMVDKKLRHRTELNHSVTHLLHAALRQVLGTHVTQKGSLVDPERLRFDFSHFEGVKREELKAVEDLVNTQIRRNHELNFAEMDIEEAKAKGAMALFGEKYDSKVRVVTMGDFSIELCGGTHVGRTGDIGLFKITSEGGIAAGIRRIEAVTGAAAMAYVAQQQAELEEAAALLKGDVASVVAKLKAQLDKARQLEKENAQLKDKLAAAASADLAGDAQEINGVKVLVKRLEGVEAGALRGLQDELKQKLKSGVVLLAIGSGDKVNLIAGVTQDLTGKVKAGELVAMVAAQVGGKGGGRPDMAQAGGSEPAKLDGALASVVPWLNERL

SEQ ID NO: 3790 - protein, 863 aa, Halorhodospira halophila SL1
MTSAQLRAAFLDFFRERGHEVVPSSPLVPANDPTLLFTNAGMVPFKEVFLGREQRGYQRATSSQRCVRAGGKHNDLENVGYTARHHTFFEMLGNFSFGDYFKRDAIRYAWSFLTEVVELPPERLWVTVYEDDDEAAQIWLEEIGVDPARFRRIGAHDNFWSMGDTGPCGPCSEVFYDHGPEVPGGPPGSDEEDGDRYIEVWNLVFMQYDRDAEGNLNPLPSPSIDTGMGLERLAAVLQGVHDNFETDLFTPLIDAAGEIAGVSDRRKPSLKVVADHIRACSFLIVDGVLPSTEGRGYVLRRIIRRAVRHGYQLGIDEPFFYRLVDPLDAVMGEAFPELRDRREFVEKILFQEEKRFRETLEDGLALLDEYLGGNDSGVIDGEVVFKLYDTHGFPVDLTADIARERNLEVDYQGFEARMAEQRERARAASRFGGAREEVVDAGESRFTGYETLEDVGSVIGLYQDGRSVQRLQPGEEGMVVLDRTPFYAESGGQVGDRGEILANGLRFRVADTVKQGEAHGHLGRLESGELGVGDQVTARVDRGTREATVRNHSATHLLHAALREILGDHVQQKGSLVAPDRLRFDFSHYEAPSREDLERIEARVNQEILTNHPVEAAHMAYEEAVQVGAMALFGEKYGDTVRVISLGDYSQELCGGTHAARTGDIGLFKIIDETGVAGGVRRIEAITGERAIGWVQEAEGRLNRLADLLRVGPDNLVMKVEQLSERTREQEKEIERLKQKLATQAGRSLLDDAGEVAGVRFLATCVEGGGKGLRDTLDQLKNQLGSGVIVLAAVQGEKVQLVAGVTKDLTDRLAAGDLVNHVAAQVGGRGGGRADFAQAGGKDPSHVNDALASVEAWIKDNLT

SEQ ID NO: 3791 - protein, 874 aa, Shewanella baltica OS155
MYQTTAELRSAFLEFFRSNGHQVVDSSSLVPGNDPTLLFTNAGMNQFKDVFLGMDKRNYTRATTAQRCVRAGGKHNDLDNVGYTARHHTFFEMLGNFSFGDYFKEEAIRFGWTFLTETLKLPKERLCVTIYQTDDEAFEIWNKKIGVAAENIIRIGDNKGAAYASDNFWQMGDTGPCGPCSEIFYDHGDHIWGGRPGSPEEDGDRFIEIWNIVFMQYNRQASGEMLPLPKPSVDTGMGIERIAAIMQGVHSNYEIDIFRTLIAKAAEIIGVSDLTEKSLRVIADHIRSCAFLIADGVMPSNEGRGYVLRRIIRRAVRHGNKLGATEAFFYKLVPSLIAVMGDAAKGLAETQAIVEKALKAEEEQFARTLERGLGILDTALNELKGTTLDGETVFKLYDTYGFPMDLTADVCRERNIIVDEAGFEVAMAEQRSRAQAAGNFGADYNAALKIDAETAFSGYTELAGQAKITAIYQNGESVTAIKAGDEAVVVLDVTPFYAESGGQVGDKGQLVASGVEFTVNDTQKYGQATGHQGVLATGNLSVGQVVEAKVDKKLRHRTQLNHSVTHLLHAALRQVLGTHVSQKGSLVDPERLRFDFSHFEGVKAAELKEVEELVNTQIRRNHELKTAEMGIDEAKEKGAMALFGEKYDSQVRVVTMGDFSIELCGGTHVGRTGDIGLFKITSEAGIAAGVRRIEAVTGAAAMAYVAQQQAELEEAAALLKGDANSVVAKLKAQLDKMKQLEKEMAQLKDKLAAAASADLVGDAVVVNGVNVLIKKLDGVEASSLRGLQDELKQKLKSAIIVLGTAQEGKVNLIAGVSNDLIGKVKAGELVAMVAAQVGGKGGGRPDMAQAGGSQPENLDAALAQVLPWITERLA

SEQ ID NO: 3792 - protein, 874 aa, Shewanella loihica PV-4
MYQTTAALRSAFLEFFRRNGHQVVDSSSLVPGNDPTLLFTNAGMNQFKDVFLGEDKRDYSRATTAQRCVRAGGKHNDLDNVGYTARHHTFFEMLGNFSFGDYFKQDAIRFAWTFLTEELKLPKERLCVTVYETDDEAFEIWNKEIGVAAENIIRIGDNKGAAYASDNFWQMGDTGPCGPCTEIFYDHGEHIWGGRPGTPEEDGDRFIEIWNIVFMQYNRQADGTMDPLPKPSVDTGMGIERIAAIMQGVHSNYEIDIFQSLIKKTAEILGVTDLENKSLRVVADHIRSCAFLVADGVMPSNEGRGYVLRRIIRRAVRHGNKLGATEAFFYKLVPTLIEVMGDAAKELVATQAIVEKALKAEEEQFARTLERGLGILDNALSQLEGKELDGETAFKLYDTYGFPVDLTADVCRERDITVDEAGFEAAMAEQRSRAQAAGQFDTDYNDSLKIDAETEFCGYSDLNGEAKVIGLYVDGQAVDALAEGDQGVVVLDSTPFYGESGGQCGDKGLLSAEGVEFEVKDTQKYGQAMGHIGLVKAGSIAMGQTLNAAVDKKLRHRTELNHSVTHLLHAALRQVLGTHVSQKGSLVEPERLRFDFSHFEAVKREELKQVEDLVNTQIRRNHELKAEVMDIDQAKEKGAMALFGEKYDSQVRVVTMGDFSIELCGGTHVGRTGDIGLFKITSEGGIAAGIRRIEAVTGAAAIAYVGEQQAQLEQAASLLKGDSASVVAKLKAQLDKTKQLEKELSQLKDKLAAATSADLAGEAQELAGVKVLVKLLEGVEAGALRGLQDELKQKLQSGIVVLGIAGDAKVNLIAGVTKDLTGKVKAGELVAMVAAQVGGKGGGRPDMAQAGGSEPEKLAGALDSVIPWLSERLA

SEQ ID NO: 3793 - protein, 875 aa, Enterobacter sp. 638
MSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQYAWELLTGENWFNLPKERLWVTVYETDDEAYEIWEKEVGIPRERIIRIGDNKGAPYASDNFWQMGDTGPCGPCTEIFYDHGDHIWGGPPGTAEEDGDRYIEIWNIVFMQFNRQIDGTMEPLPKPSVDTGMGLERIAAVLQHVNSNYDIDLFSTLIKSVAEVTGATDLSNKSLRVIADHIRSCAFLIADGVIPSNENRGYVLRRIIRRAVRHGNMLGAKDTFFYKLVGPLVGVMGDAGEELKRQQSQVEQVLKTEEEQFARTLERGLALLDEELSQLTGDTLDGETAFRLYDTYGFPVDLTADVCRERNIKVDEAGFEAAMEEQRRRARESSGFGADYNAMIRVDSASEFQGYDRLELNAKVTALFVDGKAVDSISAGQDAVVVLDKTPFYAESGGQVGDKGELKGNGFSFAVSDTQKYGQAIGHIGKLASGSLKVGEGVQAEVDEARRERIRLNHSATHLMHAALRDVLGTHVAQKGSLVNDKILRFDFSHFEAMKPSEIRAVEDMVNAQIRRNLPIETNIMDLEAARAKGAMALFGEKYDERVRVLSMGDFSTELCGGTHASRTGDIGLFRILSESGTAAGVRRIEAVTGEGAIASLHAESDQLHDIAQLLKGDSHNLGEKVRSALERSRQLEKELQQLKEQAAVQESANLSSKAVDIKGVKLLVSELAGVEPKMLRTMVDDLKNQLGSTIIVLATAVDGKVSLIAGVSKDVTDRVKAGELIGMVAQQVGGKGGGRPDMAQAGGTDAAALPAALASVESWVSAKL

SEQ ID NO: 3794 - protein, 892 aa, Shewanella putrefaciens CN-32
MRLPYGVAGNAYPIQDDFMYQTTAELRSAFLEFFRSHGHQVVDSSSLVPGNDPTLLFTNAGMNQFKDVFLGMDKRNYTRATTAQRCVRAGGKHNDLDNVGYTARHHTFFEMLGNFSFGDYFKEEAICFGWSFLTETLKLPKERLCVTIYQTDDEAFEIWNKKIGVAAENIIRIGDNKGAPYASDNFWQMGDTGPCGPCTEIFYDHGDHIWGGRPGSPEEDGDRFIEIWNIVFMQYNRHISGEMLPLPKPSVDTGMGIERIAAIMQGVHSNYEIDIFRALIAKAAEIIGVTDLSNKSLRVIADHIRSCAFLVADGVMPSNEGRGYVLRRIIRRAVRHGNKLGATEAFFYKLVPTLIDVMGDAAKGLAETQVIVEKALKAEEEQFARTLERGLGILDAALSELTGDTLDGETVFKLYDTYGFPMDLTADVCRERNIIVDEAGFEAAMAEQRSRAQAAGNFGADYNAALKIDAETAFCGYTELVGQAKVTAIYQNGESVTAIKAGDEAVLVLDVTPFYAESGGQVGDKGQLVANGIEFTVNDTQKYGQATGHQGVLVAGSLSIGQMVEAKVDKKLRHRTQLNHSVTHLLHAALRQVLGTHVTQKGSLVDPERLRFDFSHFEAVKPAELKKVEELVNTQIRRNHELKVAEMAIDEAKEKGAMALFGEKYDAQVRVVTMGDFSIELCGGTHVGRTGDIGLFKITSEGGIAAGVRRIEAVTGAAAMAYVAQQQAELEEAAALLKGDTHSVVAKLKAQLDKMKQLEKDMAQLKDKLAAAASADLVGDAVVVNGVNVLIKKLDGVEAGSLRGLQDELKQKLKSAIIVLGTAQEGKVNLIAGVSNDLVGKVKAGELVAMVAAQVGGKGGGRPDMAQAGGSQPENLDAALAQVLPWITERLA

SEQ ID NO: 3795 - protein, 860 aa, Vibrio cholerae O395
MFMSTDEVRRAFLSFFESKGHQIVESSSLVPANDPTLLFTNAGMNQFKDCFLGLEKRAYTRATTAQRCVRAGGKHNDLENVGFTARHHTFFEMLGNFSFGDYFKEDAIQYAWEFLTDVLQLPKERLLVTVYETDDEAFDIWNKKVGIPADRIIRIGDKKGGKKFDSDNFWQMGDTGPCGPCTEIFYDHGDHIWGGPPGSPEEDGDRFIEIWNNVFMQFNRHADGTMEPLPKPSVDTGMGIERISAIMQGVHSNYEIDVFQTLIKAAADAIGYQDLTNQSLRVVADHIRSCAFLIVDGVMPSNEGRGYVLRRIIRRAVRHGNKLGAQGAFFHKLVGPLAEVMGTAGVELKKQQALVEKVLRIEEENFGRTLDRGMSILNDALDQLSGQVLDGETVFKLYDTYGFPADLTNDVARERGFSIDEAGFEQAMEEQRQRAREAGQFGTDYNSLIKSATNTEFCGYTASRGQSVVREMFVEGAEVSTLSAGDKAIIVLDNTPFYAESGGQCGDTGVLKTDAGIFHVEDTQKLGNAIAHHGVLAQGVLATGDQVDAIVDEKRRAAISLNHSATHLLHAALRKVLGEHVAQKGSLVRAETLRFDFSHLEAMTAAEIKEVERLVNQEVRRNHSIETNIMNIDEAKAKGAMALFGEKYDDQVRVLSMGDFSTELCGGIHASNTGDIGLFKIISEGGIAAGIRRIEAVTGEGALDYLDAQQAQHDAKVSEMAAKAKLLEKEIQQLKDKLAAKESAGLINQVKQIAGVNVLVAQLNGADNKALRGMVDDLKNQLSSGIIMLGNVAEGKVGLIAGVTNDLTNKVKAGELVNMVALQVGGKGGGRPDMAQAGGTDAHALPSALESVDAWIAERL

SEQ ID NO: 3796 - protein, 876 aa, Geobacter uraniumreducens Rf4
MTGKEIRAQFFKFFEERGHTVVESSNLIPRNDPTLLFTNAGMNQFKDVFLGLEKRDYVRACSSQKCVRAGGKHNDLENVGRTARHHTFFEMLGNFSFGDYFKKEAIAFAWEFLTKELKLDKDRLYVTVYTDDDEAADIWNRQEGVPLERIYRFGEKDNFWSMGDTGPCGPCTEIFWDNGPGTGCGSPTCEVGCDCDRYMEIWNNVFMQFNRDAQGNLTPLPKPSVDTGMGLERISTVMQGVTSNYDTDLLQGIIKHVEKLSGKRYRQDERDDVSMRVIADHSRAITFLICDGILPSNEGRGYVLRRIMRRAARHAKMLGFAEPALYRIVDAVNTMMGDAYPELLEREEYIKKVIHAEEERFIETLDRGLAILNEEVAALKKEGKSVVPGEVIFKLYDTYGFPVDLTADIVENEGFTIDEDGFALCMERQRLQARENWKGSGEEGLAEIYKTLHGRGIRSAFVGYSEQTAYSAITAILREGAEVAEAVAGEMVEVVVDTTPFYGASGGQAGDTGVISTGSAHLRVVATSKPFPDLTVHRALVTEGTVKAGDAADLRVATEVRGATARNHTATHLLQSALRQVLGEHVKQAGSLVTAERLRFDFTHFSAMTVEELRRVENIVNTYVMDNADVKSLEMAATEAMQSGATALFGEKYGDRVRVVKVGEVSSELCGGTHVRAAGDIGFFKIVGEAGIAAGVRRIEALTGSGALEYVQQLEDEQRSIAVLVKAEGGTALDKVDRLLARQKELQREVEALQARLNASRSADLLAGARETNGIKVLAAKVEMDDPKGLRELADSLKDRLQSGVIVIGCVSAGKANLLVAVTKDLSDRLRAGDIIKSLAPIIGGSGGGKPELAQAGGTKPENLDEALEAAYKIIG

SEQ ID NO: 3797 - protein, 874 aa, Shewanella baltica OS185
MYQTTAELRSAFLEFFRSNGHQVVDSSSLVPGNDPTLLFTNAGMNQFKDVFLGMDKRNYTRATTAQRCVRAGGKHNDLDNVGYTARHHTFFEMLGNFSFGDYFKEEAIRFGWTFLTETLKLPKERLCVTIYQTDDEAFEIWNKKIGVAAENIIRIGDNKGAAYASDNFWQMGDTGPCGPCTEIFYDHGDHIWGGRPGSPEEDGDRFIEIWNIVFMQYNRQASGEMLPLPKPSVDTGMGIERIAAIMQGVHSNYEIDIFRTLIAKAAEIIGVSDLTEKSLRVIADHIRSCAFLIADGVMPSNEGRGYVLRRIIRRAVRHGNKLGATEAFFYKLVPSLIAVMGDAAKGLAETQVIVEKALKAEEEQFARTLERGLGILDTALNELKGDTLDGETVFKLYDTYGFPMDLTADVCRERNIIVDEAGFEVAMAEQRSRAQAAGNFGADYNAALKIDAETAFTGYTELAGQAKVTAIYLNGESVTAIKAGDEAVVVLDVTPFYAESGGQVGDKGQLVANGIEFTVNDTQKYGQATGHQGVLATGSLSVGQVIEAKVDKKLRHRTQLNHSVTHLLHAALRQVLGTHVSQKGSLVDPERLRFDFSHFEGVKAAELKEVEELVNTQIRRNHELKTAEMGIDEAKEKGAMALFGEKYDSQVRVVTMGDFSIELCGGTHVGRTGDIGLFKITSEAGIAAGVRRIEAVTGAAAMAYVAQQQAELEEAAALLKGDANSVVAKLKAQLDKMKQLEKEMAQLKDKLAAAASADLVGDAVVVNGVNVLIKKLDGVEASSLRGLQDELKQKLKSAIIVLGTTQEGKVNLIAGVSNDLIGKVKAGELVAMVAAQVGGKGGGRPDMAQAGGSQPENLDAALAQVLPWITERLA

SEQ ID NO: 3798 - protein, 875 aa, Yersinia pseudotuberculosis IP 31758
MSKSTAEIRQAFLDFFHSKGHQVVSSSSLVPNNDPTLLFTNAGMNQFKDVFLGLDKRAYSRATTSQRCVRAGGKHNDLENVGYTARHHTFFEMLGNFSFGDYFKHDAINFAWELLTSEQWFNLPKEKLWVTVYETDDEAYNIWANEVGVPHERIIRIGDNKGGAFASDNFWQMGDTGPCGPCSEIFFDHGDHIWGGPPGSAEEDGDRYIEIWNIVFMQFNRQSDGTMLPLPKPSVDTGMGLERIAAVLQHVNSNYEIDLFRDLIAAVADVTGATDLSSKSLRVIADHIRSCAFLISDGVIPSNENRGYVLRRIIRRAIRHGNMLGAKETFFYKLVAPLIAVMGPAAAELKQQQAMVEQVLKTEEEQFARTLERGLALLDDELSKLTGDTLDGETAFRLYDTYGFPVDLTADVCRERNLKVDEAGFEQAMEAQRRRARESSGFGADYNSLIRVDSASQFSGYDHVQQHATVTALFRNGEAVDEIHAGEEAVVVLNRTPFYGESGGQVGDKGELKNATATFSVTDTQKYGQAIGHVGILTTGTLRVNHSVEALVDVVRRNRIRLNHSATHLLHAALRNVLGEHVAQKGSLVNDKYLRFDFSHFEAMKPEQIRLVEDLVNEQIRRNMPVQTEVMELDAAKEKGAMALFGEKYDDQVRVLTMGDFSTELCGGTHASRTGDIGLFRILTESGTAAGIRRIEAVTGEGAIALLHQQSDLLQDVAHLVKGDIHNLADKVRAVLDRSKMLERELQQLKDQQAAQESASLSSSAKLINGVKLLVSQLDNVEPKMLRTMVDDLKNQLGSAIIVLATTTDDKVSLIVGVTKDLTGKVKAGELIADIAQQVGGKGGGRPDMAQAGGTDVQALPAALASVEAWVASRM

SEQ ID NO: 3799 - protein, 865 aa, Vibrio harveyi ATCC BAA-1116
MYMSTDEVRNAFLKFFESKGHQIVESSSLVPHNDPTLLFTNAGMNQFKDCFLGLEKRAYTRATTAQRCVRAGGKHNDLENVGFTARHHTFFEMLGNFSFGDYFKEDAIAFAWEFLTETLKLPADRLLVTVYETDDEAFDIWNKKVGVPADRIIRIGDKKGGKPFESDNFWQMGDTGPCGPCTEIFYDHGEHIWGGRPGTPEEDGDRFIEIWNNVFMQFNRQADGTMEPLPKPSVDTGMGIERISAIMQGVHSNYEIDVFQALIKAAAEVIGYEDLSNQSLRVIADHIRSCSFLIVDGVMPSNEGRGYVLRRIIRRAVRHGNKLGAQGAFFHKLVGVLAEIMGTAGEELKRQQAVVEKVLRIEEENFGRTLERGMAILNEALDNISSQGTDGKVLDGETVFKLYDTYGFPADLTNDVAREREFAIDEEGFEKAMEEQRQRAREAGNFGTDYNAAIKVDTQTEFCGYTGTKGSSSVAAMFVEGNEVESLSAGDKAIIVLGETPFYAESGGQCGDAGEIRTESGVFRVEDTQKLGNAIAHHGVMAEGVLAKGDEVATIVDAERRAAISLNHSATHLLHAALRQLLGEHVTQKGSLVKADGLRFDFSHLEAVTAAELKEVERLVNAQIRRNHVIETNVMDIESAKKKGAMALFGEKYDDEVRVLSMGDFSTELCGGIHASSTGDIGLFKITSEGGIAAGIRRIEAVTGEGALDAIEAQAAKYEEKLAESAQKAKSLEKEIQKLKDKMAAAESANIMGKVQDINGTKVLIAALEGADNKNLRTMVDDIKNQVGSGVILLANVNDDKIGLIAGVTKDLIGKVKAGDLVKMVAEQVGGKGGGRPDMAQAGGTDVAALPAAIQTVQPWLEERL

SEQ ID NO: 3800 - protein, 876 aa, Escherichia coli HS
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLAAGSLKVGDAVQADVDEARRARIRLNHSATHLMHAALRQVLGTHVSQKGSLVNDKVLRFDFSHNEAMKPEEIRAVEDLVNAQIRRNLPIETNIMDLEAAKAKGAMALFGEKYDERVRVLSMGDFSTELCGGTHASRTGDIGLFRIISESGTAAGVRRIEAVTGEGAIATVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVAEGKVSLIAGVSKDVTDRVKAGELIGMVAQQVGGKGGGRPDMAQAGGTDAAALPAALASVKGWVSAKLQ

SEQ ID NO: 3801 - protein, 892 aa, Serratia proteamaculans 568
MSRILLTCRYSSLSGKIMSKSTAEIRQAFLDFFHSKGHQVVASSSLVPDNDPTLLFTNAGMNQFKDVFLGLDKRAYSRATTSQRCVRAGGKHNDLENVGYTARHHTFFEMLGNFSFGDYFKHDAISYAWELLTGENWFNLPKERLWVTVYETDDEAFDIWQQQIGVPAERIIRIGDNKGGAFASDNFWQMGDTGPCGPCTEIFYDHGDHIWGGPPGSPEEDGDRYIEIWNLVFMQFNRQSDGTMLPLPKPSVDTGMGLERIAAVLQHVNSNYEIDLFSKLIAAVAKVTGATDLDNKSLRVIADHIRSCAFLVSDGVTPSNEGRGYVLRRIIRRAVRHGNMLGAKDTFFYKLVAPLIEVMGPAADELKRQQSLVEQVLKTEEDQFARTLERGLTLLDEELANLQGDTLDGETAFRLYDTYGFPVDLTADVCRERGLKVDEAGFEQAMEAQRRRARESSGFGADYNSMIRVDGASQFSGYDHEQQQSTVTALFRDGQPVNEIHAGEEAVVVLDETPFYGESGGQVGDKGVLKAANADFEVSDTQKYGQAIGHQGKLSHGSLKVNDRVDAKIDTVRRNRIRLNHSATHLLHAALRQTLGEHVAQKGSLVNDKYLRFDFSHFEAMKPEQIRTVEDLVNQQIRRNLPVQTEVMALDDAKGKGAMALFGEKYDDNVRVLTMGDFSTELCGGTHASRTGDIGLFRILSESGTAAGIRRIEAVTGDGAIATLHQQNDLLQDVAHLVKGDSNNLTDKVRAVLDRTRALEKELQQLKDQQAAQESASLSSKAKMVNGVQLLVSQLDNVEAKMLRTMVDDLKNQLGSAIIVLATTADDKVSLIAGVTKDLTDRVKAGELIGNVAQQVGGKGGGRPDMAQAGGTDVSALPAALDSVEAWVASKL

SEQ ID NO: 3802 - protein, 874 aa, Shewanella baltica OS195
MYQTTAELRSAFLEFFRSNGHQVVDSSSLVPGNDPTLLFTNAGMNQFKDVFLGMDKRNYTRATTAQRCVRAGGKHNDLDNVGYTARHHTFFEMLGNFSFGDYFKEEAIRFGWTFLTETLKLPKERLCVTIYQTDDEAFEIWNKKIGVAAENIIRIGDNKGAAYASDNFWQMGDTGPCGPCSEIFYDHGDHIWGGRPGSPEEDGDRFIEIWNIVFMQYNRQASGEMLPLPKPSVDTGMGIERIAAIMQGVHSNYEIDIFRTLIAKAAEIIGVSDLTEKSLRVIADHIRSCAFLIADGVMPSNEGRGYVLRRIIRRAVRHGNKLGATEAFFYKLVPSLIAVMGDAAKGLAETQAIVEKALKAEEEQFARTLERGLGILDAALNELKGDTLDGETVFKLYDTYGFPMDLTADVCRERNIIVDEAGFEVAMAEQRSRAQAAGNFGADYNAALKIDAETAFSGYTELAGQAKVTAIYQNGESVTAIKAGDEAVVVLDVTPFYAESGGQVGDKGQLVANGVEFTVNDTQKYGQATGHQGVLATGNLSVGQVVEAKVDKKLRHRTQLNHSVTHLLHAALRQVLGTHVSQKGSLVDPERLRFDFSHFEGVKATELKEVEELVNTQIRRNHELKTAEMGIDEAKEKGAMALFGEKYDSQVRVVTMGDFSIELCGGTHVGRTGDIGLFKITSEAGIAAGVRRIEAVTGAAAMAYVAQQQAELEEAAALLKGDANSVVAKLKAQLDKMKQLEKEMAQLKDKLAAAASADLVGDAVVVNGVNVLIKKLDGVEASSLRGLQDELKQKLKSAIIVLGTAQEGKVNLIAGVSNDLIGKVKAGELVAMVAAQVGGKGGGRPDMAQAGGSQPENLDAALAQVLPWITERLA

SEQ ID NO: 3803 - protein, 865 aa, Coxiella burnetii RSA 331
MNSNQLRETFLNYFKQLDHEVVPGSSLIPENDPTLLFTNAGMVQFKDVFLGVETRPYQRAVSIQPCMRAGGKHNDLENVGYTARHHTFFEMLGNFSFGDYFKRDAIKFAWDFLTNVLKLPPQRLWVTVFQDDFESESIWLKEMKINPERFSRCGEKDNFWQMRDTGPCGPCTEIFYDHGPTISGGPPGSAEADGDRYVEIWNLVFMQYNRDAKGNLLPLAKPSVDTGMGLERLTAVMQGVHDNYDIDLFQYLLKALRTLLKTEDLHNTSMRVIVDHIRSVAFLIADGVIPSNEGRGYVLRRIIRRAVRHGYKLGQEEPFFYQLTKPLLEEMGGAYPLLRKSQALIEQTIKQEEIQFSNTLTKGLKILDHEMAGLPSRQIPGNLIFQLYDTYGFPPDLTADIARERDFVMDYAGFDKAMERQREQSQQAHQFVANYAQKASIGGETQFVGYETLNSQANVISLLQNDQPINRLNESEKGVVVLDRTPFYAESGGQVGDQGFLYFEKGSFRVKDTKKQGDIYLHIGEMLQGHLNVKDKVRAEVDVSRFDIMRNHSATHLLHEALRRVLGERVMQKGSLVEAKRLRFDFSHAKPLTPEELQAVERLVNQQIQANLLSTIEVMTPEEAKKKGALALFGERYGKEVRVLEMGDFSTEICGGTHTERTGEIGLFKIVSESGCAAGIRRIEALTGKAALDYIESAEQQLRSLSDLLKTNRKNLAAKLSQILEDHRKLEKELAKLKQRLASQQLESLINQVVDVHDIRTLAIRLEAVDRETLRAIVDQLKQKLGKAAIVLATIEEGRIQLVAGVTKNCLEHFNATELLAPIAEKVGGRSGGRPDLAQGAGERPENLEAALAAVPKWIEKKLKE

SEQ ID NO: 3804 - protein, 876 aa, Escherichia coli C ATCC 8739
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPANENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLAAGSLKVGDAVQADVDEARRARIRLNHSATHLMHAALRQVLGTHVSQKGSLVNDKVLRFDFSHNEAMKPEEIRAVEDLVNTQIRRNLPIETNIMDLEAAKAKGAMALFGEKYDERVRVLSMGDFSTELCGGTHASRTGDIGLFRIISESGTAAGVRRIEAVTGEGAIATVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVVEGKVSLIAGVSKDVTDRVKAGELIGMVAQQVGGKGGGRPDMAQAGGTDAAALPAALASVKGWVSAKLQ

SEQ ID NO: 3805 - protein, 875 aa, Yersinia pseudotuberculosis YPIII
MSKSTAEIRQAFLDFFHSKGHQVVSSSSLVPNNDPTLLFTNAGMNQFKDVFLGLDKRAYSRATTSQRCVRAGGKHNDLENVGYTARHHTFFEMLGNFSFGDYFKHDAINFAWELLTSEQWFNLPKEKLWVTVYETDDEAYNIWANEVGVPHERIIRIGDNKGGAFASDNFWQMGDTGPCGPCSEIFFDHGDHIWGGPPGSAEEDGDRYIEIWNIVFMQFNRQSDGTMLPLPKPSVDTGMGLERIAAVLQHVNSNYEIDLFRDLIAAVADVTGATDLSSKSLRVIADHIRSCAFLISDGVIPSNENRGYVLRRIIRRAIRHGNMLGAKETFFYKLVAPLIAVMGPAAAELKQQQAMVEQVLKTEEEQFARTLERGLALLDDELSKLTGDTLDGETAFRLYDTYGFPVDLTADVCRERNLKVDEAGFEQAMEAQRRRARESSGFGADYNSLIRVDSASQFSGYDHVQQHATVTALFRNGEAVDEIHAGEEAVVVLNRTPFYGESGGQVGDKGELKNATATFSVTDTQKYGQAIGHVGILTTGTLRVNHSVEALVDVVRRNRIRLNHSATHLLHAALRNVLGEHVAQKGSLVNDKYLRFDFSHFEAMKPEQIRLVEDLVNEQIRRNMPVQTEVMELDAAKEKGAMALFGEKYDDQVRVLTMGDFSTELCGGTHASRTGDIGLFRILTESGTAAGIRRIEAVTGEGAIALLHQQSDLLQDVAHLVKGDIHNLADKVRAVLDRSKMLERELQQLKDQQAAQESASLSSSAKLINGVKLLVSQLDNVEPKMLRTMVDDLKNQLGSAIIVLATTADDKVSLIVGVTKDLTGKVKAGELIADIAQQVGGKGGGRPDMAQAGGTDVQALPAALASVEAWVASRM

SEQ ID NO: 3806 - protein, 876 aa, Escherichia coli SMS 3 5
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLATGSLKVGDAVQADVDEARRARIRLNHSATHLMHAALRQVLGTHVSQKGSLVNDKVLRFDFSHNEAMKPEEIRAVEDLVNAQIRRNLPIETNIMDLEAAKAKGAMALFGEKYDERVRVLSMGDFSTELCGGTHASRTGDIGLFRIISESGTAAGVRRIEAVTGEGAIATVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVAEGKVSLIAGVSKDVTDRVKAGELIGMVAQQVGGKGGGRPDMAQAGGTDAAALPAALASVKGWVSAKLQ

SEQ ID NO: 3807 - protein, 882 aa, Xanthomonas oryzae PXO99A
MNAPAKFSTSQIRSDFLAFFEGRGHTIVPSAPLVPGNDPTLLFTNSGMVQFKDVFLGAEKRSYVRAADVQRCLRAGGKHNDLDSVGYTARHHTFFEMLGNWSFGDYFKKDAIAWAWELLTQIWKLPTDRLLVTVYHTDEEAFALWRDMIGIPESRIVRIGDNKGAPYASDNFWQMADTGPCGPCTEIFFDHGDHIAGGPPGSPDEDGDRFIEIWNLVFMQFDRQPDGTLVPLPAPCVDTGMGLERLAAILQHVHTNYEIDLFQALIGKASALTGITDLENKSLRVIADHIRACSFLIVDGVLPSNEGRGYVLRRIIRRALRHGWMLGVRQPFFSKMVPTLVELMGEAYPELVVAKDTVARALLAEEERFAETLDAGMKIFDEVASRSQDIIPGADAFRLYDTYGFPVDLTADIARERGMRVDMEGFECAMERQRETARAAGKFGGGVALPADLVASMSPTVFLGYEAYDADALRVVALLKQGRPVERAQAGDEVIVFTDRTPFYAESGGQVGDSGQLNGPGVLIEVADTQKFAGQFHGHVGRISEGTLALGDVLAGGIDVQRRGKTILNHSATHLLHAALREVLGTHVQQKGSLVAPDRLRFDFSHFQPITADELAVIERKVNAEVRTNHGVEVHNMAMQEALDFGAMALFGEKYGENVRVLKMGGYSTELCGGTHVTRTGDIGLFKITSEGGVSSGVRRIEAVTGQGALDYVADEERRLLEAAHLLGGNATEVVDKVRALTERQKRLQRELESLKAKLASGATADLGAAAIDVAGVKVVAVRLEGFDAKALRDAMDRLKQQLGDSVIVLAGASGGKVALVSGVNGSPTGKVKAGELLSNIASQIGGKGGGRPDLAQGGGEDGPALATALDGVPLWVKQHLG

SEQ ID NO: 3808 - protein, 876 aa, Shigella boydii CDC 3083 94
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFAVEDTQKYGQAIGHIGKLAAGSLKVGDAVQADVDEARRARIRLNHSATHLMHAALRQVLGTHVSQKGSLVNDKVLRFDFSHNEAMKPEEIRVVEDLVNAQIRRNLPIETNIMDLEAAKAKGAMALFGEKYDERVRVLSMGDFSTELCGGTHASRTGDIGLFRIISESGTAAGVRRIEAVTGEGAITTVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVAEGKVSLIAGVSKDVTDRVKAGELIGMVAQQVGGKGGGRPDMAQAGGTDAAALPAALASVKGWVSAKLQ

SEQ ID NO: 3809 - protein, 882 aa, Stenotrophomonas maltophilia R551 3
MNASAKFTTSQIRSDFLEFFKGKGHTIVPSAPLVPGNDPTLLFTNSGMVQFKDVFLGAEKRSYVRAADVQRCLRAGGKHNDLDQVGYTARHHTFFEMLGNWSFGDYFKKDAIAWAWELLTQVWKLPAERLLVTVYQTDDEAYALWRDMVGIPEERIVRIGDNKGAPFASDNFWQMADTGPCGPCTEIFYDHGDHIAGGPPGSPDEDGDRFIEIWNLVFMQFDRQPDGTLVPLPAPCVDTGMGLERLAAILQHVHTNYEIDLFQALIRKASELTGTADLENKSLRVIADHIRACSFLIVDGVLPSNEGRGYVLRRIIRRALRHGWMLGVRQPFFSKLVPTLVEQMGEAYPELPAAADTVTRALQAEEERFAETLDAGMKIFEDVAGKASNGVIPGVDAFRLYDTYGFPLDLTQDIARERDLTVDIAGFDAAMEQQRETARAAGKFGGGVTLPAELVATLSPTRFLGYDRLQADGLTVLAVLKDGRPVQSANAGDAVIVITNQTPFYAESGGQVGDTGVLTGNGVRLAVEDTQKFAGQFHGHVGILSEGGLKVGDVLSGQVDGERRGATILNHSATHLLHAALREVLGTHVQQKGSMVAPDRLRFDFSHFQPISAEELAVIERKVNQQVRANNAAEVHNMGMQEALDFGAMALFGEKYGEHVRVLKMGDYSTELCGGTHVNRTGDIGLFKITSEGGVSAGVRRIEAVTGQGALDYVDAEEARLAEAADLLGGSAADVVEKIRALGQRQKQLERELESVKAKVAAGATADLSGQAVEVAGVKVLAARLEGFDAKALRDAMDRLKQQLGDAVIVLAGAQDGKAALVAGVNGSAMGKVKAGELLSHIAGQIGGKGGGRPDLAQGGGEDGPALATALAAVVEWVSPRL

SEQ ID NO: 3810 - protein, 876 aa, Salmonella enterica serovar Newport SL254
MSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQFAWELLTGENWFALPKERLWVTVYETDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIEAVAKVTGATDLGNKSLRVIADHIRSCAFLVADGVLPSNENRGYVLRRIIRRAVRHGNMLGAKETFFYKLVGPLIEVMGSAGEELKRQQAQVEQVLKTEEEQFARTLERGLALLDEELAKLQGDTLDGETAFRLYDTYGFPVDLTADVCRERNIKVDEAGFEAAMEEQRRRAREASGFGADYNAMIRVDSASEFKGYDHLELNGKVTALFVDGKAVEAINAGQEAVVVLDQTPFYAESGGQVGDKGELKGAGFTFAVDDTQKYGQAIGHLGKLSAGALKVGDAVQADVDEARRARIRLNHSATHLMHAALRQVLGTHVAQKGSLVSDKVLRFDFSHNEAMKPSEIREVEDLVNAQIRRNLPIETNIMDLDAAKAKGAMALFGEKYDERVRVLSMGDFSTELCGGTHASRTGDIGLFRIISESGTAAGIRRIEAVTGEGAMATVHAQSDRLNDIAHLLKGDSQNLGDKVRAVLERTRQLEKELQQLKDQAAAQESANLSSKAVDLNGVKLLVSELAGIEPKMLRTMVDDLKNQLGSTVIVLATVVEGKVSLIAGVSKDVTDRVKAGELIGMVAQQVGGKGGGRPDMAQAGGTDAAALPAALASVQGWVSAKLQ

SEQ ID NO: 3811 - protein, 876 aa, Salmonella enterica serovar Heidelberg SL476; identical to SEQ ID NO: 3810

SEQ ID NO: 3812 - protein, 876 aa, Salmonella enterica serovar Schwarzengrund CVM19633
MSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQFAWELLTGENWFALPKERLWVTVYETDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIEAVAKVTGATDLGNKSLRVIADHIRSCAFLVADGVLPSNENRGYVLRRIIRRAVRHGNMLGAKETFFYKLVGPLIEVMGSAGEELKRQQAQVEQVLKTEEEQFARTLERGLALLDEELAKLQGDTLDGETAFRLYDTYGFPVDLTADVCRERNIKVDEAGFEAAMEEQRRRAREASGFGADYNAMIRVDSASEFKGYDHLELNGKVTALFVDGKAVEAINAGQEAVVVLDQTPFYAESGGQVGDKGELKGAGFTFAVDDTQKYGQAIGHIGKLSAGALKVGDAVQADVDEARRARIRLNHSATHLMHAALRQVLGTHVAQKGSLVSDKVLRFDFSHNEAMKPSEIRQVEDLVNAQIRRNLPIETNIMDLDAAKAKGAMALFGEKYDERVRVLSMGDFSTELCGGTHASRTGDIGLFRIISESGTAAGIRRIEAVTGEGAMATVHAQSDRLNDIAHLLKGDSQNLGDKVRAVLERTRQLEKELQQLKDQAAAQESANLSSKAVDLNGVKLLVSELASIEPKMLRTMVDDLKNQLGSTVIVLATVVEGKVSLIAGVSKDVTDRVKAGELIGMVAQQVGGKGGGRPDMAQAGGTDAAALPAALASVQGWVSAKLQ

SEQ ID NO: 3813 - protein, 865 aa, Alteromonas macleodii  Deep ecotype
MTLSTADLRNKFINYFKSHGHQAVASSSLVPADDPTLLFTNAGMNQFKDTFLGTEKRSYTRAVSSQRCVRAGGKHNDLENVGYTARHHTFFEMMGNFSFGDYFKKEAIEFAWNFLTSEVGLPKEKLLVTVYSEDDEAFDIWENHIGVPKEKIIRISTSDNFWSMGDTGPCGPCSEIFYDHGAHIWGGPPGTPEEDGDRFIEIWNLVFMQFNKQADGTMEPLPKPSIDTGMGLERISAILQNVHSNYEIDLFQNLIKSAASIVGTEDLENKSLRVIADHIRSCSFLICDGVMPSNEGRGYVLRRIIRRAVRHGYQLGANDIFFYKLVASLANEMGEAYPELVDQLPVIEKVLRVEEEQFSKTLARGMAMLNDTLASLEGDTVPGDVVFKLYDTYGFPTDLTNDVAREHELKIDEEGFEAAMQAQRARAQQASNFGADYNSKLAIDHTTSFTGYTDVEGQANVVELIADNAFVEKLEDGQEGVVVLDSTPFYAESGGQAGDKGVLRVANGEFIVTDTQKMGNAFAHKGIAKGSVSKGDTATAAIDSANREAIKKNHSATHLLHAALREILGEHVTQKGSLVEAPRMRFDFSHFEAVTTEQLAEIERRVNQEIRANHSLATELMDLEEAKASGAMALFGEKYDEKVRVVTMGPFSVELCGGTHVARTGDIGLFKITSEAGIASGVRRIEAVTGEQAIEVVQTQQATLSSLSSLLKTDSQNVLERVVSLQNQTKELEKALNSAKQKLASQQGADMLSNAVEINGVKVLIANLEGVEAKSLRSMMDDIKNRIGEGIVVLGVANNAKVNLIAGVTKNLTDKVKAGELVNFVASQVGGKGGGRPDMAQAGGDKPENLGQALDSVNVWLQDKL

SEQ ID NO: 3814 - protein, 875 aa, Geobacter bemidjiensis Bem
MTGKEIRAQFFNFFQKKGHALVESSNLIPRNDPTLLFTNAGMNQFKDVFLGMEKRDYLRAVSSQKCVRAGGKHNDLENVGRTARHHTFFEMLGNFSFGDYFKKEAIGFAWEFLTKELGLSKDRLYVTVYTDDDEAADIWHNQEGVPRERIYRFGEKDNFWSMGDTGPCGPCTEIFWDNGPGTGCGSPDCAVGCDCDRYMEIWNNVFMQFNRGKDGVLTPLPKPSVDTGMGLERISAVMQGVTSNYDTDLLQGIIRHIEQVSGKKYRDDEKDDVSMRVIADHARAVTFLICDGVLPSNEGRGYVLRRIMRRAARHAKMLGIAEPVLFRIVDAVNMMMGDAYPELLEREHYVKKVILAEEERFIETLDRGLAILNEETAALKAKGEKVISGEVIFKLYDTFGFPVDLTADIVESEGFTLDEDGFALCMEKQRVKARENWKGSGEQGLADIYKELHGTGITTDFLGYSEQTAFSTISAIVKGGTLVEEASAGDEIEIVTAATPFYGESGGQAGDTGTISTGSGHIEVTGSTRPFTDLIVHRGRVVSGAVRTGEAADLKITVANRAATARNHTATHLLQAALREVLGDHVKQAGSLVTPDRLRFDFTHFTPMTQEEIRRVEILVNGHIMGNSTVESREMPAADALAAGATALFGEKYGDVVRVVKVGDVSSELCGGTHVHGAGEIGFFKIISEAGIAAGVRRIEAQTGSGALAVVHGMEDEQRGIATLLKAEGGTVLDKVEKLVAGQRELQKELETLQARLNASKSADLIQQVREQNGIKILSVKVDGDAKGLRELSDTLKQRIGSGIIVLGTSDAARANLLVAVTADLSARWKAGDIIKAIAPIVGGNGGGKPELAQAGGSKPEHLAEALEAVYQIVG

SEQ ID NO: 3815 - protein, 876 aa, Salmonella enterica serovar Agona SL483
MSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQFAWELLTGENWFALPKERLWVTVYETDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIEAVAKVTGATDLGNKSLRVIADHIRSCAFLVADGVLPSNENRGYVLRRIIRRAVRHGNMLGAKETFFYKLVGPLIEVMGSAGEELKRQQAQVEQVLKTEEEQFARTLERGLALLDEELAKLQGDTLDGETAFRLYDTYGFPVDLTADVCRERKIKVDEAGFEAAMEEQRRRAREASGFGADYNAMIRVDSASEFKGYDHLELNGKVTALFVDGKAVEVINAEQEAVVVLDQTPFYAESGGQVGDKGELKGAGFTFAVDDTQKYGQAIGHIGKLSAGALKVGDAVQADVDEARRARIRLNHSATHLMHAALRQVLGTHVAQKGSLVSDKVLRFDFSHNEAMKPSEIRQVEDLVNAQIRRNLPIETNIMDLDAARAKGAMALFGEKYDERVRVLSMGDFSTELCGGTHASRTGDIGLFRIISESGTAAGIRRIEAVTGEGAMATVHAQSDRLNDIAHLLKGDSQNLGDKVRAVLERTRQLEKELQQLKDQAAAQESANLSSKAVDLNGVKLLVSELAGIEPKMLRTMVDDLKNQLGSTVIVLATVVEGKVSLIAGVSKDVTDRVKAGELIGMVAQQVGGKGGGRPDMAQAGGTDAAALPAALASVQGWVSAKLQ

SEQ ID NO: 3816 - protein, 877 aa, Acidithiobacillus ferrooxidans ATCC 53993
MQAQAIRQAFLEYFVEQGHQIVPSSPLIPRNDPTLLFTNAGMVPFKDVFLGLETRPYRRAVSSQRCMRAGGKHNDLENVGYTARHHTFFEMLGNFSFGDYFKREVIGFAWRFLTERLGLPPEKLWITVYEEDDEAADIWMNEIGIDPARLSRCGEKDNFWSMGDTGPCGPCSEIFYDHGPHIPGGPPGSPEEDGDRYIEIWNLVFMQFDRDSSGTLTPLPKPSVDTGMGLERLAAVLQGVHNNYDTDLFKPLIAAAATISGKTYGSDAATDISLRVLADHIRACSFLITDGVLPANEGRGYVLRRIIRRAVRHGRKLGMETVFFHQLVAPLVAEMGSAFPELTRAQREVERALEREETRFRETLERGLSLLEEAIADLAAGAAIPGEIIFRLADTFGFPVDLTADIARERDLIMDMEGYEAAMAEQRSRSRAAWAGSGEVKTERVYHDLAMRLPVTEFTGYSTCADEGKVVALIRDGEEVAFLEAGDMGVVILDRTPFYGESGGQAGDRGELQSDDALFAVTDTQKPMGHLHVHLGRMESGRLRVGDMVVASIDEVARRATAAHHSATHLLHAALRNILGSHVQQKGSLVNPERLRFDFSQPEPVTAAQLREIERVVNAAIRNNVGAETRILPVAEAQALGAMALFGEKYGDEVRVVRMGDFSMELCGGTHVEALGDIGVFKILSESGVAAGIRRIEAVTGAVALEAIQRDEERLQAAAGLLKVAPAELDQRLAQTLERLRQLEKELEKVKRDEAARAGADLAAEAEDVGGVPVLIRRLEGMDGKALRDALDRLRSQLPDGVIVLAGVEREKVALIAGVGKGLTGRVHAGELVNTVAQPLGGKGGGRPELAQAGAGNPAALDAALAAARDWVKGKLG

SEQ ID NO: 3817 - protein, 876 aa, Salmonella enterica serovar Dublin CT 02021853
MSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQFAWELLTGENWFALPKERLWVTVYETDDEAYEIWEKEVGIPRERIIRIGDNKGAPYASDNFWQMGDTGPCGPCTEIFYDHGDHIWGGPPGSPEEDGDRYIEIWNIVFMQFNRQAEGTMEPLPKPSVDTGMGLERIAAVLQHVNSNYDIDLFRTLIEAVAKVTGATDLGNKSLRVIADHIRSCAFLVADGVLPSNENRGYVLRRIIRRAVRHGNMLGAKETFFYKLVGPLIEVMGSAGEELKRQQAQVEQVLKTEEEQFARTLERGLALLDEELAKLQGDTLDGETAFRLYDTYGFPVDLTADVCRERNIKVDEAGFEAAMEEQRRRAREASGFGADYNAMIRVDSASEFKGYDHLELNGKVTALFVDGKAVEAINAGQEAVVVLDQTPFYAESGGQVGDKGELKGAGFTFAVDDTQKYGQAIGHLGKLSAGALKVGDAVQADVDEARRARIRLNHSATHLMHAALRQVLGTHVAQKGSLVSDKVLRFDFSHNEAMKPSEIREVEDLVNAQIRRNLPIETNIMDLDAAKAKGAMALFGEKYDERVRVLSMGDFSTELCGGTHASRTGDIGLFRIISESGTAAGIRRIEAVTGEGAMATVHAQSDRLNDIAHLLKGDSQNLGDKVRAVLERTRQLEKELQQLKDQAAAQESANLSSKAVDLNGVKLLVSELAGIEPKMLRTMVDDLKNQLGSTVIVLATVVEGKVSLIAGVSKDVTDRVKAGELIGMVAQQVGGKGGGRPDMAQAGGTDAAALPAALASVQGWVSAKLQ

SEQ ID NO: 3818 - protein, 876 aa, Escherichia coli O157 H7 EC4115
MSKSTAEIRQAFLDFFHSKGHQVVASSSLVPHNDPTLLFTNAGMNQFKDVFLGLDKRNYSRATTSQRCVRAGGKHNDLENVGYTARHHTFFEMLGNFSFGDYFKHDAIQFAWELLTSEKWFALPKERLWVTVYESDDEAYEIWEKEVGIPRERIIRIGDNKGAPYASDNFWQMGDTGPCGPCTEIFYDHGDHIWGGPPGSPEEDGDRYIEIWNIVFMQFNRQADGTMEPLPKPSVDTGMGLERIAAVLQHVNSNYDIDLFRTLIQAVAKVTGATDLSNKSLRVIADHIRSCAFLIADGVMPSNENRGYVLRRIIRRAVRHGNMLGAKETFFYKLVGPLIDVMGSAGEDLKRQQAQVEQVLKTEEEQFARTLERGLALLDEELAKLSGDTLDGETAFRLYDTYGFPVDLTADVCRERNIKVDEAGFEAAMEEQRRRAREASGFGADYNAMIRVDSASEFKGYDHLELNGKVTALFVDGKAVDAINAGQEAVVVLDQTPFYAESGGQVGDKGELKGANFSFVVEDTQKYGQAIGHIGKLAAGSLKVGDAVQADVDEARRARIRLNHSATHLMHAALRQVLGTHVSQKGSLVNDKVLRFDFSHNEAMKPEEIRAVEDLVNAQIRRNLPIETNIMDLEAAKAKGAMALFGEKYDERVRVLSMGDFSTELCGGTHASRTGDIGLFRIISESGTAAGVRRIEAVTGEGAITTVHADSDRLSEVAHLLKGDSNNLADKVRSVLERTRQLEKELQQLKEQAAAQESANLSSKAIDVNGVKLLVSELSGVEPKMLRTMVDDLKNQLGSTIIVLATVAEGKVSLIAGVSKDVTDRVKAGELIGMVAQQVGGKGGGRPDMAQAGGTDAAALPAALASVKGWVSAKLQ

SEQ ID NO: 3819 - protein, 874 aa, Shewanella baltica OS223
MYQTTAELRSAFLEFFRSNGHQVVDSSSLVPGNDPTLLFTNAGMNQFKDVFLGMDKRNYTRATTAQRCVRAGGKHNDLDNVGYTARHHTFFEMLGNFSFGDYFKEEAIRFGWTFLTETLKLPKERLCVTIYQTDDEAFEIWNKKIGVAAENIIRIGDNKGAAYASDNFWQMGDTGPCGPCSEIFYDHGDHIWGGRPGSPEEDGDRFIEIWNIVFMQYNRQASGEMLPLPKPSVDTGMGIERIAAIMQGVHSNYEIDIFRTLIAKAAEIIGVSDLTEKSLRVIADHIRSCAFLIADGVMPSNEGRGYVLRRIIRRAVRHGNKLGATEAFFYKLVPSLIAVMGDAAKGLAETQAIVEKALKAEEEQFARTLERGLGILDAALNELKGDTLDGETVFKLYDTYGFPMDLTADVCRERNIIVDEAGFEVAMAEQRSRAQAAGNFGADYNAALKIDAETAFSGYTELAGQAKITAIYQNGESVTAIKAGDEAVVVLDVTPFYAESGGQVGDKGQLVANGVEFTVNDTQKYGQATGHQGVLATGSLSVGQVVEAKVDKKLRHRTQLNHSVTHLLHAALRQVLGTHVSQKGSLVDPERLRFDFSHFEGVKAAELKEVEELVNTQIRRNHELKTAEMGIDEAKEKGAMALFGEKYDSQVRVVTMGDFSIELCGGTHVGRTGDIGLFKITSEAGIAAGVRRIEAVTGAAAMAYVAQQQAELEEAAALLKGDANSVVAKLKAQLDKMKQLEKEMAQLKDKLAAAASADLVGDAIVVNGVNVLIKKLDGVEASSLRGLQDELKQKLKSAIIVLGTAQEGKVNLIAGVSNDLIGKVKAGELVAMVAAQVGGKGGGRPDMAQAGGSQPENLDAALAQVLPWITERLA

SEQ ID NO: 3820 - protein, 877 aa, Acidithiobacillus ferrooxidans ATCC 23270; identical to SEQ ID NO: 3816

SEQ ID NO: 3821 - protein, 865 aa, Thioalkalivibrio HL EbGR7
MKSADLRTSFLEYFRSKGHEVVPSSPLIPGNDPTLLFTNAGMVQFKDVFLGREQRPYVRATSSQRCVRAGGKHNDLENVGYTARHHTFFEMLGNFSFGDYFKREAIQYAWEYLTQVLKLPEEKLWVTVFEEDDEAADIWLKDVGVNPERFSRIGASDNFWSMGDTGPCGPCTEIFYDHGPEVPGGPPGTPEADGDRYIEIWNLVFMQYDRAKDGTLTPLPRPSVDTGMGLERLAAVMQGVHSNYEIDLFQNLIRAIRDMAKGADPTSPSLRVIADHIRSCSFLVADGVMPANEGRGYVLRRIIRRAARHGHKLGLDEPFFHRLVGPLVAEMGEAYPELVKAQPMVERVLRQEEERFAETLEKGLRILEEDIDGLKGTEIPGKTIFVLYDTYGFPVDLTGDIARERGLTLDMAGFEAEMEIQRERARAASHFDADYHRKLKIEGESAFTGYEHLDGQGRVTALFKDGEPVDALASGEHGLVVLDETPFYAESGGQVGDTGELLAEGVIFEVTDTRKHGAAHAHMGRVVEGRIAQGDVLGAKVNQARRQAVVLNHSATHLMHAALREILGDHVQQKGSLVAPDRLRFDFSHFQPVSAEELERIERRVNEAIRANAEAEARIMPIDQALESGAMALFGEKYGDEVRVLSMGGFSTELCGGTHVRRTGDIGVFKILSESGVASGIRRIEAVTGENALNYIGETEKNLSRIAEMVKAGRGDLDEKVALLVERSRQLEKELEALKGKLASAAGSSLADQAVEVNGIKVLAANLEGADPKSLRDTVDQLKNKLGEAAVVLATVKDGKVSLVAGVTQGQTARLKAGELVNAVAQQVGGKGGGRPDMAMAGGTDPSGLPGALASVPDWVRERLG

SEQ ID NO: 3822 - protein, 875 aa, Dickeya dadantii Ech703
MSKSTAEIRQAFLDFFQSKGHQVVASSSLVPNNDPTLLFTNAGMNQFKDVFLGLDKRSYVRATTAQRCVRAGGKHNDLENVGYTARHHTFFEMLGNFSFGDYFKHDAILNAWELLTGPQWFNLPKEKLWVTVYATDDEAYDIWANVVGIPQERIIRIGDNKGAPYASDNFWQMGDTGPCGPCSEIFYDHGDHIWGGPPGSPEEDGDRYIEIWNLVFMQFNRQADGTMLPLPKPSVDTGMGLERVSAVLQHVNSNYEIDVFRTLIAEAAKVVGTRDLNNKSLRVIADHIRSCAFLIADGVMPSNENRGYVLRRIIRRAIRHGNMLGAKDTFFYKLVAPLIDVMGSAADELRTQQTVVELALKSEEEQFARTLERGLSLLDEEIRTLQGDTLSGEAAFRLYDTYGFPLDLTADVCRERGLKVDETGFEREMEAQRQRAREASGFGADYNSLIRVDSATTFCGYDHAEQRSHVVALYRKGEPVQEISAGDEAVVILDETPFYGESGGQVGDQGVLKGVSAYFVVDDTQKYGRAFGHVGKLTQGSLRVNDAVDAVVDDVRRDRIRLNHSATHLLHAALRQVLGTHVAQKGSLVNDRYLRFDFSHPEAMKPDEIRQVEDIVNAQVRRNLPVDTAIMAIDDARAKGAMALFGEKYDDQVRVLTMGDFSIELCGGIHARRTGDIGLFRIVSESGTAAGIRRIEAVTGEGAVASLHHQSDLLQDVTLLVKGDANNLIEKVRSLLERNRGLEKELLQLKEQQAAQESSSLAGKAKDINGVKLLVTQLSNVEPKMLRTMVDDLKNQLGSAVIVLSTIVEGKVSLIAGVTQGLTERVKAGELVGFVANQVGGKGGGRPDLAQAGGSDADALPSALASVEAWVADKL

SEQ ID NO: 3823 - protein, 875 aa, Dickeya zeae Ech1591
MSKSTAEIRQAFLDFFHSKGHQVVASSSLVPNNDPTLLFTNAGMNQFKDVFLGLDKRNYVRATTSQRCVRAGGKHNDLENVGYTARHHTFFEMLGNFSFGDYFKRDAIIYAWELLTSSEWFGLPKEKLWVTVYATDDEAYDIWANEVGVPHERIIRIGDNKGAPYASDNFWQMGDTGPCGPCSEIFYDHGDHIWGGPPGSPEEDGDRYIEIWNLVFMQFNRQADGTMLPLPKPSVDTGMGLERISAVLQHVNSNYDIDLFSTLIAEAARVVGTDDLNNKSLRVIADHIRSCAFLIADGVMPSNENRGYVLRRIIRRAIRHGNMLGAKETFFYKLVGPLVDVMGSAAEELKRQQSLVEQALKNEEEQFARTLERGLLLLDEEIKQLKGDTLSGEAAFRLYDTYGFPVDLTADVCRERNLKVDEAGFERAMEAQRQRARDASGFGADYNSLIRVDESTTFCGYERTEQQSTVVAIYRQGESVQEIQAGDDAVVILSETPFYGESGGQVGDQGTLVSAAARFSVVDAQKYGQAIGHVGSLVQGVLRVNDKVDAAVDHVRRDRIRLNHSATHLLHAALRQVLGDHVAQKGSLVNDNYLRFDFSHPEAMKPEQIRQVEDIVNTQIRRNLPVDTDVMALDAARAKGAMALFGEKYDEQVRVLSMGDFSIELCGGTHARRTGDIGLFQIVSESGTAAGVRRIEAVTGENAIVALHQQSDVLHEVTQLVKGDSNNLADKVRSLLERTRGLEKELQQLKEQQAAQESSSLSGKAKDINGVKLLVTQLNNVEPKLLRTMVDDLKNQLGSAVIVLSTVADGKVSLIAGVTKELTDRVKAGELVGFVANQVGGKGGGRPDMAQAGGSDVGALPSALTSIEAWVVDKL

SEQ ID NO: 3824 - protein, 875 aa, Pectobacterium carotovorum PC1
MSKSTAEIRQAFLDFFHSKGHQVVDSSSLVPNNDPTLLFTNAGMNQFKDVFLGLDKRNYVRATTSQRCVRAGGKHNDLENVGYTARHHTFFEMLGNFSFGDYFKHDAIRYAWELLTSPQWFNLPKEKLWVTVYATDDEAYDIWADEVGVPRERIIRIGDNKGGPYASDNFWQMGETGPCGPCTEIFFDHGEHIAGGPPGSPDEDGDRYIEIWNLVFMQFNRQVDGTMLPLPKPSVDTGMGLERISAVLQHVNSNYDIDLFKTLIEAVANAVGTTDLTNKSLRVIADHIRSCAFLIADGVTPSNENRGYVLRRIIRRAARHGNMLGATDAFFYKLVAPLIEVMGPAAAELKKQQSVVEQALKMEEEQFARTLERGLSLLDEEIKNLKGDTLDGETAFRLYDTYGFPVDLTADVCRERGLKVDEEGFEAAMTAQRQRAREASGFGVDYNSLIRVDENTPFCGYEKTQQQAKVIALYHNGNAVDQIAAGDEAVVILNETPFYGESGGQVGDQGELKNAGVSFAVQDTQKYGQAIGHVGKLTQGTLRVNDSVDANVDSQRRDRIRLNHSATHLLHAALRQVLGDHVAQKGSLVNDSYLRFDFSHTEAMKPEQIRQVEDIVNAQIRRNLTVQTDVMALDDARAKGAMALFGEKYDDHVRVLTMGDFSIELCGGTHASRTGDIGLFQIISESGTAAGVRRIEATTGENALSALHRQSDVLQDIAQLLKGDSHNLTDKVRSVLDRARALEKELQQLKAQQAAQESSSLSGKAKEVSGVKLLVTQLDNVDPKLLRTMVDDLKNQLGSAVIVLGTVAEGRVSLISGVTKDLTDRVKAGELIGFVAQQVGGKGGGRPDMAQAGGSDVSALPAALASVESWVAAKL

SEQ ID NO: 3825 - protein, 875 aa, Geobacter M21
MTGKEIRAQFFNFFQKKGHALVESSNLIPRNDPTLLFTNAGMNQFKDVFLGMEKREYLRAVSSQKCVRAGGKHNDLENVGRTARHHTFFEMLGNFSFGDYFKKEAIGFAWEFLTKELGLSKDRLYVTVYTDDDEAADIWHNQEGVPRERIYRFGEKDNFWSMGDTGPCGPCTEIFWDNGPGTGCGSPDCAVGCDCDRYMEIWNNVFMQFNRGKDGVLAPLPKPSVDTGMGLERISAVMQGVTSNYDTDLLQGIIRHIEKVSGKKYRDDERDDVSMRVIADHARAVTFLICDGVLPSNEGRGYVLRRIMRRAARHAKMLGIAEPVLFRVVDAVNMMMSDAYPELLEREQYVKKVILAEEERFIETLDRGLAILNEETAALRAKGEKVISGEIIFKLYDTFGFPVDLTADIVESEGFTLDEDGFALCMEKQRVKARENWKGSGEQGLADIYKELHGTGITTDFLGYSEQTAFSTISAIVKGGTLVEEAGAGEEVEIVTAATPFYGESGGQAGDTGTISTGSGHVEVTGSTRPFTDLIVHRGRVVSGAVRTGEAADLKITVAHRAATARNHTATHLLQAALREVLGEHVKQAGSLVTPDRLRFDFTHFTPMTQEEIRRVEILVNGHIMGNSPVEAREMPATDALAAGATALFGEKYGDVVRVVKVGEVSSELCGGTHVHGAGEIGFFKIISEAGIAAGVRRIEAQTGSGALAVVHGMEDEQRGIATLLKAEGGTVLDKVEKLVAGQRELQKELETLQARLNASKSADLIQQVREQNGVKILSVKVEGDAKGLRELSDTLKQRIGSGIIVLGTSDAARANLLVAVTADLAGRWKAGDIIKAIAPIVGGNGGGKPELAQAGGSKPEHLAEALEAVYQIVG

SEQ ID NO: 3826 - protein, 442 aa, Polaromonas JS666
MEPQNIKPHTPELSRNTALFERAKKLIPGGVNSPVRAFKAVGGTPRFVQRAQGAYFWDADDQRYIDYIGSWGPMILGHGHPAVLASVQKALLDGFSYGAPTEREVELAEELVRLVPSLEMVRLVSSGTEAAMSAIRLARGATGRSKIIKFEGCYHGHADALLVKAGSGLATFGNPTSAGVPPEVVQHTLVLEYNHLAQLEEAFALHGSAIACLMIEPIAGNMNFVRASIPFMQRCRELCTQYGALLVFDEVMTGFRVALGGAQSVYAKSIPGFKPDMTVLGKVIGGGMPLAAFGGTRAVMEQLAPLGPVYQAGTLSGNPVATACGLATLREIQKPGFYEALGERTRGLVAGLTQAANKAGVPFCGDSEGGMFGFFLLGQLPQNYATVMTTDGPAFNRFFHAMLASGVYYAPALYEAGFVSSAHSAADIEATVDAAAKFFAGA

SEQ ID NO: 3827 - protein, 437 aa, Acidovorax avenae citrulli AAC00-1
MTPSTDLNLPLFERAKALIPGGVNSPVRAFRAVGGTPRFVQRAQGAYFWDANGQRFIDYIGSWGPMILGHGHPAVLEAVQKAALDGFSFGAPTEREVELAEEILRHVPSMEMIRLVSSGTEAGMSAIRLARGATGRSRIIKFNGCYHGHADALLVKAGSGLATFGHATSAGVPAEVVQHTLVLEYNDIAQLEEAFALHGSEIAGLMIEPIAGNMNFVRASVPFMRRCRELCTQHGALLVFDEVMTGFRVALGSAQSVYARDIPGFQPDITVLGKVIGGGMPLAAFGGPRAIMEQLAPLGPVYQAGTLSGNPVATACGLATLREIARPGFYEALGERTRALTGGLADAARAEGLPFSADSEGGMFGFFLLPELPRNYPTVMTTDGARFNALFHGLLDRGVYIAPALYEAGFVSSAHSAQDIDETIAAAREVFRLVSAG

SEQ ID NO: 3828 - protein, 434 aa, Acidovorax sp. JS42
MTHNTDLNLPLFERAKALIPGGVNSPVRAFRAVGGTPRFITRAQGAYMWDANGQRFIDYIGSWGPMILGHGHPAVLEAVQKAALEGFSFGAPTEREVELAEEIIRHVPSMEMIRLVSSGTEAGMSAIRLARGATRRNKIIKFNGCYHGHADSLLVKAGSGLATFGHATSAGVPQEVVQHTLVLEYNDVAQLEEAFTLHGPDVACVIMEPIAGNMNFVRASVPFMRRARELCTQHGALLVIDEVMTGFRVALGGAQSLYAQAIPGFKPDITVLGKVIGGGMPLAAFGGSRAVMEQLAPLGPVYQAGTLSGNPVATACGLATLREIAKPGFYDALGARTRALIDGLAGAASAAGVPLCGDTQGGMFGFFLLPQLPQNYPEVLNTDGMRFNTLFHGLLDGGVYIAPALYEAGFVSAAHTEQDIADTVAVARDVFQKL

SEQ ID NO: 3829 - protein, 442 aa, Polaromonas naphthalenivorans CJ2
MEQPNTKPVAPATSRNAALFERAQKLIPGGVNSPVRAFKAVGGTPRFIQRAQGAYFWDADGQRYIDYIGSWGPMILGHGHPAVVEAVQKAVLEGFSYGAPTEREVELAEEIVKLVPSIEMVRLVSSGTEATMSVIRLARGATGRSKIIKFEGCYHGHSDALLVKAGSGLATFGSPTSAGVPPEVVQHTLVLEYNHIAQLEEAFSLHGRDIACLMIEPIAGNMNFVRASVPFIKRCRELCTQYDALLVFDEVMTGFRVALGGAQSVYAQSIPGFKPDITALGKVIGGGMPMAAFGGTRAVMEHLAPLGGVYQAGTLSGNPVATACGLATLREIQKPGFYDALGARTRSLVEGLTHAANQAGVPFCGDSEGGMFGFFLLGTLPQNYPQVMKTDSPTFNRFFHAMLDSGVYYAPALYEAGFVSAAHTAEDIEATVEAATRFFAGR

SEQ ID NO: 3830 - protein, 437 aa, Verminephrobacter eiseniae EF01-2
MTPNTDLNIPLFERAKALIPGGVNSPVRAFKAVGGTPRFVKRARGAYFWDANDQRFIDYIGSWGPMILGHGHPAVLEAVQQAALEGLSFGAPTERELELAEAILRLLPSMQMIRLVSSGTEAGMSAIRLARGATGRSKLIKFEGCYHGHADALLVKAGSGLATFGNATSAGVPAEVVQHTLVLEYNSIEQLERAFALHGKELACLIIEPIAGNMNLVRASVPFMRRCRELCSEYGALLVLDEVMTGFRVAPGGAQSLYARDIPGFQPDLTVLGKVIGGGMPLAAFGGSRALMEHLAPLGAVYQAGTLSGNPVATACGLATLRAIGQPGFFAALSARTRALVEGLRGAAAAEGVAFSADSEGGMFGFFLLPALPRNYAQVLQTDSARFNQLFHGLLERGIYIAPALYEAGFVSAAHSDEDIAATVAAAREVFKTLAKP

SEQ ID NO: 3831 - protein, 436 aa, Methylibium petroleiphilum PM1
MADSRNASLFERARRSIPGGVNSPVRAFRAVGGTPRFIARADGAYLWDADGKRYIDYIGSWGPMILGHGHPAVLEAVQKAATEGFSFGAPTEREVELAEEILKLVPSAEQVRLVSSGTEAAMSALRLARGATGRSKIVKFEGCYHGHADALLVKAGSGLATFGHPTSAGVPTEVVQHTLVLTYNDVTGLEAAFSAHGAEIACVMIEPIAGNMNFVRAGLPFMKRLRELCTQHGALLVFDEVMTGFRVALGGAQSLYAKAIPGFKPDLSVFGKVIGGGMPLAAFAGPRAIMEQLAPLGPVYQAGTLSGNPVATACGLATLREIQKPGFFESLAAGTRDLLDGLLHAATAAGVPMVGDCEGGMFGFFFPKTAQAALPQNYVEVMATDGERFNRYFHGMLDRGVYLAPALYEAGFVSAAHTPADIEATLAAARATLAAA

SEQ ID NO: 3832 - protein, 438 aa, Delftia acidovorans SPH-1
MADSCTMTTDLNIPLFERAKAVIPGGVNSPVRAFNAVGGTPRFVRRAQGAHFWDENAQQFTDYIGSWGPMILGHGHPEVMAAVQAAALEGFSFGAPTEREVVLAEKILSLMPSMDMVRMVSSGTEAGMSALRLARGFTGRNKIIKFNGCYHGHADALLVKAGSGLATFGASSSAGVPQDVVKDTVVLEYNDVGQLEEAFAQFGDQIACVIMEPIAGNMNFVRASVPFTRRIRELTREHGALMVYDEVMTGFRVALGSAQSLYAQHIEGFAPDITVLGKVIGGGMPMAAFGARREIMEKLSPLGPVYQAGTLSGNPIATACGLKTLELISEPGFHDALHAKTGRLMAGFKAEADAAGVPFSVDHQGGLFGFYLLPELPSTWTEVMKTDGARFNRFFHGMLERGHYFAPALYEAGFVSAAHTDADIDKTIEAAREVFKTL

SEQ ID NO: 3833 - protein, 437 aa, Leptothrix cholodnii SP 6
MATPVSSNAELFERAQRSIPGGVNSPVRAFRAVGGTPRFIARAQGAYMWDAEGKQYIDYIGSWGPMILGHGHPAVLAAVQKAATEGFSFGAPTEREVELAETILALVPSCEQIRLVSSGTEAAMSAIRLARGATGRSKLIKFEGCYHGHADALLVKAGSGLATFGNPTSAGVPPEVVQHTLVLTYNDIEQLEEAFKIHGPELACVMIEPIAGNMNFVRATVPFMKRIRELCTQHGALLVFDEVMCGFRVALGSAQSLYAQAIPGFAPDVSVFGKVIGGGMPLAAFGASRKIMSLLAPLGPVYQAGTLSGNPVATACGLATLREISQPGFFEALGARTRRLVDGLSAAAADAGVPFVGDCQGGMFGFFFPRNRGEGLPQNYATVMATDQARFNSFFHGLLDRGVYLAPALYEAGFVSAAHSDADIDATVAAARAALQP

SEQ ID NO: 3834 - protein, 434 aa, Diaphorobacter TPSY uid29975
MTHNTDLNLPLFERAKALIPGGVNSPVRAFRAVGGTPRFITRAQGAYMWDANGQRFIDYIGSWGPMILGHGHPAVLEAVQKAALEGFSFGAPTEREVELAEEIIRHVPSMEMIRLVSSGTEAGMSAIRLARGATRRNKIIKFNGCYHGHADSLLVKAGSGLATFGHATSAGVPQEVVQHTLVLEYNDVAQLEEAFTLHGPDVACVIMEPIAGNMNFVRASVPFMRRARELCTQHGALLVIDEVMTGFRVALGGAQSLYAQAIPGFKPDITVLGKVIGGGMPLAAFGGSRAVMEQLAPLGPVYQAGTLSGNPVATACGLATLREIAKPGFYDALGARTRALIDGLAGAASAAGVPFCGDTQGGMFGFFLLPQLPQNYPEVLNTDGMRFNTLFHGLLDGGVYIAPALYEAGFVSAAHTEQDIADTVAVARDVFQKL

SEQ ID NO: 3835 - protein, 431 aa, Variovorax paradoxus S110
MPNADQNDILFERARAVIPGGVNSPVRAFKAVGGTPRFIRRAEGAYFWDANDKRYIDYIGSWGPMILGHGHPAVVEAVQKAVLEGFSYGAPTEREIELAEAILALMPSMEMVRLVSSGTEAAMSALRLARGATGRKHIIKFEGCYHGHADALLVKAGSGLATFGHPTSAGVPPEVTQHTLVLEYNNIAQLEEAFALHGNDIACLMIEAIAGNMNFVRATPAFAARCRELCTQHGALLVFDEVMTGFRVGLHGAQGVLGITPDLTVLGKVIGGGMPLAAFGGPRAIMEQLAPLGPVYQAGTLSGNPVATACGLATLKEISKPGFYEALGKKTRSLADGLKAAAAAEGLPFNADSEGGMFGFFLMNELPQNYATVMTTDNAKFNALFHGLLERGVYIAPALYEAGFVSAAHGDDDIAATIDAARQVFRTLRSL

SEQ ID NO: 3836 - protein, 181 aa, Ralstonia solanacearum
MSETRTNLTSRQRLHEYQAMLARRLQEARAKASMDSFLGVQIGDRHWLLSLGDTGEVLDYQPPARVPLTQPWYLGLVNARGTLLGVIDFALFSGEAPTVGGVGAKMVVLSKDPQRACAILVPRVAGLRSLSDLQAVEAGQEDGLPWQNRAWRDAQGTLWRELSVRQLLADPAFLQVGRSRA

SEQ ID NO: 3837 - protein, 184 aa, Pseudomonas putida KT2440
MTTRPQGASLTAFELLLDIDRRCRLLVADQPPQDNRVQQWSGIGFRIAGQWFVAPMGEVAEVLREPRSSRVPGVQPWVCGVANLRGRLLPVMDLSCFFGLGHAAPGKQRRVLVLDHDDLFVGLLVDEVLGLQHFALDSLQLSPPQPLIPAAARFVQGYFPRERNWAIFSPFALAQAPGFLDVAL

SEQ ID NO: 3838 - protein, 179 aa, Pseudomonas syringae tomato DC3000
MAEPRTAFELLLDMDRRCRSLAAGLPLQETHQQDWVGIGFRMGDQRFVAPIGEIAEILHEPRHAVMPGVKFWVAGVANLRGRLLPLMDLCGFFGHELTSARKQRRVMVVEYNDIFAGLVVDEVFGMQRFSQLSLIPHTPQDVDQRLVPFLRGQFIREQAWQIFSPWALVQSADFMDLAS

SEQ ID NO: 3839 - protein, 179 aa, Pseudomonas syringae pv B728a
MAEPRTAFELLLDMDRRCRSLAAGLPLQEAHQQDWVGIGFRMGEQRFVAPIGEIAEILHEPHHAVMPGVKFWVAGIANLRGRLLPLMDLCGFFGHELVPVRKQRRVLVVEHHDVFAGLLVDEVFGMQRFSQLSLIPQTPQEIDQRMVPFLRGQFIREQAWLIFSPWALVQSADFMDLAS

SEQ ID NO: 3840 - protein, 176 aa, Psychrobacter arcticum 273-4
MASRGFVELLRIADMARSRKSGSRGGQKFDWQGIVFEIGGQRLVAPMGQVAEVLSMPEYTSVPLVKPWMLGIANIRGRLLPLTDLSRFLQVPSRLSQMSQCKVMVIDHNNVFSGLLVDQVLGIEQFTQDQYRPEAMEPNSPFAPYNHGKFFKDEQDWYVFMPSLLTQDLQYTDAAI

SEQ ID NO: 3841 - protein, 170 aa, Dechloromonas aromatica RCB
MARKTSLRDFQEYLASRLSQAARGKGSASWLGVEAGGEAWLVDLSDGGEIVQASQMAPVPLTRPWFVGISNIRGNLHAVSDFSLFRGGPPIVQNANARLLLIGARYGINAALLVSRMLGLKNPEDFTPESADASMPAWGMQRFADTHGKIWHKLSVRELLADQDFMNIGV

SEQ ID NO: 3842 - protein, 182 aa, Ralstonia eutropha JMP134
MNAPRQDLRTRQTRLQDYQAMLARRLREARNVPAADSYLALQVGQRGWLLPLAQTGEVLDMRHPSRVPLTQPWYAGLVNARGSLLGVIDFGLFCGDAPTPLQPGSKIVVLSRQVERACGILATRVVGLRHAADLREPAQPAGAVEAWEGRRLDDGDGRAWQVLDVRALLDTPAFLQAGRMAA

SEQ ID NO: 3843 - protein, 174 aa, Thiobacillus denitrificans ATCC 25259
MAKKFNLREFQTALSQQLQAAASRDNTGSRLGFRAGDVNWLVALSDTEEVIPVPPVVRVPGARRWFRGVTNIRGNLFAVSDLSDFMGQGVTPEHGDCRLLIPHHSFGVNAALLVQGTLGLKNVGRYQARGERTATHPWVAREYVDEGGGAWCDIDVAQLLGNPEFLMVEAQVGN

SEQ ID NO: 3844 - protein, 178 aa, Nitrosococcus oceani ATCC 19707
MDKNNPFSILRNIEAQNRQHGAALPQQTAIRQVWTNLGFLLGNQKLAALLTQVYEVFPCPAITRVPGAKPWVVGVANIRGYILPLIDLHAYIYGAPSQRTHRSKVLVVTKEKFLIGLLVEEVFGLKHFLDEEWTGQNLPSHDPLTRYIQRGFAQNREIWLEFDFHLLMEQESFFLATT

SEQ ID NO: 3845 - protein, 176 aa, Rhodoferax ferrireducens T118
MANREALRELQTRLASRLQAARSGDVSVAWLAVKAGESNYLFPLAQSGEIFPLTNVQVVPYCRQWFMGVVNLRGGLFGVVDLASFMSGGSTRGRTEQSLAESSVITINSALELNCALMVDGLAGLRKRDAFAGAEAPPEGSPVFFGTRFTDRDGAHWQEINLQSLSQLPEFLSISA

SEQ ID NO: 3846 - protein, 179 aa, Saccharophagus degradans 2-40
MSQNAAFQALVHLSSLSRSAAKGLPEQMNVVPRWSGVGFSVMGKKFVAPMGQVTELMELPSSTRLPGVQPWVIGLSNVRGRLLPLFDLAHFFEGKMTGHKKNHRVLVLETDTLYSGLVVDRAFGMQHFNVDSFSTDTAELDSQLTPFVDGTYQDDSGERWNVFSVANLAADARFINAAL

SEQ ID NO: 3847 - protein, 175 aa, Methylobacillus flagellatus KT
MARPRINLQAYQQGILERLQHVATDSGAADNARLGIHAGGQQYLVALRDIKEVLPVPEIHAVPLVQPWFLGMCNIRGNLYAVTDLARFLGSRHQPAVMTAESRLMLVHDDFDINAAFLIDSLAGLRSLGDFKPLEMVADGPSYITSRHEDDQHHLWEELNMALILEKQEFLQVAA

SEQ ID NO: 3848 - protein, 176 aa, Polaromonas JS666
MANRQALRELQTRLADRLQVARTQGVAASWLAVEAGGRNYLFPLSQSGEIFPWVHTQAVPYTQAWFAGVANLRGGLFGVVDLASYVSGEAPPPKTELARAESRLVALNSALEVNCALLIDRLAGLRKQDAFVDFSEKAPDAPEFFGNQYVDLNGASWQEINLQLLAQQAHFLTIGA

SEQ ID NO: 3849 - protein, 176 aa, Psychrobacter cryohalolentis K5
MASRGFIELLRIADMARSRKSGRRGGQEFDWQGVVFEIGGQRLVAPMGQVAEVLSMPEYTSVPLVKPWMLGIANIRGRLLPLTDLSRFLQVPSRLAQMSQRKVMVIDHENVFSGLLVDQVIGIEQFTQDQYRPEAIEPNSPFAPYNHGKFFKDEQDWYVFMPSLLTQDLQYTDAAI

SEQ ID NO: 3850 - protein, 180 aa, Cupriavidus metallidurans CH34 uid250
MNAPRQDLRARQTRLQDYQAMLARRLRDARNLPAVDSYLGVVVGQRNWLLPLLETGEVIEMRQPAGVPLTQPWYRGLVNARGNLLGVIDFAMFCGDGPTPVQPGSKIVVLSRHVERACGIIATRVLGLRHAVDLTPAQGDEPEGWQGLRFADKEGRGWQVLDIGQLLASPAFLQAGRTVA

SEQ ID NO: 3851 - protein, 183 aa, Alkalilimnicola ehrlichei MLHE-1
MLSLEEQPTAFDALRALDRMGRAHPLDLTVDEGGESEWYGVAVRFSGRHFLLPMHEVAEVMPCPPLTPVPHTRDWVKGVANVRGTLIPVIDLDGFFGQGPVNMSHLTRIVIMRAGEVVAGLLVDEVLGLRPCARGGWLAQVPGGLSSDLARCIAGVFQREDGDWPVFRPVRLVRDPRFMRVAA

SEQ ID NO: 3852 - protein, 178 aa, Pseudomonas aeruginosa UCBPP-PA14
MSDVQTPFQLLVDIDQRCRRLAAGLPAQQEAVQSWSGIGFRMGGRFFVAPMGEVGEVLHEPRYTQLPGVKTWVKGVANVRGRLLPIMDLCGFLGTELSPLRKQRRVLVVEHLDVFAGLIVDEVFGMQHFPVDTFSEQLPPLEAALQPFIHGVFHREQPWLVFSPHALAQHQGFLDVAV

SEQ ID NO: 3853 - protein, 175 aa, Acidovorax avenae citrulli AAC00-1
MANREALRELQTRLAARLQAARVEGSSVSSWLAVESAGRRFLLPLGQSGEIFPWTGVQPVPYTQGWFLGVANLRGSLIGVVDLAGLLGQSTARTEQALGEASLLVLNAALEVNAALLVDRLSGLRGTDAFVDSSPPGDDAPPYFGTTYLDAEGTPWQELNLQALSQHPAFLSISA

SEQ ID NO: 3854 - protein, 175 aa, Acidovorax sp. JS42
MANREALKELQTRLAARLQAARGEGVSVSSWLAVESAGRYFLLPLGQSGEIFPWGGVQPVPYTQPWFLGVANLRGALTGVVDLAGLLGAAQMRTEQALAESSLLAFNGALDVNAALLVDRLSGLRGMEAFVASEPPEADAPPYFGTTYLDAQGTRWQELNLHALSQHPAFLSISA

SEQ ID NO: 3855 - protein, 176 aa, Polaromonas naphthalenivorans CJ2
MANRQALKELQTRLAERLQLAKMQGIAPSWLAVEAGSKKYLFPLAQSGEIFPWIGIQPVSYTQFWFLGVAGLRGGLYGVVDLAGFVSGQPSVSRNELARTESRLVSFNSALEVNCVLLIDKLAGLRKQDAFIDFSVRAPDAPAFFGNQYVDINGASWQEINLQLLAQQVHFLTIAA

SEQ ID NO: 3856 - protein, 175 aa, Verminephrobacter eiseniae EF01-2
MANREALRELQTRLASRLQAARDEATSVSSWLAAESAGSSYLLPLGQSGEIFPWVSVQTVPYTQSWFLGVANLRGGLVGVVDLAGLLGSVVPRTEQALADASLLAFNTALEVNAALLVDRLAGLRGTDAFVASEPPAKDSPPYFGTTYIDSSGKRWQELNLQILSRHPAFLSISV

SEQ ID NO: 3857 - protein, 174 aa, Methylibium petroleiphilum PM1
MAKKEALRELQTRLAERLQAARLQKSETATWLAVECGGQGLLLPLGQASEIFPLTALMPVPHTGAWFLGVANLRGRLHGVVDLAVFLGLRAAPPQEFGPQSRLIAFNPALEVNCALLVDRLAGLRSADQLRVVPDEAAHPAFAGATYADAGGRRWQEIVLAELAGEEAFLRIAR

SEQ ID NO: 3858 - protein, 181 aa, Marinobacter aquaeolei VT8
MSAQAAPFAVLTDIAQRSRSMAAGLPEQQEAVELWNGIGFILSGERYVAPMGEVTEILHVPRFTHVPGVRSFLMGAANVRGRLLPLVDLATFFDVPRSSRSLRERRVLVVEQGDVFSGLVVDSVLGMQYFAKDSFRATPDGVPDSVRPFVSGGYERNEEVWKVFSATDLVEDERFLDVAQW

SEQ ID NO: 3859 - protein, 177 aa, Pseudomonas mendocina ymp
MSAQTPFQILLEIDQRCRALAAGLPSQQAAVQTWSGIGFRMGERLFVAPMGEVGEVLHEPRYTLLPGVKSWVKGVANVRGRLLPIMDLCGFFGNELSPLRKLRRVLVVDHQEIFAGLTVDEVFGMQHFPVDAYSEQLPPLEASIAPFIHGVFQREQPWLVFSPYALAADPGFLDVAY

SEQ ID NO: 3860 - protein, 184 aa, Pseudomonas putida F1
MTTRPQGASLTAFELLLDIDRRCRLLVADQPPQDNRVQQWSGIGFRIAGQWFVAPMGEVAEVLREPRSSRVPGVQPWVCGVANLRGRLLPVMDLSCFFGLGHAAPGKQRRVLVLDHDDLFVGLLVDEVLGLQHFALDSLQLSPPQPLILAAARFVQGYFPRERNWAIFSPFALAQAPGFLDVAL

SEQ ID NO: 3861 - protein, 179 aa, Psychrobacter PRwf-1
MALKGFIELLRLEHMAKSRQVERQQGMDTPWQGVAFCVAGLNFVAPIGEVTEVISFPNSLTEVPMSKPWLLGIANIRGQLLPLVDLASFVNLSGTAEQLNRRKVLVVKQQDIAVGLLVDTVWHIKNFLPKHYLPEHLPAGAPFLPYTHGQFVTDTELEAWPIFRPSLLLADPRFLEVSL

SEQ ID NO: 3862 - protein, 178 aa, Pseudomonas aeruginosa PA7
MSDVQTPFQLLVDIDQRCRRLAAGLPAQQEAVQSWSGIGFRMGGRFFVAPMGEVGEVLHEPRYTQLPGVKTWVRGVANVRGRLLPIMDLCGFLGTELSPLRKQRRVLVVEHLDVFAGLIVDEVFGMQHFPVDTFSEQLPPLEAALQPFIHGVFHREQPWLVFSPHALAQHQGFLDVAI

SEQ ID NO: 3863 - protein, 175 aa, Delftia acidovorans SPH-1
MANREALRDLQSRLAGRLQAARSEGVKVAAWLAVQAGGRNYLMPLGQSGEIFPWAGVQPVPYTKPWFLGIANLRGTLAGVIDLASLLGHGVARSEPALAESSLLAFNAALEVNASLLVDRLQGLRSADAFVRTEPAPEQSPAFFGPVHIDEAGHRWQELQLQRLSQTSEFLSIRA

SEQ ID NO: 3864 - protein, 184 aa, Pseudomonas putida GB 1
MTTRPQGASLTAFELLLDIDRRCRLLVADQPPQDNRLQQWSGIGFRIAGQWFVAPMGEVAEVLREPRSSRVPGVQPWVCGVANLRGRLLPVMDLSSFFGLGHAAPGKQRRVLVLDHDDLFVGLLVDEVLGLQHFALDSLQLSPPQPLIRAAARFVQGHFPRERNWAIFSPFALAQAPGFLDVAL

SEQ ID NO: 3865 - protein, 184 aa, Pseudomonas putida W619
MTTRPQGASLTAFELLLDIDRRCRLLVADQPPQDTRLQQWSGIGFRVAGQWFVAPMGEVAEVSREPRSSRVPGVQPWVCGVANLRGRLLPVMDLSSFFGLGPAASGKQRRVLVLDHEDLFVGLLVDEVLGLQHFALDTLELSPPQPLIRAAVRFVQGHFPRERNWAIFSPFALAQAPGFLDVAL

SEQ ID NO: 3866 - protein, 176 aa, Leptothrix cholodnii SP 6
MANKEALRELQGRLAERLHEVKTQERTLSWLAVESGGHGFLLPLAEAGEIFQPGALLSVPHALPWFLGVANLRGVLAGVVDLAGFLGLRSRLPEGERDQARVVAFNPTLEINGALQVDRLAGLRNQTQLTPEAVDVHAQPGFVGGRYHDAGGRVWQELRLAVLARDERFLRIVKGA

SEQ ID NO: 3867 - protein, 176 aa, Xanthomonas oryzae PXO99A
MRSPFDILEDYERRSLAHATPLPERQFSADIWRGVGYRVGTRRLVSDFREVAEIVPMPPVTPVPGAQPWLLGVGNLRGNLFPVIDLKQFLEGRRTVLQEGQRVLIMRQSGGDVALTIDELYGQRSFEQVQAVEPGELAQGRYAHFIDRAFRNETQDWGVFSLALLSRTPEFRQAAA

SEQ ID NO: 3868 - protein, 181 aa, Ralstonia pickettii 12J
MNEQRTNLTSRQRLHEYQAMLARRLQEARAKSATEGFLGVQIGEHHWLLSLTETGEVLDYQPPARVPLTQPWYLGLVNARGNLLGVIDFGLFCGEAPTGSGSGAKIVVLSKDPQRACAIVVPRVAGLRSLSDLQPAEATAEEGRPWLGRAWRDAQGTQWRELDVRQLLADPAFLQVGRSRT

SEQ ID NO: 3869 - protein, 176 aa, Stenotrophomonas maltophilia R551 3
MRSPFDILEAYERRSLAHAVQLPERQFAQDLWRGVGYRVGQRRLVSDFREVVEIVPMPPVTPVPCAQPWLLGVGNLRGNLFPVVDLKYFLEGTRTVQQEGQRVLIMRQAGGDVALTIDELFGQRSFELAQQIEAGALADGRYGHFVDRAFHADGQDWGVFSLSLLSRTPEFRQAAA

SEQ ID NO: 3870 - protein, 168 aa, Thauera sp. MZ1T
MARSSLREFQERLARRLAEAAGAERRGLLGFQCGSDNWLIELAEAGEILPPPPLSAVPLTRPWFRGLANVRGSLYGVVDFAAFNGQPPISAGGRARLLLIGARHGIHSALLVSSSSGLRSHEDFEPAPGGDAPPWVARRLRDMQGRAWLQLDPARLLAQPAFLDAGLE

SEQ ID NO: 3871 - protein, 181 aa, Thioalkalivibrio HL EbGR7
MSAVLQNPFEYLQLLARKGEELAGKLPMQSVQKEAWKGVLFGLRGQQLLAPMSQVAEIVTPPPVTRIPGVKPWACGMANMRGNLLPVMDLQGFLFGENLPRDSRRHRLLVVNYQGVYAGLVVESVQGMKHYWTDDRVMELPEADPALRPYLDGAFHAGQEHLAVFSPWRLAQDERFLNVST

SEQ ID NO: 3872 - protein, 175 aa, Diaphorobacter TPSY uid29975
MANREALKELQTRLAARLQAARGEGVSVSSWLAVESAGRYFLLPLGQSGEIFPWGGVQPVPYTQPWFLGVANLRGALTGVVDLAGLLGAAQMRTEQVLAESSLLAFNGALDVNAALLVDRLSGLRGMEAFVASEPPEADAPPYFGTTYLDAQGTRWQELNLHALSQHPAFLSISA

SEQ ID NO: 3873 - protein, 177 aa, Variovorax paradoxus S110
MANRDALRAFQSRLASRLQAARTTGVAASWLAVEAGEGKYLFPLGHAGEIFPWTPPQPVPYTQPWFLGVANLRGGLYGVVHLSAFASGAPDNTAATEAARMQSRLVALNELLEVNCALLVDRLAGLRGAEAFTASEPPGAQAPAWLGHLYTDAAGERWQEINLQALSQQPEFLSIGA

SEQ ID NO: 3874 - protein, 181 aa, Ralstonia pickettii 12D
MNEQRTNLTSRQRLHEYQAMLARRLQEARAKSATEGFLGVQIGEHHWLLSLTETGEVLDYQPPARVPLTQPWYLGLVNARGNLLGVIDFGLFCGEAPTSSGSGAKIVVLSKDPQRACAILVPRVAGLRSLSDLQPAEATAEEGRPWLGRAWSDAQGTQWRELDVRQLLADPAFLQVGRSRT

SEQ ID NO: 3875 - protein, 184 aa, Jannaschia CCS1
MRHVVSALIFAGLACAMPLAAQQFDVIDGVGGFDGFELDMGDEDGTGLTLSEGADTGDIQLNLGTGAAGTFETFPGVTGPVTSISQPATEVGTTVSLRALDKMLGQPTDIELSMGQTVVFGRVAIRVIECRYPAADPGGDAFALLEVLNMEGETLFDGWMIASSPALNALEHSRYDVWVLGCSA

SEQ ID NO: 3876 - protein, 145 aa, Ruegeria sp. TM1040
MKRLITLAFCLLASAPLSAQTISVEELDPVIVQPRVPESRERVERIEATEGTLTSLRGLDKVNGKSVDVEVQTGGTAEIFGLIVTLRECRYPTENPSGDAFAYLTIRDRQDGKVFFDGWMIASSPALNALDHRRYDVWVLRCKST

SEQ ID NO: 3877 - protein, 163 aa, Rhodospirillum rubrum ATCC 11170
MLRLVSSPRAAVLSATGGLCLMLAATAPAGAEDINADTARLGWLDKTTARVGESSIAVGGDLRLGSLTITVRSCVRRVPPDDPESAAFLDIVERAEGVAAKQIFEGWMFASSPSLSAMDHAVYDVWVLRCEIPADRDAGDSGKPESAPEAAPIPVDPGGAPLD

SEQ ID NO: 3878 - protein, 123 aa, Rhodobacter sphaeroides 2 4 1
MRLLAVLLLLAAPAWAQDQRTGEGTGALLRWLDKMSGETADVELQRGQSAVSGHLTIELDECRFPAGDPASDAYAHLTIRDSRAAEPVFDGWMIASSPALSALDHPRYDVWLLRCTTEAGSAQ

SEQ ID NO: 3879 - protein, 163 aa, Paracoccus denitrificans PD1222
MTDLLTRACLCLLLAASPVLAQEEPAEDQQLMIDPAFSDDPEAVVPAEPSAAERQRAAEAARGPETARGTGAQLRGLDKITGRTQDFTLAVGEVAEFGRLQLSLAECRYPAADPTSDAYAELTITDSQANARLFSGWMIASSPALSSLDDSRYDVWVISCNRA

SEQ ID NO: 3880 - protein, 123 aa, Rhodobacter sphaeroides ATCC 17029; identical to SEQ ID NO: 3878

SEQ ID NO: 3881 - protein, 123 aa, Rhodobacter sphaeroides ATCC 17025
MRVLAALLLMAAPALAQDLRTAEGSGALLRWLDKMSGETADAELMRGQSAVSGHLTIELDECRYPAGDPASDAFAHLTIRDSRAAEPVFDGWMIASSPALSSLDHPRYDVWLLRCTTEAGSGE

SEQ ID NO: 3882 - protein, 193 aa, Acidiphilium cryptum JF-5
MSLRRAGAVVLVVAMFAALPGRGLAQSGQSVVTVPEAPPVASAPSPAMPDGALPAPDLPNAPTLPGDQGGAFAGPATPKGSQATPPAPPKQVKPIWDPRQAAILDVLEKADGAVNRIIAPVGSSFTEGALRVTIGACVVRPADMPPDAAVYMTVRHGMAAPDLFRGWLIRSEPGATVVGDAAVTFRLIGCSAG

SEQ ID NO: 3883 - protein, 87 aa, Sphingomonas wittichii RW1
VTEGTPMGERVAVLGLLNKRNGESRDVTLRPGQAIRIGDVVLRLRACETTAPWEDQKLTGAFVQTDVRGRDGAWRRVFSGWLFKESP

SEQ ID NO: 3884 - protein, 135 aa, Parvibaculum lavamentivorans DS-1
MRHLARLAAASAILCLSAAPAFADKYPVAVFSGLDKTTARVTSFSVKVDEPAQFGSLEVLVRACDKRPPEEPPQTAAFLEIRQIDRDDDSVQPAPIFEGWMFAESPGLNGLEHPVYDIWVTDCKTASGGASTGSE

SEQ ID NO: 3885 - protein, 180 aa, Dinoroseobacter shibae DFL 12
MIRTTLAVALLWVGCAAAAQQEAIIISPLDELEERAEGEEDGFGGELRLRDEEFQTFEQELRVSAAEAGLIRVLDKTTGRVETLEIPAGEARQSGRLSITLIECRFPEENPASDAFVHLQITERDTPLYDGWMIASSPALAALDHHRYDVWALRCATPGEEEATPEVAAGLQSPRPTARP

SEQ ID NO: 3886 - protein, 314 aa, Ralstonia solanacearum
MEIRHLRCFLAVAEELHFARAAEKLHIEQSPLSRTIKELEEDLGEQLFIRTSRSTRLTRAGKLFLEHVPRVFTALQQARDSVRAASNGFHGQLRIALSDGITPSRLPALLAMCRQEEPEVDIRLFEVPLSQQIKGLHDDLYDVGFAQSDEVGECIAAEAVWSDPLMVAVPARHPLLKHKRIPLEEMLRYPLVLCDPLACEGHARQVERVLRRSDMEPLIAERVASCDLMMALVSAGFALGLTGAPHIVTSREPGVVARPLAGRSPVLTTYLLHREGESSAVLSRFIERVQAIDLPEGARPALPSEAAPPEDTEP

SEQ ID NO: 3887 - protein, 151 aa, Burkholderia thailandensis E264
MGLTLMVAVPARHPLLAHKYLPLEEVLHYPLVLGDPHACEGFARQVDRILRRVDREPIVAEWVASIDLMMALVSAGFALGLAGTSQIVASREPGIVARPLAGRAPMLTTYLLRSDNEPSQVLARFIERVSNLESLAAKKAVVSFDPDAREE

SEQ ID NO: 3888 - protein, 320 aa, Cupriavidus metallidurans CH34 uid250
MNRKGTVELRHLRCFIAVAEELHFARAAERLHIEQSPLSRAIKELEEDLGVQLFERTTRSTRLTRAGQLFLEHVPRIFTALQQARDSVKAVANGFHGQLRVALSDGITPSRLPALLALCRQEEPEVEIRFFEVPLSQQIKGLHDDLYDVGFAQSDEVGDGIVALPAWSDALMVAVPARHPLLIHKRIPLDELLRYPLVLCDPQVCEGLAKHVERVLRRVDMEPLVAERVATSDLMMALVSAGFALGLAGAAHIAASRESGVVARPLASRVPPLTTYLLRLDSDPSDELARFIERVKAIDLPETPRPARGRNPDHPEELMP

SEQ ID NO: 3889 - protein, 326 aa, Cupriavidus metallidurans CH34 uid250
MTSGRDSLRRACMDLRHFRYFIAVAEELHFARAAERLHIEQSPLSRAIKELEEELGVTLFSRTTRSTRLTRAGQLFLESAYRVMAAFQQAQDSVKAVANGFQGQLRIALSDGITPSRLPILLALCRQEEPEIELRFFEVTLSQQIKGLQDDLYDVGFAQSDEVGDGIVAIPVWSDALMVAVPARHPLLAHKRIPLDELLRYPLVLCDPQICEGHAKHVDRVLRQADMEPLIAERVATGNLMMALVSAGFALALTGATHIAASREPGVVARPLASRVPPLTTYLLHTEGEPSDVLARFIERVQAIEVPDTPRSAMGHRPNPPEEAVP

SEQ ID NO: 3890 - protein, 313 aa, Burkholderia ambifaria AMMD
MELRHLRCFLAVAEELHFARAAEKLHVEQSPLSRAIKELEEELGVVLFARTTRSTRLTRAGKLFLEHVPRVFSALQQARDSVKAAANGFHSQLRVALSDGMTPSRLPALLALCRQEEPEVEIRFFEVPLAQQIKGLYGDLYDVGFARADEVGDGLIAEPVWSDPLMVAVPARHPLLAHKRIPLEELLRYPLVLCDPQACEGHARQVDRVLRRVDMEPLVAERVASCDLMMALVSAGIALGLTGCAHILASQEPGVVARPLTGRSPLLTTYLLRPEGEPSEMLARFIDRVQAIESPEGSRPTPGLDADSLEEPA

SEQ ID NO: 3891 - protein, 313 aa, Shewanella sp. ANA-3
MELRHLRCFLAVADELHFARAAEKLHIEQSPLSRAIKELEEDLGEQLFVRTSRSTRLTRAGKLFLEHVPRVFTALEQARDSVKAAANGFHGQLRIALSDGITPSRLPILLALCRQEEPEVELRFFEVPLSQQIKGLQDDLYDVGFAQSDDVGDGITVEAVWHDPLMVAVPARHPLLIHKRIPLDEVLRYPLVLCDPKVCEGHTRQVERVLRRAEQEPLIAERVASCDLMMALVSAGFALGLAGAPHIASSRESGVVARPLAGRSPMLTTYLLHREAETSEVLARFIERVQAIESPEGVRLVPPPESDQEEIEL

SEQ ID NO: 3892 - protein, 314 aa, Acidovorax avenae citrulli AAC00-1
MEIRHLRCFLAVAEELHFARAAERLHIEQSPLSRTIKELEEDLGEQLFVRTSRSTRLTRAGKLFLEHVPRIFTALQQARDSVKAAANGFHGQLRIALSEGITPSRLSSLLALCRQEEPEVEIRLFEVPLAQQIKGLHDDLYDVGFAQSDEVGEGIAAHAVWSDPLMVAVPARHPLLKHKRIPLEELMRYPLVLCDPLACEGHARQVERVLRRSDMEPLIAERVASCDLMMALVSAGFALGLTGSAHLAASRELGVVARPLEGRSPVLTTYLLHREGESSEVLSRFIERVHAIDLPEGARLAQPPESNPPEDTEP

SEQ ID NO: 3893 - protein, 303 aa, Polaromonas naphthalenivorans CJ2
MELRHLRCFIAVAEELHFARAAERLHIEQSPLSRAIKELESNLAVQLFERTTRRTRLTWAGKVFLEEAHRVFAAIDQAKASVKAAATGYRGRLRIALSDGIAQPRLSALLAQCREEEPEVEIRLSETPLSQQIKGLNSDLYDAGFAQSDEVGEGIIAEAIWSEPLVIAVPARHPLLVHRRIPLDEVLRYPLVLCHPETCEGFWQQVKRVLRTVDAKPIVVDRVPTLDLMMTLVAAGYGLGFAGESQIAACRNPDVIARPLAGRSPMLTTYLLRPEIEPSEQLSRFIDRVSPVDEQASNPATVQ

SEQ ID NO: 3894 - protein, 312 aa, Pseudomonas aeruginosa PA7
MELRHLRCFLAVAEELHFARAAERLHIEQSPLSRTIKELEDELGARLFARTTRSTRLTRAGKLFLEHMPRVFAALQQARDSVKAAANGFHAQIRIALSDGITPSRLPTLLALCRQEEPEIEIRLFEVPLSQQIKGLQEDLYDVGFAQSDEVGEALVAEPVWSDSLMVAVPARHTLLKYKRIPLDEVLRHPLVLCDPQVCEGHAKQIERVLRRAETEPLIAERVASCDLMMALVSAGFALGLTGAAHIAASRELGVVARPLEGRSPVLTTYLLRPAGEPSRTLARFIERVHFIESPDGARTRTPPQSHVSEDS

SEQ ID NO: 3895 - protein, 310 aa, Pseudomonas aeruginosa PA7
MELRHLRCFFAVAEELHFARAAERLHIEQSPLSRAIKELEEELGVVLFARTTRSTRLTRAGKLFLDHVPRVFAALQQARDSVKAAANGFHGQLRIALSDGITPSRLPALLALCRQEEPEVELRFFEVPLSQQIKGLHDDLYDVGFAQSDEVGDGIVTTPAWSDALMVAVPARHPLLAHKRIPLDELLRYPLVLCDPQVCEGLAKHVERVLRRTDMEPLIAERVASCDLMMALVSAGFALGLTGEAHIAASREPGVVARPLASRVPPLTTYLLRLEGDPSNELARFIERVQAIESPEAPKHCPDSPDAPAP

SEQ ID NO: 3896 - protein, 308 aa, Delftia acidovorans SPH-1
MELRHLRCFLAVAEELHFARAAERLHIDQSPLSRTIKELEEELGARLFVRTTRSTQLTRAGRLFLEHVQRVFTVLEQARDSVKSAANGFCGQLRIALSDGVTPSRLPALLARSREEDPEVEIRLFEVPLDQQIKGLHSDLYDAGFSMAEDAGDGIIVTPAWEDELMVAVPARHPVLAFKQIPLKEVLRHPLALGDPAVCEGHARQVDRFLRTCGQEPLIAQRVATFDVMMTLVSAGLALGLAGEAHIASSREPGVVARRLAGKPTMLMTYLLRRDTEPSEMLARFIERVDFIDSADELGIPEDLPRDR

SEQ ID NO: 3897 - protein, 313 aa, Burkholderia multivorans ATCC 17616 JGI
MELRHLRCFLAVASELHFARAAERLHIEQSPLSRAIKELEEDLGVKLFVRTTRSTRLTRAGKLFFEHVPRVFSALQQARDSVKAAANGFHSQLRIALSDGITPARLPALLALCRQEEPEVEIRFFEVPLSQQIKGLHGDLYDVGFARADEVGDGLIAESVWSDPLMVAVPARHPLLAHKRIPLEELLRYPLVLCDPQACEGHARQVDRVLRRVDMEPLVAERVVSCELMMALVSAGIALGLTGYAHILASQEPGVVARPLAGRAPLLTTYLLRPEGEPSEMLARFIDRVQAIESPEGSRPMPGLDADSLEEPA

SEQ ID NO: 3898 - protein, 304 aa, Ralstonia pickettii 12J
MELRHLRCFIAVAEELHFGRAAEKLHIDQSPLSRTIKEIEEELGAQLFTRTTRSTRLTFAGMAFLERVPRIFEALKQACDGVKSAASGFQGQLRIALSDGITPSRMPTLLARCREEDPEIDIRLFEMPLDQQIKGLHDDLYDVGFSMAEEVGDGIVVRPAWEDELMVAVPARHPVLAHKHVPLEEVLRYPLALCDPAICEGHARQVDRVLQRYEQQPLIAQRVASYEVMMTLVSAGLALGLAGAAHIASGRGPGVVARRLAGKSQMLATYLLHRDVEPSEMLARFIARVDSIDSADGSSAAEDS

SEQ ID NO: 3899 - protein, 306 aa, Thauera sp. MZ1T
MELRHLRCFLAVAEELHFARAAERLHIEQSPLSRAIKELEEELGVTLFARTTRSTRLTLAGKLFLEHVRRVFAALQQARDSVKAAANGFHGQLRIALSDGITPSRLPALLALCRQEEPEVEIRLFEVPLSQQIKGLHDDLYDVGFARSDEVGDGLIAEPVWSDPLMVAVPARHPLLAHKRIPLEELLRYPLVLCDPTVCEGDARQVERVLRRVDMEPLIAERVASSDLMMALVSAGFALGLTGAAHIATSREPGVVARPLAGRSPVLTTYLLRLDGVPSETLAHFIERVQAIESPEANRPISGRPS

SEQ ID NO: 3900 - protein, 314 aa, Thioalkalivibrio HL EbGR7
MELRHLRYFLAVAEELHFARAAERLHIEQSPLSRAIKELEEELGVVLFARTTRSTRLTRTGKLFLEHVRRVLAALEQARDSVKAAANGFHGQLRVALSDGVTPSRLPSLLALCRQEEPEVDLRFFEVPLSQQIKGLHDDLYDVGFAQSDDVGDGITAIPVWSDALMVAVPARHPLLAHKRIPLDELLRYPLVLCNPQVCEGHAKHVERVLRRADMEPLVAERVASCDLMMALVSAGFAIGLTGEAHIATSREPGVVARPLASRVPPLTTYLLHLDDEPSDVLARFIERVQAIESPESAKPVPRRSPDPPEEFTT

SEQ ID NO: 3901 - protein, 308 aa, Diaphorobacter TPSY uid29975
MELRHLRCFTAVAEELHFARAAERLHIDQSPLSRTIKELEEDLGARLFVRTTRSTQLTRAGRLLLEHVPRIFAALEQARDSVRSASNGYHGQLRIALSDGITPSRLPALLAQCREEDPEVEVRLFEVSMAQQIKGLHDELYDAGFSMADYVGDGIVVTSAWEDELMVAVPARHPVLAFKQVPLEEVLHYPLVLGDPAICEGHARQVDRILRRHEQEPLIVQHVATFDLMMTLVSAGLALGLAGAAHIGSSRELGVVARPLAGKPPMLTTYLLRRDAEVPEMLARFIERVAFIDSENYLSTAKNSRPTR

SEQ ID NO: 3902 - protein, 304 aa, Diaphorobacter TPSY uid29975
MELRHLRCFIAVAEELHFARAAERLHIDQSPLSRTIKELEEELGARLFVRTTRSTQLTHAGRLFLEHVQRVFAALDQARDSVKSVANGFHGQLRLALSDGITPSRLPALLAQCREEDPEVEVRLFEVPLAQQIKGLHDNLYDAGFSMADDGGDGIAVSSAWEDELMVAVPARHPVLAFKQVPLKEVLRYPLALGDPAVCEGHARQVDRFLRKLDQEPLIAQRVATFDVMMTLVSAGLALGLAGEAHIASSREPGVVARRLAGKPYMLTTYLLRRDAEPSEMLARFIERVAFIDSADCIDAADDA

SEQ ID NO: 3903 - protein, 314 aa, Azotobacter vinelandii DJ
MELRHLRCFLAVAEELHFARAAEKLHIEQSPLSRAIKELEEELGVVLFARTTRSTRLTRAGKLFLDHVPRVFAALQQARDSVKAAANGFHGQLRIALSDGITPSRLPTLLALCRQEEPEVEIRFFEVPLSQQIKGLHDDLYDVGFARADEAGDGIVALPVWNDPLMVAVPARHPLLAHKRIPLEELLRYPLVLCDPQACEGHARQVDRVLRRVDMEPLVAERVASCDLMMALVSAGFALGLTGCAHILASREPGVVARPLTGRSPMLTTYLLRPDAEPSETLARFIERVQAIDSPEAARPAPGDEPDVPEESEP

SEQ ID NO: 3904 - protein, 314 aa, Azotobacter vinelandii DJ
MELRHLRCFLAVAEELHFARAAERLHIEQSPLSRAIKELEEELGVVLFARTTRSTRLTRAGKLLFDHVPRVFAALQQARDSVKAAANGFHGQLRIALSDGITPSRLPALLALCRQEEPEVEIRLFEVPLSQQIKGLNDDLYDVGFARADEAGDGIVAVPVWSDPLMVAVPSRHPLLAHKRIPLEDVLRYPLVLCDPVACEGHARQVDRVLRRVDMEPLVAERVTSCDLMMALVSAGFALGLTGAAHIAASREQGVVARPLAARSPLLTTYLLRLDAEPSETLARFIERVQAIDSPEADKPMPDDDPDSLEEPEP

SEQ ID NO: 3905 - protein, 501 aa, Clostridium perfringens SM101 uid12521
MGERTPMLKMVGVSKSFPGVKALDNVSLMAYGGEVTALMGENGAGKSTLMKILSGVYKKDEGKIFIEGREVEVKGIKSAEEAGITIIHQELSVLNNLTVSENIFLGNEKHSKFTGRINKKLLDERSKMFLEQIGCDIDPNRLVSTLNVGEKQMIEIAKALTKNARIIIMDEPTTALTDVETENLFKVIENLRKKGIAIIYISHRMEEIFKICHRVEVLRDGKYTGSAEIKDIDNDKLIAMMVGRTIEDQFPYRDVKKGDLALEVKNLSCKEGVKGASFTLRKGEILGIAGLMGSGRTELAKTIFGEYKKTSGEISLNGSLININCISDAINNGICYLSEDRKKEGCILGMSVGENMTLCNLKKYENKFKSLDKKEEAKDIEYYIKKINIKTPNKEQFIKNLSGGNQQKVILAKWLMLSPEVLIIDEPTRGIDVGAKKEIYELLNELKASGKAIIMISSDLPEVLGISDRIMVMSEGRISGELNRDEANQESIMKLAVGINN

SEQ ID NO: 3906 - protein, 501 aa, Enterobacter sp. 638
MDALLQLKGIDKSFPGVKALSGAALNVYAGRVMALVGENGAGKSTMMKVLTGIYQRDAGSLVWLGKETTFTGAKSSQEAGIGIIHQELNLIPQLTIAENIFLGREFVGRFGNIDWKLMYAEADKLLAKLNLRFKSDRLVGDLSIGDQQMVEIAKVLSFESKVIVMDEPTDALTDTETESLFRVIRELKSQGRGIVYISHRMKEIFEICDDVTVFRDGQFIAEREVASLTEDSLIEMMVGRKLEDQYPRLDKAPGDVRLKVDNLCGPGVDNVSFTLRQGEILGVAGLMGAGRTELMKVLYGALPRTSGYVTLNGHEVVTRSPQDGLANGIVYISEDRKRDGLVLGMSVKENMSLTALRYFSRNGGGLKHKDEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLGGEFTREQATQEVLMAAAVGKLNRVNQE

SEQ ID NO: 3907 - protein, 500 aa, Vibrio cholerae O395
MTQAILALSQIEKAFPGVKALDKASLNVYPGRVMALMGENGAGKSTLMKVLTGIYSKDAGSIEYQGQPVSFKGPRDSQLAGISIIHQELNLIPQLTIAENIFLGREMTSPFGRILWDEMHRKADQLLARLNVKHSAKTLLGELSLGEQQMVEIAKALSFESKVIIMDEPTDALTDTETESLFNVINELREQGCGIVYISHRLKEIFEICDDITVLRDGKFIGECRVCDTNEDGLIEMMVGRKLEEQYPRIAAQQGDISLEVIGLTGSGVHDVSFTLKKGEILGVSGLMGAGRTELMKVIYGALPSERGVINLNGRTVNPVSPQDGLANGIAYISEDRKGDGLVLGLSVKENMSLCALDQLSKGVQIRHADEVIAVDDFIRLFNIKTPSREQIIGNLSGGNQQKVAIAKGLMTKPKVLILDEPTRGVDVGAKKEIYQLINQFKAEGMSIILVSSEMPEVLGMSDRILVMHEGRISGEFMASEADQEKLMACAVGRNPAHAA

SEQ ID NO: 3908 - protein, 501 aa, Escherichia coli HS
MEALLQLKGIDKAFPGVKALSGAALNVYPGRVMALVGENGAGKSTMMKVLTGIYARDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3909 - protein, 501 aa, Escherichia coli E24377A
MEALLQLKGIDKAFPGVKALSGAALNVYPGRVMALVGENGAGKSTMMKVLTGIYARDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLASGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3910 - protein, 501 aa, Serratia proteamaculans 568
MQPLLQLKGIDKAFPGVKALSGAALSVYPGKVMALVGENGAGKSTMMKVLTGIYNKDAGSQYFLGKEVAFTGPKDSQEAGIGIIHQELNLIPQLTIAENIFLGREFVNRIGRIDWKRMYAEADKLLTRLNLSYSSHRLVGELSIGDQQMVEIAKVLSFESKVIIMDEPTDALTDTETASLFKVINELKAEGRGIVYISHRLKEIFEICDDVTVFRDGQFIAERPVSELQEDSLIEMMVGRKLEEQYPRLNLPRGEKRLEVSQVSGPGVDDVSFTLYRGEILGVAGLMGAGRTELMKILYGAAPRKSGTVSLDGRPVVTHSPQDGLANGIVYISEDRKRDGLVLGMSVKENMSLTALRYFSRAGGSLKQAEEQQAVGDFIRLFNIKTPSMEQPIGLLSGGNQQKVAIARGLMTRPKVLILDEPTRGVDVGAKKEIYQLINQFKQEGLSIILVSSEMPEVLGMSDRILVMHEGHLSGEFPIEQATQEALMAAAVGKQYGVKQE

SEQ ID NO: 3911 - protein, 501 aa, Escherichia coli C ATCC 8739
MEALLQLKGIDKAFPGVKALSGAALNVYPGRVMALVGENGAGKSTMMKVLTGIYARDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMPVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3912 - protein, 501 aa, Escherichia coli SMS 3 5
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3913 - protein, 495 aa, Natranaerobius thermophilus JW NM WN LF
MTLLKMKGITKTFPGVRALDDVDLDLEAGEVLALLGENGAGKSTLMKILSGVYGEDEGMLEVEGKQVAIESPQKATDHGIGIIHQELSLVPNLSVRENIFLGREKTHPITGKIDWHYMNEESRKLLVQLGVEDIDLTRPVKDFSIGIQQMVEIARILSMNCKIIIMDEPTDALTPQEIEVLFQVINSLRESGKGIIYISHKLEEIFQISDRVQVLRDGTHVGTKDITETNTEDLIKMMVGRDLKEKFPWVAPQTGDVVLELKDVSSPGLIYNVDLMAKQGEVLGIFGLMGAGRTELCKTIFGAHPIQGEILLDGQPIKINSPKDAIEKGIVYLSENRKSEGLFLEHEVYKNMTLASLNSFTSNLGRINKGREKEKVEEYIDRLTVKTPHIAQKVKNLSGGNQQKLVFAKWLMTNPRVLILDEPTRGVDVGAKVELYNLINELKQKNVAIIMVSSELPEIMGISDRVMVMHKGRITGEFSHENVNQEQIMERAVNS

SEQ ID NO: 3914 - protein, 501 aa, Salmonella enterica serovar Newport SL254
MDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADHLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3915 - protein, 516 aa, Salmonella enterica serovar Schwarzengrund CVM19633
MRTSFFALASLSEAAMDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADHLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3916 - protein, 516 aa, Salmonella enterica serovar Agona SL483
MRTSFFALASLSEAAMDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADQLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3917 - protein, 516 aa, Salmonella enterica serovar Dublin CT 02021853
MRTSFFALALRSEAAMDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADHLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3918 - protein, 501 aa, Escherichia coli O157 H7 EC4115
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFESCDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 3919 - protein, 500 aa, Alicyclobacillus acidocaldarius DSM 446
MPRLEMREIEKSFSGVQVLRKVNLSVEGGEVHALLGENGAGKSTLMKTLAGVYHPDAGEILIDGAPQKFRGVLDSRRAGITIIHQELNLFPNLSIEENLLIGYEDEFRNAIGWIQYSRLRSRVRELLDRVGLDRDPSTPVSVLGIGERQLVEIARALQQEVRFLIMDEPTAALTDKETRRLFEIIRDLKRHEVGVIYISHRLEELFAIADRVTVLRDGMSVGTYSMRAVSEDVLVERMVGRSVENRYPKVKSHPGDVILELKDVKTRALPHPISITVRSGEIVGLGGMMGAGRTELARAISGVDRVLSGKMLMFGREVRFRGPRDAMAHGVAFVTEDRKDDGLLLPFSVRFNLALPSLSSRHRFGFVLGKQERKFAEHWVKRLAIRVHSTEQPVVNLSGGNQQKVVFAKWLALDPKLLVLDEPTRGVDVGAKQEIYQLMNEMKVRGKGILMVSSDLPELLGMCDRVYVLRDRTVAGELTGDQMTQEIFMTLVAGRQGAQA

SEQ ID NO: 3920 - protein, 206 aa, Anaeromyxobacter dehalogenans 2CP-C
MRRPVSKWALLALLFTALLAADQWTKYLAVERLTVVFERGGDETLAERVRGFYTYRHLEPLSTEPYYVWRPVWRMNYVENPGAAWGLFRGHSQFFRNAFFTLVSVAAVAFILHYYRKLRQDQRYLQVALGLVLAGAVGNFVDRLARRYVIDFIEWYWWNRPDIRWPTFNVADSLIVVGVAMLVLHPGSRREAARAPARRDAAAERV

SEQ ID NO: 3921 - protein, 211 aa, Anaeromyxobacter sp. Fw109-5
MSARRPFSKWALLALLFVTLVAIDQWTKYLAVERLTTLFERTGAETLGERLAGFLEHQHLEPISTDPYYVWRPVWRMNYVENPGAAWGLFRGHSEAFRNGFFTLVSLGAVAFILHYYRKLRAEQRYLQVALALVLSGAVGNFLDRLARGYVIDFIEWYWWNRPDIRWPTFNIADSLIVVGVALLVLHPGSGKAAQKAGADAEGDRRASTGG

SEQ ID NO: 3922 - protein, 160 aa, Candidatus Desulfococcus oleovorans Hxd3
MTAKYQMLAIITLVTVIADQATKQVILATMALHETIEVIPGFFSLTHIHNPGGAFGFMAGQPQGVRAVLFLVVSTLAAAFVLYLYKTTPRTLPWLLGALALIFGGAVGNLIDRIRFGVVVDFLDFYVKGLHWPAFNVADSAITVGMTVLVFHILFKKVPF

SEQ ID NO: 3923 - protein, 206 aa, Anaeromyxobacter sp. K
MRRPVSKWALLALLFAALLAADQWTKYLAVERLTVVFERGGDETLAERVRGFYTYRHLEPLSTEPYYVWRPVWRMNYVENPGAAWGLFRGHSQLFRNAFFTLVSLAAVAFILHYYRKLRQDQRYLQVALALVLAGAVGNFVDRLARRYVIDFVEWYWWNRPDLRWPTFNVADSLIVVGVAMLVLHPGSKREAARAPERRGAAAERV

SEQ ID NO: 3924 - protein, 130 aa, Dictyoglomus turgidum DSM 6724
MKYLLVLLIFLLDRITKELAERGYFSRLNIDFFLNFYLTHNYGVAFGIDIARKIILIFNFLALIVLVLLYRKFGFIGLAFILGGLLGNLYDRVFYGYVIDFIHLRNFFVFNLADLFISLGGVLVFFKLIK

SEQ ID NO: 3925 - protein, 206 aa, Anaeromyxobacter dehalogenans 2CP 1; identical to SEQ ID NO: 3923

SEQ ID NO: 3926 - protein, 178 aa, Desulfomicrobium baculatum DSM 4028
MPKIRRVPCKPDMGRRYRTIGLVAAVVFVLDQLSKLWIQQAIPVWEKGFTVIPGFFDIVHILNRGAAFGFLNRHDIDWQRPFFIVVSILAVGLIWVLARSQDDDGPFYVYGLGLILSGALGNLLDRARLGVVVDFLDFYIGDMHWPAFNVADMGICVGAASLLVSFYQQRRRCVPDNN

SEQ ID NO: 3927 - protein, 165 aa, Desulfohalobium retbaense DSM 5692
MRTRYALTGGLGAAILALDQLTKLLIQSSIPLYESRTVIPGFFDLVHIHNRGAAFGFLNRADIEWQTYFFIAVSALAVVLIFQLLRTVDRRDMVLFTGLGCILGGALGNLVDRIRVGHVIDFLDIYIGSAHWPAFNIADIGISIGGICILVSFYRRKKRHASHTR

SEQ ID NO: 3928 - protein, 466 aa, Ralstonia eutropha JMP134
MTMADRTDRYDTPPVSKDIGVLRPGWGYASVSDKIAGLVLERPVRLPWLSAFLLTFAGMLVFMGATAWLFARGVGIWGVDIPVAWGFAIGNFVWWIGIGHAGTFISAFLLLLRQQWRTSVNRFAEAMTLFAAAIAGLFPILHLGRPWFFYWLVPYPDVMNVWPQWRSPLVWDLFAIGTYLIVSLLFWYVGLIPDLATLRDRACLRGRRRTAQAYALLAVGWRGDARHWARYESAYLLLAGLATPLVIAVHSIVSLDFAIGNTPGYHSTIFPPYFVAGALFSGFAMVLTIAIPLRRVYGLEDFITTRHLANAAKIMLTVSLIVAYGYASEIFTAFYSGDRYEMFLFQNRWTGPYAGVYWAMMTCNVLAPQCLWWRRVRHSPAVLFVLSLVINTGMWMERFLIVVSSLHRDFLPSSWGMFYPTRWDWIMLAGSIAMFAWLFLVFIRCLPVISIAEMRELVLTSTKEAP

SEQ ID NO: 3929 - protein, 454 aa, Nitrosococcus oceani ATCC 19707
MSSRYPSNVGSTLDKKPPPGAVVTDKVSGLVLAPHRRWWWLGAFGFSALLSLLFFSAIGYLLVTGVGIWGINIPVAWAFAITNYVWWIGIGMAGTFISAALLLTRQKWRASINRSAETMTVFAVSISGLFPILHLGRPWFFYWLAPYPDIMNVWPQWRSVLVWDFFAILAYLVVSLLFWYTGMVPDFAVIRDRARKRSQQIFYGLLALGWRGEARHWRRLETATLLLAGMAVPLVFSVHSMVGLDFAEGIVPGWHSTIFPPFFVAGALFSGFAMVLMLVVPLRSVFGLHAFITSQHLNNMAKLLLATSLIVTYSYIMEVFIAWYSADPYEIAMTQNRMSGAYAPVYWATIFCNVLVPQILWFKRIRLNPIALFVVGTVVFIGMWLERLMLIVTSLYRDFLPSAWGMFYPTVWDWIFLFAPIGFFAMLFLLFIRFAPVTSMFEIRKLRSEVKNHE

SEQ ID NO: 3930 - protein, 430 aa, Pelobacter carbinolicus
MNNNVPMPQVETDVLAAMRRPRLAWLGSLALAGLLFAGGLALWAYQIRYGMGVAGITHPVGWGVYITDFVFWVGIAHSGTLISAVLYIFRARFRTSFNRAAEAMTIFALMVAGLFPLIHLGRVWVFYYLFPYPNQRQLWINFRSPLVWDVFAVSTYFLVSLVFFYVGLMPDLAIVARHRSGWIGRAYRALSLGWTGSLRQWRHYARLYMFLAAFATPLVASVHSIVSWDFAVSIIPGWHTTIFAPYFVAGAILSGTAMVLTLVIPMRRMLHLEKHIPVDHIEAIAKILLLTSLIVGFSYVIEHGMAFYGTNLFEMEQFRFRALGHYRLLFWIMIICNALLPLLLFVGRLRRNLVFLFVLSLLVNVGMWLERFVIVVCSLARDFDPYNWGNYLPSPVEIGITLGSFGLFFAAFLVFVKTLPVLSITELKER

SEQ ID NO: 3931 - protein, 478 aa, Anaeromyxobacter dehalogenans 2CP-C
MTTATKTIERVDPLETSPVLVGRPDDRALTDSLLEPVLGPTKKGWLVMLVLFGGGMAFWLLSLYMTLFVGIGVWGNNIPVAWAYDITNFVWWIGIGHAGTLISAILLLFQQKWRTSINRFAEAMTLFAVAMAGAYPVIHLGRPWLFWWLIPYPATTQLWPNFKSALPWDVFAISTYATVSFLFWYLGLIPDLATLRDAARTRAQRVVYGIMSFGWRGSARHWQHWRIGYLLMAGLSTPLVVSVHTIVSFDFAISQLPGWHTTIFPPYFVAGAIFSGFAMVMTLMIPARKVFKFEHVVTARHLDNMAKVILATGLMVTYGYVMEWFIAWYSGSEAEWFAFYNRVVGDYKLVYAMQIFCNVVAPQVFWVPALRRNVMVLFLVSVLVNFGMWAERFVIIAVTLTRDFIPGSWANYTPTWVDWGLLFGSMSTFAVLFLLFLRFLPAIPISEVKELRRELEHQDHHAAQGGQAVARGAHAERA

SEQ ID NO: 3932 - protein, 456 aa, Nitrobacter hamburgensis X14
MSVIASAPANPAHPWIAADHASYGEVTALIADSVLLRPAGWRWWIALGVSGLFVLATMVAIYVLFTEGIGVWGVNSTVVWGYAIASYVWWIAIGSGGTLISAMLLITRQRWRASVNRFAETMTIFAVSISGLFPILHLGRPQYFYWLAPYPNTMLLWPQWRSALVWDFWAIVSYLLFSLLFLYIGLLPDLATMRDRATTVYGQVFYGAFALGWRGSAHHWRCYETFQITLAALAVPLVVSVHSIVGLDFAASLMPGWQETIFPPYFVVGALFSGFASVAILTALVRWGLRLEAVITVHHFNAMAKILLLASVVMTCSYATEWFMAWYAGAAADRSLLVFLFTGSYAPLYWMQLSFNCLLPQALWFPRVRRSILCVVLIAIGINIGMWLERILIIWNTLSHGYAVSLWRLFYPTLWDWILLVGPVGLFVFFFLCFVRLVPAVPMNELRKLCREEHVA

SEQ ID NO: 3933 - protein, 468 aa, Candidatus Koribacter versatilis Ellin345
MHQGPDEKTVLQDVLEPGEPPVLAPGHDFGTVSDKISAIVLRRPLGLGWTGAAFIGFVFVNLLLMAVTWLFLRGVGIWGINVPVAWGFAIINFVWWVGIGHAGTLISAILLLLKQTWRNSINRFAEAMTLFAVACAGMFPLFHVGRPWLAYWLFPYPNSMGVWPQFRSPLVWDVFAVSTYATVSAIFWFVGLIPDIATLRDSAKNPYARTIYGLLAMGWRGSARHWKRYQSVYLLLAGLATPLVLSVHTVVSFDFAVAQLPGWHTTIFPPYFVAGAIYSGFAMVLVLAIPIRHYYGVSDMITSRHLENAAKIMLATGLIVAYGYFMEIFMAFYGTNIYERAIVWTRWRGPYAPGYWALIACNILIPQVLWIPKVRKSPFWQFVISMDILIGMWLERFIIVVTSLHRDFLPSSWGMYTPTRWDWATYLGTLGFFLFAFVLFIRVLPMITIFEIKALLPESEPHAVEVKA

SEQ ID NO: 3934 - protein, 451 aa, Cytophaga hutchinsonii ATCC 33406
MQVTSSVRPPLVTNGKTKQDVTNDICRQVEGAPSTAWKISFAMALITLFYGGYCLWTTWYEGIGMWGLNKTIGWSWDITNFVWWVGIGHAGTLISAVLLLFRQKWRTSINRAAEAMTIFAVICAATFIIAHMGRPWVGHWVLPFPNNNGSLWQNFNSALMWDVFAISTYFTVSLVFWYVGLIPDFATIRERATGIRRVIYGALSMNWDGSAKTWSRYEAVSLVLAGVSTPLVLSVHTIVSMDFATSLIPGWHTTIFPPYFVAGAIFSGFAMVLTLMLVTRVLFGLEDYITINHIESMNKIIVLTGSVVGIAYITEFFIAWYSGVPYEKYAFINRAFGPYWWAYATMMTCNVISPQMFWFKKVRTSIAWTFGLSIVVNIGMWFERFVIICTSLHRDFIPSSWSYFSPTLYDVGDYLFTFGLFFTCFLLFAKYFPVINMAEVKTIIDSSSEKK

SEQ ID NO: 3935 - protein, 466 aa, Flavobacterium johnsoniae UW101
MSSHYEAPIRKPLVIGDKSYHDVTVDVAAPVEGPANKQWWIVFTIALVAFLWGLGCIIYTVSTGIGTWGLNKTVGWAWDITNFVWWVGIGHAGTLISAVLLLFRQRWRMAINRSAEAMTIFSVVQAGLFPIIHMGRPWLAYWVLPIPNQFGSLWVNFNSPLLWDVFAISTYLSVSLVFWWTGLLPDFAMLRDRAITPFNKRVYSILSFGWSGRAKDWQRFEEVSLVLAGLATPLVLSVHTIVSMDFATSVIPGWHTTIFPPYFVAGAVFSGFAMVNTLLIVMRKVSNLEAYITLQHIELMNIIIMITGSIVGVAYITELFVAWYSGVEYEQYAFLNRATGPYWWAYWSMMTCNVFSPQFMWFKKLRTSIMFSFIISIVVNIGMWFERFVIIVTSLHRDYLPSSWTMFSPTFVDIGIFIGTIGFFFVLFLLYSRTFPVIAQAEVKTILKGTGDNYIRERANKDSHHE

SEQ ID NO: 3936 - protein, 476 aa, Roseiflexus sp. RS-1
MASQPAQKSAYGKMLEELLGPKQSYESVTRTIGDIVLTPLKRTPWGWALGFVLAALGLLMYLYSLAVLFTVGVGIWGINIPVAWGFDIINFVWWIGIGHAGTLISAILLLFRQDWRTSINRAAEAMTIFAVACAGIYPLVHTGRPWLDYWMLPYPGTLGMWPQFRSALEWDVFAISTYATVSILFWYVGLIPDLASLRDRATNKWVKIFYGFLALGWRGGARDWHRYEMASLILAGLSTPLVLSVHSIISLDFAISQLPGWHVTVFPPYFVAGAVYCGFAMVILLLIPMRRWYKLHDLITMKHFDLMGKVMLASGLVVAYGYFGEMFYAWYSANIYEYFLITNRTMGPYAWSYWALIVLNVAIPQLLWFKRFRVSLPWLFFISICINIGMWFERWVIIVLSLHRDFMPASWGYYTPSVWDISLYAGSFGWFFFLFFLFIRLLPAISIFEVRDLVHKIEAEQHAPVQVGGAGHVREA

SEQ ID NO: 3937 - protein, 482 aa, Anaeromyxobacter sp. Fw109-5
MSTAQKTLEEAHALEGAPVLVGRPDDRALTESLLAPVLEPTRKGFVVLLVALLGGVGFWLVSLGTTLFVGIGAWGNNIPVAWAFDITNFVWWIGIGHAGTLISAILLLFQQRWRTSINRFAEAMTLFAVAMAGLYPIIHLGRPWLFWWLIPYPSTNQIWPNFKSALPWDVFAISTYGTVSFLFWYLGLIPDLATLRDAAKSRTRRIVYGIMSFGWRGSARHWQHYRVGYLLLAGLSTPLVVSVHTIVSFDFAISQLPGWHTTIFPPYFVAGAIFSGFAMVITLMIPARRVLGFKHVVTERHLDNMAKVILATGLMVSYGYAMEHFMAWYSGSGYEAFAFLNRWTGPYAPIWYMQLVCNVLAPQLFWFPSMRRSEVALFVVAILVNVGMWAERFVIIAVSLTRDFVPSSWAMYVPTWVDWGLLFGSMATFGLLFLLFLRFLPAIPIFEVKELRRELEHHGPGVHIQSPADAPGAHVEDPEEVP

SEQ ID NO: 3938 - protein, 471 aa, Roseiflexus castenholzii DSM 13941
MASQPAQKSAYGKMLEELLGPKQTYESVTRTIGDIVLTPIRKTPWGWPVGFVIAALGLLMYLFSLAVLFTVGVGVWGINIPVAWGFDIINFVWWIGIGHAGTLISAILLLFRQDWRTSINRAAEAMTIFAVACAGIYPLVHTGRPWLDYWMLPYPGTLGMWPQFRSALEWDVFAISTYATVSILFWYLGLIPDLASLRDRATNIWVKRFYGFLALGWRGGARDWNRYEVASLILAGLSTPLVLSVHSIISLDFAISQLPGWHVTVFPPYFVAGAVYCGFAMVILLLVPLRRWYKLHDLITIKHFDLMGKVMLASGLVVAYGYFAEIFYAWYSANIYEYFLITNRTMGPYAWSYWALIVLNVAIPQLLWFKRFRVSLPWLFFISICINIGMWFERWVIIVLSLHRDFLPSSWGYYTPSVWDISLYAGSFGWFFFLFFLFIRLLPAISIFEVRDLVHKTETEKALAHGSAGHH

SEQ ID NO: 3939 - protein, 456 aa, Methylobacterium extorquens PA1
MSGHAQPHRWIARERLGYGEICAAVADPIQRRGPGRAWVIAFLGVLPLVLATVIAIGAVLTVGIGLSGVNTTVVWGFSIANYVWWIGIGNAGTLISSMLLLTRQHWRASINRFAEAMTLFAAAIAGIFPIIHLGRPLYSYWLAPYPNTMDLWPQWRSALVWDFWAILSYLLFSLIFWFTGLLPDLATMRDRAQSRFGRRLYGALALGWRGSARHWAVYETFHKTMAALAVPLVCSVHSIVGLDFAASLMPGWQESIFPPYFVVGAMYSGFAMVVVLAIIIRWGLNLQAVITPAHFDAMAKVMLFASIVMTFSYATEWFMGWYGGDHADRAVIVYFFTGDYRWLYYSLLFCNCLVPQALWFARVRLNLWALAIISIVINLGMWLERILIVWNTLSHGHAVSLWRTYHVSFYDVVILIAPLGLFAFGFLVLARIFPIVSIHEVSQLAHDEGAARGGTA

SEQ ID NO: 3940 - protein, 452 aa, Methylobacterium radiotolerans JCM 2831
MSGDPQAHRWIAPAQLSHGAISAAIADPIQKRGPGRLWVYALLATLPFVLVTLGAVGAVLTVGIGLSGVNTTVVWGFSIANYVWWIGIGNAGTLISSMLLLTRQRWRASINRFAEAMTLFAAGIAGIFPIIHLGRPLYAYWLAPYPNTMDLWPQWRSALVWDFWAILSYILFSALFWFTGLLPDLATMRDRATTRRGQVIYGALALGWRNSARHWQVYETFHKTMAALAVPLVCSVHSIVGLDFAASLMPGWQESIFPPYFVVGAMYSGFAMVVMIAIFVRWGLNLQAVITPAHFDVMGKVMLFASVVMTLSYATEWFTAWYGGEHPDRDVVRYFFAGDYRWLYYALIVCNCVVPQALWFPFARRNLWVLAGIAVVINVGMWFERILIVWNTLSHGHAMSLWRTYHTSLYDLAILFGPLGLFVLGFLVLVRIFPAVSMHEVRQLSHEAGAAA

SEQ ID NO: 3941 - protein, 493 aa, Opitutus terrae PB90 1
MSTHAEHAALAGAAILKEVKPAVLPRATLVEHGRSFAWITDKICGIIEGKTPGWWWVCFVVACFVASFTVAGLTYLVATGVGVWGHANPVNWAWDIVNFVFWIGIGHAGTLISAILCLLRQKWRTSINRAAEAMTIFAVVCAAIFPVFHVGRIWYAWYLFPLPNSNWIWQNFRSPLEWDVFAVSTYGTVSVLFWYVGLIPDLAVLRDRFLAAGNRFRSFLYGLFAMGWRGSNRHWSNYEMAYLVLAGVSTPLVLSVHTIVSFDFAVSLLPGWHTTIFPPYFVAGAIFSGFGMVLTLMLPLRAVYKLEDLITQYHIDCMCKITLATGTIVGYAYAMEFFIAWYGANPYEGFTFINRAFGNYAWAYWIMITCNVITPQFFWSKWVRRNTTLVWVLSIFVNVGMWFERFVIIVTSLARDFLPSSWGYYSPSIVEIFTFFGTFGVFSVLFLLFIRFLPVMPMAELKAVTPQADVHGHGPDDHAHTTGLGDPIKMEKH

SEQ ID NO: 3942 - protein, 461 aa, Methylobacterium populi BJ001
MSGTAQPHRWIDRERLGYAEICAAVADPIQKRGPGRAWVIAFLGALPFVLATLAAIGAVLTLGIGLSGVNTTVVWGFSIANYVWWIGIGNAGTLISSMLLLTRQHWRASINRFAEAMTLFAAAIAGIFPIIHLGRPLYAYWLAPYPNTMDLWPQWRSALVWDFWAILSYLLFSLIFWFTGLLPDLATMRDRAETRIGRRFYGALALGWRGSARHWALYESFHKAMAALAVPLVCSVHSIVGLDFAASLMPGWQESIFPPYFVVGAMYSGFAMVVVLAITIRWGLNLQALITPAHFDAMAKVMLFASIVMTFSYATEWFMGWYGGDHADRSVIAYFFTGDYRWLYYSLLFCNCLVPQALWFARVRLNLWALALIAVVINLGMWLERILIVWNTLSHGHAVSLWRTYHVSVYDVVILIAPLGLFAFGFLVLARIFPIVSIHEVSQIAHDEGAAAAGVPKGGVA

SEQ ID NO: 3943 - protein, 448 aa, Akkermansia muciniphila ATCC BAA 835
MQIMNRPAPSVPTADIPVEAMLAEVRKPLGPVWWSVFLASALLAAWGIGWSSWRIAAEGVGVLGVNNNVVWGLDIVHFVFWIGLGHAGTLISAVLLLTRQSWRSPIARGAEQMTLCAVICAAVFPVVHVGRVWMAWMASPLPEVSGIWPDMASPLMWDVMAVSTYFLLSLLYWYIGLVPDFALLRDCCKGRLRRRYGWLALGWQGTGRQWRAYEKASLLFAVILTPLVVSVHSVVSFDFSVTQVPGWHQSIFPPYFVGGAILSGMAMVQLILLGVRRLMAGSGVRRAVTPAILDLSSRFVLALSLVMGAMYLWEHLAAILNGGSPEPFPGRNPVNAVFLIVMVAGNVALPQLFWFRSLRTNRWVIAAVALGVLAGMWMERFWIVVNSLKASLLAANIGEYFPSVTDLAMMAGSVGLFMALYMALVRVAPFFSLCDVREQQSLNKEGGA

SEQ ID NO: 3944 - protein, 478 aa, Anaeromyxobacter sp. K
MTTATKTIERVDPLETSPVLVGRPDDRALTESLLEPVLGPTKKGWLVMLVLFGGGMAFWLLSLYMTLFVGIGVWGNNIPVAWAYDITNFVWWIGIGHAGTLISAILLLFQQKWRTSINRFAEAMTLFAVAMAGAYPVIHLGRPWLFWWLIPYPATTQIWPNFKSALPWDVFAISTYATVSFLFWYLGLIPDLATLRDAAKTRAQRVVYGIMSFGWRGSARHWQHWRIGYLLMAGLSTPLVVSVHTIVSFDFAISQLPGWHTTIFPPYFVAGAIFSGFAMVMTLMIPARKVFKFEHVVTARHLDNMAKVILATGLMVTYGYVMEWFIAWYSGNDAEWFAFYNRVVGDYKLVYAMQIFCNVVAPQVFWVPALRRNVMVLFLVSVLVNFGMWAERFVIIAVTLTRDFVPGSWANYTPTWVDWGLLFGSISTFSVLFLLFLRFLPAIPISEVKELRRELEHQDHHAAQGGQAVAQGAHAERA

SEQ ID NO: 3945 - protein, 451 aa, Methylobacterium sp. 4-46
MSAEPRPAHRWIAAARESDAAITDAVVAPILVGVGRGWWIALALTLPFVLLTLVAVAWLFWRGVGVWGINTTVVWGFAIANYVWWIGIGNAGTLISSMLLLTRQHWRASINRFAEAMTLFAVSIAGLFPILHLGRPIYAYWLAPYPNTMGLWPQWRSALVWDFWAIVSYLLFSLLFWYVGLIPDLATMRDRADSRGARLFYGSLALGWRGSARHWRRLGTLHTTLAALAVPLVCSVHSIVGLDFAASLMPGWQESLFPPYFVVGAMYSGFAMVVVLAALVRWGLRLQALITVNHFEVMGRVMLMASLVMGLSYATEWFMAWYGGKPDERRLVAYEFLGDYALLYWAMLACNVVVPQALWLGRLRRSIPAMLAISLVINVGMWLERILITWTTLSHGYAASLWRVFRPTFWDWSFLIGPLGLFAFFFLLFVRVVPAVSMHELRELAHREGAA

SEQ ID NO: 3946 - protein, 448 aa, Gluconacetobacter diazotrophicus PAl 5 JGI
MSAPAVVAPGETAQSLTERICAVTLREDARPWTPLWWWGAFAVSLGLLGMGVVAVAWLFYAGLGIWGIDWPVVWGLDILNYVWWIAIASGGTFISALFFLLGVEWRTALNRLAESLTLCAALCAAIFPILHLGRPWFFYWLFPYPNTMGLWAQFRSPLVWDFFAILTYVLASILFWYFGLLPDLATLRDRARGQGRRMFYGVLALGFRGSGTQWRHYRAVYAVMAALMAPLVVSVHSIVGMDFAGSAATGWHSTQFPPFFVFGAALSGFAVVLMAILPLRSLLGLQPYVTERHIDVLGRLFLTSSLCVAYAYLMDAFATFYGPDQADRTMFLMRAFGLYAPVYWGTIVLNIVFPQLLWWRAVRLTQPLVWLIGLGVLVGMWLERFQIIVTSLARTQLASAWGQYTPTIWEWSLLFGTIGLFLTTFLLIVRLMPVVAMAEMRAMLRGPA

SEQ ID NO: 3947 - protein, 456 aa, Methylobacterium chloromethanicum CM4
MSGHAQPHRWIARERLGYGEICAAVADPIQRRGPGRAWVIAFLGVLPLVLATVIAIGAVLTVGIGLSGVNTTVVWGFSIANYVWWIGIGNAGTLISSMLLLTRQHWRASINRFAEAMTLFAAAIAGIFPIIHLGRPLYSYWLAPYPNTMDLWPQWRSALVWDFWAILSYLLFSLIFWFTGLLPDLATMRDRAQSRFGRRLYGALALGWRGSARHWAVYETFHKTMAALAVPLVCSVHSIVGLDFAASLMPGWQESIFPPYFVVGAMYSGFAMVVVLAIIIRWGLNLQAVITPAHFDAMAKVMLFASVVMTFSYATEWFMGWYGGDHADRAVIAYFFTGDYRWLYYSLLFCNCLVPQALWFARVRLNLWALAIISIVINLGMWLERILIVWNSLSHGHAVSLWRTYHVSFYDVVILIAPLGLFAFGFLVLARIFPIVSIHEVSQLAHDEGAARGGTA

SEQ ID NO: 3948 - protein, 478 aa, Anaeromyxobacter dehalogenans 2CP 1; identical to SEQ ID NO: 3944

SEQ ID NO: 3949 - protein, 454 aa, Methylobacterium nodulans ORS 2060
MSADLRAKAPPAHRWIASERASDVAITDAIVNPILIGVGKGWWIALALTLPFVLLTLVAIAWLFWRGVGVWGINTTVVWGVAIANYVWWIGIGNAGTLISSMLLLTRQRWRASINRFAEAMTLFAVAIAGLFPIFHLGRPIYAYWLAPYPNTMGLWPQWRSALVWDFWAIVSYLLFSLLFWYVGLLPDLATMRDRASSRGAQVFYGALALGWRGSARHWRRLETLHTTMAALAVPLVCSVHSIVGLDFAASLMPGWQESIFPPYFVVGAMYSGFAMVVVLAALVRWGLRLQAVITVNHFEVIGRVMLTASLVMGLSYATEWFTAWYGGKPGERGLVAYEVTGDYAALYWAMLACNVVLPQALWLRRLRRSIPAMVVLSIIINAGMWLERILIIWTTLSHGYAASLWRVFHPTFWDWSFLFGPLGLFAFFFLILVRVVPAVSMHEVRQLSHKEAA

SEQ ID NO: 3950 - protein, 445 aa, Rhizobium leguminosarum bv  trifolii WSM1325
MTDRLADPDQEITREIVSIPLDFPRPRAWWLLFAVSLLLLGCFVVAVAVLFWRGVGVWGNNIPVNWGLAISNYVWFLGIGHAGTLISALLLIVNAHWRNSLNRFAEAMTLFAVLCAGLYPILHLGRPWFFYWMAPYPNTMQIWPQFKSPLTWDFFAVLTYLTVSVLFWYIGIIPDLASVRDRAKTRRKQVFYGLFALGWRGSARHWAKWQQAYRLTAAIAVPLVISVHSEISLLFAAGPIPGWNSTVFPPYFVMGAAFSGFAVVIMIATVIRHPLGLDQLVRARHLDLLAVFLLVTGLMTAYGYLAEIFNALYSSDVQEVETLRDRIAGAYSYSYWGAVVLNFVPLQLLWFRSSRRSPIVIFLVALSVTVGMWYERFMLLTSALYRDWLVSSYGEYHPSFWEWLLFVGMLGVFFAPYLLFVRFLPVISAFEVKEAYEETGSLDHA

SEQ ID NO: 3951 - protein, 490 aa, Pedobacter heparinus DSM 2366
MSGHNESILREPLITGKDITYAKITDDILMPVENKPNRAWWIGFTVALCGALLWVVAVSYTFWFGIGAWGLNKTVGWAWDITGFVWWVGIGHAGTLISAVLLLFRQNWRNSINRSAEAMTIFAVICAATYVVSHMGRPWLAYWVLPLPNQFGSLWVNFNSPLVWDMFAISTYFSVSLLFWYTGLLPDIATIRDRATGVKRKVYSILSFGWAGNVKTWQRFEAVSLILAGISTPLVLSVHTIVSMDFATSVIPGWHTTIFPPYFVAGAIFSGFAMVLTLLLVARKVLGLENYITMFHIESMNKIIILTGSIVGVAYLTEFFIAWYSGSEYEQYAFINRSTGPYWWAYWMMMTCNVISPQLLWFKKIRTSIPATWILSIVVNIGMWFERFVIIVTSLHRDYIPSSWAMFYPSWVDVSVFVGSIGVFFTLFLLFLRVLPSIAIAEVKLLLKSASEQAKLEQIKGGHLDKEHVSEYVESLEKFDSVKQEEYAKI

SEQ ID NO: 3952 - protein, 477 aa, Dyadobacter fermentans DSM 18053
MHVTSPVREPLIQGGKTYADVTEDICRHVEAAPTKEWKIAFGLSLIVLAYGSVCLAWTWWEGLGVWGLNKTVGWAWDITNFVWWVGIGHAGTLISAILLLFRQKWRTSINRAAEAMTIFAVICAASFILMHMGRPWMAYWALPLPNAFGSLWVNFNSPLVWDVFAISTYFSVSLVFWYIGLIPDLATIRDRATSKVSKFMYGTFAMGWDGSAKTWARYEYISLILAGLSTPLVLSVHTIVSMDFATSVIPGWHTTIFPPYFVAGAIFSGFAMVQNLMLITRVVYKLEDYITLEHIETMNKVITLTGSVVGVAYITEFFIAWYGGVEYEYYAFFNRMTGPYWWAYWAMMTCNVISPQLFWSRKLRRSISFTFFISVIVNIGMWFERFVIIVTSLHRDYIPSSWTMFSPTRYDIGDYIFSFGLFFTLFLLFSKYLPVVNMAEVKAVLRSTSAQLPAKIAGVAKVRQRGTAEPAYNKDQE

SEQ ID NO: 3953 - protein, 486 aa, Chloroflexus aggregans DSM 9485
MAQAQPLRTRPVDDGEAYLLPGETYTSITQKIGDVPLTPPLKTPKGWLAGFSVAFFLLMIFFVSVTWLFIRGVGIWGINIPVGWGMDIINFVWWIGIGHAGTLISAILLLLNQGWRNSINRFAEAMTLFAVACAGLYPILHLGRPWLFYWLIPYPNTHGMWPQFRSALAWDVFAISTYATVSLVFWLVGLIPDFATLRDRAKNIWVKRLYGIAALGWRGSARHWHRYEIASILLAGLSTPLVVSVHSIISLDFAISQVPGWQVTVFPPYFVAGAVFAGFAMVLLLMIPVRTFYGFESYITIHHLDVMAKVMLATGMIVVYGYFMEVFASLYSGNEFEEYLLYNRLFGPSSWAYWGLLFCNAVAIQPLWFKKVRQNVPALLIISLIVSVGMWLERYVIIVISLERDFLPSSWDIYIPTIWDWSLYLGTFGLFFTLLFLFIRVLPMINIFEMRLFLHQETERAKQRAEHGAHSHGHDHSPAHGVASAD

SEQ ID NO: 3954 - protein, 494 aa, Chitinophaga pinensis DSM 2588
MHLKYESTLREPLVDGVKDYHQVTEDIISPIEAKPGKLWYVGFFISLMLLAFGAFSVTWEVYYGTGVWNLNKTIGWGWDITNFVWWVGIGHAGTLISAILLLFRQGWRTGVNRAAEAMTIFAVMCAGQFPIFHMGRVWMAFFVLPYPNTRGPLWVNFNSPLLWDVFAISTYFTVSLLFWYSGLIPDFATVRDRAKTKLRKLLYGVASFGWTGSTKHWQRHEALSLVLAGLSTPLVLSVHTIVSFDFATSVIPGWHTTIFPPYFVAGAIFSGFAMVQTLLIIVRKILGLEDYITLGHMEAMNKVIVLTGSVVGCAYLTELFMAWYAAVPYEFDTFYKYRAAGPLGWSYWIMMTCNVITPQVFWFSKMRRNVAVTFVMSIIVNIGMWFERFVIICTSLYRDYLPSSWSYYRPSWPEVGFYMGTFGLFFTCFFLFAKYFPVIAVAEIKSVLKTSGESFKKGMEQYEQQPAEEFEAGLHHDDDHHHDAHGAVAHAHHN

SEQ ID NO: 3955 - protein, 912 aa, Arthrobacter FB24
MASLIEKLLRTGDKKTLRQLRNYADSINALESSFQTFTDAELREETDRLRERHQDGEKLDDLLPEAFAAVREASSRTLGMRHFDVQLMGGAALHLGNIAEMKTGEGKTLVATAPAYLNALTGNGVHVITVNDYLAEYQSDLMGRVYRFLGLTSGCILSNQDPAVRREQYAADITYGTNNEFGFDYLRDNMAWDKSELVQRGHHFAIVDEVDSILIDEARTPLIISGPAQGDTNRWYSEFAKVVTRLKPDEDYEVDEKKRTVGVLEGGIEKVEDYLGIHNLYESANTPLIGFLNNAIKAKELFKRDKDYVILDGEVLIVDEHTGRILAGRRYNEGMHQAIEAKEGVEIKAENQTLATVTLQNYFRMYNKLSGMTGTAETEAAEFMSTYKLGVVAIPTNRDMQRIDQPDLVYKNEAVKFDAVVKDIAERHEKGQPVLVGTTSVEKSEYLSRLLAKEGIRHEVLNAKNHAREAAIVAQAGRKGAVTVATNMAGRGTDIMLGGNAEFTAVAELAAKGLDPEENSEEYEAAWPAAFEAAKQAVKDEHEEVLELGGLYVLGTERHESRRIDNQLRGRSGRQGDPGESRFYLSLTDDLMRLFNSGAAERLMNSSVPDDVALESKLVSRAIASAQGQVEGRNAEQRKNVLKYDDVLNRQREAIYGDRRRILEGDDLHEKVQFFLEDTITALIDAATSEGTGDDWDFNQLWTNLKTLYPVSVTSHDVIDEAGGKSRITVDFLKEEILSDARLVYQAREQAIGSESMRELERRVVLSVIGRKWQEHLYEMDYLKEGIGLRAMAQRDPLVEYQREGFIMFQAMMEAIREESVGFLFNLEVEVTPAEDVVVADGAGEHTEHHEPQIHAAGLEAPEKPAQLQYTAPGEDGASQTRVEGRSSGRSGNPAKAAQDGARKPAPKKKKR

SEQ ID NO: 3956 - protein, 937 aa, Nocardioides JS614
MPAILDKILRIGEGKILRQLEAIAQAVNAIEDDFVAMSDAELQGMTAEFKERLANGESLDDIMPEAFATVREAARRVIGLRPFDVQVMGAGALHMGNIAEMKTGEGKTLVAVLPSYLNALSGKGVHIVTVNDYLAKFQSEMMGRVHHFLGLTVGVILPEMRPDERRVAYNCDITYGTNNELGFDYLRDNMAGSIEECVQRGHNFAIVDEVDSILIDEARTPLIISGPTQDEVHWYAEFAKVARNLVRDEDYEVDEKKRTISVLEPGITKVEDHLGIENLYESANTPLISFLHNSIKAKELFHNDKEYVVLNGEVLIVDEHTGRMLAGRRYNDGLHQAIEAKEDVQVREEYQTLATVTLQNYFRLYDKLSGMTGTAMTEASEFDKIYKLGVVPIPTNKPMARKDQADLVYRTEEAKYEAVVEDIAERHEKGQPILVGTVSVEKSEHLSAKLKKRGIPHSVLNAKVHADEAKIVALAGHKGAVTVATNMAGRGTDIMLGGSVEFLADAELRKRGLEPAGETADEYQAEWPGTVERIKSQVANEHDEVRALGGLYVVGTERHESRRIDNQLRGRSGRQGDPGESRFYLSLQDELMRLFKSDWVDRVLQVLKIPDDVPIENKRVTSAIANAQGQVESQNFESRKNVLKYDDVMDRQRKVIYAERREVLEGKDLQDQIRTFIDDTVTGYVTGATEEFAEEWDLEALWTALRQIYPVGVDYRVLEEEAGGRANMDRDELIAVLQKDAHEAYDRREAEVGETVMRELERRVVLSVLDRKWREHLYEMDYLREGIYLRAYSQRDPLVEYQREGFEMFAAMMDGIKEESVGFLFNLEVQVEIEEEDEEEEEVLEPMRQPVPSFDQQGAMPQIRAKGLERPSQPTKLAYSAPSEDGDAEVKGATVTNADDEFAGVGRNDRCPCGSGKKFKQCHGRPGGPTGLTARVS

SEQ ID NO: 3957 - protein, 971 aa, Salinispora tropica CNB-440
MSILEKVLRAGEGRLVRRLKAIAAAVNSIEDDYVNLTDDELREMTAQFRERLDDGETLDDLLPEAFAVCREGAARVLGQRPYDVQVMGGAALHFGNIAEMKTGEGKTLTSVMPVYLNALSGKGVHVITVNDYLAERDAAWMGRVHEFLGLTVGVVLPNRPAAEHRAAYECDITYGTNNEFGFDYLRDNMAWSKEDLVQRGHNFAVVDEVDSILIDEARTPLIISGPAEHSARWYGEFAAVVARLQSGKDGEGDYEVDHAKRTVAVTERGVGKVEDRLGIDNLYESVNTPLVGYLNNAIKAKELFKRDKDYIVSEGEVLIVDEFTGRILHGRRYNEGMHQAIEAKEGVEIKQENQTLATITLQNYFRLYEKLAGMTGTAQTEAGEFNKVYKVGVVTIPTHRPMVREDRSDVIYKTEKAKFNAVVEDIAERHHAGQPVLVGTVSVENSEILSQLLRRRGIPHSVLNAKFHAREAEIVAQAGRKGAVTVATNMAGRGTDILLGGNPEFLAANDLRQRGLDPTEHEEEYAKAMEEVLPTWKQACDDEAEEVSAVGGLYVLGTERHESRRIDNQLRGRSGRQGDPGESRFYLSLQDELMKRFRSGAVEAVMERFNIPEDVPIESKMVTRQIKTAQAQIESQNAEIRKNVLKYDEVMNKQRQVIYAERLRVLNGEDLSDQVRNMIDDVVEAYVRGATAEGYAEDWDFEQLWSSLKQLYPVGITIEELEEEAGGSRASIDVDFLLSRLKEDAHAGYDRREEELGAEGVRQLERMVLLQVIDRKWREHLYEMDYLQEGISLRAYAQRDPVVEYQREGFDMFATMMDGIKEETVGFLYNLDVQVQESEPAADEVKLLEKPVEVRAKGLGRTPQQQGLQYSAPTIDGEAGRGSVAVERAEEAAPQEGRPAMTAPAAPGQSAPTAPQRPGNRARGHAVAAGTARRAAPGQAEGGNGPSRNAPCPCGSGRKYKRCHGSPNGGA

SEQ ID NO: 3958 - protein, 1018 aa, Frankia EAN1pec
MGGDRGASILVVGEPRRHACRRSFAVVLDKILRAGEGRILRKLKAIAEQVNLIEDDFTGLTDAELRGMTDEFRQRLASEEETLDSLLPEAFATVREAARRTLGQRHFDVQIMGGAALHLGNIAEMKTGEGKTLVSTLPSYLNALSGNGVHIVTVNDYLAQRDAENMGRVHRFLGLTVGVIHPQMPPSVRRQQYRCDITYGTNNEFGFDYLRDNMSWSAEELVQRGHHFAVVDEVDSILIDEARTPLIISGPADNPTRWYTEFSRIAPLLERDVDYEVEEGKRTVSISEVGVEKVEDQLGIENLYESVNTPLVGYLNNALKAKELYKRDKDYIVTDGEVLIVDEFTGRVLHGRRYSEGMHQAIEAKEKVEIKQENQTLATITLQNYFRLYDKLSGMTGTAMTEAAEFHQIYALGVVPIPTNKPMARTDQADVVYKTEIAKFDAVVEDIAERHENGQPVLVGTTSVEKSEYLSKQLAKRGVRHEVLNAKHHEREAMIIGEAGRRGAVTVATNMAGRGTDIMLGGNPEFIAQTELRQRGLSPIDTPDDYEAAWPEALEKARASVKAEHEEVVNAGGLYVLGTERHESRRIDNQLRGRAGRQGDRGESRFYLSLGDDLMRLFNAAAVEGIMDRLNIPDDVPIESKIVTRAIRSAQTQVEGQNFEIRKNVLKYDEVMNKQRTVIYEERRKVLEGADLHEQVRHFVDDTVEGYVRGATADGYPEEWDLETLWSGLGLLYPVGVDAPGTDDREGLTSDLLLEDLQADAQDAYDRREADLGDKPDGEAVMRELERRVVLAVLDRKWREHLYEMDYLQEGIGLRAMGQRDPVVEYQREGFDMFQTMMEGIKEESVRLLFNVEVQVAGRDTDQSGTAPEGAPAAPAGTTPTPATPAERGSVSVGAVPLVTPAAPAPAQPARTAPEPPPAPVPASPPPVFVKGLEPHRPTGGLRYTAPSVDGGSSTVTTVDNGSELSRAGGGGPRSAGGGVSRGAGEGGTARPARNAPCPCGSGRKYKRCHGDPARRND

SEQ ID NO: 3959 - protein, 971 aa, Salinispora arenicola CNS-205
MSILEKVLRAGEGRLVRRLKAIAAAVNSIEDDYVNLTDDELRGMTAQLRERLADGETLDDLLPEAFAVCREGAARVLGQRPYDVQVMGGAALHFGNIAEMKTGEGKTLTSVMPVYLNALSGKGVHVITVNDYLAERDAAWMGRVHEFLGLTVGVVLPNRPATEHRAAYECDITYGTNNEFGFDYLRDNMAWSREDLVQRGHNFAVVDEVDSILIDEARTPLIISGPAEHSARWYGEFAAVVARLQSGTDGEGDYEVDYAKRTVAVTERGVAKVEDRLGIDNLYESVNTPLVGYLNNAIKAKELFKRDKNYIVSEGEVLIVDEFTGRILHGRRYNEGMHQAIEAKEGVEIKQENQTLATITLQNYFRLYEKLAGMTGTAQTEAGEFNKVYNVGVVTIPTHRPMIREDRSDVIYKTEKAKFNAVVEDIVERHQAGQPVLVGTVSVENSEVLSQLLRRRGIPHSVLNAKFHAREAEIVAQAGRKGAVTVATNMAGRGTDILLGGNPEFLAANELRQRGLDPAEHEEEYAKAMEEVLPTWKHACDAEAEEVTSVGGLYVLGTERHESRRIDNQLRGRSGRQGDPGESRFYLSLQDELMKRFRSGAVEAVMERFNIPEDVPIESKMVTRQIKTAQAQIESQNAEIRKNVLKYDEVMNKQRQVIYAERLRVLNGEDLSDQVRNMIDDVVEAYVRGATAEGYAEDWDFDQLWSSLKQLYPVGITIEEMEEEAGGSRASIDVDFLLSRLKEDAHAAYGRREEQLGEEGVRQLERMVLLQVIDRKWREHLYEMDYLQEGISLRAYAQRDPVVEYQREGFDMFATMMDGIKEETVGFLYNLDVQVEEPEPAADEVKLLEKPVEVRAKGLGRAPQQQGLQYSAPTIDGEAGRGSPSIERADEAAPPAGRPAMSAPAGPGRTAPAAPRRAGGGSNGHAVAAGTARRAAPGQAESSNGPSRNAPCPCGSGRKYKRCHGSPNSGA

SEQ ID NO: 3960 - protein, 916 aa, Arthrobacter chlorophenolicus A6
MASLIEKLLRTGDKKTLRQLRNYADSINALEDSFKTFTDAELREETDRLRERHQDGEKLDNLLPEAFAAVREASSRTLGMRHFDVQLMGGAALHLGNIAEMKTGEGKTLVATAPAYLNALTGKGVHVVTVNDYLAEYQSDLMGRVYRFLGLTSGCILANQDPAVRREQYAADITYGTNNEFGFDYLRDNMAWDRNELVQRGHNFAIVDEVDSILIDEARTPLIISGPAQGDTNRWYSEFAKVVLRLQPEKDYEVDEKKRTVGVLEGGIEKVEDYLGISNLYESANTPLIGFLNNAIKAKELFKRDKDYVIMDGEVLIVDEHTGRILAGRRYNEGMHQAIEAKEGVEIKAENQTLATVTLQNYFRMYGKLSGMTGTAETEAAEFMSTYKLGVVAIPTNRDMQRIDQSDLVFKNETVKFDAVVRDIAERHEKGQPVLVGTTSVEKSEYLSRLLAKDGIRHEVLNAKNHAREAAIVAQAGRKAAVTVATNMAGRGTDIMLGGNAEFTAVAELAKRGLDPEENSEEYESAWPAALEAAKQAVKDEHEEVLNLGGLYVLGTERHESRRIDNQLRGRSGRQGDPGESRFYLSLTDDLMRLFNSGAAERLMNSSVPDDVALESKLVSRAIASAQGQVEGRNAEQRKNVLKYDDVLNRQREAIYSDRRRILEGDDLHEKVQFFVEDTIMALIDDATAGGNGDDWDFHQLWTNLKTLYPVSVSADDIIEEAGGKSRLTVEFLKEELLSDARLVYQAREESIGSESMRELERRVVLSVIGRKWQEHLYEMDYLKEGIGLRAMAQRDPLVEYQREGFTLFQSMMEAIREESVGFLFNLEVEVTPAQDVVVEDAAGGHTEHVEPQVRAAGLEAPEKPAQLQYTAPSEGGGTQTRVETRSTGRSGNPAKAAEQDAAKDAAKRPAKKKRR

SEQ ID NO: 3961 - protein, 985 aa, Brachybacterium faecium DSM 4810
MVNLFDKILRAGEGRELRRLEAIARRVGEAENVFTELSDEELRAETDHFKERLAEGETLDDILVEAFAAVREAAHRTLGQRPYDVQIMGGTALHRGRIAEMKTGEGKTLVATLPAYLNALSGKGVHIVTVNDYLAGYQSDLMGRVFRFLGLTTGVIKSGMTPAERREQYAADITYGTNNEFGFDYLRDNMSLKPEDRVQRGHAFAIVDEVDSILIDEARTPLIISGPGSGDANKWFSEFAKVVKLLRRDRDYEVDEKKRTVGVLESGIDKVEDHLGIDNLYESLNTPLIGFLNNAIKAKELFKRDKDYVVLNGEVMIVDEHTGRILAGRRYNEGMHQAIEAKEGVKIKAENQTLATITLQNYFKLYEKLSGMTGTAETEAAEFMNTYELGVVPIPTHRPMQRADEPDRIYRTEKAKFDAVVEDIVGRHEKGQPVLVGTTSVEKSEYLGKLLTAQGVQHEVLNAKNHAGEAAIVAMAGAKGAVTVATNMAGRGTDIMLGGNVEFMAHAELEKRGLDPEEDPEAYEAAWDEELARAKEAVAEQHDEVVEVGGLYVLGTERHESRRIDNQLRGRSGRQGDPGESRFYLSLQDDLMRLFNSGAAESLLARGGVDESIPLTGRMVTGAIQRAQNSIESRNAEIRKNVLKYDDVLTKQRKKFYEERGRILEGEELEPHIERFIDEVIGGTVDAHTRGKPAEDVDLEELWGALRPAYPVSLTAQELIEEVGGKENLEASVLKEEILADARVAYEKRREELGEEGLQQLQRRVLLSVLDRRWREHLYEMDYLKEGIGLRAMAQRDPLIEYEREGHLMFNDMMAGVKEDVVGYVYHLEVQVEKAEPVVPKAVSDLLAGATKAARGAAAAAAASSGGAASGGGAEGAAARSAEPAESGAAEGEDADEPVDESGVVLRAKGLDDGPSERQLRYTSAEGNDVQDASTLSRAQRRQQARQQRGAAGAAARGTVQDKPEGAPQGAGQNRAQRRAKRRRR

SEQ ID NO: 3962 - protein, 911 aa, Micrococcus luteus NCTC 2665
MPSIIDRVLKISDNRVLKRMQATVDAVNLLEDDFRALSDAELRAETDTLRARHADGESLDLLLPEAFAAVREAAGRTLGQRHYDVQLLGGIALHQGNIAEMKTGEGKTLVATAPAYLNALSGRGVHVVTVNDFLASYQADLMGRVFRFLGMQTGVIVAGQTPAVRREQYAADITYGTNNEFGFDFLRDNMAWSLDELVQREHHYAIVDEVDSILIDEARTPLIISGPAQGEANRWYGEFARLVRRLEADTDYEVDHKKRTVGILGPGIEKVEDHLGITNLYETQNTTLIQFLNNAVKAKELFKRDKDYVVLDGEVQIVDEHTGRVLKGRRYNEGLHQAIEAKEGVEVKPENQTLATVTLQNYFRGYEKLAGMTGTAETEAAEFTSTYGLGVVVIPPNRERQRVDRNDVVYKNEKVKFDAVVDDIAERHAKGQPVLVGTTSVEKSEYLSTLLAKRGIRHEVLNAKNHAREAAIVAQAGRPGAVTVATNMAGRGTDIMLGGNAEFTAVARMQELGLDAAEDPEAYEARWPEVLAQAEAAVEDAHREVIEAGGLYVVGTERHDSRRIDNQLRGRSGRQGDPGESRFYLSLTDELMRNFNPGVAQRIMNSPSIPDDMALEFGFVSKAIQNAQAQVEGRNAEQRKNVLKYDDVMNRQREAIYTDRRSILEGEDLQDRVRRFVEDAVGNIVDAATEEGQATDWDLDQLWRDLAELYPVGISQEDVLDEVGGRGRLKAEVLKRELVSDALLAYEDREAQVGSEALREAERRVVLASIGRHWQEHLYEMDYLKEGIGLRAMAQREPLVEYQREGYTMFQNMLAGIREDAVRTLFQAQISAAPAPTSLPGVKDARAVTMAPQISVEGIDAPQRPAQLRFTGPSEDGQSAVTRSGTDSGATVAAGTNRRSRRQAERRGRRG

SEQ ID NO: 3963 - protein, 901 aa, Kytococcus sedentarius DSM 20547
MPKIIDRVLRAGEGRVLKRLQGIADAVNAQEAGIQGLTDAELLEQTDRFRARLADGETLDDLLPEAFATVREAAVRTLGKRHFDVQIMGGAALHHGSVAEMKTGEGKTLVATLPSYLNALTGKGVHVVTVNDYLAEYQAELMGRVHRFLGLETGVILSKLSPAQRREEYRKDITYGTNNEFGFDYLRDNMAWSTSDLVQREHHYAIVDEVDSILIDEARTPLIISGPGDQATSWYTTFATLAGMLEKGTAADKLKGIEATGDYEVDIKKRTVGVLESGIEKVEDYLGVHNLYEARNTPLIGYLNNAIKAKELFTKDKDYVVMDGEVHIVDEHTGRLLKGRRYNDGIHQAIEAKEQVEIKQENQTLATVTLQNYFRMYDKLAGMTGTAQTEAAELHSIYKLDVVPIPTNRPMQRQDQADLVFAKAKGKFDAVVEDIVERHRRGQPVLVGTTSVSKSEYLSEQLTARGVQHEVLNAKYHEQEAAIVAEAGRKGAVTVATNMAGRGTDIMLGGSPEFMAVASLKKRGLDPDEQPEAYEAAWDEALARAEKAVQTEHQEVLELGGLYVLGTERHDSRRIDNQLRGRSGRQGDPGESRFYLSLEDDLMVRFNSGLMQRAMAGADPDTPLEFGMLTKAIERAQTQVESQNFESRKNVLKYDDVLNRQREVIYAERKRVLEGADLESQVRHFINDVIIGYVQGATVHGYAEDWDFDELWGALEELYPVSLTVDDIVEAAGGIGGVDAGLLIDELTSDAQHAYDAREQAMGETVMRQLERRVVLGVLDRKWREHLYEMDYLKEGIGLRSMAQRDPLVEYQREGYQMFGVMADSIKEEAVMGLFSVEPSAQGVQAVAAGEQRRKHGGAVDANEDQASWQYTAPTAEGGVERRNATGQSGNRAQRRAAQRG

SEQ ID NO: 3964 - protein, 928 aa, Catenulispora acidiphila DSM 44928
MARLMDKVLRAGEGKILRRLEAVADLVEEIEDDYVQMSDAELRAQTDEFRARLEDGETLDDLMPEAFAVVREAAKRTLGQRHYKVQMMGGAALHLGNIAEMRTGEGKTLVGTLPAYLNALAGKGVHIVTTNDYLAERDSSWMGRVHRFLGLKVGVILANMTPAERREQYECDITYGTNNEFGFDYLRDNMAWSREEMVQRGHFFACVDEVDSILIDEARTPLIISGPADQATKWYTDFSKIVDRLAPDVDYEVDEKKRTVGILERGVERVEDLLGIDNLYESVNTPLVGYLNNAIKAKELFKKDKDYVVMNGEVMIVDEHTGRILAGRRYNEGMHQAIEAKENVEIKDENQTLATITLQNYFRLYDKLAGMTGTAMTEAAEFQQIYKLGVVPIPTNRPLIRMDQQDLIYVSEEAKFEAVVEDIAERSALGQPILVGTTSVEKSERLSQMLRKRGVPHEVLNAKYHEREAAIVAQAGRKGAVTVATNMAGRGTDIQLGGNPDDLANGELQQRGLDPEGTPDEWVAALPDALEKAKRKVKAEHDEVQELGGLYVLGTERHESRRIDNQLRGRAGRQGDPGETRFYLSLGDDLMRMFKAGMVERVLAMANVPKDVPIEHKMVTRAIASAQTQIEQQNFEIRKNVLKYDEVLNRQRLVVYEERRKVLDGADLEDQVRLMMDDTIAGYVDAATAEGYAEEWDLDKLWTALETLYPISVTVEEIEEAAGGADKVTRDVLADELIADIRSGYDAREEQLGEQITRELERRVVLSVLDRKWREHLYEMDYLQEGIGLRAMAQRDPLVEYQREGYAMFQAMMDAIKEESVGYLFNLKVEVEAVNQDPQAQAQAAATANALAGQNGVQDAVPQLHAKGLDTPRRPDHLNYTAPTVDGEGGVLQREVSFAAEYADKDAAPEPAEDDTPRRRSSGKRKKR

SEQ ID NO: 3965 - protein, 955 aa, Saccharomonospora viridis DSM 43017
MLLNRLLRAGEGKMVKRLRRIADHVNTLEDDVKDLSDAELQAKTDEFRKRYSDGESLDDLLPEAFAVVRESARRVLGQRHYDVQLMGGAALHLGQVAEMKTGEGKTLTSLLPVYLNALPGKGVHVVTTNDYLAQRDSEWMGRVHRFLGLEVGVIRSDLTPAERKAAYAADITYGTNNEFGFDYLRDNMAWSLDDCVQRGHYYAIVDEVDSILIDEARTPLIISGPADQSSRWYVEFARMAPLMKRDVHYEVDERKRAIGVTELGVEFVEDQLGIDNLYDAANTPLVGFLNNALKAKELYHRDKEYIVRNGEVLIVDEFTGRVLPGRRFNEGMHQAIEAKEGVEIKAENQTLATITLQNYFRLYEKLAGMTGTAETEAAEFHQTYKLGVVPIPTNRPMIRVDQPDLIYKTEEAKFEAVADDIAERHEKGQPVLVGTTSVEKSEYLSKLLLKRGVPHEVLNAKHHHREALIVAKAGRKGAVTVATNMAGRGTDIVLGGNPDILADEVLRERGLDPVENSEEYEAEWPKVLEEVTAECKAEAEEVVKAGGLYVLGTERHESRRIDNQLRGRAGRQGDPGESRFYLSLGDELMRRFNAGMVERVMTTMRLPDDVPIEHKMVSRAIKSAQTQVEQQNMEIRKNVLKYDEVMNQQRKVIYAERRRVLEGEDLREQMRHMITDVITAYVNGATAEGYAEDWDHAKLWTALKTLYPVSVTWEEIIEENEDIDAERLREILVEDALAAYDRREAEIDAKAGEGAMRELERRVVLSVLDRKWREHLYEMDYLKEGIGLRAMAQRNPLVEYQREGFDMFNAMLDSLKEEAVGLVFNLQVQQAEQQQAEEASKTEQARKPQAPAASGNGRASGAAAKTSTPRHARPVPPQPKIPGQSVPVALQGQKLGGQIPQGLTFSGPSEGGGVQSRGDGTTSAKKQGSAAGGTRRERRAAAREQAKKNKRNARR

SEQ ID NO: 3966 - protein, 906 aa, Jonesia denitrificans DSM 20603
MVTILEKILRFGEGKILKKLNVIVQQVNALEEHYQAFTDEELREETARFKEDIAEGSSLDALLPQAFAVVREASVRTLGQRHYDVQIMGGAALHMGNIAEMKTGEGKTLVATLPAYLNALSGQGVHIVTVNDYLAKYQSDIMGRVFRFLGLKTGCIVSGQNPTERRAQYEADITYGTNNEFGFDYLRDNMAWSMKDLVQRGHNFAIVDEVDSILIDEARTPLIISGPADGDVNKWYTEFAKVSRRLIAGEDYEVDEKKRTIGILEPGIEKVEDYLGIDNLYESLNTPLIGFLNNSIKAKELFKRDKDYVVMNGEVMIVDEHTGRILAGRRYNEGMHQAIEAKEGVTIKAENQTLATITLQNYFRLYSTLSGMTGTAETEAAEFHSTYSLGVVPIPTHRPVQRVDQSDLIYKTETGKFQAVVQDIVERHAHGQPILVGTTSVEKSELLSSLLKKQGVPHEVLNAKQHAREAAIVAMAGRKGAVTVATNMAGRGTDIMLGGNAEFMAHAELEQRGLDAVEHPDEYEAAWDEALAAAQQAVKDEHDEVVELGGLYVLGTERHESRRIDNQLRGRSGRQGDPGESRFYLSMEDELMRLFGSGLAESMMNRAGFPEDVPLESKMVSRGIASAQGQVESRNLEIRKNVLKYDDVLSRQRTVIYDERRRVLEGEDMQEQIQHFLTDVITGHVEMTTTSNDQNEWDLEALWATLKGIYPISITVEEVEEQAGGRTHLKRDELLEEILSDARLAYEQREAELGSENLRDLERRIVLSVVDRKWREHLYEMDYLKEGIGLRAMAQRDPLVEYQREGYDMFTAMLEGVKEEAVGFLYNLQVTVEKKEVDLDGDGTPDIEEDVMVAKGLDQPKRPTQLQYTSSEGSTSESGSGTSGGAANAGSNRAERRAAQKRSRKR

SEQ ID NO: 3967 - protein, 751 aa, Rhodoferax ferrireducens T118
MKTLSAEPTGAASLAQPLPQLLTATAQTLPEQSHALARARAFAEPLLASETLDTGENTLAHADAVAAILRIIGGSEAMQAASYLVYACDHLNKPQEVIAKAFGDNFAALAVETTKLVRVQRQARQAQVASERAATGIPMAQTAAAQTENVRKMLLAFSRDLRVVMLRLASRLQTLRFFAAARQAAPPGVAREALQVFAPLANRLGIWEIKWEMEDLAFRFLEPDVYRQVARLLDEKRSERELHVEQLRQQLESDLKAQGMSVTVQGRPKHIFSIVKKMRGKSLAFDQVHDIRALRIVVADIADCYAALSWVHSQFTPIAEEFDDYIAKPKANGYQSLHTVVRDAAGLPIEIQIRTQAMHDHAEHGVAAHWAYKEAGVKGYAGVSATSSYDAKIAVLRQLLAWERDLSGTSAQDVGLDDRIYVLTPEAAIVELPQGATAVDFAYSVHTDLGHRCRGARIDGVMVPLNTPLKNGQTVEVTVAKEGGPSRDWLMAEQGYLVSHRARSKVRAWFNAQALHETVAKGREAVEKLLQREGKTALKLQDLAAQLGFNSADDLFEVVGKDEFSLRNIETLLHPPEPVQADDGPLLKKPRSASNPAKGGLLVVGVDSLMTQLAKCCKPAPPDPICGFVTRGKGVSVHRADCSNLREMIAQNGERVIEVEWGQPPGSANGSAGSAVYPVDVAVHAMDRQGLLHDISEVFTKEKMNVIGVQTQSVKGIALMTFTVEVSDAGRLHKVLGVVAELPGVRSARRR

SEQ ID NO: 3968 - protein, 750 aa, Polaromonas JS666
MKSNVLGPDGPTAPQRPNASIVTATADSPPDQPNALARARAFAEPLIAGETLDTGENILAHADAVAAILKGIGGSEAMQAATYLVHACQHLTKPQEVIAKAFGANYAALAIETTKLVHVQRQARTADAKAQLLDDPAAQTENVRKMLLAFSRDLRVVMLRLASRLQTLRYYAATRQSAPLALAHESLHVFAPLANRLGIWQIKWEMEDLAFRFLEPDTYKHTARLLDEKRVEREGFMESLRAQLERELNQNGIAALVQGRPKHIYSIVKKMRGKSLGFDQVFDIRALRVIAADINGCYAALGFVHSRFTPVAGEFDDYIAKPKSNGYQSLHTVVRDAAGRAVEIQIRTQAMHDHAEHGVAAHWAYKEAGTKGYSGVSASSEYDAKIAVLRQLLAWERDLSGPAAKQGLFEDRIYVLTPDAAIVELPQGATAVDFAYSVHTSLGHRCRGARIDGAMVPLNTPLQNGQTVEVVTAKEGGPSRDWLNSELGFLASHRAKSKVRAWFNALAMEQTVAKGREAVEKLLQREGKTAMKLDDLALQLGFKTADDLFEVVGKDELSLRTIENMLRPPEPVLSQDDYVLAKKARQPDKSSQSGKGGKGSVLVVGIDSLLTQLAKCCKPAPPDEILGFVTKGKGVSIHRSDCSNFRNMASGSPDRVIEVQWSSSKTADGSVYPVDVAVEAADRQGLLRDISEVFAKEKMNVIGVQTQSVKDNRGGTAWMTFTVEVAQSGRLNQVLGLVADVPGVRSARRR

SEQ ID NO: 3969 - protein, 753 aa, Acidovorax avenae citrulli AAC00-1
MRSIAAPQPPHAAAGQEAVPQLIAATSLALPEQAGALARARAFAEPLLSGETLETGENTFAHAEAVAAILKTIGGSEAMQAASYLVHACSHLNKPEEVIAKAFGQNFATLAVETTKLMRVQHHAREAQLAGHAVDDPATHTENVRKMLLAFSRDLRVVMLRLASRLQTLRFYAASKRPVSPSIAREALQVFAPLANRLGIWQMKWELEDLSFRFLEPDTYKQIARLLDEKRAEREVYMEQLRGRLESELRARSISATVQGRPKHIYSIVKKMRGKSLDFDQVFDIRALRVVVPTVKDCYAALSWVHSHFKPIDAEFDDYIAKPKPNGYQSLHTVVRDEAGKAIEIQIRTQAMHDHAEHGVAAHWAYKEAGAKGYAGVSASSEYDAKIAVLRQLLAWERDMAGAVQHRGLFEDRIYVLTPNAEVVELPQGATPVDFAYAVHTSVGHRCRGARVDGAMVPLNTPLHNGQTVEITTVKEGRPSRDWLNPELGYLTSHRARAKVRAWFNAQATHETVARGREAVEKLLQREGKTAIRLEDLAVQLGFKTADALFEVVGKDEFSLRTIETLLRPPEPVLQPDDYLLLKKARTNESAPKGGVLVVGIDSLMTQLAKCCRPAPPDPIRGFVTRGKGVSVHRADCSNFREMAARSAERVIDVEWGSAGGSGGGAQGGGQGGHPALLYPVDVAVEAADRQGLLRDISEVFAREKTNVIGVQTQSVKGTAWMTFTVEVSDSGRLNKVLSIVAAVQGVRSARRR

SEQ ID NO: 3970 - protein, 747 aa, Acidovorax sp. JS42
MKSSSIGHLPMGQGAAAGPRPEAVPQLIAATAQAGPEHADALVRARAFAEPLLIGETLETGENTLVHADAVSAILKHLGGSETMQAAAYLVYACSHLNKPEEVITKAFGSNFAALALETTKLMRVQLQAREAQVMGQQVDDAATQTENVRKMLLAFSRDLRVVMLRLASRLQTLRFYAAAKRPVSPAIAREALQVFAPLANRLGIWQMKWELEDLAFRFLEPETYKEVARLLDEKRVERELYMEQVRSRLESELRARSISASVQGRPKHIYSIVKKMRGKSLNFDQVFDIRALRVVVPSVKDCYAALSWVHSQFKPIEAEFDDYIARPKPNGYQSLHTVVRDEAGKAIEIQIRTQAMHDHAEHGVAAHWAYKEAGTKGYAGVSASSEYDAKIAVLRQLLAWERDLVGSASRSGLFEDRIYVLTPDAAVVELPQGATPVDFAYAVHTSVGHRCRGARVDGNMVPLNTPLQNGQTVEITTVKEGRPSRDWLNPELGYLTSNRAKAKVRAWFNAQATHATVARGRELVEKLLQREGKTALKLDDLAVQLGFKSAEALFEVVGKDEFSLRSIETLLRPPEPAVDEPDVLLKKARTPDGAPKGGVLVVGVDSLMTQLAKCCKPAPPDEIRGFVTRGKGVSVHRADCSNFREMAARNAERVIDVEWGKSQRAAGEAAVYPVDVAVEASDRQGLLRDISEVFAREKTNVIGVQTQSVKGTAWMTFTVEVSDAGRLNKVLGIVAAVQGVRSARRR

SEQ ID NO: 3971 - protein, 756 aa, Polaromonas naphthalenivorans CJ2
MKHKVAATHAPAISPDSLSSIVAATADSLHGQPHVLVRARAFAEPLIASEVMDTGENILAHADAVVGILKTIGGSEAVQAATYLVHSCQHLNKPQDVIAKAFGPSYAALAVETTKLIYLQRQTRAVDAKSQLHDDPAAQTENVRRMLLAFSRDLRVVMLRLASRLQTLRYYAASRQAAPRALAHESLHVFAPLANRLGIWQIKWEMEDLAFRFLEPDTYKQIARLLDEKRAEREVFMEALRAQLERDLNQNGIAALVQGRPKHIYSIVKKMRGKSLGFDQVFDIRALRVIAADVKGCYAALGFVHSCFSPVNGEFDDYIAKPKPNGYQSLHTVVRDEGGRAMEIQIRTQAMHDHAENGVAAHWAYKEAGTKGYAGVSASSEYDAKIAVLRQLLAWERELSGPAAQRARDANQGLFEDRIYVLTPDAAIVELPQGATTVDFAYSVHTSLGHRCRGARIDGVMVPLNTPLQNGQTVEVITTKEGGPSRDWLNPELGFLSSNRAKSKVRAWFNALAMEQTVAKGREAVEKLLQREGKTAMKLQDLAFLLGFKTADELFEVVGKDEFSLRTIENMLRPPEPAPSPDDYVLAKKTRQSEKSSAAGKGGKGSVLVVGMDSLLTQLAKCCKPAPPDVILGFVTKGKGVSIHRSDCSNFRNMATGSPDRVIEVEWGSAKAPDGAVYPVDVAVEAADRQGLLRDISEVFAKEKMNVIGVQTQSVKDNRGGTAWMTFTVEVAQSGRLNRVLGIVADVPGVRSARRR

SEQ ID NO: 3972 - protein, 736 aa, Verminephrobacter eiseniae EF01-2
MKIHPPTQPPALSDAAAQLIAATAPHPLPEPAHALAHARAFAEPLLAGASLDSGENTLAHADAVAAILKGIGGSEAMQAASYLVQACIHLNKPEELITKTFGANFATLALETTQLMRVQRQARAAQPVDDPALQTENVRKMLLAFSRDLRVVLLHLASRLQTLRFHAASKRPVSPGLVRESLQVFAPLANRLGIWQMKWELEDLCLRFLEPDVYKQVARLLDEKRGERELCIEQLRARLEAELRARSISASVQGRPKHIYSIVRKMRGKALNFDQVFDIRALRVVVPTVKDCYAALSWVHQQFKPIEQEFDDYIARPKPNGYQSLHTVVRDDNGKPIEIQLRTQAMHRHAEHGMAAHWVYKEAGSKGYAGVSASSAYDAKIAVLRQLLAWERDLSGALPQRALFEDRIYVLTPDAAVVELPQGATPVDFAYAVHTSVGHRCRGARVDGAIVPLNTALQNGQTVEISTVKEGRPSRDWLNAELGYLVSYRAKAKVRAWFNAQATHETMARGREAVEKLLQREGKTALKLDDLAAQLGFKSADALFEVVGKDEFSLRSIEAVLRPPEPAPPPSTQLLHKKTRSHDPPRKDGVLVVGIESLLTELAKCCRPAPPDAIVGFVTRGKGVSVHRADCSNLREMAARSIERVIDVEWGQPRPAVSAAVYPVNVAVQAADRQGLLRDISEVFAREKTNVIGVQTRSVKGTAWMTFTVEVTDAIRLNKVLGIVADVPGVRSARRP

SEQ ID NO: 3973 - protein, 762 aa, Methylibium petroleiphilum PM1
MKTVPADAALETAPIVLLAGDVAGEEALAPGQPAGDAASQDAVLARARAFAEPLLAGERFDTGEDALAHADGVAAILQAIGAAPTMRAAAYLVYAGDYLAKPEEVIAKAYGDSYASLVAHTRKLVQVQRSAREALGDAALDAAQQAAQVERVRKMLLAFSRDLRVVLLRLASRLQTLRYYAASRQACPQALARESMQVFAPLASRLGIWQIKWEIEDLAFRFQQPDEYRRIARLLDEKRVEREQVVEAARARLVTVLAEVGVRAEVQGRPKHLYSIWKKMRGKHLDFERVLDVRALRVIVDDVPACYATLGRVHELWRSLPEEFDDYIARPKANGYQSLHTVVLDEQDRPIEIQIRTTAMHEHAESGIAAHWAYKEAGARGYAGVSAGGDFEEQVAQARKAVLRQLLAWERELVEPGGDGAVGAGQGLFDDRIYVFTPQAAIIELPAGATAIDFAYTLHTDLGHRCRGARVDGAMVTLNTPLQSGQTVEIVAVKEGGPSLDWLNGELGYLRSSRAKTKVRAWFNALTQQHTIARGREAVEKLLQREGRTAIKLDELASQLGFRNAEALFEVVGKDEYSLRNIETLLRPPEPLPDPDEALAQRLRRGPSSDATPKGGVLVVGVESLLTTLARCCRPAPPDAIGGYVTRGKGVAIHRTGCSNFRQMAGRSPERVISVAWGRPRGDAPSVYPVDVAVEAADRQGLLRDISELFAKEKMNVVGVHTQSLRGTAWMTFTVEISDSARLQAVLGSVCQVSGVRSARRR

SEQ ID NO: 3974 - protein, 676 aa, Polynucleobacter necessarius asymbioticus QLW P1DMWA 1
MANTPSQSDKTAIFKDAWFGEPAESHAAAVTKILQSLNLDEATLIAASNIARTHGKEALTKLIGDEPAKLLIGYRGLRQAQAKLVRDDGGLSVSGQEEMLRKMLLAFGDDLRVVLIYLASRLETLRWVTQEKMAMSVTWAQEILNIDASLANRLGIWQMKWEMEDLAFRALSPETYREIANMLDAKRIERQAFIERIVVQLQEEIKTARIDGEVLGRPKHIYSIWKKMQGKSLDFANLYDVRAFRVLVEDVKTCYAVLGIVHNIWQPVPREFDDYIARPKPNGYQSLHTVVMNEDGAAFEIQIRTHEMHQQAEYGLAAHWRYKEGAYTGMATPANPAKTNKPNVSHQQGTHSAEVAYERQIAWARQLISWKEDAWEQLKHHEIDDHIYVLTPLGKVISLEKGSTPIDFAYAVHTNLGHRCRGARVDGAMVPLETALQNGQTVEIIAVKHGGPSRDWISPDKNYLRSQRARQRVRAWFNALDDEEGGLVAKTSDKTDISAEQKPTPSAPEIVLRNSSRKIGQGGDVLVVGVDSLLTQLARCCRPVPPDAIGGFVTQGRGVSIHRRSCKTFRGLLERAPERVIQTAWTASAADPVVNSEQKRVFPADLVVSGVDRPELMRELFEILTRQGVHVIDLRKSAKKGLAQILLTVEIKDSEVLRVVQNSLEEVKGVTQVRRR

SEQ ID NO: 3975 - protein, 749 aa, Delftia acidovorans SPH-1
MKTASSEAAVQAPSPAAAAQGQVPAVLPHLITATSQTLPEQVNALARARSFAEPLIATETMESGENTMAHADAVAAILKTIGGSETMQAAIYLVHASVHLNRPQEVIAKAFGENFATLAVETNKLMRVQQQARGAELGGQYLDDEATQTENVRKMLLGFSRDLRVVLLRLASRLQTLRYYAASKRPVSPGIAREALTVFAPLANRLGIWQIKWELEDLSLRFLEPETYREVARLLDEKRVEREAYMEQMRARLEADLRAHSISATVQGRPKHIYSIVKKMRGKSLNFDQVFDIRAMRVVVPTIKDCYATLSWVHEQFTPIEAEFDDYIAKPKPNGYQSLHTVVRDETGRAIEIQIRTQAMHDHAEHGVAAHWAYKEAGTKGYAGVTASSEYDAKIAVLRQLLAWGSDLAGAHHRGLFEDRIYVLTPDAAVIELPQGATPVDFAYSVHTSLGHRCRGARVDGAMVPLNTPLQNGQTVEITTVKEGRPSRDWLNADLGYLTSNRAKAKVRAWFNAQATHETVARGREAVEKLLQREGKTAVKLEELAVQLGFKSADALFEVVGKDEYSLRNIETVLRPAEAEEEVEEFSPVRKARGTDSPKGGVLVVGVDSLMTQLAKCCKPAPPDDIRGFVTRGKGVSVHRSDCSNFREMAARNSERVIDVAWGQPKAATVASAVYPVDVSVEAADRQGLLRDISEVFAREKTNVIGVQTQSVKGTAWMTFTVEVADSGRLSKVLGIVAAVAGVRSARRR

SEQ ID NO: 3976 - protein, 758 aa, Leptothrix cholodnii SP 6
MKTTRLDVGAESASPILQLADAVGTAGQPDAGQETERLERARAFAVPLLSGHRFDTGEDALEHADGVAQILKSVGAAPSMQAAVYLVYAGDFLTDPETVVSQAFGPSYASLVTHTRKLVKLQRSARDALLEETDQEVLAEQLERVRKMLLAFSHDLRVVLLRLASRLQTLRFHAASRTPCPRALARESQQVFAPLANRLGIWQIKWELEDLAFRFLQPEQYKRIARLLDEKRVERETGIERAREHLAQALAQAGVQAQVQGRPKHIYSIWKKMQGKSLDFSRVFDVSALRVIVADVRDCYAALSRVHELWHALPDEFDDYIARPKANGYQSLHTVVLDDEQRPFEIQIRTREMHEHAESGVAAHWAYKEAGSKGYAGVSAAGDFEDRVALARRAVLHQLLAWERDFAGQSAAQAAGLGGQGAGAGFFEDRIYVLTPQGSVIELPAGATAIDFAYQLHTDLGHRCRGARVDGALVPLITPLKSGQTVEIVAAKEGGPSLDWLNPQLGYLQSHRARAKARAWFNARALQDTVARGREAVDKLLQREGRTAIKLDELATQLGFRHAEALFEVVGKDEYSLRNIELQLRPPEPVVEDDTPVFKRSRSHAGGGNGVLVVGVGSLLTQLAHCCRPAPPDVIGGFVTRSKGVAVHRKDCLNFREMVARHPERAIPVTWGSQGASDGRNAVYPVNVSVTAVDRQGLLRDISEVFAKEKMNVTGVHTRSVKGTAWMTFTVEVADSALLAHVLSLVASVNGVRSAQRR

SEQ ID NO: 3977 - protein, 678 aa, Polynucleobacter necessarius STIR1
MANLPSTPAKSATIVDAWFAEPAELHAAGVLKILLQTLNLDDATLTAASNIARTHGKEALIKLIGEEPAKLLIGYRGLRQAQAKLMRDDGGLSVTGQEEMLRKMLLAFGDDLRVVLIYLASRLQTLRWITQEKIKMSAAWAQEILNIDASLANRLGIWQMKWEMEDLAFRALSPDTYREIAKMLDAKRIERQAFIDQIVLQLQGELKLSQIEGEVLGRPKHIYSIWKKMQGRSLDFANLYDVRAFRVLVDDIKSCYAALGIVHNVWQPVSREFDDYIARPKPNGYQSLHTVVMDDDGTAFEIQVRTHEMHQQAEYGLAAHWRYKEGAYVGMATPPNPTKSNKPSINHQQGTHSAEVAYERQIAWARQLISWKEDAWEQFKHHEIDDHIYVLTPLGKVISLEKGSTPIDFAYAVHTSLGHRCRGARVDSAMVPLETSLQNGQTVEIIAVKHGGPSRDWISPDKNYLRSQRACQRVRAWFNALDDEEAGHSNKVIDSKQEVSPEIKAVPIAPEIVLRSSTHKSGRSGDVLVVGVDSLLTQLARCCRPVPPDAIAGFVTQGRGVSIHRRSCKTFRGLLERAPERVIQTAWTASVADPIINREQKRVFPADLLVMGLDRHELMRELFEILTRQGVHVIDLRKSAKKGLAQILLTVEVKDSEVLRVVQNSLEEVKGVTQVRRR

SEQ ID NO: 3978 - protein, 747 aa, Diaphorobacter TPSY uid29975
MKSSSIGHLPMGQGAAAGPRPEAVPQLIAATAQAGPEHADALVRARAFAEPLLIGETLETGENTLVHADAVSAILKHLGGSETMQAAVYLVYACSHLNKPEEVITKAFGSNFAALALETTKLMRVQLQAREAQVTGQQVDDAATQTENVRKMLLAFSRDLRVVMLRLASRLQTLRFYAAAKRPVSPAIAREALQVFAPLANRLGIWQMKWELEDLAFRFLEPETYKEVARLLDEKRVERELYMEQVRSRLESELRARSISASVQGRPKHIYSIVKKMRGKSLNFDQVFDIRALRVVVPSVKDCYAALSWVHSQFKPIEAEFDDYIARPKPNGYQSLHTVVRDEAGKAIEIQIRTQAMHDHAEHGVAAHWAYKEAGTKGYAGVSASSEYDAKIAVLRQLLAWERDLVGSASRSGLFEDRIYVLTPDAAVVELPQGATPVDFAYAVHTSVGHRCRGARVDGNMVPLNTPLQNGQTVEIITVKEGRPSRDWLNPELGYLTSNRAKAKVRAWFNAQATHATVARGRELVEKLLQREGKTALKLDDLAVQLGFKSAEALFEVVGKDEFSLRSIETLLRPPEPAVDEPDVLLKKARTPDGAPKGGVLVVGVDSLMTQLAKCCKPAPPDEIRGFVTRGKGVSVHRADCSNFREMAARNAERVIDVEWGKSQRAAGEAAVYPVDVAVEASDRQGLLRDISEVFAREKTNVIGVQTQSVKGTAWMTFTVEVSDAGRLNKVLGIVAAVQGVRSARRR

SEQ ID NO: 3979 - protein, 747 aa, Variovorax paradoxus S110
MKRESSSLQTAHASDTAVVDYPLSAATADRTPVMENMLARARAFAEPLIADEKLDTGENTLAHADAVAAIVAKMGGSEAMQAASYLVYACQHLNRPQEVIAKVFGDNFAALAVETTKLVRVQEQARSASQGHHLAEGAAGAQTENVRKMLLAFSRDLRVVMLRLASRLQTLRHAAASKQPAPESVARESLQVFAPLANRLGIWQVKWEIEDLSFRFLEPETYKLIARLLDEKRVEREGHVEQLRSQLERELQAEGVRATVQGRPKNIYSIVKKMRGKSLDFAQVFDILALRVVVPDVKDCYAALAWVHSHFLPIDEEFDDYIARPKPNGYQSLHTVVREMVDGKPGKPIEIQIRTEEMHDHAEHGVAAHWAYKEAGHKGYAGVWASGEYDAKIAVLRQLLAWERDLSGGSQGQGLFDDRIYVLTPDAAIVELPQGATPVDFAYTVHTTLGHRCRGARVDGAMVPLNTPLSNGQTVEIIAAKEGGPSRDWLNAELGYLASHRARAKVRAWFNAQITHETVARGREAVEKLLQREGKTSTRLEDLASQLGFKSADHLFEVVGKDEFSLRNIEVLLRPPEPAPNPDDGVQIKKPRASEKSGKGGVLVVGVSSLMTQLAKCCKPAPPDAIRGFVTRGHGVSVHRVDCSNFRMMASRDSERVIDVEWGAAKGGEAPVYAVDVSVEAADRQGLLRDISDVFAREKMNVIGVQTQSVKGTAWMTFTVEISDAARLTQVLGVVTAVAGVRSARRR

SEQ ID NO: 3980 - protein, 1439 aa, Dechloromonas aromatica RCB
MPRGISFRKPGFASSLVLRIGLLILLSLAAFTISLYYLIGRPTVDRLAETQMLLAAEQLEARYTRLLKTVEITLRSSQGWGKNSDIDQTRLLHFNEFFFPIIANHGEITSVIFAHESGREILLLMTDDGRWINRISNPADWGNQTYWITWDKNRQIESVEMRERNYDARERPWFKGAMGLPDEQSVFWTEPYIFFTTKEPGITAAMRWQAEDGSSYVIGHDVRLIDIAEFTTRMTVGSHGKAGLFLKEGKLIAPPRDPRFADRNAINQALLKTSEELELPEFAEAFRLWQMDPHPLKRLHSFDRPDGRWISFFQPISGNTSGISLGVVAPESDFVPISSQDLILLGLITLSALALGMAVAIRIANRFGEPLIALAEDSSQIGSMNLDKPVTTDAPWREVIQLAAALEEMRQHLQSSRRTLEDTNIELELKVAKRTLALRQNQEILQKREAFFRAIFDNAAVGIISLDPERKPVLVNPAFAKFIDQPINTLLSHLENIALPKEVLGRINDLLGQTGSAQQQSLRNEFEFIDKNGDTHWGDVQIAAVRDENGELDSLLITVLDVSDRREIEAELIRQFSFLQALLDTIPNPIFYKGANTHFLGCNQAYEAFFGINRREFVGKRVVDLEYLPEDTRQAYQTEDEQVIEAGSRISREVSLPGADGKLHDVLYSVSGFHSPDGRPDGLIGVIVDITALKEAEREADRARATAESAAAAKADFLANMSHEIRTPMNAIIGMTHLALQTELNSRQKNYLTKVDNAAKGLLGIINDILDLSKIEAGMMHFEHAPFSLDASLERLSDMCSLKARERGLELLYDIAPEVPDQLIGDSLRLGQVLLNLVGNAIKFTEAGEITVTVKLLANRENEVDLGFEVIDTGIGMNVEQQSQLFSAFTQADTSTTRKYGGTGLGLSICKRIVELQGGSIGVSSQPGIGSRFTFQLQFGRATEQTGTPRRIGLPNNLRALIVDDSHGACEVFLHMLTVFGIDCHAVRSAPAALLELAAAAETGQAYGLLIIDWKMPDMDGVELVEKISQSNGPERTAAIVMATAYDHEELLAALGKHPVGAILSKPATPSSLFDSIMVALHREPTTQMVPNITPTMLSEQFAGRHILLVEDNEVNRELAEEMLGNIGLLVDTAENGQQAIDRIRQNAYDLVLMDCHMPVMDGYTATEYIRHELKLPQLPIIAMTANALHSDREHCLAVGMDDHIPKPIDVAVLHATLLRWLSQAGERTSPSPLPAASRDLTLPAGEIDTATALARLGGNRSLYDRLLLRFQENQGSAIECLAADRTRGDSAAMILRAHTLRGLAGNIGATGLSRLAGDLEERLKQNASVKEAGIENLLGSLAENLPKVLAAAEKLRQETPQITPAPLQEAQQGTLSELQHLLDNDDAAAVRYFEQISAWLKQEFEPRLVDQLARQINQYEFDVAMETLQQMTINRQQV

SEQ ID NO: 3981 - protein, 1118 aa, Nitrosospira multiformis ATCC 25196
MTIRKMSYIFYLVTGVLISLLTLFVALRFFELRKLNEAENVRYAGFLAVDELRQSSDDLTRTARAYVATGNPKFEQIYFDILAIRNGDKERPLHYERGHWDLILGHLNPESAPGRRISLRSQIRKLGFTATELAKLTKAENRSNQLTEREYKAFNAMKGLFQDSAGEFGVKGAPDAALASSLLHDESYHTAKAEIIRLLNEFHELLDKRTRNTMALAQNRANLYISGVFFMLAFLMAWFAFSYRVVHRKVQNLAWLEDKARNIGEASNSPSFYIDSNDEIGSLSRAFIVAQAERDRYFNQSLNFLAISGFDNRFKRVNTAWTKVFGYSEEELLSKPFMDLVFSGSRADTAAELDKLVMGSNVSFESQMRCKDGSFRWVLWNIAAAQDVREFYFSGQDITARKNIERELQNARKAAEAANRAKSEFLANMSHEIRTPMNGVLGAVGLLLNTTLTPSQRELAGLARASGETLLCIINDILDFSKIEAGKLVISPVPFDLLQAVEEVAGMVAMQPARKANVNVIVRYLPNVPRYVFGDLGRIRQVLINLTNNAIKFTDKGHVLIDVEAEALSEDEVSLRISVEDSGLGIAPDKLQSIFDKFTQADASTTRRYGGTGLGLAISKQLVQLMGGTIAAKSRVGAGSTFWFTLPLALQKNWPTDAGLHIDLTHVRVLIVDDNAANRLVLQEQLRSWRMRIGSCPSGAEALRALHTSHASGDPYRIAILDHQMPDMDGEMLGRTIKADPLLRSIHLVMLSSLGQEGDLRERLQKIGFAAYLVKPARQSELLSTLVNIWDAQRHQRTINLISQPFFPANPEMQAADSSNGLFAGTRVLLAEDNATNQIVGAMILRNLGCLVDVATNGREAMEMVDAFLYDMVFMDCEMPEMDGFEATAALRRRPDSKSRLPVIAVTAQAMQGDRERCLRAGMDDYISKPVKLEDFAAALKRWMPGREQGQKSETSPTARHEKSMADSTPNHSPPIVPSSLPVSSSLSMSSASSALNAEVVARLRSLAEATDPSLITQIFTSFLSDGAKRIDALKEALAGGNMELLHKTAHAIKGASANIGAHSLTDMAQKLELAGKAGDMTGAVTLIEQIEMEFGRVQHEITQSELDCVALPDATRP

SEQ ID NO: 3982 - protein, 1763 aa, Shewanella amazonensis SB2B
MQENTEKLSTFRSRILFQIAVPLIIIMTGVSGVTGWLNYKAEEKAFFADLAEKADFAAKRLEFELTLAQQDTQTLAFTLGHLDAKAQLQQAPFLYQLLTDRLARNDSFYGSAVAFVPGFTPGQERFAPYVFRQDLTIATLDIGKEAYDYTNGEWDWWTEALKRPKGYWTAPYYDDGAGNIQMITFSQPFGDEEPLGVVTTDLALSSLPIRLGIDPKKLLVLDARGTLIYHPDNNLTRNATISDWLVKDVASEEAAKKVLEGEAQEVALKDLNGVQYLASIAKVSPLAWRVLVITPQTELVETFLKGFSSLTLSLLVLALILLVTSYYSAKRLTEPLEALETGIVDFSKGLIKRLQKPEGVVREIATLSHKFNEMAEVLEEREQALLDSRGNRFATLIDGMSDKSFYCSMTPDGNIDQVSAGVEKVLGISPEVLKRKYQRLFSSNAINEQNWQFMEMALRGEAVPPHQVEMAGADGSLRRLDLFMQPLLDDEGQLISVEMLFNDVTEQFSAAAWSNAVLEAAPEAMLIVDESGQLVFSNSRCQELFGYSGEEMLNLNIDALIPENERHGHQGKRQLFIEGGRDKVMANGKPLHALKCGGEQFPVQIGLSLLPADSRGQRQVAASIRDLTEQLAVERQIRESESRFRGLVSNIPGAVYRTRINGTWTMEYVSDNITELTGYPAWHFIESKKRSFGSLILDEDAERCDAIISGALAEQHAFEVEYRIRHRDGSLRWVHEKGKASYDEDGNPVWFDGSLNDITESKLAQERIEQSREQLETITESVPSTVYQLVWRSERDRRFTFLSSAAMATLGFHRNEVLDNFELVAERIVEEDRGEIIQMLAGRHGMQWTKAFRYHFPSGELRWLEAGARGSKQQDALVWNGYLMDISGRKRMETELAQSEAHFRALFDNAGIGIVNLDDRGIIKDCNGQFVSDLGISSDSLKRKQLADLMHPEDRALATGLYQALAESEQGSISGEWRMLDGDGELMWMAVIASVLEEGDGGERSVVMSIANITRLKLLSDELMAAKEDADAANQAKSDFLANMSHEIRTPMNAIIGMSQLCLQTELDRKQRNYVEKIERASKSLLGIINDILDFSKIEAGKLDIEVVPFQLDTILEDLGDMFSVKAADKQLELLFSVAPGVPTHLEGDPLRLSQVLINLMNNAIKFTERGEVMLSISELARDEDQVQLKFAVRDSGIGLTAEQQAKLFKSFSQADTSTTRKYGGTGLGLAICKQLVELMGGEIGVDSQFGNGSTFYFTVSVKVAQNAQLNVEQELEGMAVLVVDDNSTARDILRTTLQSMGFSVDSARSGMEALEKCAERDYRIALIDWKMPEMDGTETAARMRELKQPPLILMVSAHANSEFIDKVEEMGINGYITKPISASRLLDGIMSALGRQGHKPVRRKAQPMDAQKLSGLKGKRILLVEDNEMNQEVASEFLEQVGVVLSIADNGQIALEKLGQQSFDLVLMDCQMPVMDGYQATRELRKLPGLAELPVVAMTANAMAGDKEMCLLAGMNDHIAKPIEVGILYQTLLQYLCPEAKGLESADADAAADQEVTSLTSWPEHEDLDIDRGLQLVQNSERLYRRILERFVTSQAQAGKKIRKALALGQQEDAVRLAHTLKGVAGNLSADTLVEEARQLEAKLAQGEACEAELEAVETRLVTIVAAIERWMTEGVEEQGVESGEPLSADALKEVLNTLVTQLEDADADAVSTLESLSGQVVAGIWARLKPVSQMVAGYQFDDGADLVRELIQELETDGESA

SEQ ID NO: 3983 - protein, 1266 aa, Halorhodospira halophila SL1
MSESAPHSDRRADEWRILFDHLPDATLLIAPDTGRVLEGNPAAAAHLGYTPEALRGLTIADFEAAETPAEIAAHIEKIQRAGRDDFESQHRRRDGTLVDVQITVSQVEFAGHPRLLAVFRDITERKETIRALRTSEQRFLDVVDAAGEYIWEIDRDGTYQLVTAQIEPLLGRSTAEIIGRSPVDFMPSAEAERIQTMLSERAQTGAAWQGLEHESVRPDGTRVWQRVSGLPIFNEAGELIGFRGTGRDITAERQAQQNEKRLNERLRLATTAARIGVWELDRATDRLEWDAGSARIFGTDPAAFNHRLANLQATLWDENRTIAEGLIERSLHSAEPCEAEFRIRRKSDGAIRHIRSVSLSIPDEHGQVQRLVGINEDITDRVQAREQLAAQEARFRGLFELAPVGLAMTDFETGAFLDFNDQVSEAAGYTREAFAQLTYWDVTPREYEPKEREHLEAMARTGYYGPYEKEFIHRDGHRFPVLLNGFRMTDPQTGRVVVWSVIQDISERKAVEQALHQAKEAAEANNRAKSDFLANMSHEIRTPMNAVIGLGQLLIETDLDPVQRNYAEKMHNASRMLLGIINDILDYSKIEADRLTLDPHPFDLHELMDQMATLFGDQAGEKGLELFLRVEPTIPSSLEGDALRLSQVLSNLLSNAIKFTKHGQVGLSITQLGQDPEGVRLHFQVEDTGIGITPEQQRNLFQAFSQADTSTTRNYGGTGLGLVISQRLVAHMGGELRLESTPGEGTRFAFELHLPIAGTGPWTLDAPSLPGGHVLVVDDHDVARQILREYLEAWGYTVTEADSGPAGIEAALAAERSRQPFDLMLIDGHLPGEADGWGTARRLRTLHERGDLPTTRGPMILVSAYQLDDRSVGDPFDGCLPKPVTASTLFDVVQNTFVGAPAATPVTTSGAIPNLSDRSLLLVEDNAINQEVAQRLLEQTGARITLASNGAEAVAWTREATFDLILMDLQMPVMDGYEATREIRREHPNLPILALTAAVLDNDRAGARDAGLDDHIGKPIDSRLLYQRLVHWLGAEGTASPSVNGPTPPGADGEDAALPEQLSGIDQTTGLRHLEGDRAFYRRLLQRFASQLEGELGQLPAALDRGDPETARRVAHTLKGTAATVGATRLAEAAAGVDRCLKAGESVSDELHRELRAALDEVSAGLEVLADAATTSAPQPPLDATAAREALNRLYTALRANELVDEALVDAALHHLRALSDEATVRRVRQQIDQFDYDAATEVLAPHAALTPDSAASGESPPARDR

SEQ ID NO: 3984 - protein, 1582 aa, Shewanella woodyi ATCC 51908
MDKLLQIALLVVMLLALCVVFWRLRLLTIKDKEKFSGYARYGRLAGAGVIIFVTIIFLIAKIGLIVADKNDREKSGQSLLGVVDVADAAIEAWVSGWEDRILSVAFNPILHSHVEDLLHAPRDRESLLLDSDVEWARSAYFRYSKPFGTMGFFIIAPDGINLASNRDANLGLINIVQTKYPELLASAFNGEIVITPPMHSDVELETPDGSFNKNTPTMFVMSPIEFVNGTIPAVLALRINPYKEFSKLTSSAHVGDTGDSYFVDDRGRLLTESRFNSKLVDLGLLKKGQTSVLNLTSQIPKSSYEAAGITPSSSDQVHLTESAKQIRDHLDGEDFSGYIDFKGDKVIGAWRWSDKYGFGIVSELTLKEARKNYTSFQRIVYSMFAVVVLLVCIIFMGSVWVGRRIHEQLKAVNEKLEDRVNTRTLELQERETRLWDLYEHSPVAYASLDIKGNFIKHNLAFAQLTGREREEFSHLKFNDVIKHSEEFTQELLDHVLSGEVTSDIRVELFRDDKQKKFASMTVISKLDEQGKLEDIRLSLLDVTQREMVRKELKYNQAQFSSMVSNIQGAVFRYRLSEDWRTSEMLYTSPKMAQITGYEIEFFLGDAPQVNLFDLIHPADVDEFNLQMESSRLDGSSLRADVRIINASNIERYVQFRALFSVNASGSAEYLDVSIFDITEQKSSELKLHESEERLDVASSSAQLGMWDSFPLESKVLINHVCVTMLGYKMDDLCISNDKWSELKSGNRTWLGLIHPDDRELYTELIEAHITGNEEIYRQELRLLNHSGQYEWMLSVGKVFERDNQGRAIRISGINVNIDAAKQLEKELELSKQKADSANRAKSDFLANMSHEIRTPMNAIIGMSHLALETDLDRKQRNYIDKVNRSAESLLGIINDILDFSKIEAGKLDIEKIDFSLEDVLEDVSDLVGFKAKDKGIELLFNTESSLPFYFNGDPLRLSQVLTNLSNNAIKFTEQGEVQIKVYAHSINETNIELAFEISDTGIGMSKEQQLKLFKAFSQADSSTTRKHGGTGLGLVISQNLVELMGGVISFESEEGVGSCFKFILPLTPASALETQSFDKVSLENIHVLVVDDNANAREIFANMLEGHGISYSLAANGQQAMALLEQEGASYQVVLLDWKMPGMSGVDTARAIQESSLITEKPKVLMVTAYGREELINLSQGVNFAGVLTKPITSSHLLNTILESLGREVNKRSKSSAKEMMYRAALKQLAGAHILIAEDNDLNRELIVDLLSNNQITSVVAMNGQEAIDCLLKESFDGVLMDCQMPVMDGYTATKKIREVEGLSALPIIAMTANAMAGDREKAIGCGMTDHISKPINVQNTFITMANSIKPKHPVKVQDEVADNAHKELGCDIEMLQFNSIDTKSGLERTQGDGALYRKVLKRFNGSTDSFESDLMQALTQTDLIAAERVVHTLKGVAGTIGATDLAIEAAQLESCVKQRSVADTEMVALNAQLEKVKAQLKEVRSELADYFDGFSEAVASQPSEDNLSDDEVRDKLNRLDTMLENYEAEVGDFIFDELYFLKGGSLDKAFNELSKQIENYDFEAARAVVASMLSSLNEKLD

SEQ ID NO: 3985 - protein, 1548 aa, Desulfovibrio vulgaris  Miyazaki F
MPTPPGPMLFRHLSVFQRLLICTLLIVAFSIVLGYSTLSLMRDMAEDANTVYRHTFIATSSLQQAKESVERMRAAMREQIIEVDEAIKAEQVATLRREERLFHDCVEAVRANFRGEPALIDALASHYDDFLSMRDRAMTMSENREIQEAWRLTESSPQNPADRLLHAIDDLMHAARATAEHFFQSSVAENRTTQLKAIAASGLFCAMVVAITYLVSWSIRRRLLALTGCVKALADGDLDVQIPYGEERNEMGAMARSLQVLLGVSRQMEQQRWIKAQMSETATTLQQAGDLDSFGQRLSAVAAQVSGAPYAALYVPNDDGVHLDLVASLGGIVGGPPASIPKGGGLVGRCAATRAPVELTPPEGETLRFATGLGDVHPASLRAYPLLLGERLLGVLELATLGPLPPRAATLFEDMLPMAALSQEVLERNLHTRSLLDQTRRQATELEESRELLRRSEAFFRAVFETAGIGIVSERRGLGIDRANPAFSDFIGISEPELRGRDLEDFFHPDDREALEALLSRLDPDKLEYAVPRHGNPERDGLDAGEPDQARSTITVRAEHRYLRPDGEVRWADVRCALIGDRDITPRRVTLINDITELKEQQAELKDTEAWYRGIVHSAPDAMVVVDGEGRIVLCNPQLERLLGYEMGELTGHLVEQFLPEEVRERHVKLRNDFLASPLQVIGHEREVIGVRKDGTRLPLEISLSKLPPSDRHPMSACGALRDISLRKRSEAELRRAKEMAEEATRLKSDFLANMSHEIRTPMNAIIGMAHLALKTELDPRQADYVRKIRASGQHLLGILNDILDFSKIEAGKLTVENTEFELETVLDTVANLVSEKAATKGLEFVLDVAANVPPVLRGDPLRLGQILINYANNAVKFTEHGEIVIHVETLETGDTDVLLRFAVRDTGIGLTDEQKARLFVSFQQADTSTTRKYGGTGLGLAIAKKLADLMGGGVGVDSVPGGGSTFWFTARLGLGSGRRALLPRIDLRGLRVLVVDDNPQARMVLAHMLEGMTFRPVMADGGETALDLLREARDADTPFGMVFLDWQMPGMDGLETARNIRTLAPDLPVAIVTAHGREEIFAASEGVGVSAVLVKPVQPSLLFDTAMRLLGAVHPAPRAAVPPPDTRPAMLDGVRGSRVLLVEDNELNREVALGLLAEAGLVPDAAEDGAQAVRMVMEGDYDLVLMDVQMPVMDGYEATRIIRRSREADSLPIVAMTANAMRSDREACLAAGMNDHVAKPIDPDELFAALIRWLPRRGEAERQQDAADTTAPGTQPATQADTLSGASPDTSPASGPVRQHGQNGQGRQNGQNDARHVLDPEAGLRRVLGKQATYHTLLRRFVSQHADAATRIAGFIQSGDGAGATREAHTLKGVAGTLGARAVQSQAADLEAALRHAASQEHTTEVLALLRISLDEAVRAMHRLLDATRPDPNGAAPGTVPDAPVRRDAGSGDAAGDGHEAGQDTGPERNLADSDLSRALPEGLLDQLETLIEEDDSEAVDLFNTHSEALRAALGQPLVTGMGEALRAFEFETALEMLRSARPPHDG

SEQ ID NO: 3986 - protein, 866 aa, Thioalkalivibrio HL EbGR7
MNDPRQRPSGSGQASPSALAMIRQRLASRADSEHQQALLRLVIGLAVFVYFHSPLFAAVVDPPALEYARLGSTLFLAFSLGIFLAILLWPEPSPSRRLLGLAGDMTGASLSLLLGGEAGAPILAVYLWVIVGNGFRYGLPYLYAATVMALAGFAVVFTLSPFWSTHPVFSFSLMLVLILVPLYTATLLRTLKGAIDRANEANQAKPRFLANMSHELRTPLNGVIGMSDLLMDTPLNDEQRDLGRSIHTSARVLLGLIENILDISRIESGKLSSEREDFDLHRLVHGTLGMFEAQARGKGLHLGARIDPSVPFALHGDALHLRQVLVNLIGNALKFTERGQVELSVQLLEAPAEDAVRLRFKVRDTGIGIPEEAQARIFESFEQADTTVTRRYGGTGLGTTIARQLVQLMGGTMGLESRVGEGTTFYFDLPLGRQAIPEEASHGALASEGSRVLILAEDKLAAGLGELLTGWGLVPESAESPPQALARLFHGGENPSEPHAVVLVQRRMLGADPAHFLGLLRQDASLRRLPLILLDEGAAGPAQDVWLRAGYSAVLGAPPDKTLLFNALHAAQSATEPAENVVSLADHYRSRAGGVRALRILVAEDNTVNQQVISGILERAGHKVTVVGNGEAALDLLSARARDFDLMILDMNMPVMGGLDVLKARGFMAEEARLPAIVLTADATTEALVACREAGAEAYLTKPLDARRLLDTVAGLALQGATRPATLETRPEPAAPQTATKEVDVLNSEVLDSLVRLGSGPVFLMDLLDGFRRDGEQQLADLRQAVTMNDYPRMRDALHALKGSAGEMGGALLVRLCQAAEGLKPYELGTDKPATYVTHIEQAFRETCAGVDAYLRRRRGDADALT

SEQ ID NO: 3987 - protein, 1030 aa, Azotobacter vinelandii DJ
MDLPGKTTGTDAKIPGANVKLGKPSTLASLLAVLLLLFSSLNAVRTVLLAQERREVLQALAHGVGSPATTGDGRDPEAFQAGEDIARGKALERLAARLERLDGQVDSAMRIVAATLLPGLLLAAFALHGRHRRRSPRDQPRTPPEQAGSDESELQRVLFDSIPFPLFVKDREARYIRFNRAFLNNFRVRAEELTGKTILDFLELPAEERSRYQAASERLLREGGLFSTERRIRYADGREHPSIYTLAGYPGGDGRPAGLLGMLIDISAQKASERALAEAKELAEEATRMKSDFLANMSHEIRTPMNVIMGMTQLALDSGLDERQRNFVEKAHDAARSLLGIINDILDFSKIEAGKMRFEQVDFQLESVTDHLADLSVLKAQEKGLELLFDIATDVPTALIGDPLRLGQVLSNLLDNAIKFTSRGEITLRIRKECEDERGVRLRFEVRDTGIGLNETQRRKLFRAFTQADSSTSRQYGGTGLGLAICKHLVAMMDGEIGVDSSPGVGSTFHFDARFERQANQRELLADSADLLGMRVLVVDDNASALEIFAGMLSALRFAVTTADNAPQAIRLLERAQQEDNPYRLVIMDWLMPGMDGVQAVGAIRAAPRIAETPLFVMVTSYGRDELLERLGKVPVEGLLVKPVTPSSLLDGILDACSRRMRTAPNSRKALESEAEQAREALRGVHLLLVEDNPVNQEMAMELLATAGIRVDVANDGAEAVGKVMAHAYDGVLMDCQMPVMDGFEATRRIRRAGLVDLPILAMTASTMAGDRERCLAAGMHAYIAKPIDVAQLFVTLRHWVGSGRPLALPAPLAIGGSVPTASANTALERAGALRRLGGNRALLDRLLARFAATQADAAARLGAALAAGDREGARRIAHTLKGLAGNIGATELATQAATLEQCLGQNRQPPAETLDDLERTLGALCASIAAPAAGNPAPIVAETPQELSALDEGLRTLEALLRDDDADAVAQLRALGPRLAARGLGERAGELQALVARYDFEAALASLAAIRRNLAPRDAEAAGPQRPRR

SEQ ID NO: 3988 - protein, 558 aa, Brucella suis 1330
MARSNTTEFVFLPLGGVGEIGMNLAMYGFGPADNREWLVVDMGVSFAGPEQPGADLILPDIRYLEAEKHNLRGIVITHAHEDHFGALLDLWPRLKVPVYATPFTAGLLEAKRQSEDSAPEIPITIYKAGETFEVGPFKIEAVAVTHSIPEPVSLAITTPLGTVVHTGDWKMDPEPSLGPVIDEARFRAIGEAGVLALICDSTNALREGESPSERQVGESLRELIQNARGRVAITTFSSNVGRIRSITEAARDAGRQVLVVGRSMKRAISVATELGYMEGLPEYLSEEDYGYIPRENVVMILTGSQGEPRAALAKLARDEMRSLALTAGDTVIYSSRAIPGNEKAILDIKNRLIDRGIKIIGDEDALVHVSGHPRRSELRRMYSWVRPQILVPVHGEAAHLVAQGSLGAMEGIEQIAQVRDGDMLRLAPGKAEIIDEAPVGRLYKDGKLIGDEEEIGMVERRKLAYVGHVAVSVLLDREHKMLDEPDLVAFGLPEEDRQGELMEDILLDAAIEAIDSIPRVRRKDIETVRESVRRAVRAAANEAWGKKPVVTVFVNRIR

SEQ ID NO: 3989 - protein, 557 aa, Nitrobacter winogradskyi Nb-255
MIARPDELMFAPLGGVGEIGMNLSIYGLGNRHQRSWLAVDLGVSFGDEEHLPGIDLIMPDIRFLEQERKNLVGLVLTHAHEDHFGAIIDLWPRLKCPIYATKFSAALFEAKCAAERNPPDIPVTVVPSGGRIEVGPFGVEFIPVAHSIPESHALAIHTAAGIVVHTGDWKIDPTPIIGPPTDERRLRELGDEGVLALIGDSTNAVRDGRSPSEAEVARTIADLVKAAKGRVAVTTFASNVGRLRAVADAAREAGREVVVVGRAMARVVQVARETGHLNGMQDFRSADVYGHLPHDKVLALCTGSQGEPRAALARIARDDHPEVTLNRGDTVIFSSRTIPGNEKAVGAIINGLVAQGIEVITDRTQLVHVSGHPRCDELRDMISWVRPGLLIPVHGEALHLSEHARLARASGVPKVLICKNGDLVRLGPGEPGIIDELPSGRLYKDGAILEDSKSRAVVERRRMAFAGCVFVAIAVTAKGELIEDPEVDLVGIPEKNMAGEVLDDIVFDTVVSTAKGFSRTLRRDPDAMAESLRRAVRAAVAEQWGKKPLCYVHVLVI

SEQ ID NO: 3990 - protein, 556 aa, Rhodopseudomonas palustris HaA2
MARPDDLVFAPLGGVGEIGMNLSIYGLGNRQQRSWLAVDLGVSFGDEEHLPGIDLIMPDIRFLEKEKKNLVGIVLTHAHEDHFGAIIDLWPKLRCPIYATKFSASLFAAKLAAERTTLKIPITVVPSGGRIDLGPFNVEFIPVAHSIPESHALAIRTSAGLVLHTGDWKIDPTPVVGPPTDEKRLRELGDEGVLALIGDSTNAVRDGHSPSETEVGASLTGLIKAAKGRVAVTTFASNVGRMRAVADAAKAAGREVVLVGRAMDRVSQVARECGYFDGVQGFRGSEYYGHFPPDKVLALCTGSQGEPRAALARIARDDHPDVTLNKGDCVIFSSRTIPGNEKAVGSIINGLVNQGIEVITDRDHLVHVSGHPRREELRELISWVRPQLLIPVHGEALHLNEHAKLARQMGVPKVLTCRNGDLIRLGPGDPAIIDQLPAGRLYKDGTILEEEKSRAVAERRKMAFAGCAFVALALTQAGEMVDDPEVELIGVPENNSAGEPLDDIVFDAVVATVEGLPKARRRDPDAVAESVRRTVRSTVQAEWGKKPLCFVHVLKV

SEQ ID NO: 3991 - protein, 556 aa, Rhodopseudomonas palustris BisB18
MTRPDELTFAPLGGVGEIGMNLYLYGIGKGSQRKWLAVDLGVSFGDEEHLPGIDLIMPDIRFLEKERKNLVGLVLTHVHEDHFGAILDLWPKLKCPIYATQFSAALFRAKCEAERNPPKIPVTVVPSGGKVDLGPFNVEFIPVAHSIPEAHALAIRTSVGVVLHTGDWKIDKTPIIGKPTDERRLRELGDEGVLALIGDSTNAVREGTSPSETEVAKTLAELVKNAKGRVAVTTFASNVSRLRAVADAARAVGREVVVVGRAMERVVQVARESGYLDGVQNFRGADLYGHFPPDKVLALCTGSQGEPRAALARIANDDHPQVTLNKGDCVIFSSRTIPGNEKSVGGIINGLIKQGIEVITDRTHLVHVSGHPRRDELREMISWVRPQLLIPVHGEALHLFEHAKLARACGVPKVLTCVNGDLVRLGPGDPAIIEQIPSGRLYKDGNILEDAKSRAVVERRKIAFAGCAFVAIALDAKGELADDPEVELVGIPEKNTAGEPLDDLVFELVISTVETLPKAKRRDPDAVGESVRRAVRSALNEQWGKKPLCYVHVLTV

SEQ ID NO: 3992 - protein, 556 aa, Rhodopseudomonas palustris BisB5
MARPDELTFAPLGGVGEIGMNLSIYGLGNRHQRSWLAVDLGVSFGDEEHLPGIDLIMPDVRFLEKEKKNLVGLVLTHAHEDHFGAIIDLWPKLRCPIYATKFSAALFAAKLAAERTTLKIPITEVPSGGRIDLGPFNIEFIPVAHSIPESHALAIRTSAGLVLHTGDWKIDPTPVVGPPTDEKRLRELGDEGVLALIGDSTNAVRDGRSPSETEVGASLTGLIKAAKGRVAVTTFASNVGRIHAVAQAAKAAGREVVLVGRAMDRVSNVARECGYLDGIQGFRGPEYYGHFPPDKVLALCTGSQGEPRAALARIARDDHPEITLNKGDCVIFSSRTIPGNEKAVGSIINGLVNQGIEVITDRDHLVHVSGHPRREELREMISWVRPQLLIPVHGEALHLNEHAKLARQMGVPKVMVCRNGDLVRLGPGDPAIIEQLPSGRLYKDGAILEEEKSRAVVERRKMAFAGCAFVTLALTQAGELVDDPEVELIGIPENNSAGEPLDDIVFDAVVSTVEGLPKARRRDPDAVAESVRRTVRSVVQTEWGKKPLCFVHVLKV

SEQ ID NO: 3993 - protein, 557 aa, Nitrobacter hamburgensis X14
MIARPDELMFAPLGGVGEIGMNLSIYGLGNRHQRSWLAVDLGVSFGDEEHLPGIDLIMPDVRFLEKERKNLVGLVLTHAHEDHFGAIIELWPRLKCPIYATKFSAALFEAKCAAERNPPDIPVTVVPSGDRIDLGPFGVEFVPVAHSIPESHALAIHTAAGIVVHTGDWKIDPTPIVGPPTDERRLRELGDEGVLALIGDSTNAVRDGRSPSETEVAKTIAELVKAARGRVAVTTFASNVGRLRAVADAARAAGREVVVVGRAMERVVQVARETGHLDGMQELRSADVYGHLPSDKVLALCTGSQGEPRAALARIAKDDHPQVTLNRGDTVIFSSRTIPGNERAVGAIINGLVTQGIKVITDRTELVHVSGHPRRDELRDMIAWVRPQLLIPVHGEALHLSEHAQLARAAGVPKVLICKNGDLVRLGPGDPGIIDELPSGRLYKDGAILEDSKSRAVVERRRMAFAGCVFVAIAVTEKGELADDPEIDLVGIPEKNTVGEVIDDIVFDTIVSTVKALPRTRRRDPDAMAESLRRAVRAVVAEEWGKKPLCYVHVLLI

SEQ ID NO: 3994 - protein, 560 aa, Rhodospirillum rubrum ATCC 11170
MADNSPPVPPRFEKNALYFVPLGGAGEIGMNLNLYAHQGKWLMVDLGVTFGNETTPGVDIILPDPSFIEERKGDLVGLVLTHAHEDHVGAVAYLWPYLECPVYATPFTAEFLRHKLREEGIEPDVKLIEIPLGGRFTVGPFDIEMITTTHSIPEPNHLAIRTTAGTVLHTADWKFDPEPLVGPPADEAALRRLGDEGVLAMVGDSTNIFTEGHSASEGDVRRSMIDLFARFQGRIAVGCFASNIARMETIALAAKANGREVALVGRSLWRMMETARTCGYLKGCPAFLGDEEAAKLPRDKVVYICTGSQGEPRAALKRIASGSHPYVSLSAGDVVIFSSRVIPGNERSILQLQNQLVEMGVKLITSRDAMVHVSGHPGAEEVRSLYGMVRPSIALPVHGEFLHLDHHADVARDLGVAHVVRITNGAVVRLDGAEPTVVGKVPFGRLALDGDRLLQIDCEIIRDRKRMGYNGSVAVSLAIDDKGKLLGTPKISARGLLDPEDDADEVADLTNRVRGAVNAVRPADRKDDAAVAEAVRLAVRRVFRQGQNRRPVTDIHVLRV

SEQ ID NO: 3995 - protein, 555 aa, Mesorhizobium BNC1
MASDEAELVFCPLGGVGEIGMNLALYGYGPRDNRTWIMIDCGVSFPGENLPGVDLILPDVSFIEDQLENLAGIIITHAHEDHYGALLDLWPRLKTNVWMTPFTAGLLEAKRQGEVNAPKVPVTIYKAGETFTVGPFAIEAIAVAHSIPEPVSLAITTPAGTVIHTGDWKIDPAPELGPKTDEARFRALGEKGVLALICDSTNAMREGVSPSEQDVGRGLREVIEKAPGRVAVTTFSSNVGRIRSIAEAARDAGRQVLVLGRSLQRVIDVADELGYLDGLPPFLVEEDFGYIPRENAVILCTGSQGEARAALAKLARDEMRNVALSPGDTVIFSSRTIPGNEKAILTIKNQLIEQGIRVVEDSDALVHVSGHPRRNELKQMYEWVRPRILVPVHGEAAHLVAQGSLGAMSGIPEVAQVRNGGMLRLAPGPAEIIDQVPFGRIYRDGKVIGTDDEVGVRDRRKLSFAGHVAVNVVLDDRYDLAGDPDLVAIGLPQADSAGEPMEDIMLDAAVGAVRSIPRGNRRDLDLVGEAVRRAVRAAASDAWGKKPIVTVFVTQ

SEQ ID NO: 3996 - protein, 556 aa, Maricaulis maris MCS10
MTDSLYFLPLGGSDEIGMNLNLYGYGPEGKQKWIIVDCGVTFGDLTTPGVDLIMPDPRFIEERRDDLIGMVLTHAHEDHMGAVAHLWRRLRCPIWATPFTAWLVRDRLREYGLLDEVELHEMALDCRFDLGPFNLQLVTLTHSIPEPNGIAIRTPAGMVLHTGDWKIDPAPMIGEATDIDALTAIGNEGVLAMVCDSTNVFSPGESGSEGDVREELIKVVGECKTGKVAIASFASNVARLQSSIEAAEANGRRVCLVGRSMHRMTAAAKAVGMLKHVKDFVSEEEASSFPASKILYLCTGSQGEPRAALSRIAAGNHRNVSLSRDDTVIFSSRVIPGNELGIFELQNQLAERGVHIITEKTRPIHVSGHPCRDELAQMYAWAKPSVAIPVHGERRHLLEHADFARELQVPHSVSVRNGDMVQIRSDGTASIVDEAPASRLHVDGNFIVDADAASMRERRKLAHAGQVTLSMAVSEKGEIVSGPEVRLQGVPEDDNMSLDDFADAMADEAERAFDRLSKRDRRDVERAEEEVRRAVRREANRIWGKKPWVEIMMLEV

SEQ ID NO: 3997 - protein, 556 aa, Bradyrhizobium BTAi1
MARPDELTFAPLGGVGEIGMNLSIYGLGNRHQRSWLAIDLGVSFGDEEHLPGIDLIMPDVAFLEKERNNLVGLVLTHAHEDHFGAIIDLWPRLKCPIYATKFSAALFEAKCEAERLPAKIPVTVIPSGGRVDIGPFNVEFIPVAHSIPESHALAIHTEVGTVLHTGDWKIDPTPVLGAPTDEKRLRELGDAGLLALIGDSTNAVREGRSPSEAEVAKTIAMLVKEAKGRVAVTTFASNVARIRAVADAAREAEREVVIVGRAMERVVQVARETGYLDGVQNFRGMDLYGHFPADKVLALCTGSQGEARAALARIANDDHPLVTLNKGDTVIFSSRTIPGNEKAVGAVINGLVQQGIEIITDRNHLVHVSGHPRRDELRDMIAWTRPQLLIPVHGEALHLHEHARLARACGVPKVITCRNGDLVKLGPGEPGIIDELPAGRLYKDGSIVEDAKSRAVVERRKMAFAGCIFVALAITEKGELADDPEVDMVGIPEKNAAGEEMDDIVFDAVVSTFEGLPRARRRDPDAAAESVRRAVRAAVNEQWGKKPICLVHVLEV

SEQ ID NO: 3998 - protein, 558 aa, Brucella ovis; identical to SEQ ID NO: 3988

SEQ ID NO: 3999 - protein, 555 aa, Sinorhizobium medicae WSM419
MAQNEELVFLPLGGVGEIGMNLGLYGYGRPGSRQWIMVDCGVTFPGPDLPGVDLVLPDIAFLAEERRNLKAIIITHAHEDHYGALNDLWPGLNVPVYASPFTAGMLEAKRAFEKSRSEIPITIFKQGDRINVGPFSVEAVGVNHSIPEPMALIIRTQLGTVVHTGDWKIDLEPSLGPLTDEKRLRQIGEEGVLALICDSTNALREGVSPSERQVSESLSKIIADAEGRVGITTFSSNVGRIRSVAQAAEAAGREVLLLGSSMKRVVDVARDVGLMEGLRPFLAEDEFGYIPRDKVVVILTGSQGEPRAALAKIARDEMRNVAFSAGDTIVFSSRTIPGNEKAINDIKNGLIEQGIHIITDSEALVHVSGHPRRNELQQMYQWVKPQIVVPVHGEAAHLTAHAELALQSGIPSVPRLRNGEMLRLAPGPAEVVDQAPHGRIYKDGTLIGDFEEMGIGERRKLSFAGHVSVSVVLDNRYDFLGDPDVVPIGLPEYDDEGESMEDTLYDAVLGAVESIPRAKRKDLAMLQEAVRRAVRSTANQVWGKKPVVTVFVTKV

SEQ ID NO: 4000 - protein, 558 aa, Ochrobactrum anthropi ATCC 49188
MARSNTTELVFLPLGGVGEIGMNLAMYGFGPADNREWLVVDMGVSFAGPEQPGADLILPDIRYLEAEKHNLRGIVITHAHEDHFGALLDLWPRLKVPVYATPFTAGLLEAKRQSEHGAPEIPITIYKAGEKFEVGPFKVEAVAVTHSIPEPVSLAITTPLGTVVHTGDWKMDPEPSLGPVIDEARFRAIGDAGVLALICDSTNALREGESPSERQVGESLRELIENARGRVAITTFSSNVGRIRSITEAARDAGRQVLVVGRSMKRAISVATELGYMEGLPEYLSEEDYGYIPRENVVMILTGSQGEPRAALAKLARDEMRSLALTAGDTVIYSSRAIPGNEKSILDIKNRLIDRGIKIIGDEDALVHVSGHPRRSELRRMYSWVRPQILVPVHGEAAHLVAQGSLGAMEGIEQVAQVRDGDMLRLAPGKAEIIDEAPVGRIYKDGKLIGDEEEIGMVERRKLAYVGHVAVSVLLDREHKIIDEPDLVTFGVPEENAQGDLLEDILLDAAIEAIDSIPRVRRKDIELVRESVRRAVRAAANEAWGKKPVVTVFVNRIR

SEQ ID NO: 4001 - protein, 567 aa, Parvibaculum lavamentivorans DS-1
MSMSASVASPHAPGAHDELIFLPLGGSGEIGMNLNLYGFGPPKARQWIMVDLGVTFGDDRTPGVDVIMPDPAFIVERKKDLLGIVLTHAHEDHIGAVAHIWPRLRCPVYATPFTAAMVRGKLIEAGIENEVPMHIIPLGHRFALGPFDIELVTLTHSILEPNGLAIRTPLGLVMHTGDWKIDPDPVAGDDMDIARLSEIGDEGVRAIVCDSTNVFSPGTSGSEADVASSLIELIKSCEGRVAVTTFASNVARLESIARAAEACDRHAVLVGRSMYRVVGAARECGYLTGLAPFVSEHDAAYLPRDKVLFICTGSQGEPRAALARIAEDGHPHIVLEEGDTVVFSSRIIPGNETSIFDLQNLLAERGVRVVTEKDHFVHVSGHPCRDELARMYQWIRPEVAVPVHGEARHLAEHAVLARELQVPEQVVIRNGLMVRLAPGPAEIVGEVPSGRIYLDGDVLTESDEGAVRERRKLAFAGSVFVSLVLDGKGEVRGEPQVRLMGLPEEDGNGVSFEDRALDAVEDALDRLPKKRRGDDDAVAEFLRRAVRGDIRRYWGKKAQVAIAVIRI

SEQ ID NO: 4002 - protein, 556 aa, Xanthobacter autotrophicus Py2
MAPTDELVFAPLGGVGEIGMNLGLYGFGPRKARTWLIVDLGMSFAGEEAPGVDLVLPDIRFLEAEKKHIAGLVLTHAHEDHIGAVLDLWPRLKCPIYTTRFTAGLLEAKRAGEPGAPSQLPITVVRSGGTVDIGPFGVEFIPVAHSIPDSHALAIRTAAGLVVHTGDWKLDPTPVVGLPTDVARLKALGDEGVRAIICDSTNAVRDGVSPSEADVAASLRKIVGKAKHRVAFTTFSSNVARIRGIAESAYANGREVVVVGRALERVIGVAREQGLLDGVPAFRTAEAYGYLPREKVVAILTGSQGEQRAALRRIADDDHPEIALSPGDLVVFSSRTIPGNEKVVNHIINALTKRGVEVLTDRKALVHVSGHPRRGELAEMYRMVRPQVSIPVHGEALHLHEHAQLAKSLGVPEVVNCYDGNVIRLAPGPAERVDDVPFGRLYKDGRLLIPDGGRSIPERRKLSFVGAVSVAVAVDRQGGLAGDPSVEITGVPERGEGGIDMLDHVLDTVVATLDNLPKARRRDPDALAETLERAVRSAVNAVWGKKPVCHVHILEV

SEQ ID NO: 4003 - protein, 557 aa, Methylobacterium extorquens PA1
MTTRQDELVFVPLGGVGEIGMNAGLYGIGPEKQRKWIMVDCGMGFAGEEGLPGIDLMFPDLTFIEERKKDLLAIFITHAHEDHIGAISELWPRIKAPVYATRFAKNLLETRRLSEPGAPKVDLREIKPGRRVTVGPFEIEFVPVAHSIPESNAVAIRTEHGLVLHTGDWKLDDTPVAGDSTSPEAFTALGDEGILALICDSTNVLREGRSPSESEVSATLHKLIENAPHRVAVTTFASNVARIRAVAEAAQACGRQVIAVGRAMDRVIDVARECGYLDGLPDFLSAESYSHIPRDKVVCLLTGSQGEPRAAMSRVSRHDHPAISLTAGDRVIFSSRAIPGNERDVGSIINDLIEDGIEVITDRTELVHVSGHPRREEMVTMYSWTRPKAVVPVHGEALHLDEHARFARSQGVESVVKARNGAVVRLAPGKPEVVEHVRAGRLYKDGNVLIDSKDRAIPERRKLSQTGIVSVAIAIDERGEVIGDPAVDIMGLPNRGRTGEPLLDTVVDTVNRTLNGLPRGKMKDSEAVENAVDRAVRSAVNEAWGKKPACHVQVVEV

SEQ ID NO: 4004 - protein, 557 aa, Methylobacterium radiotolerans JCM 2831
MVKGQEELVFLPLGGVGEIGMNAALYGFGPEKGRKWIMVDCGMGFAGEEQMPGVDLMFPDLSFIEERRKDLLGIFITHAHEDHIGAISELWPRLKAPVYATRFAKNLLETRRLSEPGAPKVELREVKPGRRVTVGPFELEYVPVSHSIPESNAIAIRTAAGLVLHTGDWKIDPTPVAGSVTSPEAFTALGDEGVLAIVCDSTNVVREGFSPSEKTVAETLKTLIADAPHRVAVTTFASNVARIRAVAEAAAACGREVIAVGRAMDRVIDVARECGYLDGLPEFRRSDSWKSLPRERVVALLTGSQGEPRAALARVSRRDHPDISLTAGDQVIFSSRAIPGNERDVGSIINDLIEQGVEVITDRTDLVHVSGHPRRDEMVEMYRWTRPGTAIPVHGEALHLDEHARFARAQGVQNVVKARNGSLIRLSPGKPEVIDHVKAGRLFKDGDVLIDEKDRAIPERRKLMQAGLVSVAIAIDEDGVVLGEPAVDIIGLPNRGRSGEPLIETVVDAVSRTLSGMSRGKLKDSESVEKTVDRAVRTAVNEVWGKKPACHVQVVEV

SEQ ID NO: 4005 - protein, 557 aa, Methylobacterium populi BJ001
MTTRQDELVFVPLGGVGEIGMNAGLYGIGPEKQRKWIMVDCGMGFAGEEGLPGIDLMFPDLTFIEERKKDLLGIFITHAHEDHIGAISELWPRIKAPVYATRFAKNLLETRRLSEPGAPKVDLREIKPGRRVTVGPFEIEFVPVAHSIPESNAVAIRTEHGLVLHTGDWKLDDTPVAGDSTSPEAFTALGDEGILALVCDSTNVLREGRSPSETEVSATLRKLIENVPHRVAVTTFASNVARIRAVAEAAQACGRQVIAVGRAMDRVIDVARECGYLDGLPDFLSADSYSHLPRDKVVCLLTGSQGEPRAAMSRVSRHDHPAISLTAGDRVIFSSRAIPGNERDVGAIINDLIEDGIEVITDRTELVHVSGHPRREEMVAMYSWTRPKAVVPVHGEALHLDEHARFARSQGVESVVKARNGAVVRLAPGKPEVVEHVRAGRLYKDGNVLIDSKDRAIPERRKLSQTGIVSVALAIDERGEMAGEPAVDIMGLPNRGRGGEPLLDTVVDTVNRTINGLSRGKMKDSEAVENAVDRAVRSAVNEAWGKKPACHVQVVEV

SEQ ID NO: 4006 - protein, 556 aa, Rhodopseudomonas palustris TIE 1
MARPDEFTFAPLGGVGEIGMNLSIYGLGTRHQRSWLAVDLGVSFGDEEHLPGIDLIMPDVRFLEKEKKNLVGLVLTHAHEDHFGAIIDLWPKLGCPIYATKFSASLFAAKLAAERTTLKIPITEVPSGGTIDLGPFSVEFIPVAHSIPESHALAIRTSVGTVLHTGDWKIDPTPVVGPPTDEARLRQLGDEGVLALIGDSTNAVRDGRSPSEAEVAVSLAGLIKSAKGRVAVTTFASNVGRIRAVADAAKAAGREVVLVGRAMDRVAQVARETGHLDGVQSFRGPEYYGHFPPDKVLALCTGSQGEPRAALARIAKDDHPEITLNKGDCVIFSSRTIPGNEKAVGSIINGLVTQGIEVITDRDHLVHVSGHPRRDELREMISWVRPQLLIPVHGEALHLNEHAKLARQMGVPKVMTCRNGNLIRLGPGDPAVIDQLPSGRLYKDGTILEQDTSRAVVERRKMAFAGCAFVALALTETGELADDPEVDLVGMPENNTAGEPLEDIVFDAVVSTVEGLPRARRRDPDAVAESVRRTVRSIVQAEWGKKPLCTVHVLTV

SEQ ID NO: 4007 - protein, 557 aa, Methylobacterium sp. 4-46
MTTKGDELVFVPLGGVGEIGMNAALYGYGPPNSRKWIMVDCGMGFASEEHMPGVDLMYPDLSFIEKQRENLLGILITHGHEDHIGALVELWPRLKVPVYATRFTKSLIETRRLSEPGAPKIDLREIQVHERHRFGPFEIEYIPVAHSIPEANALAIRTAQGLVLHTGDWKLDDGPVAGNVTSEEAFTQLGEEGVLALICDSTNVTREGRSPSETEVAAQLAELIRNAPHRVAVTTFASNVARIRAVAEAAKACGREVVAVGRAMDRVIDVARECGYLDGLDEFREPEAYGYLPREKIVALLTGSQGEPRAALARVSREEHPEIALSPGDRVIFSSRAIPGNERSIGAIINDLIDAGVEVITDRTELVHVSGHPRRDELAAMYRWTKPRIAVPVHGEPLHLAEHATFARKQGVEQVVKARNGTLIRLAPGEPEIIDHVTRGRLYKDGMVLIGESDRALPERRKLSFTGIISVALAVDQHGEMKGEPAIDLMGLPTYGRKGEAIIDLVEEVVERTFDGLSRQKRRDSEAVENAIDRAIRAAVNEVWGKKPACHVQVVEI

SEQ ID NO: 4008 - protein, 556 aa, Rhizobium leguminosarum bv  trifolii WSM2304
MAKQDELVFLPLGGVGEIGMNLALYGYGPPEHRQWIMVDCGVTFPGPDLPGVDLVLPDIRFLASERKNLKAIIITHAHEDHYGALADLWPGLNVPVYASGFTAGLLEAKRNFEKARIGEVPVTPFKAGDTINIGPFSIEGVAVNHSIPEPMSLMIRTPVGNVIHTGDWKIDHEPSLGPLTDETRFRQLGDEGVLALMCDSTNALRDGVSPSEKDVSESLRKIIEDAEGRVAITTFSSNVGRIRTVAEAAEAAGREVLLLGSSLKRVVDVAQDIGLMEGVKPFISEEEYGYIPRDKVVVILTGSQGEARAALAKLSRDEMRNVAFAAGDIVVFSSRAIPGNEKAIQDIKNGLVEQGVHIITDTEALVHVSGHPRRNELQRMYEWTRPKIVVPVHGEATHLTAHKELAEQSGIALVPRVRNGDILRLAPGPAEVIGQAPHGRIYKDGSLIGDFDEMGIGERKKLSYVGHVAVSVVLDARYDIVGDPDLVSIGLPVYDDEGEEMEDTLFDAAISAIESIPRARRKDIDMVQEAVRRAIRAAANHAWGKKPVVTAFVTKV

SEQ ID NO: 4009 - protein, 556 aa, Methylocella silvestris BL2
MNAANDELVFAPLGGLGEIGMNLALYGFGPKGRMKWLMVDCGIAFAGPEHAGIDIIIPDVSFIEKMREDLVGLVITHAHEDHIGAVADIWPKLGCPLYATRFAAQLLRTKRLSEPGAPEVPIEIVPQGGHIKVGPFAVEFIAMAHSIPESCALAIRTPLGTVIHSGDWKIDAEPGLGAPTDARRLSEIGDEGVLALVCDSTNILREGISPSEGEVARTLREVIAGTTGRVVVTTFASNVARIRAVALAAAAAGRSVVLAGRAMERVVAVARDCGYLDGVPDFFGIDAFAHLPRDRVALIATGSQGEPRAAIARISEGEHPAISLTAGDKVIFSSRTIPGNEREVGRIINNFIRSGIEIVTDRNALVHASGHPRRGEVSELYAWVRPQIAIPAHGEDLHLAEHAIFARAMGVPHVIPARNGDIVALAPGQAAIVGEAPSGRLLKDGNIFVSATDEAPRMRQKLAASGIITIALAVTAKGDLAGVPDVMTAGIPTRGHGGAPMDAIVDDAMFQTFDHLPRQKRRDADVVSSAIEKAVRNAVAQAWGKRPSVHVLVVEI

SEQ ID NO: 4010 - protein, 557 aa, Methylobacterium chloromethanicum CM4
MTTRQDELVFVPLGGVGEIGMNAGLYGIGPEKQRKWIMVDCGMGFAGEEGLPGIDLMFPDLTFIEERKKDLLAIFITHAHEDHIGAISELWPRIKAPVYATRFAKNLLETRRLSEPGAPKVDLREIKPGRRVTVGPFEIEFVPVAHSIPESNAVAIRTEHGLVLHTGDWKLDDTPVAGDSTSPEAFTALGDEGILALICDSTNVLREGRSPSESEVSATLHKLIENAPHRVAVTTFASNVARIRVVAEAAQACGRQVIAVGRAMDRVIDVARECGYLDGLPDFLSAESYSHIPRDKVVCLLTGSQGEPRAAMSRVSRHDHPAISLTAGDRVIFSSRAIPGNERDVGSIINDLIEDGIEVITDRTELVHVSGHPRREEMVTMYSWTRPKAVVPVHGEALHLDEHARFARSQGVESVVKARNGAVVRLAPGKPEVVEHVRAGRLYKDGNVLIDSKDRAIPERRKLSQTGIVSVAIAIDERGEVIGDPAVDIMGLPNRGRTGEPLLDTVVDTVNRTLNGLPRGKMKDSEAVENAVDRAVRSAVNEAWGKKPACHVQVVEV

SEQ ID NO: 4011 - protein, 556 aa, Methylobacterium nodulans ORS 2060
MAKGDELVFVPLGGVGEIGMNAALYGFGPPTARKWIMVDCGMGFASEEHMPGVDLMYPDLSFIEQQRENLLGILITHGHEDHIGALVELWPRLKVPVYATGFTKSLIETRRLGEPGAPKIDLREVRPNERMSFGPFEVEYVPVAHSIPEANALAIRTAHGLVVHTGDWKLDDAPVVGNVTSEEVFTRLGEEGVLALVCDSTNVTREGRSPSEAEVAAHLAELIRSAPHRVAVTTFASNVARIRAVADAAQACGREVVAVGRAMDRVIDVARECGYLDGLPEFREPEAYGYLPREKVVALLTGSQGEPRAALSRVSRDEHPEIALSPGDRVIFSSRAIPGNERAIGAIINDLVEAGVEVVTDRTELVHVSGHPRRDELAAMYRWTKPRIAVPVHGEPLHLAEHATFARKQGVEDVVKARNGTLIRLAPGAPQIIDHVSHGRLYKDGMVLITETDRALPERRKLSFTGIISVAIAIDQHGEMKGEPAIDLMGLPTYGRNGEAIIDIVEDVVERTFGGLSRQKRRDSEAVENAVDRAIRAAVNEVWGKKPACHVQVVEI

SEQ ID NO: 4012 - protein, 555 aa, Agrobacterium vitis S4
MTKTDELVFLPLGGVGEIGMNLALYGFGPPKNREWIMVDCGVTFPGPDLPGVDLVLPDIRFVLSQKNRLKAIFITHAHEDHYGGLNDIWPGLNVPVYASGFTAGMLEAKRNYEGTRAEIPVTPFKPGDKVHVGPFVVEASDVNHSIPEPMSLIIRTPLGNVIHTGDWKIDHAPSLGPLTDEARFRALGDEGVLAVMCDSTNAMREGVSPSEQEVSEGLRKIIQTAEGRVAITTFSSNVGRIRSIAKAAEAAGREVLLLGSSLKRVVGVARDVGLMEGVQPFIAEDEYGYIPRDKVVVILTGSQGESRAALAKLSRDEMRNVALTKGDTVVFSSRAIPGNEKPINDIKNGLIEQGVTIVTDSDALVHVSGHPRRNELLQMYQWTRPQILVPVHGEAAHLTAQQKLALEAGIAQVPKVRNGDILRLAPGPAEVIGEAPYGRVFKDGKLLGDFEQMGIGERRKLSFAGHVSVSVLLDERFEFRDDPEVVAHGLPAEDLEGDDMEDILYDAVLSAVESIPRTRRKDLGALRESIRRAVRSTANECWGKKPVVTVFVTKV

SEQ ID NO: 4013 - protein, 556 aa, Rhizobium leguminosarum bv  trifolii WSM1325
MAKQDELVFLPLGGVGEIGMNLALYGYGPPEHRQWIMVDCGVTFPGPDLPGVDLVLPDIRFLASERKNLKAIIITHAHEDHYGALADLWPGLNVPVYASGFTSGLLEAKRNFEKSKIGEVPVTPFKAGDTINVGPFSIEGVAVNHSIPEPMSLMIRTPVGNVIHTGDWKIDHEPSLGPLTDETRFRQLGDEGVLALMCDSTNALRDGVSPSEKDVSESLRKIIENAEGRVAITTFSSNVGRIRTVAEAAEAAGREVLLLGSSLKRVVNVAQDIGLMEGVKPFISEDEYGYIPRDKVVVILTGSQGEARAALAKLSRDEMRNVAFAAGDIVVFSSRAIPGNEKAIQDIKNGLVEQGVHIITDTEALVHVSGHPRRNELQRMYEWTRPKIVVPVHGEATHLTAHKELAEQSGIALVPRVRNGDILRLAPGPVEVIGEAPHGRIYKDGTLIGDFDEMGIGERKKLSYVGHVAVNVVLDARYDIVGEPDLISIGLPTYDDEGEDMEDTLFDAAVSAIESIPRARRKDIDMLQEAVRRAIRSAANNTWGKKPLVTAFVTKV

SEQ ID NO: 4014 - protein, 381 aa, Prochlorococcus marinus NATL2A
MEQSQNEANLSSEEIDRYARHISLPEIGIKGQEKLKTSSVACIGTGGLGSPLLIYLAAAGIGRIGIIDFDVVEYSNLQRQIIHTTDSIGLLKTDSAKQHIRKINPSCRVDLFNQKLTSSNALEILKAYDVICDCSDNFPTRYLINDACLILNKPNIYGSIARFEGQVSVFNLKEDSPNYRDLIPTPPPQELIPSCSEAGVMGILPGIIGTIQAAEAIKIITNIGYPLNGRILIFNALKMQFKELTLKSNPENKNIHKLIDYKSFCSEVKVKDEVECDIESISIKELKVLLSQSSKEILLIDVRNQNEYNQCSITGSLLMPLSSIESGKAIDEIKILTAKKNLYVLCKSGKRSLLALKHLNKFGIIGINILGGIDAWNSEKN

SEQ ID NO: 4015 - protein, 390 aa, Anabaena variabilis ATCC 29413
MLNPNLEDIQLTKDDYERYSRHLILPEVGVEGQKRLKAASVLCIGTGGLGSPLLLYLAAAGIGRIGIVDFDVVDTSNLQRQVIHGTSWVGKPKIESAKNRIHEINPYCQVDLYETRLSSENALDIIRPYDIVVDGTDNFPTRYLVNDACVLLNKPNVYGSIFRFEGQATVFNYEGGPNYRDLYPEPPPPGLVPSCAEGGVLGILPGIIGVIQATETVKIILGNGNTLSGRLLLYNALDMKFRELKLRPNPIRPVIEKLIDYEQFCGIPQAKAAEAQKMQEIQEMTVTQLKELLDSGAKDFVLLDVRNPNEYEIAKIPGSVLIPLPDIENGNGVAKVKEALNGHRLIAHCKMGGRSAKALAILKESGIVGTNVKGGITAWSREVDPSVPEY

SEQ ID NO: 4016 - protein, 257 aa, Nitrosococcus oceani ATCC 19707
MNDQQLLRYSRQILLPQIDIEGQQKLLDSRILVVGVGGLGSPIALYLAGAGVGQLTLVDPDEVELSNLQRQILHDSNVIGLPKVESARRRLQALNPEVEVRPIAARLEGKDLEAVIAQADVVVDGSDNFATRFALNIASARVGRPLVSGAAIRMEGQVAVFDSRQPDGACYHCLFQEGGENEEETCSQTGVLAPLLGIIGSVQAMETLKLLLGIGRSLHNRLLLLDGLSMRWRETRIQQDPQCPICNGSRERWRELA

SEQ ID NO: 4017 - protein, 388 aa, Synechococcus sp. CC9902
MQPSHPTPNQSLSSDERGRYARHLILPEVGLAGQERLKAAAVLCVGAGGLGSPLLLYLAAAGVGRIGIVDGDAVELSNLQRQVIHRSDAVGRSKARSAAESVHALNPHCQIDVHDVMLDITNVMDLIADYDVVCDGTDNFASRYLINDACVLSDKPLIYGSVQRFEGQVTVFNCNPESPNFRDLLPVPPSPGAIPSCSEAGVMGVMPGLIGLLQATETIKLITGIGRCLDGRLLVVDALSMRFRELTLRRDLDRAPIKDLIDYSQFCSAATTEMDPSVMETISVTELKALLEGDAGDLALVDVRNPAEAEIVVIPSAVLIPLSTIESGEAIEQVRSLAEGRRLFVHCKLGMRSAKAAQLLAEHGIFAINVTGGIDAWAQEVDPTLPRY

SEQ ID NO: 4018 - protein, 378 aa, Synechococcus sp. CC9605
MHDQPMLSADERGRYARHLILPEVGPAGQLRLKEASVLCVGSGGLGSPLLLYLAAAGVGRIGIVDGDVVELSNLQRQVIYSSSGVGGSKARSAAARIHDLNPHCQVEVHEHMLDVGNALDLIADYDLVCDGTDNFPSRYLINDACVLLGKPLVYGSVQRFDGQVSVFNRTPTSPNYRDLLPEPPPPDAVPSCSEAGVMGVMPGLIGLLQATEAIKLITGIGECLDGRLLVVDALAMRFRELTLRVDPDRAKVESLIDYRQFCRPASSEMEAITVTELKALLDSAPDEIALVDVRNPAEAEMASIEGSHLVPLASLESGEAIDRVRALAEGRRLLVHCKLGGRSARAVELLAQQGIAATNVTGGIDAWSQQVDPAIPRY

SEQ ID NO: 4019 - protein, 269 aa, Geobacter metallireducens GS-15
MFTEEQIERYSRHIILKEVGGKGQKKLLEGKVMVIGAGGLGAPIALYLAAAGVGTIGIADADVVDLSNLQRQVIHFTPDVGKPKVESAREKMEAINPDVTVRTYQEWISAANIARIIADYDFVIDGTDNFAAKFLINDACVMAGKPYSHGGILQFVGQTMTIKPGESPCYRCIFPAPPPKDAIPTCSQAGVIGVLPGVIGTIQATEAIKYLLGKGALLTGHIMMYDALEMNFRKVKLNRNRKCPVCGDNPTVTELVDELDALNVCDLEK

SEQ ID NO: 4020 - protein, 391 aa, Synechococcus elongatus PCC 7942
MLNLDTDSIQLTQDDYARYSRHLILPEVGLEGQKRLKAAKVLCIGTGGLGSPLLLYLAAAGIGRIGIVDFDIVDHSNLQRQVIHGTSWVGKPKIESAKNRIHEINPYCQVDLYETALSSENALSILEPYDVIVDGTDNFPTRYLVNDACVLLGKPNVYGSIFRFEGQATVFNYEDGPNYRDLYPEPPPPGMVPSCAEGGVLGILPGIIGVIQATETVKIILGQGQTLSGRLLLYNALDMKFRELKLRPNPERPVIDRLIDYQEFCGIPQAQAAEAAATDSIPEISVTELKAILDRQDPEVLLIDVRNPHEAEIATIPGAILVPLPDIEAGAGVETVRELLNGKRELIVHCKMGGRSAKALGILKEAGITGTNVAGGINAWSQDVDPSVPQY

SEQ ID NO: 4021 - protein, 390 aa, Nitrosospira multiformis ATCC 25196
MQLSPLVHPSEELSKEEISRYSRHLLIPDVGLEGQQRLKNSKVLVIGAGGLGSPTLLYLAAAGVGTLGIIDFDIVDESNLQRQVIHRQQDIGRPKCRSAQDSVKALNPYIQVRIHDERLETTNAIDIISDYDLVIDGTDNFSTRYLVNDACVLAGKPYVWGSIFRFEGQASVFWEDAPGGRGLNYRDLYPEPPPPEMAPSCAEGGVLGILCASIGAIMATEAIKLITGLGNTLLGRLAVYDALDMTFRFIPLRRAPVRTPITRLIDYQAFCGLPQSTTGGKPNVPTISALELKEMRDCSVAMQLIDVRGIQEWNIVHIEGANHIPKDRMMSEEVLARLNKDELIVLHCKMGVRSRDILMEMRKRGFTNVKSLDGGILAWIRDVDQTLPSY

SEQ ID NO: 4022 - protein, 391 aa, Trichodesmium erythraeum IMS101
MLNPNLEQIQLNTEEYQRYSRHLILPEVGLDGQKRLKAASVLCIGTGGLGSPLLLYLAAAGIGNIGIVDFDIVDSSNLQRQVIHGTSWVGKPKIESAKNRIHEINPYCQVDLYETRLSAENALDILKSYDVIVDGTDNFPTRYLVNDACVLLNKPNVYGSIFRFEGQATVFNYEGGPNYRDLYPEPPPPGMVPSCAEGGVLGILPGIIGVIQATETIKVVLGKGKTLSGRLLLYNSLDMTFRELKLRPNPIRPIIEELIDYEQFCGIPQAKAQEAETKMAIPEMTVQDLKQLFDSGKKDDFVLVDVRNPNEYDIAKIPGSVLVPLPDIEQGPGVTKVKELMNNRSLIAHCKMGGRSAKALGILKEHGIEGTNLKGGITAWSKEIDSSVPQY

SEQ ID NO: 4023 - protein, 480 aa, Alkalilimnicola ehrlichei MLHE-1
MSETSVTVRLPAPLRPFAGDQPELHVPGASVGEVLEALARDYPLLHARLVDPDGELRAFVNLFRGEQDVRELAGQRTPLRPGDVLTVLPAVAGGAPSALERLSARIRREVPEVTPAEAQKLAAQGAVLLDVREAGEVAEGSPTGALRIDRNWLELRIEEAVPEPERPILTLCAVGQRSLLAADDLRRLGYRDVRNIAGGFNRWKDEGLPFEVPRVLDDASRARYARHLRMPEVGEAGQLRLGESRVVLVGAGGLGSPAALYLAAAGVGTLVLVDHDVVDRSNLQRQILHTDDRVGQPKTESGRQAVAALNPQVRVEAVQARLNSENIEAVLAGADLVIDGSDNFPTRYLVNDACVKLGLPLVYGAVYRFEGQVTVFNVDDGPCYRCLYPEPPPAELAPSCAQAGVLGVLPGVIGLLQATEAVKLLLGVGEPLSGRLVHYDALRGQFQQLRMKANPDCPVCAPGRPFPGYVDYEAFCSSSA

SEQ ID NO: 4024 - protein, 409 aa, Prochlorococcus marinus MIT 9303
MRLRIWDSGKGIASGTLSPMGLHETVDVGLSPDELERFSRHLTLPEVGMNGQKRLKAASVLCVGSGGLGSPLLLYLAAAGVGHIGIVDFDVVELSNLQRQVIHGTSWVGQPKTHSARARILEINPHCQVDLYEKALTRDNAFEIIHPYDIVCDCTDNFPSRYLVNDACVLLGKPSIYGSIHRFEGQATVFNLDAESPNYRDLVPEPPPAGLVPSCVEGGVMGILPGLIGLIQSAEVIKIITGIGTTLSGRLLVVDALAMTFREMALRPSQPRVVIDQLIDYQDFCASGADQPAQEKAAGLESISVQDLKSLLDLGAEDFALVDVRNPNEAEIACIAGSELIPLNKIESGEAIEKVRQLASGRRLYVYCKLGGRSAKALTTLKRHGIEGVNVTGGIDAWAKEVDNSLPRY

SEQ ID NO: 4025 - protein, 381 aa, Prochlorococcus marinus NATL1A
MEQSQSKANLSSEEIARYARHISLPEIGIKGQEKLKTSSVACIGTGGLGSPLLIYLAAAGIGRIGIVDFDVVEYSNLQRQIIHTTHSIGLLKTDSAKQAIRKINPSCRVDLFNQKLTSSNALEILKAYDVICDCSDNFPTRYLINDACLILNKPNIYGSIARFEGQVSVFNLKEDSPNYRDLIPIPPPQELIPSCSEAGVMGILPGIIGTIQAAEAIKIITNIGYPLNGRILIFNALKMQFKELTLKSNPENKNIHKLIDYKSFCSEISVKDEVECDIESISVKELKVLLRQSSKEMLLIDVRNQDEYHQCSITGSLLIPLNSIESGKAIDEIKILTAKKNLYVFCKSGKRSLLALKHLNKFGIRGINILGGIDAWNSEKN

SEQ ID NO: 4026 - protein, 270 aa, Clostridium thermocellum ATCC 27405
MNFTNEQMERYSRHIILKDVGVKGQKKLLESKVLIIGTGGLGAPAAMFLAAAGVGTIGLVDFDAVELSNLQRQIIHLTKDVGKPKVISGKETINEMNPDVNVVTYQEWVSSANIKDIIKDRDYDFIIDGTDNFPAKFLINDACVLTGKPFSHAGIIRFQGQTMTYVPGKGPCYRCIFENPPPPDKVPTCKQAGVLGVMGGVIGTIQATEAIKYLLGIGELLTGYILTYDAKAMEFRKVKLPWNKRCQVCGENPTIKELIDYEQAVCDLKS

SEQ ID NO: 4027 - protein, 270 aa, Geobacter uraniumreducens Rf4
MLSEEQIARYSRHIILKEVGGKGQKKLFDGRVMIIGAGGLGSPIALYLAAAGVGTIGIADADVVDLSNLQRQVIHQTKDVGIAKVLSAKEKMQAINPELKVNTYQEWISAANIADIISEYDFVIDGTDNFAAKFLINDACVLAGKPYSHGGILQFDGQTITIEPGKSPCYRCLFPAPPPKDAIPTCSTAGVIGVLPGVIGTIQATEAIKYLLGKGELLTGRLLTYNALRMRFREVPVKKSAKCPICGENPTITELKDELDALTVCDLETK

SEQ ID NO: 4028 - protein, 379 aa, Prochlorococcus marinus MIT 9211
MKSIKANNMQLSPEEFARYSRHLSLPEIGIKGQKKLKGSSVLCIGCGGLGSPVLIYLAAAGIGNLGIVDNDLVEESNLQRQIIHTHKSIGKSKIESARSRIIDINPYCKVTIFSELLNNENALEIIKPYDLVCDCTDNFESRYLINDACVLLGKPYIYGAISKFEGQASVFNLDKDSPNFRDLIPQPPSMDLLPSCSESGVIGVLPGIIGLIQATEIIKIIAGIGTTLSGRILIFNALEMKFKELKLKKDYAAKPITELIDYKDFCGSSGVTKVEDSIKSISAKKLRVLLEDNPNKNILLDVRTEEEFKLNAIKGSILVPLKNIQNGQEIDKIRKLASNKNIFVHCKTGKRSRKAILSLRSNGIDAVNLEGGINSWNES

SEQ ID NO: 4029 - protein, 284 aa, Natranaerobius thermophilus JW NM WN LF
MLETITEKWGELMNFNEAQLERYSRQIILSEVGVEGQQKLLDSKVLIIGTGGLGAPAAMYLAALGIGTIGLVDGDKVELSNLQRQIIHQTKDIGKLKAESGKETILHMNPDVEVIPHNTWINSQNIQDIIEDYDFVIDGTDNFAAKFLINDACVMSEKPFCHAGIIRFQGQVMTYVPNGNGVTPCYRCVFNEPPPDGVVPSCQEAGVLGLLGGVIGGLQATEAVKYLLGIGDNLTGELLVYDALKMDFRKIELHSDRDCKICGTNPEIKDLVDYTGPKCNLQTK

SEQ ID NO: 4030 - protein, 268 aa, Chlorobium phaeobacteroides BS1
MIDFTQSQLERYSRHILLDSVGVEGQQKLLSSRVMIIGAGGLGAPAALYCAAAGIGTIGIVDADAVEISNLQRQIIHFTDDIGKAKVASAREKMEAINPDVKVEPLRAFVNASNISDIIDGYDFVIDGTDNFATKFLINDACIMKGIPFSHGGILRFNGQTMTVLPKESACYRCVFHKPPPKNMIPTCSEAGVLGAIAGMLGTIQAAEALKCITGAGEILADALLTFDALPMNFRKVKLQKNPKCAVCSENPSITVLQDEEQQVCDLK

SEQ ID NO: 4031 - protein, 270 aa, Geobacter bemidjiensis Bem
MKLSEEQITRYSRHILLKEVGGKGQKKLLEGRVLIIGAGGLGSPIALYLAAAGVGTIGIADADEVDLSNLQRQVIHTTPDVGKAKVLSAKETMLAINPELTVNAYQTWVSAENIAGLIADYDFVIDGTDNFAAKFLINDACVLAGKPYSHGGILQFDGQTMTVKPGESPCYRCIFPEPPPKDVIPTCSRAGVIGVLPGVLGTLQATEAIKYLLGAGDLLTGRLLTYNALRMRFREIPVKKSAKCPICGDHPTITELKDELDAMTVCDLGH

SEQ ID NO: 4032 - protein, 269 aa, Desulfitobacterium hafniense DCB 2
MGFSDEQLERYSRHIILKEVGVKGQKKLLQSRVLIIGTGGLGAPAAMFLAAAGVGTIGLVDFDGVELSNLQRQIIHLTKDVGKPKVISGRETIGEMNPDVEVVPYQEWVSSGNIQDIIWDRDYDFIIDGTDNFPAKFLINDACVLSGKPFSHAGIIRFQGQTMTYVPGQGPCYRCIFKNPPPTDSVPTCKQAGVLGVMGGIIGTIQATEAIKYILGLGDLLTGALLTYDALKMEFRRVKLPHNKKCQVCGEEPSITELIDYEQAACDLN

SEQ ID NO: 4033 - protein, 270 aa, Anaerocellum thermophilum DSM 6725
MKLTDTQLERYSRHIILNEVGAKGQQKLLESEVLIIGTGGLGSPAAMFLAAAGVGTIGLVDFDAVELSNLQRQIIHFTPDVGKPKVFSAKEKINQMNPDVEVVTYREMVNSSNIIDIIKDRDYDFIIDGTDNFPAKFLINDACVILKKPFSHAGIIRFDGQTMTYVPEKGPCFRCIFQNPPPPDAVPTCRQAGVLGVMGGIIGTIQATEAIKYLLGIGDLLTGYILIYNALKMEFRKVKINKRESCEICGKNPTIKELIDYEQPQCDLKG

SEQ ID NO: 4034 - protein, 270 aa, Geobacter M21
MKLSEEQITRYSRHILLKEVGGKGQKKLLEGRVLIIGAGGLGSPIALYLAAAGVGTIGIADADEVDLSNLQRQIIHTTPDVGKAKVLSAKETMLAINPELTVNTYQTWVCAENIAGLIADYDFVIDGTDNFAAKFLINDACVLAGKPYSHGGILQFDGQTMTVKPGESPCYRCIFPEPPPKDVIPTCSRAGVIGVLPGVLGTLQATEAIKYLLGAGDLLTGRLLTYNALRMRFREIPVKKNANCPICGDHPTITELRDELDAMTVCDLGH

SEQ ID NO: 4035 - protein, 266 aa, Candidatus Methanosphaerula palustris E1 9c
MKDEQIERYSRNIILKEVGGKGQERLLQSKVLIIGAGGLGSPAALYLAAAGVGTIGIVDGDRVDLSNLQRQVIHFTADVGTYKADSARDKITQLNPDVTVQIHKEMVSSSNIREIITDYDFIIDGTDNFPAKFLINDACILLGKPFSHAGILRFNGQTTTVIPDKSACYRCIFNTPPPVGTVPSCSESGVIGSMAGVIGTLQAMEAIKYLLGIGDLLTNRLLVFEALPMNFREIKIKKNPKCPVCGEHPTITSLIDYEQKVCELRK

SEQ ID NO: 4036 - protein, 686 aa, Bacillus cereus ATCC 10987
MSKIRVHEYAKKHNISSKDLMTKLKEMNIEVSNHMTMLDDEVVNKLDNEYQTEKPSVADEFEVEEKVVRSKKNSNKKKKKGKGNEDKRQENFAGRQQTQTVETPDKITFSGSLTVGDLAKKLSKEPSEIIKKLFMLGIMATINQDLDKDTIELIANDYGIEVEEEVIVSETEFETFIDEQDDEENLKERPAVVTIMGHVDHGKTTLLDSIRNSKVTAGEAGGITQHIGAYQVEVNDKKITFLDTPGHAAFTTMRARGAQVTDITILVVAADDGVMPQTVEAINHAKAAGVPIIVAVNKMDKPAANPDRVMQELTEYELVPEAWGGDTIFVPISAIQGEGIDNLLEMILLVSEVEEYKANPNRYATGTVIEAQLDKGKGTIATLLVQNGTLRVGDPIVVGTTFGRVRAMVSDIGRRVKVAGPSTPVEITGLNEVPQAGDRFMAFADEKKARQIGESRAQEALLAQRGEKSKLSLEDLFQQIQEGDVKEINLIVKADVQGSVEAMAASLRKIDVEGVKVKIIHTGVGAITESDIILASASNAIVIGFNVRPDVNAKRTAELENVDIRLHRIIYKVIEEIEAAMQGMLDPEFEEKVIGQAEVRQTFKVTKVGTIAGCYVTDGKITRDSGVRIIRDGVVIYEGQLDTLKRFKDDVKEVAQNYECGITIEKYNDLKEGDIIEAYIMEEVKR

SEQ ID NO: 4037 - protein, 782 aa, Listeria monocytogenes 4b F2365
MSKVRVYEYAKEHQVSSKKVIEALKDLGIEVANHMSTINENALRQLDNAIDGTNKKAEAPKKETTSNENGNSKGPNKPNMTNSNEKSNKPNNPAGQANKPATANKSQGAKPATNKPANTSKQTQSSGNQQQAGGQKRNNNNNSNRPGGGNPNRPGGNNRPNRGGNFNNKGRNTKKKGKLNHSTVPPTPPKPKELPEKIVFSESLTVAELAKKLYREPSELIKKLFMLGVVATINQSLDKDAIELICDDYGVQVEEEIKVDVTDLDVYFENELNEAVDESKLVERPPVVTIMGHVDHGKTTLLDSLRNTKVTLGEAGGITQHIGAYQLEIHDKKITFLDTPGHAAFTAMRARGAQITDITILVVAADDGVMPQTIEAINHAKAAGMPIIVAVNKIDKPQANPDRVMQELTEYELVPEAWGGDTIFAPISAKFGEGLENLLDMILLVSEVEELKANPDRRAIGSVIEAELDKGRGPVATLLVQDGTLNIGDPIVVGNTFGRVRAMVNDLGRRVKKVGPSTPVEITGLNDVPQAGDRFVVFEDEKTARNIGETRASRALVAQRSATNRVSLDNLFEHMKAGEMKEVNVIIKADVQGSVEALAASLRKIDVEGVNVKIIHTAVGAINESDITLAAASNAIVIGFNVRPTAQAREAAENESVDIRLHRVIYKAIDEIEAAMKGMLDPEFQEKIIGQAQVRQTINVSKVGTIAGCYVTDGKITRDSGVRIIRDGIVVFEGEIATLKRFKDDAKEVAKGYECGITVQNFNDIKEDDVIEAYVMEEIERK

SEQ ID NO: 4038 - protein, 686 aa, Bacillus anthracis Ames 0581
MSKIRVHEYAKKHNISSKDLMTKLKEMNIEVSNHMTMLDDEVVNKLDNEYQAEKPSVADEFEVEEKVVRSKKNSNKKKKKGKGNEDKRQENFAGRQQTQTVETPDKITFSGSLTVGDLAKKLSKEPSEIIKKLFMLGIMATINQDLDKDTIELIANDYGIEVEEEVIVSETEFETFIDEQDDEENLKERPAVVTIMGHVDHGKTTLLDSIRNSKVTAGEAGGITQHIGAYQVELNDKKITFLDTPGHAAFTTMRARGAQVTDITIIVVAADDGVMPQTVEAINHAKAAGVPIIVAVNKMDKPAANPDRVMQELTEYELVPEAWGGDTIFVPISAIQGEGIDNLLEMILLISEVEEYKANPNRYATGTVIEAQLDKGKGTIATLLVQNGTLRVGDPIVVGTSFGRVRAMVSDIGRRVKVAGPSTPVEITGLNEVPQAGDRFMAFADEKKARQIGESRAQEALLAQRGEKSKLSLEDLFQQIQEGDVKEINLIVKADVQGSVEAMAASLRKIDVEGVKVKIIHTGVGAITESDIILASASNAIVIGFNVRPDVNAKRTAELENVDIRLHRIIYKVIEEIEAAMQGMLDPEFEEKVIGQAEVRQTFKVTKVGTIAGCYVTDGKITRDSGVRIIRDGVVIFEGQLDTLKRFKDDVKEVAQNYECGITIERYNDLKEGDIIEAYIMEEVKR

SEQ ID NO: 4039 - protein, 686 aa, Bacillus anthracis str Sterne; identical to SEQ ID NO: 4038

SEQ ID NO: 4040 - protein, 686 aa, Bacillus thuringiensis konkukian
MSKIRVHEYAKKHNISSKDLMTKLKEMNIEVSNHMTMLDDEVVNKLDNEYQAEKPSVADEFEVEEKVVRSKKNSNKKKKKGKGNEDKRQENFAGRQQTQTVETPDKITFSGSLTVGDLAKKLSKEPSEIIKKLFMLGIMATINQDLDKDTIELIANDYGIEVEEEVIVSETEFETFIDEQDDEENLKERPAVVTIMGHVDHGKTTLLDSIRNSKVTAGEAGGITQHIGAYQVEVNDKKITFLDTPGHAAFTTMRARGAQVTDITILVVAADDGVMPQTVEAINHAKAAGVPIIVAVNKMDKPAANPDRVMQELTEYELVPEAWGGDTIFVPISAIQGEGIDNLLEMILLVSEVEEYKANPNRYATGTVIEAQLDKGKGTIATLLVQNGTLRVGDPIVVGTSFGRVRAMVSDIGRRVKVAGPSTPVEITGLNEVPQAGDRFMAFADEKKARQIGESRAQEALLAQRGEKSKLSLEDLFQQIQEGDVKEINLIVKADVQGSVEAMAASLRKIDVEGVKVKIIHTGVGAITESDIILASASNAIVIGFNVRPDVNAKRTAELENVDIRLHRIIYKVIEEIEAAMQGMLDPEFEEKVIGQAEVRQTFKVTKVGTIAGCYVTDGKITRDSGVRIIRDGVVIFEGQLDTLKRFKDDVKEVAQNYECGITIERYNDLKEGDIIEAYIMEEVKR

SEQ ID NO: 4041 - protein, 686 aa, Bacillus cereus ZK; identical to SEQ ID NO: 4040

SEQ ID NO: 4042 - protein, 955 aa, Thermobifida fusca YX
MAKVRVYELAKEFGVESKAVLAKLQEMGEFVRSASSTVEAPVVRRLKEAFSQSSESTEGAKGGQEKKKPSPKPQPSPQQQTKASAPSAGGETPRPAVPKPGPGLKPGPRPVPKPGPRPGPRPEGGAGKAGQQPSGAQGPARPESGKTPRPVPKPGPRPGNNPFSSTASGMGTRPTPRPPASGGTGAPRPGPRPHPGMMPPRPGASAGGPPRPQAPRPQAPRPGPGTAGGRPGSSAGGPPRPVPRPGPRPSPMNMPASRPTPPGGARPSTSSRSGGGRGRGGGGGAGPRGGGAGGGAPRTGFGGRPGGGRGRGGTAGAFGRPGGRPSRSRKSKKQRRQELKDMQAPSFGGVKIPSGNGKVIRLSRGASLADFGERIDVNPASLVQVVMTQLGEMVTATQSLPDETLQLLGEELNYTVEVVSPEDEDRELLESFSIEFGEDIGSEEDLKPRAPVVTVMGHVDHGKTRLLDAIRNTNVASGEAGGITQHIGAYQVTTTVDGEERKITFIDTPGHEAFTAMRARGAQATDIAVLVVAADDGVKPQTAEAIDHAKAADVPIVVAVNKIDLPTADPQKVRAQLTEYGLVAEEYGGNVQFVDISAKENLNIDQLLEAIILTADAELDLKANPDMPAQGLAIEAYLDRGRGSMATVLVQRGTLRVGDSIVCGDAYGRVRAMLDENGNRVKEAEPSRPVQVLGLTNVPSAGDSFLVVKDDRVARQIAQQREARERFAQQAKASRRVTLDNWQKTLEEGQREELLLIIKGDMSGSVEALEESLLKIDPGTDEVAIRVIGRGVGAITQNDINLAASSGAVIIGFNVRPEGKNSELAERMGVDIRYYSVIYQAIEEVEAALKGMLKPEYEEVQLGTAEIREIFKVPRVGNVAGAVVRSGVIKRNAKARLIRDGVVVSDNLTVESLRRFKDDVTEVREGFECGIGIGYNDIRVEDIIETFEMREKPRD

SEQ ID NO: 4043 - protein, 947 aa, Pelobacter carbinolicus
MGKKIRVYELAQKMGVDNKVLLEKLHEAGIDAKSHMSVLSEEDVEKLDEAPAKVERVEERRITAGVIRRRRKEVPQEEKAAPPAAAEEPSSVDTAVAEEAPAEEVQPVSDQPEIAVEPPPAGKQEEVAAPAPEPKAEEPVVEEVIAEPAVEEVVEEPSAVEQEEHVETTPVAEEEPKVEEQPSVEAESKAVSGELEESKTADQSKGQSEAAEVSVTKEKPKVEKATANRAKILGRVELSTLTSPPKRQERAKNGKGRPERPKGAKPSGGPAPRAKEAAPQAAVPFDGGPAPDKEVRGGKKGKKGKGNSYDKDKGFADGGKGRRARRQVYEPERDERRMRRGKKTPKPQKKTEVTVSKAIKRIIRISDVITVGELAKRMGVKSKDLITELMRQGQMVTINHPLDFETAAILASEFNYEVENVAFDEENLLADTAAVTEEGDSEEGCVPRPPVVTIMGHVDHGKTSLLDAIRATNVTGGEAGGITQHIGAYDVSVDDKKITFLDTPGHEAFTSMRARGAKVTDIVILVVAADDGVMPQTKEAINHSKAAGVPIIVAVNKMDKPDANSDRVKQELTEFEMIPEEWGGDTIFVEVSAKNRTNLDSLLEMVLLQAEVLELKANPNKRAKGAIVEARLDRGRGPVATVLVEEGTLRIGDPIVSGLHYGKVRTMTNDRGERLEEAGPACPVEVTGLSGTPTAGDSFHAVESEKDAKEVATHRQRKVREQELASTSKISLEQLYARMQEGEVQELKVIIKADVQGSVEAVRDSLVKLSTDACRLVVIHTAVGGINESDVSLASASDAIILGFNVRAESKAAALAETEGVDIRFYNVIYDAVNDIRDAMEGLLAPTLREKHLGKVEVRETFHVSKVGTIAGCYVTEGKVLRNAQVRLIRDHVVIWEGKLASLKRFKDDAREVQNGYECGLSLENYNDIKVGDIIEVFEMEEVKTSL

SEQ ID NO: 4044 - protein, 950 aa, Anaeromyxobacter dehalogenans 2CP-C
MSKKRVHELGKQLKEQGIELSNQELVEKLHALGYLEVKSHSSSLEDDQAHAAYEKILAERKPKPAPARPSGPGFVVRKRAHVEPPTVTAPAAPPSPEPEYAEPQYAEPQAEQAYEPEPQAAQPEAGAEPAAAPEPPAEAAPLAAQAAPSPGAEAAAPAAPQAQPAQPAAPAAPPAPTAQPSAPPPAAAQPRPPQPSAPSRPPPPGYRPAPPPGARPPVSAAPGAPGQPGAAGQPPRPPVDPRTLRPTSTQAVVISRPLVPVRRVTPPTSARQQFPVAPGPRALGEVRELKVVPGSLGREREFIDVSRDKRRGRQPGRPISEEQAKSLSGKELLQAAISDRAYIPIRGKKKKPTKKGAKTQITEKAEHKKVIRIEESISVSELSQVMGVKASDLIRKLMQMGKMVTINAQIDADTAATLALEHGYTVEKKGFEVEEFIPEVEVDESKLVIRPPVVTVMGHVDHGKTSLLDAIRQADVAAGEAGGITQHIGAYSVNTPQGPITFLDTPGHEAFTAMRQRGAQVTDLVVLVVAADDGVMPQTVESIKAAKAAGVTILVAINKVDKPQAAPERVMQQLTEYELVAEQWGGTTIMLPVSARTKQGIPELLEYIALQSEVLELKANPDKLAAGRVIEAKLEKGRGPVATVLVEEGTLRVGDALVTGVHFGRVRAMMNERGEQVDNVGPGYPVEVLGLSGVPVAGDEFDVVEDEKAAKEVAQHRATKQRQKELGGVKKATLEDLFAKAKTSAQKVLNLVVKADVQGSSEAVSQALEKAATKKVGVKILESAVGAITKSDVLTAAAGNAVIVGFNTKPETEIENIASQQGVKILMFGIIYEAVDRIREEMAGLLEPIIKEKPLGKAEVRQVFNIPRVGQIAGSAVTEGVVKRAGHVRVVRDRKVVFTGKIGSLKRVKDDVREVAQGFECGIGVDGFSDVKQGDVLEVYELEEIRQSLD

SEQ ID NO: 4045 - protein, 1062 aa, Frankia CcI3
MAGKARVHELAKELGVDSKTVLAKLKDLGEFVKSASSTVEAPVVRKLKEAFPADGAPTSPGRATSRPGPPGGGARPTPPSRPGLAPRPGPRPVPGRPGPLGRPGPATPAPSPSPASPPLPASPVQASPVQASPVQASPTSAPAAPRPAAASAVPAPPMPSVPSAPSGPRPGPNAPRPGAPQGGGRPRPGTPVPPSGPTAGGPTAGGPTAGGPTAGGPRPGPRPGPRSAAPGNNPYTTPSAGPRPSAGPRPSAGQSGPPSTPTPRPSAPRSGTPRPGTPRPGGPRPGGTGAGGPRPTPGGMPPRPGGPRSGAGGGMPPRPGGTGGPRPNANMFQPRPAGGPPGRPGGGGAPGRPGGGGAPGRPGGGGGPRPGGFAGRGGAPGRPGGGGGGGGAPGRPGGGGGGGGAPGRPAAGGRGRGGTTAGAFGPGGRGRPGRQRKSKRAKRQEWESGLEAPRMGAMVPRGNGQAIRLPRGASLADFADKIDANPGALVQVVFTQLGEMVTATQSCTDETLQLLGVTLGYEVQIVSPEDEDKELLESFDLSFGGEYGDDVELSSRPPVVTVMGHVDHGKTKLLDAIRSTDVVGGEAGGITQHIGAYQVRAKVDGDERPITFIDTPGHETFTAMRARGAQVTDIVVLVVAADDGVKPQTIEALNHAQAAGVPVVVAVNKVDKEGADPAKVRGQLTEYGLVAEEYGGDTMFVDVSARNRTNIDGLLEAIVLTADASLDLRAPTEVEAQGVAIEGRLDRGRGPVATVLVQRGTLRVGDSVVAGEAFGRVRAMLDEHGGQVVEAGPARPVQVLGFTSVPDAGDNFLVVPEDRVARQIAERRQARERNAELALSRGRPTLETILERMKEGEKTQLNLILKGDVSGSVEALEDALLKIDVGDEVGLRIIDRGVGAITETNVMLASASDAIIIGFNVRPQGKATELADREGVEVRYYSVIYQAIEDIENALKGMLKPVYEEAQLGTAEVREVFRVPRIGNVAGSLVRSGVIRRNTKARLIRDGVVVADNLTVESLKRFKDDATEVREGYECGIGLGSFNDIKIDDVIETFEQREVPRA

SEQ ID NO: 4046 - protein, 1011 aa, Candidatus Koribacter versatilis Ellin345
MKIRINDLARELEVKSKAILDALTKVGVTEKKTHSSSIEDHEAVLVKKYIHEHGTEESPRRRSAGEDEFKPKIDLSKISKPGDVLKALTQKAAPPPPPPPPPRPAVKAPSPVSQEPRPPAVPPAPQKPAVFARPASETVHTPPEPPKPRFITPASVAAQRPVITPPKPPVPPAPPVAVAPPAVIEPAAPAEEPKAAAPATTAPEAPEVKAPVSPERVAPAADTGAHVTAKPEAPAAPGAATPAPTPGRPLPGVPLRQQTPGRRMIVPQTGPRPVYSAPPPAPPRPTPPPQMSQGAGTRPGMPVRGQPIFQRRPQSGPGGGSGGPGGFQRPGGPPRPGDRPRGPHPTRQFPSGPRPMGGIGLAPPGAPANKPAGRPAPARRPGQRYVPRGQKEGPMKGFVPPPRLSLSNEPLPITRNITISEGISVKDLAEKLGIRAKDLIARLLARGVFATVNQTLEASLASEMANHFGASTDVITFEDQLAQETAKAAGETPEEAAANAVVRPPVVTIMGHVDHGKTSLLDAIRATDVAGGEAGGITQHIGAYKVAIGDPNSPAFGREIVFLDTPGHEAFTRMRARGSKITDIVVIVVAADDGVMPQTVEAIDHARAANVPIIVAVNKIDKPDAMPERVKKQLADRGLMPEDWGGNTVFVDVSAKQKTNLNLLMEMICLVADLGDLKANPDRMASGTVVEAKLDRGRGPVATVLVQNGTLRTSDNFVVGNAFGKVRAMFNDRGVSLDTAGPSTPVEIIGLETLPQAGDQFTVVADREKARDISEYREGRAREAQLAKSSRVSLEGLAEQLKTAGQKDLPIILKGDVQGSVEVLNDLLSKMSTEKVKITMIRSGVGAITESDVLLASASNAIIIGFNVRPERKAQELAVQEGVDIRLHSIIYELQDEMKKAMLGLLEPIIKETYQGRADVKDTFRIPKVGTIAGCQVADGIIKRDSHVRLVRDNVVIYTGKIGSLKRFKDDASEVRNGMECGIGIAGYGDIRSGDVIEAFTSEKIAADSLH

SEQ ID NO: 4047 - protein, 689 aa, Rubrobacter xylanophilus DSM 9941
MSKRVYEIAKELDLDTKEVIGRLNAAGIEVKNHFATVEDPDYERVFGGGNGRSEAGEERGRKGRQKKRRRVVIDASATNRGPRAAAPSRPSRGRGAAREEAPAAEEREAPEVVRVEPGATVRDLGEALGVPPTRIIQILMGLGEMKTVTQTLSTEEIELVAEELGRRVEVGALEEPAPEEIGPEDSPEDLVEKPPVITVMGHVDHGKTSLLDRIRRTNVVSGEAGGITQHIGAYQVEHEGRRITFIDTPGHEAFTEMRARGARVTDIVVLVVAADDGVMPQTEEAIEHARAAGVPIVVAINKIDVPNANPDRVMGELAERGLTPEQWGGETVTVPVSAKTGEGIEDLLENILVVAELEELRANPKAPASGYVIESRLDPGRGPVATLLLNRGTLHRGDVVLAGTAYGRVRAMFDYTGQRIKEAGPGTPVEILGLSGVPEAGTRFEVAENERAARSRAQQAEERLRRQELAASGPRRTTLEELLGEGGAEELNLVVKADVAGSVEALKEALAKLSTDEVRVNVVRSGVGAVTDSDIMLASASGGIVIGFNVRPTNTAKQVAEREGVEIRTYDVIYKVIEEIEAAMKGMLAPETAERETATAEVRATFRVPNVGTVAGCYVTSGEIRRNNRVRVVRDGTVVYDGQIASLKRFKDDVRTVREGFECGVGIENFNDVKEGDVLEFYEVVEIPR

SEQ ID NO: 4048 - protein, 962 aa, Syntrophobacter fumaroxidans MPOB
MTRMRVHELAKELNMDNKDLIDRILKLGIQVKNHMSTLTDSAVLKIRQQFSEAKTETVEEKRIGRAVIRRRKKLTEGESAAAPAEGEERVASEALPVEAEMPAQPVEAPELIAEPISKLPPEVGVAQPQLPEEPEPAPEPLIPAVKPEEAAASELAVEPQTVVPPVAAPAAEVKPARPPMEAPAPARKPPEEKETKVKHAEPESLAEPLPSPAPVELTLVPAESAAGQVAERTDEEEEEDDKARPKKAKKRRRKKVRKDEPARIIKLPEIIPEEPEEEAVLPAHLATRIQVKTEEVEVKEAPRKKRPRPEEFEKEAAERKAKGTRRKEVFEREDLYSKQEIAAQDDRGRLKGDKRRPFAKEPARPEIAVVKPGKRKIRVDEAITVANLAKQMGIKATELIKKLLLLGLPANINQAVDFDTAALLASEFEFEVEKTGFEEEELLQVREDRVEDLIRRPPVITVMGHVDHGKTSLLDAIRDTNVIGGEAGGITQHIGAYYVMLPNGNVVFLDTPGHEAFTSMRARGAKVTDIVILVVAADDGVMQQTIEAINHAKAAEVPIIVAINKVDKPNANIDRVKRELAEHGLIPEEWGGNVTMVGISAKKRTGIEELLEMVLLQAELLELKANPAKPARGRVIEAKLDKGRGPVATILIQEGTLRTGDVYLCGVNSGRVRNMFSDRGQRLDEAGPSMPVEVLGLSGVPNAGDDFITLPDERQAKMIAEHRLVKLREKELSRTSKVTLESLFEQIQEGEIKELNLILKADVHGSLEAITDSLLKLSTPEVKVSLIHFGTGAVIETDVMLASASNAIVIGFNVRSETKVQELADQENVDVRYYDVIYQLLSDVKDAMVGMLEPVFKENVIGRAEVRQTFQVPKIGMIAGSFVLEGRVERNAKCRVLRDHVVTYDGKISSLRRFKDDAKEVKAGFECGIGVENFNDIKVGDILEVYELQEMKPVLESPPGDK

SEQ ID NO: 4049 - protein, 879 aa, Acidothermus cellulolyticus 11B
MAKVRVYELAKELNVESKTLLAKLHELGEFVRSASSTIEAPVVRKLREAFPPPPEPAAGNGSAAQPTAKPSAAKSTGKTTEPAADAAAPPAVTTPPSAAPAGATTSAPSDAGGEKIATPPRPVKLPQPPRPAPAVPKPPSGPPRMGNNPFTSPMPRPMPPRPVQRPTGTPGTPGIPRPPLRPGAPGRPTPGAMPPRPAAGRAAPGRGAPIRLPGGLGRAPAPPSAGRPGVGGRGRGAPGGAFGRGPGAKPSRPHKSKKQRRQEFDNLQAPVIGGIQIPRGNGQVVRLPRGASLADFADKIGANPASLVQVAFHLGEMVTATQSVNEETLQLLGAELGYEVQIVSPEDEDRELLESFDIELGTDQGDEAALVPRPPVVTVMGHVDHGKTKLLDAIRNTNVAAREHGGITQHIGAYQVTAQTADGPRQITFIDTPGHEAFTAMRARGAQVTDIAVLVVAADDGVMPQTVEALNHAKAADVPIVVAVNKIDKPGADPVKVRGQLTEYGLVAEEYGGDTMFVDVSALTGQGIDDLLEAILLTADAALDLRANPNQPAQGVAIEAHLDRGRGPVATVLVQRGTLRVGDSIVAGEAFGRVRAMLDEFGQPVEEAGPSRPVQVLGFTSVPDAGDTFLVVPEDRVARQIAERRAARERNAQLAASRRRRTLEDILERMEKGEVAELRLILKGDVSGSVEALEDALLKIDVGDEARIRVIDRGVGAITENNVMLAVASDAIIIGFNVRPEGKARELAEREGVDVRYYSVIYQAIEDVEAALKGLLKPVYEEVQLGTAEVREVFRSSKFGNIAGCLVRSGTITRGAKARVVRDGVVVANDVSIASLRRFKDDVTEVREGFECGVGLGSFNDIRVGDVIETYEMREKPRS

SEQ ID NO: 4050 - protein, 1079 aa, Desulfovibrio vulgaris DP4
MTENKTKVKDLAAELGVTTKELGQVLKDMNISAKTSTSVIAQEDLPRIKERVQAQRDGGARKEGNPDVIVRRRHRDGDRASARAEAKAPEQEATAAMPETSAPERAEEADKPAVAKPAKAPETEAHARARKEPQAEPVKARIIRRPDEPAPVAKVVEAAPAETPAPEAPAVKATVTAEAAPAKTVEPESERPQADKPATARVVRPATPDASAVPDGTSSAPTLPVRSAEPSDTVERADADADGDDDDAQQRRRKKKRRQPEAVVPQVRVISRPDPAAVAQQQMQQQAAQQQREAGGYRPGGQRPEGGYRPEGQREGGYRPEGQREGGYRPGGAPRPEGGYRPGGPRPEGGYRPGAPRPEGGYRPAGGPRPEGQREGGYRPGAPRPEGGYRPAGGAPRPEGQREGGYRPAGGPPRPGGAPRPGGFGGAPGGMPVPGADGRGDQSKKKRQKGRRTVDFQADGPRGRSDDDVMRGPRGRGKRGKKDVRPAATQPLKAIKRKIKVDEAIRVADMAHQMGLKANEIIKVLFGLGVMATINQSLDIDTATVVAGEFGYEVEKVGFSEDDYLVPKEEDAPETLVTRPPVVTIMGHVDHGKTSLLDAIRKSNVTAGEAGGITQHIGAYHVTTKKGEIVFLDTPGHEAFTAMRARGAQITDLVVLVVAADDGVMEQTREAVNHSKAAGVPIMVAVNKMDKEGANPDRVIRELSELGLVAEDWGGDTIFAKVSAKTREGLDELLELIAIQAEILELKANPDKAARGHVVEAKLDKGRGPLATVLVQEGTLRQGDAFVCGVFAGRVRAMFDDQGRKVKEAGPSTPVEVQGFDGVVEAGEEFVSVADDKVARRIAESRAVKQRERELAKESKVTLETFLSRRADAAEALTLNLVLKADVQGTLEAISEAVRKLSTEKVKINIIHGGAGAITESDILLASASDAIIIGFNVRPTSKVKDIAEQENVDIRFYDIIYKLVDEIKSAMAGMLAPVQREVYLGQAEVRETFSVPKIGVIAGCHVADGKVTRNAGVRLLRDGVVVYTGKITSLKRFKDDVRDVQKGYECGMGLENFNDIKVGDVIEAFEMVEEAATL

SEQ ID NO: 4051 - protein, 689 aa, Bacillus cereus cytotoxis NVH 391-98
MSKIRVYEYAKKYNISSKEIITKLKEMNIEVSNHMTMLDDEVVNKLDNEYNNEVKKPSVADEFEVEEKVVRSKKNSNKKKKKGKGNQDKRQENFAGKQQAQTVETPDKITFSGTLTVGELANKLGKEPSEIIKKLFMLGIMATINQDLDKDTIELIASDYGIEVEEEVVIDEIEFETFIDEQDEEEGDLKERPAVVTIMGHVDHGKTTLLDSIRNSKVTAGEAGGITQHIGAYQVEVNDKKITFLDTPGHAAFTTMRARGAQVTDITILVVAADDGVMPQTVEAINHAKAAGVPIIVAVNKMDKPAANPDRVMQELTEYELVPEAWGGDTIFVPISAIKGEGIDNLLEMILLVSEVEEYKANPNRYATGTVIEAQLDKGKGAIATLLVQNGTLRVGDPIVVGTTYGRVRAMVNDIGRRVKVAGPSTPVEITGLNEVPQAGDRFMAFADEKKARQIGESRAQQALLAQRGEKSKLSLEDLFQQIQEGDVKEINLIVKADVQGSVEAMAASLRKIDVEGVKVKIIHTGVGAITESDIILASASNAIVIGFNVRPDVNAKRTAESENVDIRLHRIIYKAIEEIEAAMRGMLDPEFEEKVIGQAEVRQTFKVTKVGTIAGCYVTDGKITRDSGVRIIRDGVVIYEGQLDTLKRFKDDVKEVAQNYECGITIEKYNDIKEGDIIEAFIMEEVKR

SEQ ID NO: 4052 - protein, 1046 aa, Frankia EAN1pec
MAGKARVHELAKELGVDSKTVLAKLKDLGEFVKSASSTVEAPVVRKLKEAFPAEGSAPSSRPGGRPGNGARPMPPPRPGPAIGRPGPGSGTGPRPGPGGRPVPGRPGPAPLPGASRPSTPTAAPQSQPAQTQPPQSQPVAPQPSQAPRPAAAAASAAAPAPAPSAPAPAPSAPAPAPITSAPTAATPPAAPQRPTPGGPRPGPAAPGRPRTGGPGGPGGPGGGPRPGPRPGPRPAAPGNNPYTSPAAGPRAASGQGGSPSAPPRPGAPRPGGPRPGGPRPGGPGGQRPSPGQMPPRPGGSGGPRPTPGQMPPRPGGSGGPRPNSNMFQPRPAGGAPGRPGGGGGPGRPGGGGGGPRPGGGGFAPRGGAPGRPGGGGGAPGRPGGGGPGGGGRPAAGGRGRGGTTAGAFGPGGRGRPGRQRKSKRAKRQEWESGLEAPRMGAMVPRGNGQAIRLPRGASLADFADKIDANPGALVQVVFTQLGEMVTATQSCTDETLQLLGVTLGYEVQIVSPEDEDKELLESFDLSFGGDYADDVELSARPPVVTVMGHVDHGKTKLLDAIRSTDVVGGEAGGITQHIGAYQVRAVVDGTERPITFIDTPGHETFTAMRARGAQVTDIVVLVVAADDGVKPQTIEALNHAQAANVPIVVAVNKVDKEGADPAKVRGQLTEYGLVAEEYGGDTMFVDVSARNRTGIDELTEAVILTADASLDLRAPTGTEAQGVAIEGRLDRGRGPVATVLVQRGTLRIGDSVVAGEAFGRVRAMLDENGAQVSEAGPARPVQVLGFTSVPDAGDNFLVVPEDRVARQIAERRQARERNAELALSRGRPTLETILERMKEGEKTQLNLILKGDVSGSVEALEDALLKIDVGDEVGLRIIDRGVGAITETNVMLASASDAVIIGFNVRPQGKATELADREGVEVRYYSVIYQAIEDIENALKGMLKPVYEEAQLGTAEVREVFRVPRVGNVAGSLVRSGIIRRNTKARLIRDGVVVADNLTVESLKRFKDDATEVREGYECGIGLGSFNDIKVDDVIETFEQREVPRT

SEQ ID NO: 4053 - protein, 884 aa, Candidatus Desulfococcus oleovorans Hxd3
MAKIRIFELARSLNMTNPDLLDRLKEMGIEAKSHLSSLEDDIVEKVRQGVFRTEVEKPEKVEQKRVRSNVIRKRRQPVKSEAEPEAEAPAAQAPEAEEVTAPTAEEAVPEEAADADVSAKAETPTAPETPEEAEISVSEEAPVEEAADQVPPTDEAVDPAEAAPAEEESSPSRKKAKAKKHQAAKIIKFPDAPQRLSNKGVLEVVDDTAPADSPAAPAAATPAGEKDKKPSRKDRKKRGKTESVETEEAVPVKKKGVFKRKEIVEGVALYDRTRGRMRKKGKGGAKVPGGAKTQITTPKAIKRKVRINESISVAELAKRMGVKASEVIARLMGMGVMATLNQQVDFDSAALVAAEFEYEVEKASATEEELLELNVEEDQGNLKKRAPVVTIMGHVDHGKTSLLDVIRQSRITEGEAGGITQHIGAYKVNTANGEVVFLDTPGHEAFTAMRARGARATDIVILVVAADDGIMPQTIEAINHSRAAGVPIVVAVNKIDKEGADPDRVKREASDHGLVPEDWGGDTMFVNVSAKQKLGISDLLDMVLLQAEMLELKANPDKKARGVVIEAKLDPGRGPVATVLIHEGTLSVGETVVCGIHYGKIRAMFDDKGAPLDQAGPATPVELIGLGGVATSGDDLFAVGDEKSAKTVSENRQQKQRTEDLARKDSISLENFFEKMQEKEEKVLNIIIKADVNGSCEAIADSLQKFSSGEVKIHVVHSAPGTIIESDVTLASASNAIVLGFNVRPSPKVRALAAEENVDIRSYDIIYDLIDDIKKALTGMMSSTFEEEVLGRAEVRELFVIPKKGTIAGSYVLDGKIERGRPARLLRDGVIAYNGVIGSLRRHKDDAKEVASGYECGIGIENYNDIKPGDVIECYFLREIKPEL

SEQ ID NO: 4054 - protein, 995 aa, Salinispora arenicola CNS-205
MAGKARVHELAKELGVESKTVLAKLKEMGEFVKSASSTVEAPVARRLRNAFVNNAGSPAPAAPPAVAPPTPTPTPPRTPTPAPPPGGPRVSAKPMPPRRQGVPTPGPKPKGPVPGPPQSATPVTKPASAHDIEVAAAEARAAALKAEQEAAVKAAQAARQQQRENVRREPPTEGGPRPGPRPGPGTMPPRPGSPAAGRSGAPAPGPGPRPGGRPPARGAGNNPFGIQGGQQRPPAAGAGGPRPSPASMPPRPSPASMPPRPSPASMPSQRPGRPGGPGSGRPGSGAGRPGGGGGGGYRGGGGGGGGGGYRGGPGGGGGGGGGFRGGPGGGGGGFRSGPGGGGRPGGGGRGRGGGAAGAFGRPGGRPTRGRKSKKQRRQEFDNLSAPTMSSGAPRGQGQVVRLSRGASLSDFADKINANPGSLVQEMFNLGEMVTATQSCSDDTLLLLGEHLGFAVQIVSPEDEDRELLAQFNIDLDAEVAEDRLVSRPPVVTVMGHVDHGKTKLLDAIRKANVVAGEAGGITQHIGAYQVHVPHDGEDRAITFIDTPGHEAFTAMRARGAQVTDIVILVVAADDGVMPQTIEALNHAKAAEVPIVVAVNKIDKPEANPDKVRQQLTEYGLVAEEYGGDTMFVNVAAKPGTGIESLLEAVLLTADASLELTAPTDGPAQGVAIEAHLDKGRGAVATVLVQKGTLRAGDSIVAGGAHGRVRAMLDENGNQVAEAGPSRPVLVLGLTAVPGAGDTFLAAEDDRTVRQIAEQRQARRRAAAFANSRGRATLETLMEQLKAGEKTSLNLVLKGDVSGSVEALEDALFNLDIPEEVQLRIIHRGVGSITESDVMLASASSEAVTIIGFNVRAANKVREMADREGVEIRYYTVIYQAIEEIEAALKGLLKPEYEEVELGTAEVREVFRSSKVGNISGCIVRSGLIRRNAKARLLRDGAVVADNLTIGSLKRFKDDATEVREGFECGLTLGGYNNVQVGDVIETFEMREKARA

SEQ ID NO: 4055 - protein, 688 aa, Bacillus weihenstephanensis KBAB4
MSKIRVHEYAKKNNISSKDLMTKLKEMNIEVSNHMTMLEDEVVNKLDNQYSAGAEKPSVADEFEVEEKVVRSKKNSNKNKKKGKANEDKRQDNFAGRQQTPIVETPDKITFSGSLTVGDLAKKLSKEPSEIIKKLFMLGIMATINQDLDKDTIELIATDYGIEVEEEVVVSETEFETFIDEQDDEENLKERPAVVTIMGHVDHGKTTLLDSIRNSKVTAGEAGGITQHIGAYQVDVNDKKITFLDTPGHAVFTTMRARGAQVTDITILVVAADDGVMPQTVEAISHAKAAGVPIIVAVNKMDKPAANPDRVMQELTEYELVPEAWGGDTIFVPISAIQGEGIDNLLEMILLVSEVEEYKANPNRYAAGTVIEAQLDKGKGTIATLLVQNGTLRVGDPIVVGTSFGRVRAMVSDIGRRVKVAGPSTPVEITGLNEVPQAGDRFMAFADEKKARQIGESRAQEALVAQRGEKSKFSLEDLFQQIQEGDVKEINLIVKADVQGSVEAMAASLRKIDVEGVKVKIIHTGVGAITESDIILASASNAIVIGFNVRPDVNAKRTAELEKVDVRLHRIIYKVIEEIESAMQGMLDPEFEEKVIGQAEVRQTFKVTKVGTIAGCYVIDGKITRDSGVRIIRDGVVVFEGKLDTLKRFKDDVKEVAQNYECGITIERYNDLKEGDIIEAYVMEEVKR

SEQ ID NO: 4056 - protein, 686 aa, Bacillus cereus AH187
MSKIRVHEYAKKHNISSKDLMTKLKEMNIEVSNHMTMLDDEVVNKLDNEYQAEKPSVADEFEVEEKVVRSKKNSNKKKKKGKGNEDKRQENFAGRQQTQTVETPDKITFSGSLTVGDLAKKLSKEPSEIIKKLFMLGIMATINQDLDKDTIELIANDYGIEVEEEVIVSETEFETFIDEQDDEENLKERPAVVTIMGHVDHGKTTLLDSIRNSKVTAGEAGGITQHIGAYQVEVNDKKITFLDTPGHAAFTTMRARGAQVTDITILVVAADDGVMPQTVEAINHAKAAGVPIIVAVNKMDKPAANPDRVMQELTEYELVPEAWGGDTIFVPISAIQGEGIDNLLEMILLVSEVEEYKANPNRYATGTVIEAQLDKGKGTIATLLVQNGTLRVGDPIVVGTTFGRVRAMVSDIGRRVKVAGPSTPVEITGLNEVPQAGDRFMAFADEKKARQIGESRAQEALLAQRGEKSKLSLEDLFQQIQEGDVKEINLIVKADVQGSVEAMAASLRKIDVEGVKVKIIHTGVGAITESDIILASASNAIVIGFNVRPDVNAKRTAELENVDIRLHRIIYKVIEEIEAAMQGMLDPEFEEKVIGQAEVRQTFKVTKVGTIAGCYVTDGKITRDSGVRIIRDGVVIYEGQLDTLKRFKDDVKEVAQNYECGITIEKYNDLKEGDIIEAYIMEEVKR

SEQ ID NO: 4057 - protein, 658 aa, Dictyoglomus turgidum DSM 6724
MKKRIYELSKELGIDNKDLLKILADLGVNVKSALNVIDEEVEEIVKELVLGKTEITEEKAEKPETPPVEKEERKVQEETVEVIELPKEEKKEKVLKIQGSMRVKDLAEALSISPTELIMELLNMKILANVNQMLDPDIIKELAKKHDYKVEEVKPQVSLKKKILSPEEEARLKSRPPVVVVMGHVDHGKTTLLDAIRQTKVAEKEYGGITQHIGASMVEHNGRKIVFLDTPGHEAFTALRARGAQVTDIAVLVVAADDGVMPQTIEAINHAKAANVPIIVAINKIDKPEANPERVKQQLSEYGLIPEEWGGDTIMVPISAKRKQGIDQLLEMILLLSDILELKADPDKPAKGAIIETKMDKGRGPVATVIIQEGTLRLRDVFVAGNVMGRVRTMFDDKGRPLKEALPSWPVEVSGFDELPQAGDILEVVENEEVAKAILEERKQKKETSNIEVWGLGEKILPIIVKADTQGSLEAILQTIDKMHTEDITIKVIHSGVGGITESDVMLASASKGIIIGFNVRPDSKAQQAIAKEKVIAKTYRIIYEIIEDLQNYIKGLKEPQIKEVIIGKGEVKATFNVPKVGTVAGVYVREGKIQRNAKVRLIRDGKIIYDGRIASLKRFKDDVNEVLTNFECGVGLENFGDIKPGDILEVYVLQQTQ

SEQ ID NO: 4058 - protein, 686 aa, Bacillus cereus B4264
MSKIRVHEYAKKHNISSKDLMTKLKEMNIEVSNHMTMLDDEVVNKLDNEYQTEKPSVADEFEVEEKVVRSKKNSNKKKKKGKGNEDKRQENFAGRQQTQIVETPDKITFSGSLTVGDLAKKLSKEPSEIIKKLFMLGIMATINQDLDKDTIELIANDYGIEVEEEVIVSETEFETFIDEQDDEENLKERPAVVTIMGHVDHGKTTLLDSIRNSKVTAGEAGGITQHIGAYQVEVNDKKITFLDTPGHAAFTTMRARGAQVTDITILVVAADDGVMPQTVEAINHAKAAGVPIIVAVNKMDKPAANPDRVMQELTEYELVPEAWGGDTIFVPISAIQGEGIDNLLEMILLVSEVEEYKANPNRYATGTVIEAQLDKGKGTIATLLVQNGTLRVGDPIVVGTSFGRVRAMVSDIGRRVKVAGPSTPVEITGLNEVPQAGDRFMAFADEKKARQIGESRAQEALVAQRGEKSKLSLEDLFQQIQEGDVKEINLIVKADVQGSVEAMAASLRKIDVEGVKVKIIHTGVGAITESDIILASASNAIVIGFNVRPDVNAKRTAELENVDIRLHRIIYKVIEEIEAAMQGMLDPEFEEKVIGQAEVRQTFKVTKVGTIAGCYVTDGKITRDSGVRIIRDGVVIFEGQLDTLKRFKDDVKEVAQNYECGITIERYNDLKEGDIIEAYIMEEVKR

SEQ ID NO: 4059 - protein, 688 aa, Bacillus cereus G9842
MSKIRVHEYAKKNNISSKDLMTKLKEMNIEVSNHMTMLEDEVVNKLDNEYNTGAEKPSVADEFEVEEKVVRSKKNSNKKKKKGKGNEDKRQDNFAGRQQTQIVETPDKITFSGSLTVGELAKKLSKEPSEIIKKLFMLGIMATINQDLDKDTIELIATDYGIEVEEEIVVSETEFETFMDEQDDEENLKERPAVVTIMGHVDHGKTTLLDSIRNSKVTAGEAGGITQHIGAYQVEVNDKKITFLDTPGHAAFTTMRARGAQVTDITILVVAADDGVMPQTVEAISHAKAAGVPIIVAVNKMDKPAANPDRVMQELTEYELVPEAWGGDTIFVPISAIQGEGIDNLLEMILLVSEVEEYKANPNRYATGTVIEAQLDKGKGTIATLLVQNGTLRVGDPIVVGTSFGRVRAMVSDIGRRVKVAGPSTPVEITGLNEVPQAGDRFMAFADEKKARQIGESRAQEALVAQRGEKSKLSLEDLFQQIQESDVKEINLIVKADVQGSVEAMAASLRKIDVEGVKVKIIHTGVGAITESDIILASASNAIVIGFNVRPDVNAKRTAELENVDVRLHRIIYKVIEEIELAMQGMLDPEFEEKVIGQAEVRQTFKVTKVGTIAGCYVIDGKITRDSGVRIIRDGIVIFEGQLDTLKRFKDDVKEVAQNYECGITIERYNDLKEGDIIEAYVMEEVKR

SEQ ID NO: 4060 - protein, 1079 aa, Desulfovibrio vulgaris  Miyazaki F
MTDDKTRVKDLSTELGVSTKDLLHTLRDLDIPAKSVMTTLTADEVSRVRERHQGQTAEAGVDRKVVQPGVIVRRRRRDGEEGEAPVRRRADEGEAASGIADAEAPAAKAEAPVPPAADERPARAARAEAPAAPEARPATPAARIIRRHDEPAPVAEAPAEPVQVAPVAPAAPVTPAPASADKPADVQVEAAPAVAAQQAEKPATPTARIIRPARPDASAMPDATPQPSILPPVAADAAPRGEGVDGDEDDADGNRRRKKKRTPDAPGPQVRVISRPDPSAPAPRPYPQGDRTDRGDRPAYGDRQGYQPRSGGPGGDRPSYGGDRQGYAPRPGGPGGPGGDRPGYAPRPGGPGGDRPGYAPRPGGPGGDRPGYGPRPGGPGGPGGPGGDRPGGYRPGGPGGPRPGGPGGPGYGPRPGGPGGPGGPGMGQPPAGGDEGQSKKKRLKGRRTVDFQPGADRTTRGREDDDFPRGGARRGKGRKGRDMKVATATQPLKAAKRKIKVEEAIRVADMAHQMGLKSTEIIKVLFGLGVMATINQSLDIETATLVASEFGYEVEKVGFSEDDYLIPKEEDTPETLQHRPPVVTIMGHVDHGKTSLLDAIRKTNVTMGEAGGITQHIGAYHVTTKKGEIVFLDTPGHEAFTAMRARGAQVTDIVVLVVAADDGVMEQTREAVNHSKAAGVPIMVAVNKMDKEGANPERVQRELAEMGLVSEAWGGDTVFSHVSAKTRQGLDELLELLALQAEILELKANPDKPARGHIVEAKLDKGRGPVATVLIQEGTLKQGDTFVCGVFSGRVRAMFNDQGKKVKEAGPAMPVEVQGFEGVPEAGEEFVCVTDEKLARRIAETRAVKQREKELARESKVTLETFLSRRVDDQEALVLNLVVKSDVQGSLEAISEALRKLSTEKVRINIIHGGAGAISESDILLASASDAIIIGFNVRPTAKVKDIAEQENVDIRFYDIIYKLVDEVKSAMEGMLAPVQREVYLGQVEVRQTFGVPKVGTIAGCHVADGKITRNAGVRLLRDGVVVYTGKITSLKRFKDDMKEVMKGYECGVGLENFNDIKIGDIIEAFEMVEEAATL

SEQ ID NO: 4061 - protein, 951 aa, Anaeromyxobacter dehalogenans 2CP 1
MSKKRVHELGKQLKEQGIELSNQELVEKLHALGYLEVKSHSSSLEDDQAHAAYEKILAERKPKPAPVRPSGPGFVVRKRAHVEPPTVTAPAAPPPAEPEYAEPQYAEPQQAEQAYEPEPQEAQPEAAPEPVAAPEQPAEAAPLAAQAAPSPGAEAAAPAAPQAQPAQPAAPVAPPAPSAQPSAPQPPAAQPRPPQPPMPSRPPPAGYRPAPPPGARPPMSAAPGAPAQPGAAGQPPRPPVDPRTLRPTSTQAVVISRPLVPVRRVTPPTSARQQFPVAPGPRALGEVRELKVVPGSLGREREFIDVSRDKRRGRQPGRPISEEQAKSLSGKELLQAAISDRAYIPIRGKKKKPTKKGAKTQITEKAEHKKVIRIEESISVSELSQVMGVKASDLIRKLMQMGKMVTINAQIDADTAAILALEHGYTVEKKGFEVEEFIPEVEVDESKLVIRPPVVTVMGHVDHGKTSLLDAIRQADVAAGEAGGITQHIGAYSVNTPQGPITFLDTPGHEAFTAMRQRGAQVTDLVVLVVAADDGVMPQTVESIKAAKAAGVTILVAINKVDKPQAAPERVMQQLTEYELVAEQWGGTTIMLPVSARTKQGIPELLEYIALQSEVLELKANPDKLAAGRVIEAKLEKGRGPVATVLVEEGTLRVGDALVTGVHFGRVRAMMNERGEQVDNVGPGYPVEVLGLSGVPVAGDEFDVVEDEKAAKEVAQHRATKQRQKELGGVKKATLEDLFAKAKTSGQKVLNLVVKADVQGSSEAVSQALEKAATKKVGVKILESAVGAITKSDVLTAAAGNAVIVGFNTKPESEIENIASQQGVKILMFGIIYEAVDRIREEMAGLLEPIIKEKPLGKAEVRQVFNIPRVGQIAGSAVTEGVVKRAGHVRVVRDRKVIFTGKIGSLKRVKDDVREVAQGFECGIGVDGFSDVKQGDILEVYELEEIRPSLD

SEQ ID NO: 4062 - protein, 1034 aa, Actinosynnema mirum DSM 43827
MAGKARVHELAKELGVTSKELMTTLASQGEYVKSASSTVEAPVARRLRDAHAKGEGKKPSSGARPSAPKPQAPSAPQGGSEAPRPSMPMGKPGPRPVPGPRPQAPKPQTPAKPAAAEQAPQAPAATPVAPAPAAQAAPAPAAQAPKAPAAPAAERQQGPRPASGPRPGPRPGPRQQPQQQQPAAAAENPSVVPPRPQSPKPQGPRGPRPGNNPFGVGGGAPAPRPQAPRPQGGPGGGERGDRGSKPGDPRPGGPRPAGPRPGGSAGSGGPRPNPGNMPPRPNPGMMPGRSAAPRPGGGGGGRPGGGPGGGGRGPGGGGGGGGFRGGGGGGGGGGFRGGGGGGGGGGFRPGGGGPGGGGGGGGFRPGGGGGAPAGGGGGGFRGRPGGGGPGGRGGTAGAFGRPGGPARRGRKSKRQKRQEYMDNMQAPSVGGVRLPKGSGETIRLPRGASLTDFADKINANPASLVQVLFHLGEMVTATQSVSDEILELLGSEMNYVVQVVSPEEEDRELLETFDITYGEDAGGEDDLAIRPPVVTVMGHVDHGKTRLLDTIRKTKVAEGEAGGITQHIGAYQVQTELEGNPRLITFIDTPGHEAFTAMRARGANSTDIAVIVVAADDGVMPQTVEAINHAQAANAPIVVAVNKIDKEGANPAKIRQQLTEYGLVAEEYGGDTMFVDISAKQGVNIDGLLEAILLTADASLDLRANPGMEAQGVAIEAHLDRGRGPVATVLVQRGTLRVGDSIVAGDAYGRVRRMVDEHGDDVTEAYPSRPVLVIGLTSVPRAGDTFLVVEEDRVARQIAERRQARTRNALNAARRKRVSLEDLDAALKETSQLTLIIKGDNSGTVEALEDALMKIEVGDDVELRVIHRGVGGITEGDINLAVAGSAIVLGFNVRAEGKATELANREGVDVRYYTVIYQAIDEIEQALKGMLKPEYEEVQLGRAEVREVFKSSKVGTIAGCLVLSGEIRRNARARLLRDNNVIQESLPISSLRRFKDDATEVREGYECGLTLGNYGDLKIGDVIETFEMREKPRA

SEQ ID NO: 4063 - protein, 940 aa, Desulfomicrobium baculatum DSM 4028
MSTRLRVRDLATELDISSKDLMTLLRELKIPAKSHMSSLTDEEVGQVRNHHQNRAATPQVVDTRATTGVIVRKRHKVAATETPAEEPAPIEVEAPEETVEKPKTRKPSRAVIVTPARIIEEAPSSAAEADKPAVEEAPAAEAPVTEAPAAMEEAPEQAVAAESATVAPAAAEEKVTASAETPGETAAETEGESEEAGRARKKAKKAKPAPPSVQVKIISRPTIVEFPDTRVDGQPVRPMGPAARPMGPAGYTPRPSGPGTRPSGPGGPGGPGGPRPSTPRPSGPPSLGAPPRPAPESEGAKDSRGKKKKGRRTVEAADLYRKEEFSMGKGKKAQRAEARRAGGARAQAQNTQPLKASKRKIRIDDTIRLTDLAHQMGIKAQDLIKKLFSLGVMATINQSLDFDTALLLAAEFKYEVERAGFSEDDFLLPKEADKAEDLKPRPPVVTIMGHVDHGKTSLLDAIRSTSVASGEAGGITQHIGAYHVATSRGEIVFLDTPGHEAFTTMRARGAKVTDIVVLVVAADDGVMEQTKEAVSHSKAAGVPIVVAVNKMDKEGADPDRVKRELSDLGLMPEDWGGDTIFAHVSAKKREGLDELLELILLQAEVLDLKANPDKPGRGHIVEAKLDKGRGPVGTVLIQEGQITQGDAFVCGMISGKVRAMFDDQGRQIKTAGPAIPTEIQGFEGIPEAGDEFVIVKDEKVARKIAEDRRVKHRDKELAKESKVTLESFLATKAGEEAQNLNLLLKADVQGSLEAISEALRKLSTDEIKIVLIHGGAGAITESDILLASASNAIIIGFNIRPTAKIKEVAEQEKVDIRFYDIIYKLVDDIKAAMSGMLSPDIKEVYLGQADVQQVFSVPKIGNIAGCMVSDGKLRRNAGIRLLRDGVVIYTGKLSSLKRFKDDAKEVTKGYDCGAGLENFNDIKVGDIIEAFELVEEARTI

SEQ ID NO: 4064 - protein, 732 aa, Geobacillus WCH70
MSKMRVYEYAKKNNVPSKDVIHKLKEMNIEVTNHMATLEPEVVEKLDHTYNKKNERPQASAPKEKQKAPVKPKNYVDDFDDEDEEVVKTKVPKKKSANKKKEGKKHDLQLQQQEKKIFHQQKKKIKGKAKAKEQQPVQQEQPMKKEKELPKKITFEGTLTVAELAKKLGREPSEIIKKLFMLGVMATINQELDKDAIELICSDYGVEVEEKVVIDETNFESIEIVDDPEDLVERPPVVTIMGHVDHGKTTLLDSIRHSKVTEQEAGGITQHIGAYQVTVNDKKITFLDTPGHEAFTTMRARGAQVTDIVVLVVAADDGVMPQTVEAINHAKAANVPIIVAINKMDKPDANPDRVMQELMEYNLIPEEWGGDTIFCKLSAKTGEGIDNLLEMILLVSEMEELKANPNRRATGTVIEAKLDKGRGPVATLLVQAGTLHVGDPIVVGCTYGRVRAMVNDTGRRVKEAGPSTPVEITGLHEVPQAGDRFMVFEDEKKARQIGEARAQKQLMEQRNMKARVSLDDLFEQIKQGEMKELNIIVKADVQGSVEALVAALQKIEVEGVRVKIIHAAVGAITESDILLATTSNAIVIGFNVRPDANAKRVAESEKVDIRLHRIIYKVIEEIEAAMKGMLDPEYEEKVIGQAEVRQTFKVSKVGTIAGCYVTDGKITRDSKVRLIRQGIVVYEGEIDSLKRFKDDVKEVMQGYECGLTIKNFNDIKEGDVIEAYIMQEVERK

SEQ ID NO: 4065 - protein, 1051 aa, Catenulispora acidiphila DSM 44928
MAKVRVYELAKELGVESKVVMAKLQDLGEFVRSASSTVEAPVVRKLIDSIQQAESGGAKGGAPKSAASAQSGSAAKAASSGAPRPGGAPKPGPRPGPVAPKPGPAVPAQAQAAVEAASPVAEAPEAPAAPEVQAAPAAPVAEAPSAPAPAPARPASQGRPSQGQGTGGAIPPRQAPAAGGSIPGRPGPRPATPGQRPGGERDRGERNDRGERGQRPAPGGTRPSPAGAQRPGQGQGQGGRPGGAPTPGPRPAGPRPGNNPFTSSGSTGMQQPPRPAPRPGPPTGAQSGGGEGGPRPGMPPRPGGGVPGAPRPNPGMMPGRAAPRPGAGQGRPGGPRPGAPAGGPGGRSGGPRPGAPAGGPGARPGGGGGGGGYGAPRPGGGAPGGGGGGYGGRPGGGGGYGRGGRAGGGGTAGAFGRPGGRPGRGRKSKKQRRQEFDNMQAPSLGGAMLPRGNGQTIRLPRGASLVDFAERINANPASLVQVMFHLGEMVTATQSVSDDVFELLGQELGFTVQIVSPEEEDRVLLESFDIDFGENEGGEEDLRVRPPVVTVMGHVDHGKTRLLDAIRKTNVIEGEAGGITQHIGAYQVVAEVAGTERAITFIDTPGHEAFTAMRARGAKATDIAILVVAADDGVMPQTIEALNHAQAADVPIVVAVNKIDKEGADPTKVRGQLTEYGLVAEEYGGETMFVDISAREGLNIDQLLEAVILTADASLDLRANPDMDAQGVAIEANLDRGRGAVATVLVQRGTLRVGDSMVVGDAYGRVRAMMDENGENVAEAGPSRPVQVLGLTSVPGAGDTFLVVEEDRVARQIAERRATRERNAAMARSRKRVSIEDWENVIKAGEVQQLNIIIKGDGAGSVEALEDSLLKLDVGAEVDLRVVHRGVGSITESDVDLAMASDAVILGFNVRPDGRAKTKADREGVEIRFYSVIYQAIEEIEAALKGMLKPEFEEVQLGTAEIRAIFRSSKIGNIAGCMVQDGLIRRNSKARLIRGGSVVADNLTIVGLRREKDDATEVREGFECGINLGSYNDIKEGDIIETFEMREKPRA

SEQ ID NO: 4066 - protein, 938 aa, Saccharomonospora viridis DSM 43017
MAGKARVHELAKELGVTSKEVLAKLKEQGEFVKSASSTVEAPVARRLRDAFSKKDDQQAEKAPDKGKPSMVRSTTPRRGETGTPTPKPAPPQPQAGQPQAKPEQPPVPKPGPRPVPKPGPKPGPIPKPGEQAPAAKATPKDQQGSVVPPKPQGPKPGPKPGPRPPRVGNNPFGVGSGAPAPRPAPPRPGGGQSDRAPRPGGERPASPKSGAPRPHPGNMPPRPNPGMMPPRPPRPAGGPGGRSGGPGGRGGPGGRGGAPRTGGGFRGGPGGGGGGFRGGPGGGGGFRGGRGGPGGRGGTAGAFGRPGGPSRKGRKSKRQKRQEYMETMQAPSVGGVRLPKGNGETIRLPRGASLTDFAEKINANPGSLVQVLFHLGEMVTATQSVSEDVLELLGSEMNYNVQVVSPEEEDRELLEAFDINFGTDAGSEEDLRPRPPVVTVMGHVDHGKTRLLDTIRQTKVGEAEAGGITQHIGAYQVKTEVDGEERLITFIDTPGHEAFTAMRARGAQATDIAVIVVAADDGVMPQTVEAINHAQAAKAPIVVAVNKIDVSGANPAKVRQQLTEYGLVAEEYGGDTMFVDISAKQGTNIDGLLEAIVLTADAALDLRANPDMEAQGVAIEAHLDRGRGPVATVLVQRGTLRVGDSVVAGDAYGRVRRMVDEYNRDVTEAKPSRPVQVIGFTSVPRAGDTFLVVEEDRVARQIAERRQARIRNAENAARRKRVSLEDLDSALKETNTLNLIIKGDNSGTVEALESSLMQIDVGDEVELNIVHRGVGGVTESDIDLATASDAVVIGYNVRAQGKATERATREGVDVRYYTVIYQAIEEIEQALKGMLKPVYEEVDLGRAEVREVFKSSKVGTIAGCLVTSGEIRRNSKARLLRDGVVVGENLPVSSLRRFKDDVVEVREGFECGLTLGKFSDIKVGDVIETYELREKPRE

SEQ ID NO: 4067 - protein, 892 aa, Desulfohalobium retbaense DSM 5692
MTTKMRVRELSNELGLSNKELLHLLRELGIQVKSHMSGLSDDEVDQVRQRFHAGSQSQDSVQKRTTRSGVIVRRRRRAAKSESEPEPQPAEEPEAEPEAAAEAAAAEPQPEPAPTARIVEPPHADEEPEEGEPEAEEPEAEEPQHPEETTQAEPAQDTGVAQEPQETEETIQEQPAEDSEEPSETEAGKKKKKKRKKKPESPAVKVISKPEVTAEEPAPSPAPAEAADTEAASKKKKKKDKRVVDFSSTPAEAEPQDKRKASTQWKKKKSAGVKDKTGGKERRPGRKRQQQGGKAEPVRPTTQPTKASKRKIKIDEAIRLGDLARQLGVKVQELIKSLMQLGIMATINQSLDIETATVLAEEFGYEVEKVGFSEDEFILPKEEDNPEALEPRWPVVTIMGHVDHGKTSLLDAIRESKITTKEAGGITQHIGAYYVGTDRGELVFLDTPGHEAFTAMRARGAQVTDIVILVVAADDGVMDQTREAINHSKAAGVPLIVAVNKMDKENADPERVKRELAEFDLVPEEWGGDTIYAYVSAKSHSGLDDLLEMVLLQAEVQELKANPAKRARGHIVEAKLDKGRGAVGTVLVQEGTLHHGDAFVCGLYHGKVRALFNDRGKNIKSAGPSMPVEVQGFDGVPEAGDEFVAVQDDKVARRIAEERQTKQREKDLAKETKVTLESFMAAKADEEVKSLNLVIKADVQGSLEACIEAVRKLSTDEVKVEIIHGGTGSISESDIMLASASSAVLIGFNVRPTARIKDIAEQEKVDIRFYDVIYQMVNEVKDAMAGMLAPVVKEVYLGQAEVRDTFSVPKVGTVAGCMVVDGKLQRNAHTRLLRDGVVIYTGKIDSLKRFKDDAKEVQKGFECGVGLENFNDIKSGDIIEAFEEVQEKATLD

SEQ ID NO: 4068 - protein, 612 aa, Nakamurella multipartita DSM 44233
MQAPSIGGVALPRGNGSTIRLARGSSLADFADKIDANPASMVQALFHLGEMVTATQSVSDDILELLGSEMGYQVEIVSPDDEDRELLESFDLTYGEDEGDESDLVVRPPVVTVMGHVDHGKTKLLDAIRNTHVVDKEAGGITQHIGAYQVATHLGDEERLITFIDTPGHEAFTAMRARGSQSTDIVVLVVAADDGVMPQTVEAINHAKAADVPIVVAINKIDKEGANPDKIRQQLTEYGLVAEEYGGDTMFVEISAKAMINIDGLLEAVLLTADAALDLRANPNMNAEGVAIEAHLDRGRGAVATVLVQRGTLRVGDSIVAGNAYGRVRAMLGDHGEQVAEATPSRPVQVLGFTSVPGAGDSFMVVEEDRVARQIAERRQARARKAQIGNRRRISLEDFGKALAEQKIEQLTLIIKGDNSGTVEALEDSLLKLDVGEEVDLRVVHRGVGGITQDDINLAATTDAIVIGFNVKPVRGVQELADREGVDIRYYTVIYQAIDEVEAALKGLLKPEFEEVQTGSAEIREIFRSSKFGNIAGCIVRNGEIRRNARARLLRGGVVLNDNLQIDSLRRFKDDVTEVREGFECGIGLGSWNNIELEDTIETYEVREKPRS

SEQ ID NO: 4069 - protein, 255 aa, Nitrobacter winogradskyi Nb-255
MTADIRLFTCLTDNFGVLIHDPATGATAAIDAPEAEPVIQALDREGWVLTDILITHHHSDHVGGVAELKRKYACRVVAPHDRSAEIANVDLRVGQGDIIKVGTLLGRVLETPGHTLDHVSYVFDDEKVVFAADTLFSIGCGRVFEGTYPMMWDSLLKLRALPDSFRLYCGHEYTDSNIKFALTIEPNNPVLKARAEEVTRLRAEGRPTVPTLMGEEKKANVFLRADDPAVAAGVHMKGASGVEVFAELRERKNKS

SEQ ID NO: 4070 - protein, 255 aa, Rhodopseudomonas palustris HaA2
MAADIRIVPCLTDNFGYLIHDPSSGATASIDAPEAAPLIAALEKEGWKLTDILVTHHHGDHVGGIAELKAKYHCRVVAPHDANAKIADADLRVEEGDVVKVGGLEARVLETPGHTLDHISYVFADDRALFAADTLFSIGCGRVFEGTYPMMWESLLKLRALPDDYKLYCGHEYTASNVKFALTIEPENAALQARAKQVEQQRGAGRPTIPVTLGEEKQANVFLRADVPSVAAAIGFAGESAADVFGELRERKNNS

SEQ ID NO: 4071 - protein, 255 aa, Rhodopseudomonas palustris BisB18
MAAEIRVFTCLKDNFGYLVHDSDSGATASIDAPEAAPILAALAREGWTLTDILVTHHHADHIGGIAELKQATNCRVVAPHDNGAAIPLVDLRVRQGDVVKIGGLLARVLETPGHTLDHVAYVFDDDKALFAADTLFSIGCGRVFEGTYPMMWESLLKLRVLPDDMRLYCGHEYTAANVKFALTVEPNNPALQARAAEVAHLRTAGLPTIPTLLGDEKRANVFLRADEPTVAAGVRLKGAGAVEVFTELRERKNKS

SEQ ID NO: 4072 - protein, 255 aa, Rhodopseudomonas palustris BisB5
MAADIRIVPCLTDNFGYLIHDPSSGATASIDAPEAAPLIAALEKEGWKLTDILVTHHHGDHVGGVAELKKKYQCRVVAPHDANAKIADIDLRVEEGDVVRVGGLSARVLETPGHTLDHISYVFDDDRALFAADTLFSIGCGRVFEGTYPMMWESLLKLRELPDDFKLYCGHEYTASNVKFALTIEPDNAALQARAKQVEQQRAAGQPTIPVTLGEEKQANLFLRADVPSVAAAVGLPGESAADVFGELRERKNNS

SEQ ID NO: 4073 - protein, 255 aa, Nitrobacter hamburgensis X14
MTADIRLFTCLTDNFGVLIHDPATDATAAIDAPEAGPIIEALDREGWTLTDILVTHHHADHIGGIAELKQKYKCRVVAPHDKKAPIANVDLRVGQGDIVKVGTLLGRVLETPGHTLDHISYVFDDEKVVFAADTLFSIGCGRVIEGTYPMMWDSLLKLRALPDDFRLYCGHEYTASNVKFALTVEPNNAALKARAEDVARLRAENKPTVPTLMGEEKKANVFLRADDPAVAAGVHMKGASGADVFGELRERKNKS

SEQ ID NO: 4074 - protein, 256 aa, Maricaulis maris MCS10
MSELLIRQFPCLSDNYGFLIHDPDSGETATIDTPDADVILNEADQAGWSITQIWNTHHHFDHAGGNETIQALTGAKVVAPRYDRHRIPGISMEVEDGDVISLGDHKAKVFYTPGHTMGHVCYHMPMDGIAFVGDTLFALGCGRLFEGTPAEMWHSLSRLAALPDETRIYCAHEYTEANARFALSIDPDNHDLQVYAAMVEGERARGEPTVPTTIAAEKAANPFLRPDDPAIRARLGMEHDDDEEVFAEIRRRKDSF

SEQ ID NO: 4075 - protein, 255 aa, Bradyrhizobium BTAi1
MAADIRVFTCLSDNFGYLIHDPATGATASVDAPEAGPIIRQLEAAGWTLTDILITHHHHDHVGAVAELKQKYGCRVVAPHDKTTAIADVDLRVGHGDVIKVGELLARVLETPGHTLDHVSYVFDADKAVFAADTLFSVGCGRVFEGTYPMMWDSLLKLRALPDDFRLYCGHEYTASNVKFALTVDGDNEALKARAAEVTRLRAANESTIPSLLGDEKQTNVFLRADDPAVAIKLRMKGATAEQVFGELRERKNKS

SEQ ID NO: 4076 - protein, 256 aa, Sinorhizobium medicae WSM419
MAALELDLFLCRTDNYGVLLHDRLSGATASIDAPEERPILDALERRSWQLTHILTTHHHGDHVAGNIGLKERFGVTIIGPKNESPKIPGIDRSVGHGDRFDFAGHPVEVIETPGHTAGHVCYHFPEDKLLFAADTLFALGCGRLFEGTPETMWQSLSRLMALPDDTAIYFGHEYTLANARFAVTVDPENTALKERAAEIEETRSDGGFTAPTTMGLEKRTNPFLRADDPKIRAFLGMDKASDAAVFAEIRKRKDSF

SEQ ID NO: 4077 - protein, 256 aa, Parvibaculum lavamentivorans DS-1
MTKLQIHQFPCLSDNYGYLVHEPSSGMTAAIDTPEVKPILDALAEKGWKLTHILNTHHHFDHAGGNAELKEKTGCTIIGPKGEEGAIPGIDRAVQEGDIVELGAARARVLDVPGHTRGHIAYSFDDDHIAFVGDTLFALGCGRLFEGTAQQMWTSLGKLMALPDDTVVYCAHEYTQSNARFALSVEPQNEALIARAKEIDAKRARGEWTVPTTIGLEKATNPFLRAASADLRRTIGLETAADVDVFAETRKRKDNF

SEQ ID NO: 4078 - protein, 282 aa, Xanthobacter autotrophicus Py2
MPAASATHSGAVSNAVPLALRRPETVPAEIRLVPCLSDNYAVLIHDPVTEATAVVDVPEATPVIAALEKEGWNLTHILVTHHHADHTQGIPAVKARFGATVVGPKSEADKIPGLDVTVVDGDPVAVGSLVGRVLETPGHTAGPATYLFEGEKLLFAGDTLFTLGCGRPLECEPPVLWDSLQRLRALPEDLQVYSGHEYTLANARFAATVDPDNPALIRLYGDAQRKRDAGSPTIPSRLGDEVAANPFLRADDPGMAERLGMAGAEPALVFTELRLRKNAFKG

SEQ ID NO: 4079 - protein, 248 aa, Caulobacter K31
MSLTIHQFPCLSDNYGFLVRDDATGTTATIDTPDADAILAELKKLGWKLDLILNTHWHPDHAGGNAAIQAATGATIVGPQEVSRIAPLDRPVVQDDTVMLGETALSVIDTGGHTLGHIAYHDAADHIAFVGDTLFALGCGRLFEGTAEQMWGSLSKLTALPDDTTVYCAHEYTASNARFALSVDQDPALKSRANAVFAARERGEATVPTTIGLEKATNPFLRAPLLRPHLPPAEAFGEIRAAKDSFKG

SEQ ID NO: 4080 - protein, 256 aa, Beijerinckia indica ATCC 9039
MSAHIHQFLCLKDNFGVLVHDPESRHTAAIDAPEAGPILEALAAREWTLTEILITHHHQDHIGGIPGLKAEFPEARIIGPAREADKIGHLDQAVREGDQVKVGQLEAMVLEVPGHTSGHVVYWFEQDDILFTGDTLFAMGCGRGFEEPANILYNSLMKLAALPGELQVYCGHEYTLSNAEFALTIEPDNVLLRDRVAEVRQLRAENRFTLPTTITIELGTNPFLRVDEPSVQAAVGMPGGDPAAVFAELRERKNRA

SEQ ID NO: 4081 - protein, 255 aa, Rhodopseudomonas palustris TIE 1
MPADIRIVPCLTDNFGYLVHDPATGATASIDAPEAAPLIAALDKEGWKLTDILVTHHHGDHVGGIAELKKKYQCRVHAPHDANAKIADADVRLQEGDVVRVGDLTARVLETPGHTLDHLSYVFDADRALFAADTLFSIGCGRVFEGTYPMMWESLLKLRALPDDFKLYCGHEYTASNVKFALGIEPDNAALQARAKQVEALRAEGKPTIPVTLGEEKQANVFLRADVPSVAAAVGMPGAPAAEVFGEIRERKNNG

SEQ ID NO: 4082 - protein, 255 aa, Methylobacterium sp. 4-46
MPEIRTFLCRSDNIGVLIRDPATGACAAIDVPEAGAVLRVLGETGWSLTDILVTHRHFDHVEGTPEVKARTGARVTAPAKAGDAVPEVDATVREGDAVRLGSLVAAVWETPGHCADHVTYWFERERIAFAGDTLFTLGCGRVMESPPEVLWRSLSRFLALPDETAIYSGHDYVLSNARFALAADPDNPNLKARAELAERVKRDGRFLIPTTLGEEKATNPFLRATEPALARAVGMAPGSDPAAVFTALREWKNRF

SEQ ID NO: 4083 - protein, 256 aa, Rhizobium leguminosarum bv  trifolii WSM2304
MKPLELDVFLCRTDNFGVLVHDPETGFTAAIDAPEEAPILEAATRRGWKITHIFTTHHHTDHVAANLALKEQFGCEIIGPINEAIAIPGLDRTMADGDSFLFGDHTINVIETPGHTAGHICYHFVDDKLLFAADTLFALGCGRLFERPAADMWHSLQKLAVLPDETAIYFGHEYTLSNARFALTVDPGNERLKGRAAEIEALRADGKFTIPTTLGLEKETNPFLRAADPAIRRNLLMEGKTNEEVFAEIRKRKDNF

SEQ ID NO: 4084 - protein, 256 aa, Methylocella silvestris BL2
MAPHIHQFICLSDNFGVLVHDPETRATCAVDAPDGAPILAALAAREWELTDILLTHHHADHVQGVGALKAAFPKARVVGPLKEAEKIGGLDLKVGEGDLVMVGSLAARVIAVPGHTSGHVAYWFEEEDLAFVGDTLFAMGCGRAFEEPPDVLFHSLSKLAALPDETQVYCGHEYTLANAKFALSVEPGNTLLKERAGEVAALRAAGKFTLPTTISIELATNPFLRAEEPELQAAVGMPGADPAAVFAVLRERKNHA

SEQ ID NO: 4085 - protein, 255 aa, Methylobacterium nodulans ORS 2060
MPEIRTFLCRSDNIGVLLHDPVTSACAAIDVPEAGAVLRALKETGWRLTDILVTHRHFDHVEGIPEVKARTGARVTAPAKAGDAVPEVDATVREGDVVKVGSLVGTVWETPGHCADHVTYWFERERLAFAGDTLFTLGCGRVMESPPEVLWRSLSRFLALPDETAIYSGHDYVLSNARFALAADPDNSNLKARAELAERVKRDGRFLIPTTLGEEKATNPFLRAGEPALARSVDMAPGSDPAAVFAALREWKNRF

SEQ ID NO: 4086 - protein, 256 aa, Agrobacterium vitis S4
MKSPDIEIFPCRTDNYGVLVHCPETGLTASIDAPEEGPIVAAAEKRGWQISHIFTTHHHNDHVEANLALKQRYGCEIIGPVNEAVAIPGLDRSAYDGEEFLFGPHRVQVIETPGHTAGHVCYHFPDAKLLFAADTLFALGCGRLFERPAADMWHSLQKLAVLPDETAIYFGHEYTLANARFALTIDPDNERLQARARDIEAMRAQGQFTIPTTMSLEKETNPFLRVADPKIRRNLVMESKSNEEVFAEIRKRKDNF

SEQ ID NO: 4087 - protein, 256 aa, Rhizobium leguminosarum bv  trifolii WSM1325
MKPLEIDVFLCRTDNFGVLVHDPETGFTAAIDAPEEAPILEAATRRGWKITHIFTTHHHTDHVTANLALKEQFGCEIIGPINEAVAIPGLDRTMADGDSFLFGDHTVNVIETPGHTAGHICYHFVDDKLLFAADTLFALGCGRLFERPAADMWHSLQKLAVLPDETAIYFGHEYTLSNARFALTVDPDNERLKSRAAEIEALRADGKFTIPTTLGLEKETNPFLRAADPAIRRNLLMEGKTNEEVFAEIRKRKDHF

SEQ ID NO: 4088 - protein, 262 aa, Arthrobacter FB24
MDWFNTIIRTFFDFGAMAEVLPQLLGVGLLNTLIISVAATIIGVALGMVVAVMGISPSKWLRVPARIYTDLFRGLPAILTILLIGQGFARLSQSIFGPSPYPLGIIALSLIASAYIGEIFRAGIQSVDRGQGEACRALGMSYAKSMALVVVPQGIRRVLPALVNQFIAIVKDSSLVYFLGLLVTERELFRVGQDAAVLSGNLSPLVMAGIFYLIITVPLTHLVNYFDSRFRTGRRRPSAPTSGLNEVKELDAASPLITGSNT

SEQ ID NO: 4089 - protein, 226 aa, Shewanella baltica OS185
MIDAINTSLFSPIGEDGMIGILLILNGLKVTLIVTFFAMLLGAVLGIGTTFMKMSSKWYIRFPANLYVGVIRGTPVVVQLVILYFIVLSALDVDKITAAIIAFGLNSGAYISEIIRAGIQAVDKGQTEAARSLGLSQAMTMKSIILPQAIKNILPALGNEFIVLLKETAVIGFIGGVDLMRAGEIIRSRTFEDSVPLFTCALIYLFLTYSFTFVLSKFEKRLKQSD

SEQ ID NO: 4090 - protein, 219 aa, Bacillus cereus cytotoxis NVH 391-98
MNLDFSAITPSIPYILKGLEVTLKIVAVSALIGFILGTLLALCKIARIRVLNVAADLYTSIFRGTPLVLQLMIIYFGVPQMIGYDIPAFLAAVIAFSLNSGAYMSEVIRAGIQAIDKGQTEAAIALGVPYGKMMRHIILPQALKNILPALVNEFATLTKESAVVTVIGATDLMRRAYIVGGETFKYLEPLLFVGLVYYILVIVLTVVGKAIEGRMKKSD

SEQ ID NO: 4091 - protein, 235 aa, Campylobacter hominis ATCC BAA-381
MYFKIFKFLFFIAIVLIAIYYTYPTDITDAQIKNYCKSYGITMILTIGGTSIGIFLGFILAFLKFANFKILNFIIDEYIDIIRGTPIVIQLMIFVFVIFASWTNNIAAAVFALGLNSSAYVAEIVRSGINSIDKGQMEAARAMGLNYTTSMRKIVFPQAIKNILPALANEFISLFKETSVVGMVAITDLTFFSKSLQATLYTVQPILFAAVIYYVSVKFFTLLVKLLEKRLNRND

SEQ ID NO: 4092 - protein, 226 aa, Shewanella baltica OS195; identical to SEQ ID NO: 4089

SEQ ID NO: 4093 - protein, 235 aa, Clostridium phytofermentans ISDg
MSIQIKMEEFYQRFVSNFIEDNRYMYLVRGLITTLVITFFAVMIGALLGFIIAIIRSTYSKTGKLRVLNFLCNIYITVIRGTPVVVQLLIIYFVIFGSVNINKIFVAVLAFGLNSGAYVSEIVRSGIMSVDEGQFEAGRSLGFNYNQTMRLIILPQAIKNILPALGNEFIVLLKETSVCGFIALEDLTKAGDIIRGRTYDAFMPLIAVALIYLTLVIIFTKLVNYLERRLRNSDH

SEQ ID NO: 4094 - protein, 226 aa, Shewanella baltica OS223
MIDAINSSLFSPIGEDGMIGILLILNGLKVTLIVTFFAMLLGAVLGIGTTFMKMSSKWYIRFPANLYVGVIRGTPVVVQLVILYFIVLSALDVDKITAAIIAFGLNSGAYISEIIRAGIQAVDKGQTEAARSLGLSQAMTMKSIILPQAIKNILPALGNEFIVLLKETAVIGFIGGVDLMRAGEIIRSRTFEDSVPLFTCALIYLFLTYSFTFVLSKFEKRLKQSD

SEQ ID NO: 4095 - protein, 258 aa, Catenulispora acidiphila DSM 44928
MIAIGCTAGFAAVVGVLVVTSPGWPRFRESFLSWSVFRSSMPDILRGFWLNIQIFMVAEPIILILGLGVALIRTTKSPGLLPFRLTATLYADVFRGVPTLLLILVVGFGIPALQLSGTPKDPVVLGVVALTLSYVAYVSEVFRAGLDSVHPSQRAAATALGLSERQTLRFVVLPQAIRNVVPPLLNDFSALQKDTALVSTLGVVESLRQAQIHESLTFNYTPYVGAALLFIAVTVPLARYTDRLARRAAARQQAGGAR

SEQ ID NO: 4096 - protein, 575 aa, Rhodoferax ferrireducens T118
MHYDACTDVDKCIFMLLTRGEQNVSTPSRVEYQITPSQYKHWKLEFNGPVATLKADFDENAGLRPGYKLKLNSYDLGVDIELNDAISRIRFEHPEVRTVVVTSARDRVFCSGANIFMLGVSSHAWKVNFCKFTNETRNGLEDSSAHSGLKFLAAVNGACAGGGYELALACDEIILVDDRSSAVSLPEVPLLGVLPGTGGLTRITDKRHVRHDLADLFCTSAEGVRGDKAVAWRLVDAVAKPAVFAQKVQERALALAAQSDRPADAKGVALTPLERSIEADALRYTHVTVEIDRAKRTATFTVKAPTGVQPSDIAGIEAAGAAWYPLAMARELEDAILNMRTNETEIGTWLIKTEGEAKAVLAMDATLLAHKNHWLVRETLGLLRRTFSRLDVSSRSLFALIEAGSCFAGTLLELALACDRSYQLVLPNDEASTPRITVTETNFGLYPMATTQSRLGRRFYDEQSALDSVRARIGEALDADAAFALGLVTSNPDDIDWADEVRIAIEERVSMSPDSLTGLEANLRFNGQENMSTRIFGRLTAWQNWIFQRPNAVGEKGALKVYGKGDKAAFDWNRV

SEQ ID NO: 4097 - protein, 556 aa, Burkholderia xenovorans LB400
MSTAETAVAPVDYRTDPSQYKHWKLSFNGPVATLGIDIAEDGGIRDGYKLKLNSYDLGVDIELHDAIQRIRFEHPEVRTVVLTSLKDRVFCSGANIFMLGLSTHAWKVNFCKFTNETRNGLEDSSRHSGLKFLAAVNGACAGGGYELALACDEIYLVDDRSSSVSLPEVPLLGVLPGTGGLTRVTDKRKVRHDRADIFCTVVEGVRGERAKAWRLVDEVVKPNQFDQAIQARALELAAQSDRPAHAQGVPLTRIERTDREDGLTYKTLDVTIDRAKRIATFTAKAPQTEPPASIDAIVAAGANWWPLKFAREFDDAILSMRTNELAVGTWVFRTEGDARHLLAADASLMQHKDHWFVRETIGLLRRTLARIDVSSRSLFALIEPGSCFAGTFAELAFAADRTYMAALPANEDEEPAITLSEVNFGLYPMVTHQSRLARRFYEETEPLDAVRSRIGQAIKPVEAERLGLVTASPDDIDWADEIRIALEERAAMSPDALTGLEANLRFNGPETMETRIFGRLTAWQNWIFNRPNAVGEKGALKVYGKGSKAQFDVSRV

SEQ ID NO: 4098 - protein, 552 aa, Polaromonas JS666
MNIDTRVDYQTNPGRYKHWALKFEGPVATLTADFDENAGLRPGYKLKLNSYDLGVDIELNDAINRIRFEHPEVRTVVVTSAKEKVFCSGANIFMLGVSSHSWKVNFCKFTNETRNGLEDSSKYSGLKFLAAVNGACAGGGYELALACDEIILVDDRSSAVSLPEVPLLGVLPGTGGLTRVTDKKHVRHDLADLFCTSVEGVRGQKAKDWRLVDDIAKPQVFAQKVRERALELAATSDRPADGKGVMLSPVACVLEADALRYPNVTVEIDRAKRTATWTVKGPTGAQPTDVAGIEAAGAAWYPLQMARELEDAILQMRTNELDIGTWLIETQGDPAAVLAMDATLLAHQNHWLVRETIGLLRRTFSRLDVSSRSLFALIEPGSCFAGTFLELALACDRSYHLALPDDESGAPKITVGEVNFSLYPMVTEQSRLGRRFYNEQPALDAVRASMGQPLDADAAFALGLVTSNPDDIDWTDEVRIAVEERVSMSPDALTGMEANLRFNGPENMFTRVFGRLTAWQNWIFQRPNAVGEKGALKVYGKGDKAQFDWNRV

SEQ ID NO: 4099 - protein, 552 aa, Polaromonas naphthalenivorans CJ2
MTIASRVEYQTDPSQYKHWKLSFNGPVATLAVDIDENAGLRPGYKLKLNSYDLGVDIELNDAISRIRFEHPEVRTVVVTSAKEKVFCSGANIFMLGVSSHSWKVNFCKFTNETRNGLEDSSRYSGLKFLAAVNGACAGGGYELALACDEIILIDDRSSAVSLPEVPLLGVLPGTGGLTRVTDKRHVRHDLADLFCTSVEGVRGQKAKDWRLVDDIAKAVDFSQKVQTRALALAEQSDRPADGKGVVFKPLNRTVEADALRYSNVTVEIDRAKRTATWTVKAPTGAQPSSIAGIEALGADWFPLVMARELEDAILMMRTNELEIGTWLIKTEGDAAAVLAMDDVLLANQKHWLVRETIGLLRRTLSRLDLSSRSLFALIEPGSCFAGTYLELALACDRSYHLALPDDEDRAPKITVAETNFGLYPMVTDQSRLGRRFYDEAPALEAVRAKAGQPLDADAAFAIGLVTSNPDDIDWTDEVRIAIEERVSMSPDALTGMEANLRFNGTENMFTRIFGRLTAWQNWIFQRPNAVGEKGALKVYGKGDKSQFDWNRV

SEQ ID NO: 4100 - protein, 560 aa, Verminephrobacter eiseniae EF01-2
MTDHPPPVAARIDYRTDPGQYRHWKLAVDAPVARLSLAIAEDGGIRPGYQLKLNSYDLGVDIELHDALNRIRFEHPQVRSVIITSARERIFCSGANIFMLGRSSHAWKVNFCKFTNETRNGMEDSSRYSGIKFVAAVNGTCAGGGYELALACDAIVLVDDRSCAVSLPEVPLLGVLPGTGGLTRLTDKRHVRHDLADIFCTSVEGVRGQRALDWRLVDQIAKPAQFAAAVDACAARLGAGSMRPSDARGVRGIALTPLEREESADSLRYAHVSVAIDRRRGCATLSIQAPTGAQPADIASIEAAGAAWWPLAMARELDDAILHLRTNELDIGTWLLKTQGDAAAVLASDATLLAHQEHWLVRETIGLLRRTLARLDVSARSLFALIEPGCACAGSLAELAFAADRIYMLALPGDAQRAPRLTLDEFNFGLLPMVNDQSRLQRRFHAEAAPLQAARAALGQPLDADAAQALGLVSAAPDDIDWDDELRIAIEERAAMSADALTGLEANLRFAGQENMNTRIFGRLTAWQNWIFNRPNAVGEKGALKVYGTGQKAVFDPDRV

SEQ ID NO: 4101 - protein, 562 aa, Bradyrhizobium BTAi1
MAGAPRKLANGKAFIDFQTEPSRYRHWKLSVQGETATLAMDVDENAGLFEGYQLKLNSYDLGVDIELADALMRLRFEHPNVKVVLLRSAKDRVFCAGANIRMLAGSEHPHKVNFCKFTNETRNAMEDASQYSGQRFVTVVNGTAAGGGYELALATDHIMMVDDGSTAVSLPEVPLLAVLPGTGGLTRVVDKRMVRRDHADVFCTIEEGIKGRRAVQWRLIDELVPPSKLEERVKATASDLATKSPRSGPAEGVKLTQLDRKFRADGIDYGFVRLDIEAAQRLATITVRVAEAASAKSAAEIVALGAAFWPLQCARELDDAILHLRNNAYEIGTVIFKTEGDPEVARAYDDLLEAHRDNWFVHEIRHYWKRVLKRIDVTSRTLVALIEPGSCFVGTLAELAFAADRSYMLLGQFQGDNRPAATIELTRANFGAYPMSHGLTRLQSRFLATPDKPAQLEAKIATALDADEAEALGLVTFALDDIDWADEVRVFLEERASFSPDAMTGLEANLRFAGPETMESKIFARLTAWQNWIFQRPNAVGEEGALARYGTGQRPTYDLRRV

SEQ ID NO: 4102 - protein, 556 aa, Delftia acidovorans SPH-1
MHPSSPTVDYRTEPAQYRHWSFTVEGAIARMQLNIAEDGGIRPGYKLKLNSYDLGVDIELHDALNRIRFEHPQVRTVIVTSGRDRIFCSGANIFMLGVSSHAWKVNFCKFTNETRNGIEDSSRHSGLKFLAAVNGACAGGGYELALACDDIVLIDDRSSSVSLPEVPLLGVLPGTGGLTRVTDKRHVRHDLADIFCTSVEGVRGQRAVDWRLVDAVAKPAQFEAVVAQRAQRLAEGSTRPANAQGITLTRLEREATDDALHYRHVSVQIDRARRSATLTVKAPTLGQGPQPATIEAIEQAGDAWWPLAMGRELDDAILHLRTNELDVGTWLLKTEGDAAAVLAADAALLAHQDHWLARETLGLLRRSFARLDVSSRTLFALIEPGSCFVGMLAELAFAADRAYMLVLPDDTERAPRIQLDEFNFGLLPLVNDQSRLQRRFYEEAAPLEAARAATGRALDGDQALALGLVTAAPDDIDWDDEIRIAMEERAAMSPDALTGLEANLRFASRENMVTRIFGRLSAWQNWIFNRPNAVGDKGALKLYGTGQKAGFDFNRV

SEQ ID NO: 4103 - protein, 560 aa, Burkholderia phymatum STM815
MSAVMSPAHAAAARVDYRTDPAHYKHWKLSFDGAVATLGIDIAEDGGIRDGYKLKLNSYDLGVDIELHDALQRIRFEHPEVRTVVVTSLKDRVFCSGANIFMLGLSSHAWKVNFCKFTNETRNGIEDSSLHSGLKFLAAVNGSCAGGGYELALACDEIYLVDDRSSSVALPEVPLLGVLPGTGGLTRVTDKRKVRHDRADIFCTVVEGIRGTRAKEWRLVDEVVKPNGFEQAIAARALELAALSDRPANARGVTLTRIERMDREDGITYATLDVTIDRAKRTATFTAKAPSTAQPLDIDAVVAMGASWWPLQFARELDDAILSMRTNELDVGTWILKTQGDARGVLAADATLLQHKDHWFVRETIGLLRRTLARIDVSSRSLFALIEPGSCFAGTLAEFAFAADRTYMAALPANEDEEPAITLSEVNFGLYPMVTHQSRLARRFYEETEPLDAARAKTGQPVKAAEAERLGLVTASLDDIDWADEIRIALEERAAMSPDALTGMEANLRFNGRETMETRIFGRLTAWQNWIFNRPNAVGEKGALKVYGKGSKAQFDVSRV

SEQ ID NO: 4104 - protein, 556 aa, Burkholderia phytofirmans PsJN
MSTAETAVAPVDYRTEPSQYKHWKLSFNGPVATLGIDIAEDGGIRDGYKLKLNSYDLGVDIELHDAVQRIRFEHPEVKTVVLTSLKDRVFCSGANIFMLGLSTHAWKVNFCKFTNETRNGLEDSSRHSGLKFLAAVNGACAGGGYELALACDEIYLVDDRSSSVSLPEVPLLGVLPGTGGLTRVTDKRKVRHDRADIFCTVVEGVRGERAKAWRLVDEVVKPNQFDQAIQARALELAEQSDRPADAQGVVLTRIERTDREEGLTYKTLDVTIDRAKRIATFTAKAPQSEPPTNIDEIVAAGVNWWPLQFARELDDAILCMRTNELAVGTWVFKTEGDARNLLAADASLMQHKDHWFVRETIGLLRRTLARIDVSSRSLFALIEPGSCFAGTFAELAFAADRTYMAALPSNEEEEPAITLSEVNFGLYPMVTHQSRLGRRFYEEAEPLDAVRSLIGQPIKPVEAERLGLVTASPDDIDWADEIRIALEERAAMSPDALTGLEANLRFNGPETMETRIFGRLTAWQNWIFNRPNAVGEKGALKVYGKGSKAQFDVSRV

SEQ ID NO: 4105 - protein, 558 aa, Variovorax paradoxus S110
MTETTTLQAPLRVDYRIEPAQYRHWKLSFEGPVARLVLDIAEDGGIRPGYKLKLNSYDLGVDIELNDALNRVRFEHPEVRSVIVTSGKDRIFCSGANIFMLGVSSHAWKVNFCKFTNETRNGIEDSSKHSGLKFIAAVNGACAGGGYELALACDEILLVDDRSSSVSLPEVPLLGVLPGTGGLTRVTDKRHVRHDLADIFCTSVEGVRGQRAVDWRLVDAVAKPAQFAAAVQERAAQLAAASDRPASGKGVALTRLERTDSADGIAYSNVDVKIDRSKRTATITVKAPTGTQPADIAAIEAAGAAWWPLAVCRELDDAILNLRTNELDIGTWLLKTEGDAAAVLASDALMLAHKDHWLVRETIGALRRTLARLDVSSRSLFALVEAGSCFAGTLAELAFAADRSYMLALPDDAARAPKLVLNEFNFGFFPMVNDQSRLQRRFYEEAAPLDAARAAAGKPLDADEALKLGLVTAAPDDIDWDDEIRIAVEERAAMSPDALTGLEANLRFASKENMATRIFGRLTAWQNWIFNRPNAVGEKGALKVYGTGQKAGFDLNRV

SEQ ID NO: 4106 - protein, 309 aa, Jannaschia CCS1
MTEPTAPRSFQEIILRLQAYWASKGCAVLQPYDMEVGAGTFHPATTLRSLGTRPWTAAYVQPSRRPTDGRYGDSPNRWQHYYQYQVIIKPSPPDLQELYLGSLRAIGIDMDLHDIRFVEDDWESPTLGAWGLGWEVWCDGMEVSQFTYFQQVGGHDCHPVSGELTYGLERLAMYVLDCDDGNEMPFNDPDAPIPLTYGDVFREAEAQYARWNFDVADTDILFQHFKDAEAECARILDQPDTDPKTGRRIVMALPAYDQAIKASHVFNLLDARGVISVTERQAYIGRVRTLTKKCADAFVQTAAGGAEVA

SEQ ID NO: 4107 - protein, 316 aa, Ruegeria sp. TM1040
MTQTTAPRSFQEIILRLQTYWASKGCAILQPYDMEVGAGTFHPATTLRSLGSKPWAAAYVQPSRRPTDGRYGENPNRLQHYYQYQVLIKPSPPDLQELYLGSLEAIGVDMDLHDIRFVEDDWESPTLGAWGLGWEVWCDGMEVSQFTYFQQVGGHDCHPVSGELTYGLERLAMYILGVDHVMDMPFNDPQSPQPLSYGDIFKQTEEEYARWNFDVANTEVLLRHFEEAETECAAILAQEHTDPKTGKRIIMAHPAYDQCIKASHVFNLLDARGVISVTERQAYIGRVRALAKQCADAFVLTEAGGHTEETAGETAA

SEQ ID NO: 4108 - protein, 307 aa, Rhodobacter sphaeroides 2 4 1
MTGKPVPPRSFQEIILRLMTYWGAKGCAVLQPYDMEVGAGTFHPATTLRSLGARPWAAAYVQPSRRPTDGRYGENPNRLQHYYQYQVLIKPSPPDLQKLYLGSLEAIGIDMDLHDIRFVEDDWESPTLGAWGLGWEVWCDGMEVSQFTYFQQVGGHDCRPVSGELTYGLERLAMYVLGIDHVMDMPFNDPCGPTPLTYGDVFRQTEQEYSRWNFDQADTDMLLQHFKDAEAECERILAAPETDKAGRRIVMAHPAYDQCIKASHLFNLLDARGVISVTERQAYIGRVRALAKKCADAFVTTEAGAAA

SEQ ID NO: 4109 - protein, 316 aa, Paracoccus denitrificans PD1222
MTSPKDNQTAKPVCFQDVILRLQSYWAAQGCAVLQPYDMEVGAGTFHPATTLRSLGARPWAAAYVQPSRRPTDGRYGENPNRLQHYYQYQVIIKPSPPNLQELYLGSLAAIGLDPMIHDVRFVEDDWESPTLGAWGLGWEVWCDGMEVSQFTYFQQVGGHDCRPVSGELTYGLERLAMYVLGVEHVMDMPFNPPGSPIPLSYGDVFRQAEREYSRWNFEQADTGMLLQHFKDAEAECDRILTAAETDSAGRRIPMAHPAYDQAIKASHLFNLLDARGVISVTERQAYIGRVRALAKRCADLFVTTEAATLQAEDAA

SEQ ID NO: 4110 - protein, 307 aa, Rhodobacter sphaeroides ATCC 17029
MTGKPVPPRSFQEIILRLMTYWGAKGCAVLQPYDMEVGAGTFHPATTLRSLGARPWAAAYVQPSRRPTDGRYGENPNRLQHYYQYQVLIKPSPPDLQKLYLGSLEAIGIDMDLHDIRFVEDDWESPTLGAWGLGWEVWCDGMEVSQFTYFQQVGGHDCRPVSGELTYGLERLAMYVLGIDHVMDMPFNDPDGPTPLTYGDVFRQTEQEYSRWNFDQADTDMLLQHFRDAEAECERILAAPETDKAGRRIVMAHPAYDQCIKASHLFNLLDARGVISVTERQAYIGRVRALAKKCADAFVTTEAGAAA

SEQ ID NO: 4111 - protein, 307 aa, Rhodobacter sphaeroides ATCC 17025
MTGKPVPPRSFQEIILRLMTYWGGKGCAVLQPYDMEVGAGTFHPATTLRSLGARPWAAAYVQPSRRPTDGRYGENPNRLQHYYQYQVLIKPSPPDLQQLYLGSLQAIGIDMELHDIRFVEDDWESPTLGAWGLGWEVWCDGMEVSQFTYFQQVGGHDCKPVSGELTYGLERLAMYVLGVDHVMDMPYNDPDSPTPLKYGDVFRQTEQEYSRWNFDQADTEMLLQHFKDAEAECERILSAPETDKAGRRIVMAHPAYDQCIKASHLFNLLDARGVISVTERQAYIGRVRALAKKCADAFVTTEAGAAA

SEQ ID NO: 4112 - protein, 327 aa, Dinoroseobacter shibae DFL 12
MTLPGLLPIENAALIKGIPMDTPRSFQEIILRLQAYWADQGCAVLQPYDMEVGAGTFHPATTLRALGSRPWAAAYVQPSRRPTDGRYGENPNRLQHYYQYQVIIKPSPPDLQELYLGSLRAIGIDAALHDIRFVEDDWESPTLGAWGLGWEVWCDGMEVSQFTYFQQVGGHDCRPVSGELTYGLERLAMYVLGVDHVMDMPFNAPDAAIPLSYGDVFRQTEAEYSRWNFDQADTATLLKHFEEAEAECAAALAAPHQDPKTGKRILMVHPAYDQCIKASHLFNLLDARGVISVTERQAYIGRVRALAKACADAFVQTEAGGWTPAPA

SEQ ID NO: 4113 - protein, 1003 aa, Polaromonas JS666
MMRETRSTCPYCGVGCGVIIESQGDQITGVRGDPDHPANFGRLCTKGSTLHLTATAPVTRQTRLLYPMRREHRHEAAQRVSWDNALDFASESFAQIIRDHGPDAVGFYISGQLLTEDYYVFNKLAKGLIGTNNVDTNSRLCMSSAVAGYKQTLGADAPPACYDDVNHAQCIFIVGSNTAYAHPILFRRIEDAKAKNPQLKIIFCDPRRTDTAEIADLYLPLQPGTDVSLFNGMLHIMLWEGWVKADYIAAHTSGFEALKATVRDYTPDLVAETCGIKKEDLFTAAKLFATSPATLSLYCQGLNQSSSGTAKNAALINLHLATAQIGKPGAGPFSLTGQPNAMGGREVGGLANLLSAHRDLANADHRAEVAALWGVPSVPEAPGKTAVEMFQAAADGEIKALWIACTNPAQSMPDQATVRRALERAEFVVVQEAFATTSSCDYADLLLPATTWGEKTGTVTNSERRISRVRPAVPAPGETRHDWSIAVAFAQRLEKLLGAQSPHPNPLPKGEGVIQETQETSNSPSSLPLPLGEGRGEGARTGSLFPYSLSDEAAGVETIWNEHRESTRGRDLDITGMSYAMLEESPQQWPLREGETTGKVRLYEDGIFPTADGKARFVNTVYKPVAEPRESRYPFSLTTGRLRDHWHGMSRTGTLGRLFGHVAEPAIQMNAQDMARRLLNEGDLVHVTSKRGSIVVPVQSSSEIGMSQAFVAMHWGEEYLSGRSSTGAPLAGVNALTTSAYCPTSKQPELKHAAVKILKAELPWSLLAMAWLPEDDALGAREQLKPLMAAFPFSSCVPFSNNTPLAQSSRERTGLLFRAAADEAPSAETLASIERILGLAGSDALRYADKKKGQHRTVRLVRKGDQAELAGFVLAGDTSAQAWIKTLLQDELPAQTYGRLLLLPGAKPPVTVQSRGKLVCTCLNVTDTAIADHLTAVSHGGGGAGYLGTDEERLASLQGALKCGTNCGSCVPELKRLVRSARSTQPPGSGLEGRTVIPIRQLA

SEQ ID NO: 4114 - protein, 986 aa, Acidovorax avenae citrulli AAC00-1
MHNKETHSTCPYCGTGCGVIIESTGNRITGVRGDPTHPANFGRLCTKGSTLHLTATQPVALQTRLLTPLHRTQRGQAPGPIGWDAALDMAAEKFADIVQAHGPDAVGFYVSGQLLTEDYYVFNKLAKGLIGTNNIDTNSRLCMSSAVAGYKATLGADAPPACYEDLALAQCLFITGSNTAWAHPILMRRIEDARAANPGMKIIVADPRRTETAAMADLHLPILPGTDVMLCHGMLHLMLWEGWVDAGYIAAHTTGFEALKATVRDCTPARVAEVCGVTEAQLATAARWFALGGADAPASGAGGRAPTLSLYCQGLNQSSSGTDKNAALVNLHLACGQIGRPGAGPFSLTGQPNAMGGREVGGLANLLSAHRDLANPAHRAEVAALWGVPEVPATPGRTAVEMFQAAADGEIRALWIACTNPAQSLPDQATVRRALERAEFVVVQEAFSTTATCAYADLLLPATTWGEKTGTVTNSERRISRVRPAVPAPGQARHDWAIAVEFARRLQDRLRPQGASLFPYDTGGAEAGAEAIWNEHRETTRGRDLDITGLSWALIDMQGPQHWPFPEGAAQGRARLYEDGVFPTPDGRARFAAAPWKPVAEPRSARYPFSLTTGRLRDQWHGMSRTGTLGRLFGHTPEPCVQLHPQDMERRRLAEGELVRVESRRGAVVVPVQASTDVGLSQAFIAMHWGGEMLCGHAGAQDGIADGTDAPPPALGVNAVTSPAFCPASKQPELKHAAVHIERAALPWRLYGMAWLPADEALAVRAQLAGLLAGFPFAVCVPFGNNAPLSEPARERHGVLLRAAGAAPAPDALLARIEALLGLGGADTLRYADARRGQRRAMRLEAAPTAAGGPGMEPGTGTAGSQELRLGALLLAGDTSAEAWLRGLLQEERPAQGYGRRLLSPGLQAPDSATPAPPRSRPVCSCMNVSDVAIAAQLGRCHGGDAERLGQLQAALGCGTQCGSCLPELRRMVRGSVAVPAAESSI

SEQ ID NO: 4115 - protein, 952 aa, Acidovorax sp. JS42
MQETRSTCPYCGVGCGVIIQSDGDTITGVRGDPHHPANFGRLCTKGSTLHLTASRPITLQTRLLQPQLRPQRGQAAHPIDWDAALDTAAQRFAATIDRHGPDAVGFYLSGQLLTEDYYVFNKLAKGLIGTNNIDTNSRLCMSSAVAGYKATLGADAPPACYDDLGHAQCLFIAGSNTAWAHPIVFRRIEDARAANPAMKIIVADPRRTDTAAMADLFLPLLPGSDVMLFNAMLHVMLREGWVDQGYIARHTSGFADLQAVVQDCTPERAAAVCGLPPQDIATAARWFAGVESMAEGGPRRPTLSLYCQGLNQSTSGTAKNAALIHLHLACGQIGQPGAGPFSLTGQPNAMGGREVGGLANLLPAHRDMANPDHRAEVARLWGLESVPARPGKTAVEMFQAAADGEIKALWIACTNPAQSLPDQTTVRRALQRAEFVVVQEAFATTATAQYADLLLPATTWGEKTGTVTNSERRISRVRAAVAAPGGARHDWQIALALAQRLERHLRPGQPTLFPYTGDTAQACAEAIWNEHRETTRGRDLDITGLTWAALEADGPQQWPYPSGARTGRARLYADGVFPTPDGRARFVPTAWQPLAEPPSARYPFSLTTGRLRDQWHGMSRTGTLGRLFGHASEPALQMHPQDLQRLQLAAGDLAHVTSARGSIIAPVQADDTLAPGQAFMAMHWGGEYLGGRSSTGRPLAGVNALTTPAFCPGSKQPELKHAAVKVLKAELPWTLLAMAWLPEDEALAAREALAALMPELPFAHCVPFSGAAPAAGPARTGVLLRGAAHEAPPPALLARIEHLLHLDGPGTLRYADRRRAQHRAARLQRQADGRTTLDALLLAGNGSAGGWLRTLLQEELPVQTYGRLLLLPTQQPPVAVAARGKRVCVCLNVTDTDITERLGQCQGSPAERLAQLQGALRCGTQCGSCVPELKRMVQAAVAGIGTTAVQAA

SEQ ID NO: 4116 - protein, 955 aa, Polaromonas naphthalenivorans CJ2
MTETRSTCPYCGVGCGVIIESQGDDITGVRGDPDHPANFGRLCTKGSTLHLTASSVVTRQTRLLYPMRREHRSEAPQRASWDSALDFASESFAQIIREHGPDAVGFYISGQLLTEDYYVFNKLAKGLIGTNNIDSNSRLCMSSAVAGYKQTLGADAPPACYDDVKHAQCLFIVGSNTAYAHPILFRRIEDAKTANPALSIIYCDPRRTDTAEIADLYLPLQPGTDVMLFNGMLHIMLWEGWTDPAWIAAHTHDFDALKATVRDCTPDLVAQTCGIRKEDLFAAARLFATSAATLSLYCQGLNQSSSGTAKNAALINLHLATAQIGKPGAGPFSLTGQPNAMGGREVGGMANLMSGHRDLSNPDHRAEVAALWGVPSVPEKPGKTAVEMFQAAADGEIKALWIACTNPAQSMPDQALVRRALERAELVIVQEAFATTATCAWADLLLPATTWGEKTGTVTNSERCISRVRPAVAAPGETRHDWSIAAAFAQRLERLLPGRSPGALFPYSLTDPALGVETIWNEHRESTRGRDLDITGMSYAMLEQAPRQWPLKEGETTGKARLYEDGIFPTPDGKARFVNTVYKPVAEPRESRYPFSLTTGRLRDQWHGMSRTGTLGRLFGHVAEPSIQMNVQDMARRLLKEGELVHVTSKRGSIIVPVQASPEVAVSQAFMAMHWGSEYLSGQSSIGQPLAGVNALTTSAYCPSSKQPELKHAAVKILKAELPWSLLAMAWFDEGDALAAHEQLKALLTAFPFASCVPFSNNKPLTDRQGERTGLLFRAAAHEAPGEEILALLERIFGLNGSYILRYADRKKGQRRTIRLARTHDNAELTGFVLAGDTSAQAWITTLLKDELPAQAYGRLLLLPGAKPPVAVQSRGKVVCSCLNVTDTAIDEHLALLGQADTDEARLASLQGALKCGTSCGSCVPELKRRLRSASGTAIDTPASPRSVIPIKQVA

SEQ ID NO: 4117 - protein, 929 aa, Methylibium petroleiphilum PM1
MRETRSTCPYCGVGCGVIIESQGAQITGVRGDPEHPANFGRLCTKGSTLHLTASAAITQQTRLLQPLRRAARGQAAQPVGWDAALDEAAERFAAVIAQHGPDAVGFYLSGQLLTEDYYVFNKIAKGLIGTNNVDTNSRLCMSSAVAGYKATLGADAPPACYDDLKHASTIFIAGSNTAWAHPILFRRLEDARAANPAMKLIVADPRRTETAEVADLHLPLLPGTDVALFHGLLHLLMWEGLTDTAYIATHTTGFEALRDRVREFTPKHVAQVCGLDESAIVQAARWFGQNTPTLSLYCQGLNQSSSGTDKNAALINLHLATGQIGKPGAGPFSLTGQPNAMGGREVGGLANLLSAHRDLANPQHRAEVAALWGVPDVPAAPGKSAVEMFQAAADGEIKALWISCTNPAQSMPDQTTVRRALERCEFVVLQEAFATTATAAYADLLLPATTWGEKDGTVTNSERRISRVRPAVAAPGEARHDWAAAVDFARRLEAKLPRRAANGGSLFPYAGPESVWNEHRESTRGRDLDITGLSYARLDQGPQLWPCPQGQAEGRARLYEDGVFATPDGRARFAAMAYRPVAEPRDARYPVSLTTGRLRDHWHGMSRTGTLGRLFGHVAEPGVEIHPRELVRRGWEEGALVHVTSRRGSVMLPVRASDSVAPAQAFVAMHWGEEFVSGLSPSGVRLAGINTLMPSAYCPQSKQPELKHAAVKLLKAEMPWQLLAAAWLPEDQALLAQQRLRDLMPSFSYAHCVPFGREPHARGVVGVLFRAAAEEPAADELMAQIESLLGVAGPQALRYADPKRGQRRAMRLVAGDGGNARLDAFVLGGDIRAEAWIKALLTDELPAQAYGRALLRPGAEPPGAVVARGRQVCSCFNVTEPEILDALTRCSGTPEARLDQLQGLLKCGTNCGSCIPALRTLVRGSVQAA

SEQ ID NO: 4118 - protein, 951 aa, Burkholderia mallei NCTC 10247
MTVDTLAQPIAPSTPGAVRETRSTCCYCGVGCGVVIETRRDANGRDTIVGVRGDPDHPANFGRLCSKGSTLHLTATPERYAQTRATHPELRASRDATRTRVSWDDALEHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAVTQPYGDARADWRIAADVGHRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVAFSVAGAAGATEDSAAVLRDYVDTGASVGALGRLLLFAGRVPLQTAPARGRTICNCVGVSEREIGAVLAADAPSAAPIERLANLQERLKCGTQCGSCIPELRRLIAETATAAAPPPR

SEQ ID NO: 4119 - protein, 951 aa, Burkholderia pseudomallei 668
MTVDTLAQPIAPSTPGAVRETRSTCCYCGVGCGVVIETRRDANGRDTIVGVRGDPDHPANFGRLCSKGSTLHLTATPERYAQTRATHPELRASRDAARTRVSWDDALEHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGTLKAIWIVCTNPAHSIPSQALARAGLERAEFVVLQDAYAHTGTAPYADVLLPAATWGEKEGTVTNSERRISRVRAATQPYGDARADWRIAADVGRRLEARLAPGRPTLFPYEDAEAIWNEHRATTLGRDCDIGGLSWPLLARDGPQQWPFPAGARQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVAFSVAGAAGATEDSAAVLRDYVDTGASVGALGRLLLFAGRVPLQTAPARGRTICNCVGVSEREIGAVLAADAPSAAPVERLANLQERLKCGTQCGSCIPELRRLIAETATAAAPPPR

SEQ ID NO: 4120 - protein, 951 aa, Burkholderia pseudomallei 1106a
MTVDTLAQPIAPSTPGAVRETRSTCCYCGVGCGVVIETRRDANGRDTIVGVRGDPDHPANFGRLCSKGSTLHLTATPERYAQTRATHPELRASRDAARTRVSWDDALEHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAATQPYGDARADWRIAADVGRRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVAFSVAGAAGATEDSAAVLRDYVDTGASVGALGRLLLFAGRVPLQTAPARGRTICNCVGVSEREIGAVLAADAPSAAPVERLANLQERLKCGTQCGSCIPELRRLIAETATAAAPPPR

SEQ ID NO: 4121 - protein, 946 aa, Polynucleobacter necessarius asymbioticus QLW P1DMWA 1
MAEVKSTCCYCGVGCGVIIETAESNGKIEVTGVRGDPDHPANFGRLCSKGSTLHLTANPSLQMQARLGSPAIRKARGEDPVDISWPEAIQTVAQKFADIIQEHGSESVGIYVSGQLLTEDYYIFNKLMKGLIGSNNIDTNSRLCMSSAVAGYKQTLGMDAPPCCYEDIDSASTIFITGSNTAFAHPILYRRLEDARKNNPDLKVIVVDPRKTDTAKEADLYLQIQPGTDVALYHGMLYIMLWEKWINESYINSYTADFDALRDLVRDFTPKAVSQICGINEKDLFQAAQWFATSPATLSMYCQGLNQSASGTAKNAALVNLHLATGQIGKAGAGPFSLTGQPNAMGGREVGGLANLLSAHRDLANPEHRAEVANLWGVDSVPEKPGLSAIPMFEALRTEKLKAIWIVCTNPAQSMPDLNAVHEGLSKAEFVVVQEAYAHTATTLYADVLLPATTWAEKVGTVTNSERRISKVNPAIDPYASAKHDWQIALEIGLALEALLPGNRKEGTSTLFPYAGPEDIWNEHRESTAGRDLDITGLSYKILEERGPQQWPMPVGSDSGKKRLYEDGIFPTKDKKAHFIAAPYKATAESVDARYPFALNTGRLRDQWHGMSRTGTIGTLYGHSPEPCVELSPKDAGRMNLENGDLVHVTSRRGSEIFPIKVSDDIASSQAFIAMHWGSEFISGAAGKTPGRGVNGLTCNMIDPVSGQPELKHSAVKILPANLPWHLVAFGLFPKEEVFSVQNSLRSILPHFDSAQCVLFGREQDGGLIGVSFKAAHHDDPLEESESLAAQALKQVMQKFKLDEASGEPVMRYIDKRRGVVRLVRAQEKVLSAMLTGPIGSLASTAWLREYLESGLDAKALGRSLLMPVSKPPVEIKPKGKAICNCFNVSADTMKQCLSKMPAGTSPDDAMSSLQSETQCGTNCGSCKPEVKQIIVSFLKKVEVAA

SEQ ID NO: 4122 - protein, 873 aa, Dinoroseobacter shibae DFL 12
MTDQSVCTTCPYCGVGCGVLASPDGTIAGDLAHPANLGRLCSKGSALGETLDLEGRLLAPQIGNRRAGWDEALDLVANRFRAAAETHGPDSVAFYVSGQLLTEDYYVANKLIKGFIGTANIDTNSRLCMASSVAGHKRAFGTDTVPGQYTDFETAELVVLVGSNLAWCHPVLFQRLQAAKAVRPELKVVVIDPRRTATSQLADLHLGLRPDGDAVLFNLLLTELVRRDLVDRRYVAEAVSGFDAAVAEAERAEAAQTGLDSFELAQFLDLWCRTEKVVTLYSQGVNQSACGTDKVNAILNCHLATGRIGRPGMGPFSMTGQPNAMGGREVGGLANMLTCHLDLENAAHRDAVQQMWSAPTMADKPGLKAVELFDACARGEIKALWIMSTNPVVSLPDADAVAAAIRAVPFTVMTDIMADTDTGRCVDVLLPATGWGEKSGTVTNSERCISRQRRFLPTPGEARADWNILADVGRRMGWPEAFDYRSEAEVFREFARLSTLGHTFGKDFDISGLADLTDAEYDALPPTVWPVPTEGPSGGRFFADGGFYHPDGKAKMLPIAAPASEAPNTARPVRLNTGRVRDQWHTMTRTGKAPRLGAHMAEPYLEIHPGDAAAAGLSDADLAKVSSAHGSAILRVMITDRSQQGSVFVPMHWTDIVSSTGRINAVVAPTTDPVSGQPASKGTAVALEQVAAHWYGFAVSTATMTPTRPYAAIARTRTGTRAEVADFKLPDNWEAEARKILSLPGGSASVIEDSARGTARVAIHEKGTLTGLFFAAATPVALSRSHVVALIGTAADPIQALAGVPAADRPDPGAMVCACFDVGANSLRRAIDGGATTLHALGVCTRAGTNCGSCRPELEAILTAATAMKLAAE

SEQ ID NO: 4123 - protein, 954 aa, Delftia acidovorans SPH-1
MQETRSTCPYCGVGCGVLIESDGARITGVRGDPAHPANHGRLCTKGSTLHLTASPALAQQTRRLQPALRATRGAAPQDVGWDAALDLAAGRLASIVQEHGPDAVGLYVSGQLLTEDYYVFNKLAKGLIGTNNIDTNSRLCMSSAVAGYKLTLGADAPPACYEDVDHADCLFIAGSNAAWAHPVLTRRIEQARAARPQMKIIVADPRRTDTAGMADLFLPLRPGSDTLLFHGMLHIMELEGWLDQAYIARHTSGFADLQALVREATPERVGELCGLPRHDLFQAAQWFALGGDARGGAARGATLSLYCQGLNQSSNGTAKNAALIGLHLATGQIGRAGAGPFSLTGQPNAMGGREVGGLANLLSAHRDLANPVHRAEVAALWGVDAVPHRPGKTAVEMFEAAAEGEIRALWIACTNPAQSMPDQALVRRALQRAEFVIVQEAFATTATCAYADLLLPATTWGEKLGTVTNSERRISRVRPAVAAPGAARHDWRIAVDCARRMEARLRPGRPSLFPYDTEDAAAGAQAIWNEHRESTRGRDLDITGLSWDLLDAQGPQQWPLPEGAAQGRARLYEDGRFPTPDGRARFALLPWQPLAEPPDAHYPFSLTTGRLRDQWHGMSRTGQLGRLFGHAAEPCLQMHPRDMAERGLRAGDLVQMSSRRGALLVPVQPDDTLTPSQLFMAMHWGGEYLGGTSMGGTSMGGVNALTTPALCPGSKQPELKHTAVKLQKAELPWTLLAMAWLPEDRVLAVREQLSALMPHFGFASCVPFGNAVPLQDAARARHGVLLRAAAHEAPGEAVLARIESLLGLDAADTLRYTDRRRQHSRALRLDRHSLSTTVEALLLAGDTRAGSWLSTLLQDQMPAQDYGRLLLMPSGSAPLAIQPRARQVCTCFDVDETAIAGALARCEGSDDARLAALQGRLRCGTNCGSCLPELKRLVRHIPLAKSQETAERGD

SEQ ID NO: 4124 - protein, 952 aa, Diaphorobacter TPSY uid29975
MQENRSTCPYCGVGCGVIIQSDGDTITGVRGDPHHPANFGRLCTKGSTLHLTASRPVTLQTRLLQPQLRPQRGQAAHPIDWDAALNTAAQRFAATIDRHGPDAVGFYLSGQLLTEDYYVFNKLAKGLIGTNNIDTNSRLCMSSAVAGYKATLGADAPPACYDDLAHAQCLFIAGSNTAWAHPIVFRRIEDARAANPAMKIIVADPRRTDTAAMADLFLPLLPGSDVMLFNAMLHVMLREGWVDQGYIARHTSGFADLQAVVQDCTPERAAAVCGLPPQDIATAARWFAGVEGIAEGGPRRPTLSLYCQGLNQSTSGTAKNAALIHLHLACGQIGQPGAGPFSLTGQPNAMGGREVGGLANLLPAHRDMANPDHRAEVARLWGVESVPARSGKTAVEMFQAAADGEIKALWIACTNPAQSLPDQTTVRRALQRAEFVVVQEAFATTATAQYADLLLPATTWGEKTGTVTNSERRISRVRAAVAAPGGARHDWQIALALAQRLERHLRPGQPTLFPYTGDTAQACAEAIWNEHRETTRGRDLDITGLTWAALEADGPQQWPYPSGARAGRARLYADGVFPTPDGRARFVPAAWQPLSEPPSARYPFSLTTGRLRDQWHGMSRTGTLGQLFGHASEPALQMHPQDLPRLQLAAGDLAHVTSARGSIIAPVQADDTLAPGQVFMAMHWGGEYLGGRSSMGRPLAGVNALTTPAFCPGSKQPELKHAAVKVLKAELPWTLLAMAWLPEDEALAAREALAALMPELPFAHCVPFSGAAPAAGPARTGVLLRGAAHEAPPPALLARIEHLLHLDGPGTLRYADRRRAQHRAARLQRQADGRTTLDALLLAGNGSAGGWLRTLLQEELPVQTYGRLLLLPTQQPPVAVPARGKRVCVCLNVTDTDITERLGQCQGSPAERLAQLQGALRCGTQCGSCVPELKRMVQAAVAGIGTTAVQAA

SEQ ID NO: 4125 - protein, 931 aa, Variovorax paradoxus S110
MAETRSTCPYCGVGCGVVIESDGAQITGVRGDPDHPANFGRLCTKGSTLHLTATATVTRQTRLLQPMRRAERGATPEAIGWDGALDMATDKFAQVIRDHGPDAVGFYVSGQLLTEDYYVFNKLAKGLIGTNNIDTNSRLCMSSAVAGYKQTLGADAPPACYDDLKHAQCLFIVGSNAAWAHPILFRRIEDAKAANPGLKIIVADPRRTDTVEIADLFLPIQPGTDVMLFNGMLHLMLWEGWTDNGYIAAHTSGFDALKTTVRECTPDKVAQICGISKEDLLAAARLFATSPATLSLYCQGLNQSSSGTAKNAALINLHLATGQIGKPGAGPFSLTGQPNAMGGREVGGLANLLSAHRDLANPAHRAEVAALWNVPSVPEKPGKTAVEMFQAAADGEIRALWIACTNPAQSMPDQATVRRALERAEFVVVQEAFSTTATCAFADLLLPATTWGEKEGTVTNSERRISRVRPAVAAPGEARHDWSIAVDFARRLEQRLGATPTLFPYETAESVWNEHRESTRGRDLDITGMSYAMLDSAGPQQWPLKEGEATGRARLYEDGIFPTPDGRARFVDTVYKPVAEAREARYPFSLNTGRLRDQWHGMSRTGTVGRLFGHVAEPLVQMNAQDMARRQLKDGDLVHLTSKRGSILMPVQASAEIGLSQAFVAMHWGEEYLSGCSSTGTPLAGINALTTSAYCPTSKQPELKHTPVKILKAELPWSLLAMAWLPPDAALAAHQALKPMMAMFPFATCVPFSGNTPGEERSGILFRAAAHDAPADETIDRIEGLLGLRGSDALRYADRRRGQRRVARLVRRADGNAGLEAFLLGGDTSAEAWIGTLLREEIPAQSYGRLLLSPGARAPVAVQSRGHPVCTCFNVTDLAIQAELGRCTGTPDERLAALQGALKCGTNCGSCLPELKRMVRATPAETVAEGA

SEQ ID NO: 4126 - protein, 134 aa, Brucella suis 1330
MIVGIGSDLIDIRRVEKTLERHGSRFRDRVFTEIEQRKSEGRKQRAASYAKRFAAKEACAKALGTGIAEGVFWRDMGVVNTPSGKPTMHLTGGAAKQLQKLLPAGTNAAIHLTITDDFPLAQAFVIIEALPVLE

SEQ ID NO: 4127 - protein, 133 aa, Mesorhizobium BNC1
MIVGIGSDLIDIRRVEKALERHGERFTHRVFTEVERVKSDRRRMRAASYAKRFAAKEACAKALGTGLAQGVFWRDMGVVNLPGGKPTMHLTGGAAERLNALIPAGHRPLIHLTITDDFPLAQAFVIIEAVSVE

SEQ ID NO: 4128 - protein, 133 aa, Bartonella bacilliformis KC583
MIIGLGNDMIDIRRIEKILIRHSSRFIQRIFTDIEQNKSENFPKRSYAYAKRFAAKEACAKALGTGIAYGVNWRDIGIVNSPSGKPTIKLTNHAQIQLEKLLPSNHDAFIHLSMTDDFPWAQAFVIIEALPRG

SEQ ID NO: 4129 - protein, 134 aa, Brucella ovis; identical to SEQ ID NO: 4126

SEQ ID NO: 4130 - protein, 139 aa, Sinorhizobium medicae WSM419
MIIGIGSDLIDIRRIENSLQRFGERFVNRCFTDIEIAKSDGRKNRAASYAKRFAAKEACSKALGTGLAQGVFWKEMGVVNLPGGKPTMQLTGGAAARLREMLPVGHRAAIHLTITDDFPLAQAFVIIEALPVAPAEGTV

SEQ ID NO: 4131 - protein, 158 aa, Ochrobactrum anthropi ATCC 49188
MIVGIGSDLIDIRRVESALERHGDRFRNRVFTEVEQKKSDGRKQRAASYAKRFAAKEACAKALGTGIAQGVFWRDMGVVNAPSGKPTMHLTGGAAKQLQKLLPAGTRAAIHLTITDDFPLAQAFVIIEALPECLNQNASGRSENGDFREPERSVLKGT

SEQ ID NO: 4132 - protein, 134 aa, Rhizobium leguminosarum bv  trifolii WSM2304
MIIGIGSDLIDIRRVEKSIERFGDRFTHRCFTEIERARSDRRANRGASYAKRFAAKEACSKALGTGIAQGVFWKDMGVVNLPSGKPTMVLSGAAALILESMLPAGHRPAIHLTITDDYPLAQAFVIIEALPESL

SEQ ID NO: 4133 - protein, 134 aa, Rhizobium leguminosarum bv  trifolii WSM1325
MIIGIGSDLIDIRRVEKSIERFGERFTHRCFTEIERARSDKRANRAASYAKRFAAKEACSKALGTGIAQGVFWKDMGVVNLPSGKPTMLLSGGAALILESLLPVGHRPAIHLTITDDYPLAQAFVIIEALPESL

SEQ ID NO: 4134 - protein, 206 aa, Ralstonia eutropha JMP134
MPKLLYLSVSPRAENSYSRQAGARMIAWLERRHGPLTVIDRDLAADPVPHIDGAMARASLMPAADRGPAEHAALALSETLIGELEAADIVLISTPMHNFTVPSALKAWIDHVVRSNRTFRSTPAGKVGLLADRPVLAVVSCGGPFHDGPGSQRDMMTPYLQYVFGSVGITQVEVVRMENMARGEDFVARGFERLNAWTGSLAIRAA

SEQ ID NO: 4135 - protein, 204 aa, Burkholderia 383
MNNLLFVDASPHGSRSLGARIAREAIAQWQAAHPHARVVSRSLGQPGLPSISADYAHALVARQPDSDPALACSEQLIAEVEHSDGVLISTPMHNFTVPAALKLWIDFVLRIGRTFAATPEGKVGLLADRPVLVLVRSGGICRGAAARQPDFLTPYLKQVLAVIGFSTVDFIYLEGVAPDDAAIDAVRGQLAQSALLARRATETA

SEQ ID NO: 4136 - protein, 206 aa, Cupriavidus metallidurans CH34 uid250
MTTLLHLNVSPRGERSHSRQAGSVVRERLAAHRGPLTVIERDLGAEPLPPIDAAFTDANLAVAAGGDEQAPALMLSERLIAELESADMVLITTPIHNFTVPATLKTWIDVVVRPGRTFRSTPQGKQGLLRDRPVLAVVACGGAFHDGPGSQQDFFTPYLKYVLGTIGLSRVEVLRMENMNRGSDPVARSFDHLRAWCEAAVPAMVD

SEQ ID NO: 4137 - protein, 221 aa, Pseudomonas putida W619
MTSSQQPLAPLRILRLVASPNAEASESLKLSQQILFALASQAGRRGIQLTDLDLNTLVPVDSPYAQALANQRVVIASGQKGTLSRSDELIDQLQACDVLLIATPMHNYSVPAPLKMWIDHVVRVGKTFLGTAKGKVGNLTDRPVYVAIASGGYISGPQARQPDFLRPYLSAVLATIGLTQVHYFTVEGTAKGGESLNTGRATGYGDVQAYFVRHSRRVDQV

SEQ ID NO: 4138 - protein, 208 aa, Ralstonia pickettii 12J
MTTLLHVTVSPRDDRSHSRRGAKWVVAQLAEAVGGLRVIERDLAATPLPHPDAGFVEASLTPDADRTAAHRAALALSETLIGELGAADAVLISTPVHNYTVPSALKAWIDLVVRPERTFRRTPTGKVGMLTDRSVLVVSASGGHFDGAHAQTDFLMPYLRYVFATVGIHQVEGIRLQNTARGADSAMQAFESFRQELAARMLLMPLVA

SEQ ID NO: 4139 - protein, 224 aa, Burkholderia phytofirmans PsJN
MRILLINASPHGEASHGYRFADEIVGMLHGHAAPAASAITVVERDLAAAPLPPIARDYARAVTSRAPDTAHFDVSEQLIGEIETTDALIINTPMHNFTVPAALKLWIDYTLRIHRTFASTPEGKVGLMRDRPTIVIVGSGGVHSGERARQTDFLTPYLRYALGSIGIHSVQFLLLQGLVMGEATVAKALDAARVQLTGDAVFVSLAAQASRCARTAAGSTARSA

SEQ ID NO: 4140 - protein, 208 aa, Ralstonia pickettii 12D; identical to SEQ ID NO: 4138

SEQ ID NO: 4141 - protein, 865 aa, Enterobacter sp. 638
MGKALVIVESPAKAKTINKYLGNDYVVKSSVGHVRDLPTSGSASKKSADSTSTKGAKKPKKDERSALVNRMGVDPWHEWEAQYEVLPGKEKVVNELKQLAEKADHIYLATDLDREGEAIAWHLREIIGGDETRYSRVVFNEITKNAIRQAFEKPGELNIDRVNAQQARRFMDRVVGYMVSPLLWKKIARGLSAGRVQSVAVRLVVEREREIKAFVPEEFWEIDANVTTPAGDALPLQVTHENDKPFRPVNRDHTMAAVAQLEKARYQVVEREDKPTSSKPGAPFITSTLQQAASTRLGFGVKKTMMMAQRLYEAGYITYMRTDSTNLSQDAVTMVRDYIGENFGKKYLPESANQYASKENSQEAHEAIRPSDVSVVSESLKDMETDAQKLYQLIWRQFVACQMNPAKYDSTTLTVGAGDFRLKARGRILRFDGWTKVMPALRKGDEDRILPPVNKGDELSLTELLPAQHFTKPPARFSEASLVKELEKRGIGRPSTYASIISTIQDRGYVRAENRRFYAEKMGEIVTDRLEANFRELMNYDFTAQMEDRLDQVANHQAEWKNVLDSFFSDFTEQLAKAEKDPEEGGMQPNQMVLTSIDCPTCSRQMGIRTATTGVFLGCSGYALPPKERCKTTINLVPENEVLNVLEGDDAETNALRAKRRCQKCGTAMDSYLIDPKRKLHVCGNNPTCDGYEIEEGEFRIKGYDGPVVECEKCGSEMHLRMGRFGKYMACTNEECKNTRKILRNGEVAPPKEDPVPLPELPCEKSDAYFVLRDGAAGVFLAANTFPKSRETRAPLVEELYRFRDRLPEKLRYLADAPLQDPEGNKTVVRFSRKTKQQYVSAEKEGKATGWSAFFIDGKWVEGKK

SEQ ID NO: 4142 - protein, 876 aa, Vibrio cholerae O395
MGKSLVIVESPAKAKTINKYLGKDFIVKSSVGHVRDLPTAGQTATPTGKAAAASTKKASTTDKEQQKREKERAALIKKMGVDPYHGWQANYQILPGKEKVVAELQKLAKDADSVYLATDLDREGEAIAWHLREIIGGDEKRYKRVVFNEITKNAIQQAFKQPGELNMDGVNAQQARRFMDRVVGFMVSPLLWKKVARGLSAGRVQSVAVKLLVEREREIKAFVPEEFWDINADTLTADKQDFRLLVAQKDGLAFKPVNETEALAAVAALNKAQYEVCKREDKPTTSKPSAPFITSTLQQAASTRLGYGVKKTMMLAQRLYEAGYITYMRTDSTNLSAEAVENLRGYITKHYGEAYLPSQPNVYGSKQNAQEAHEAIRPSDVTVTADDLEGMEADAHKLYALIWNQFVACQMTPAQYDSTTVSVKAAEYTLKAKGRILKFDGWTRVQRPLGKNEDQILPPVKIGDSLKLVSLDPKQHFTKPPARYTEAALVKELEKRGIGRPSTYASIISTIQDRGYVKVDQRRFFAEKMGEIVTDRLDENFDDLMNYDFTARMEEKLDQIAEGEVNWTAVLDEFFADFSRDLETAEQDESLGGMKPNHIVMTNILCPTCSRPMGIRTASTGVFLGCSGYALPPKERCKTTINLGDEEGVINVLEEDVETAALRAKKRCPICETAMDAYLIDDKRKLHVCGNNPNCEGFIVEEGEFKVKGYEGPTVECDKCGSDMVLKNGRFGKYMGCTNDACKNTRKILKNGEVAPPKEEPVHFPELPCENSDAYFVLRDGASGLFFAASNFPKSRETRAPLVEELKRFAERLPEKYQYLTSAPAHDPDGLPAVVRFSRKEKEHYVRTETEGKPSGWMAVYQEGKWLVTDKRKNAK

SEQ ID NO: 4143 - protein, 876 aa, Vibrio harveyi ATCC BAA-1116
MGKSLVIVESPAKAKTINKYLGKDFIVKSSVGHVRDLPTAGQSTGEKKAAAISTKGMSPEEKARVKKEKDRKALIKKMGINPYHDWDANYQILPGKEKVVSELQKLAKDADYVYLATDLDREGEAIAWHLREIIGGDEERYKRVVFNEITKNAIQQAFQTPGELNMDGVNAQQARRFMDRVVGFMVSPLLWKKVARGLSAGRVQSVAVKLLVEREREINAFIPEEFWDINANTHTKDKTAFKLLVAQKDGVAFKPVNEAETKAALSVLEKASYEVCKREDRPTKSKPSAPYITSTLQQAASTRLGYGVKKTMMLAQRLYEAGYITYMRTDSTNLSAEAVDAVRGFIGSEYGDKYLPAKPLTYGSKEGAQEAHEAIRPSDVSVKSEDLQGVDADAHKLYSLIWNQFVACQMTPAEYDSTTISVKAAEYTLKAKGRILKFDGWTRVQRPMGKNEDTILPAVQLGEKLDLESLEPKQHFTKPPARFTEAALVKELEKRGIGRPSTYASIISTIQDRGYVKVEQRRFYAEKMGEIVTDRLDDSFNDLMNYDFTARMEQKLDQIAEGDVMWKDVLDNFFTDFTGDLEKAEQDENEGGMKLNHIVMTDIECPTCGRPMGIRTASTGVFLGCSGYALPPKERCKTTINLGDEDGIINVLEEDVETAALRAKKRCPICETAMDAYLIDDKRKMHVCGNNPNCEGYIVEHGEFKVKGYDGPVVECDKCGSDMVLKNGRFGKYMDCTSETCKNTRKILKNGEVAPPKEDPVHFPELPCENSDAYFVLRDGASGLFMAASNFPKSRETRAPLVSELARFEERLPEKFKYLTTAPAADPDGRPAVVRFSRKSKENYVRTEDNGKPSGWTALFVDGKWEITDKRKKAKA

SEQ ID NO: 4144 - protein, 865 aa, Serratia proteamaculans 568
MGKALVIVESPAKAKTINKYLGNDYVVKSSVGHIRDLPTSGSASKKSADSTEDKAKKKVKKDPTTALVNRMGVDPYHGWKAHYEILPGKEKVVAELKSLAENADHIYLATDLDREGEAIAWHLREVIGGDDKRFSRVVFNEITKNAIQNAFKQPGELNIDRVNAQQARRFMDRVVGYMVSPLLWKKIARGLSAGRVQSVAVRLVVERERDIKAFVPEEYWELHADLLAKGDTALQMEVTHAHDKPFKPVNREQTHAALNVLEKARYTVLDREDKPTSSKPGAPYITSTLQQAASTRLSFGVKKTMMMAQRLYEAGHITYMRTDSTNLSQDALEMVRGYIGDNFGDKYLPKAPNQYSSKENSQEAHEAIRPSDVNVLAEQLKDMEADAQKLYQLIWRQFVACQMTPAQYDSTTLSVKAADYQLRAKGRTLRFDGWTKVMPALRKGDEDRTLPYVEVGSDLELQKLIPSQHFTKPPARYSEASLVKELEKRGIGRPSTYASIISTIQDRGYVRVESRRFYAEKMGEIVTDRLEENFRELMNYDFTARMENGLDQVANNQAEWKAVLDEFFAEFSEQLETAEKEPEEGGMRPNQMVMTSIDCPTCGRKMGIRTASTGVFLGCSGYALPPKERCKTTINLVPETEVLNILEGDDAETNALRARRRCQKCGTAMDSYLIDNQRKLHVCGNNPACDGYEIEEGEFRLKGYDGPVVECDKCGSEMHLKMGRFGKYMGCTNESCKNTRKILRNGDVAPPKEDPVPLPELPCEKSDAYFVLRDGAAGVFLAANTFPKSRETRAPLVEELARFKDRLPEKLRYLADAPVADAEGNKTLVRFSRKTKQQYVSAEKDGKATGWSAFYIDGKWVEGKK

SEQ ID NO: 4145 - protein, 871 aa, Yersinia pestis Angola
MGKALVIVESPAKAKTINKYLGNDYVVKSSVGHIRDLPTSGSASKKSANSAEEKAKKDDKPKKKVKKDEKVALVNRMGVDPYHGWKAQYEILSGKEKVVAELKALAENADHIYLATDLDREGEAIAWHLREVIGGDDKRFSRVVFNEITKNAIQQAFNQPGELNISRVNAQQARRFMDRVVGYMVSPLLWKKIARGLSAGRVQSVAVRLVVEREKEIKAFVPEEYWELHADLVAKGDIPIQMEVTHAHGKPFKPVNREQTHAALTLLENARYKVLDREDKPTSSKPSAPFITSTLQQAASTRLSFGVKKTMMMAQRLYEAGHITYMRTDSTNLSQDALTMVRGYIGDNFGDKYLPATPNQYSSKENSQEAHEAIRPSDVNVLAEQLKDMEADAQRLYQLIWRQFVACQMPPAKYDSTTLTVQAGDFQLRAKGRTLRFDGWTKVMPALRKGDEDRTLPVIEVGSDLDLQKLIPSQHFTKPPARYSEASLVKELEKRGIGRPSTYASIISTIQDRGYVRVENRRFYAEKMGEIVTDRLEENFRELMNYDFTARMESGLDQVANDQAEWKAVLDGFFAEFSEQLEKAEKDPEEGGMRPNQMVMTSIDCPTCGRQMGIRTASTGVFLGCSGYALPPKERCKTTINLVPDAEILNILEGDDAETNALRARRRCQKCGTAMDSYLIDNQRKLHVCGNNPACDGYEIEAGEFRIKGYEGPIVECEKCGSEMHLKMGRFGKYMGCTNDECKNTRKILRSGEVAPPKEDPVPLLELPCEKSDAYFVLRDGAAGVFLAANTFPKSRETRAPLVEELVRFKDRLPEKLRYLADAPVVDKEGNKTLVRFSRKTKQQYVSSEKDGKATGWSAFYIDGKWVEAKK

SEQ ID NO: 4146 - protein, 865 aa, Salmonella enterica serovar Newport SL254
MGKALVIVESPAKAKTINKYLGNDYVVKSSVGHIRDLPTSGSAAKKSADSTSTKTAKKPKKDERGALVNRMGVDPWHNWDAHYEVLPGKEKVVSELKQLAEKADHIYLATDLDREGEAIAWHLREVIGGDDARYSRVVFNEITKNAIRQAFEQPGELNINRVNAQQARRFMDRVVGYMVSPLLWKKIARGLSAGRVQSVAVRLVVEREREIKAFVPEEFWEIDANTTTPSGEALPLQVTHQNDKPFRPVNREQTLAAVSLLEKARYSVLEREDKPTSSKPGAPFITSTLQQAASTRLGFGVKKTMMMAQRLYEAGYITYMRTDSTNLSQDAVNMVRGYIGDNFGKKYLPDNPNQYASKENSQEAHEAIRPSDVAVMAESLKDMEADAQKLYQLIWRQFVACQMTPAQYDSTTLTVGAGEFRLKARGRILRFDGWTKVMPALRKGDEDRTLPAVNKGDALTLLELTPAQHFTKPPARFSEASLVKELEKRGIGRPSTYASIISTIQDRGYVRVENRRFYAEKMGEIVTDRLEENFRELMNYDFTAQMEDSLDQVANHQAEWKAVLDNFFSDFTQQLDKAEKDPEEGGMRPNQMVLTSIDCPTCGRKMGIRTASTGVFLGCSGYALSPKERCKTTINLVPENEVLNVLEGDDAETNALRAKRRCQKCGTAMDSYLIDPKRKLHVCGNNPTCDGYEIEEGEFRIKGYDGPIVECEKCGSEMHLKMGRFGKYMACTNDECKNTRKILRNGEVAPPKEDPVPLPELPCEKSDAYFMLRDGAAGIFLAANTFPKSRETRAPLVEELYRFRDRLPEKLRYLADAPQQDPEGNKTVVRFSRKTKQQYVAAEKDGKATGWSAFFVDGKWVEGKK

SEQ ID NO: 4147 - protein, 865 aa, Salmonella enterica serovar Heidelberg SL476
MGKALVIVESPAKAKTINKYLGNDYVVKSSVGHIRDLPTSGSAAKKSADSTSTKTAKKPKKDERGALVNRMGVDPWHNWDAHYEVLPGKEKVVSELKQLAEKADHIYLATDLDREGEAIAWHLREVIGGDDARYSRVVFNEITKNAIRQAFEQPGELNINRVNAQQARRFMDRVVGYMVSPLLWKKIARGLSAGRVQSVAVRLVVEREREIKAFVPEEFWEIDANTTTPSGEALPLQVTHQNDKPFRPVNREQTLAAVSLLEKARYSVLEREDKPTSSKPGAPFITSTLQQAASTRLGFGVKKTMMMAQRLYEAGYITYMRTDSTNLSQDAVNMVRGYIGDNFGKKYLPDNPNQYASKENSQEAHEAIRPSDVAVMAESLKDMEADAQKLYQLIWRQFVACQMTPAQYDSTTLTVGAGEFRLKARGRILRFDGWTKVMPALRKGDEDRTLPAVNKGDALTLLELTPAQHFTKPPARFSEASLVKELEKRGIGRPSTYASIISTIQDRGYVRVENRRFYAEKMGEIVTDRLEENFRELMNYDFTAQMEDSLDQVANHQAEWKAVLDNFFSDFTQQLDKAEKDPEEGGMRPNQMVLTSIDCPTCGRKMGIRTASTGVFLGCSGYALSPKERCKTTINLVPENEVLNVLEGDDAETNALRAKRRCQKCGTAMDSYLIDPKRKLHVCGNNPTCDGYEIEEGEFRIKGYDGPIVECEKCGSEMHLKMGRFGKYMACTNDECKNTRKILRNGEVAPPKEDPVPLPELPCEKSDAYFVLRDGAAGIFLAANTFPKSRETRAPLVEELYRFRDRLPEKLRYLADAPQQDPEGNKTVVRFSRKTKQQYVAAEKDGKATGWSAFFVDGKWVEGKK

SEQ ID NO: 4148 - protein, 865 aa, Salmonella enterica serovar Schwarzengrund CVM19633
MGKALVIVESPAKAKTINKYLGNDYVVKSSVGHIRDLPTSGSAAKKSADSTSTKTAKKPKKDERGALVNRMGVDPWHNWDAHYEVLPGKEKVVSELKQLAEKADHIYLATDLDREGEAIAWHLREVIGGDDARYSRVVFNEITKNAIRQAFEQPGELNINRVNAQQARRFMDRVVGYMVSPLLWKKIARGLSAGRVQSVAVRLVVEREREIKAFVPEEFWEIDANTTTPSGEALPLQVTHQNDKPFRPVNREQTLAAVSLLEKASYSVLEREDKPTSSKPGAPFITSTLQQAASTRLGFGVKKTMMMAQRLYEAGYITYMRTDSTNLSQDAVNMVRGYIGDNFGKKYLPDNPNQYASKENSQEAHEAIRPSDVAVMAESLKDMEADAQKLYQLIWRQFVACQMTPAQYDSTTLTVGAGEFRLKARGRILRFDGWTKVMPALRKGDEDRTLPAVNKGDALTLLELTPAQHFTKPPARFSEASLVKELEKRGIGRPSTYASIISTIQDRGYVRVENRRFYAEKMGEIVTDRLEENFRELMNYDFTAQMEDSLDQVANHQAEWKAVLDNFFSDFTQQLDKAEKDPEEGGMRPNQMVLTSIDCPTCGRKMGIRTASTGVFLGCSGYALSPKERCKTTINLVPENEVLNVLEGDDAETNALRAKRRCQKCGTAMDSYLIDPKRKLHVCGNNPTCDGYEIEEGEFRIKGYDGPIVECEKCGSEMHLKMGRFGKYMACTNDECKNTRKILRNGEVAPPKEDPVPLPELPCEKSDAYFVLRDGAAGIFLAANTFPKSRETRAPLVEELYRFRDRLPEKLRYLADAPQQDPEGNKTVVRFSRKTKQQYVAAEKDGKATGWSAFFVDGKWVEGKK

SEQ ID NO: 4149 - protein, 865 aa, Salmonella enterica serovar Agona SL483; identical to SEQ ID NO: 4147

SEQ ID NO: 4150 - protein, 865 aa, Salmonella enterica serovar Dublin CT 02021853; identical to SEQ ID NO: 4148

SEQ ID NO: 4151 - protein, 868 aa, Dickeya dadantii Ech703
MGKALVIVESPAKAKTINKYLGNDYVVKSSVGHVRDLPTSGSASKKSAEAGEEKEKKKAAKPVKKDEKSALVNRMGVDPYSGWKAHYEILPGKEKVVSELKALAQNADHVYLATDLDREGEAIAWHLREIIGGDDKRFSRVVFNEITKNAIRQAFEQPGELNTARVNAQQARRFMDRVVGYMVSPLLWKKIARGLSAGRVQSVAVRLVVEREREIKAFVPEEFWELHADLLTGDVALQMQVTHHNDKPFKPVNQAQTQAAVSLLERARYVVVEREDKPTSSKPGAPFITSTLQQAASTRLGFGVKKTMMMAQRLYEAGYITYMRTDSTNLSQDALSMARDYIGHQFGKRYLPETANLYASKENSQEAHEAIRPSDVTVLSEQLGDMETDAQKLYQLIWRQFVACQMTPAQYDSTTLVVGAGDYQLRARGRTLRFDGWTRVMSALRKSDEDRTLPAIEVGQSLELEKLLPSQHFTKPPARYSEASLVKELEKRGIGRPSTYAAIISTIQDRGYVRVENRRFYAEKMGEIVTDRLEENFRELMSYDFTARMENSLDLVANNQAEWKAVLDEFFAEFSNQLETAELEPESGGMKPNQMVLTSIDCPTCGRKMGIRTASTGVFLGCSGYALPPKERCKTTINLIPEAEVLNVLEGDEAETNALLARRRCSKCGTAMDSYLIDNQRKLHVCGNNPSCDGYEIEAGEFRLKGYDGPIVECEKCGSEMHLKMGRFGKYMACTNDGCGNTRKILRNGEVAPPKEDPVPLPELPCEKSDAYFVLRDGAAGVFLAANTFPKSRETRAPLVEELVRFHDRLPEKLRYLAEAPVSDPQGNKTLVRFSRKTKQQYVASEKDGKATGWSAFFVDGKWVENVK

SEQ ID NO: 4152 - protein, 867 aa, Dickeya zeae Ech1591
MGKALVIVESPAKAKTINKYLGNDYVVKSSVGHVRDLPTSGSGSASKKSAEANGEKAKKAVKKDERTALVNRMGVDPYRGWQAHYEILPGKEKVVSELKMLAQNADHVYLATDLDREGEAIAWHLREIIGGDEKRFSRVVFNEITKNAIRQAFENPGELNINRVNAQQARRFMDRVVGYMVSPLLWKKIARGLSAGRVQSVAVRLVVEREREIKAFVPEEYWELHADLLANAETALQMQVTHHHGKPFRPVNQAQTQAAVSLLEKASYVVNEREDKPTSSKPGAPFITSTLQQAASTRLGFGVKKTMMMAQRLYEAGHITYMRTDSTNLSQDALSMARDYIQGEFGKRYLPDAPNLYTSKENSQEAHEAIRPSDVSVLADQLKDMEADAQKLYQLIWRQFVACQMTPAQYDSTTLVVSAADYQLRAKGRTLRFDGWTKVMPALRKSDEDRTLPAVEIGQSLSLEKLSPSQHFTKPPARYSEASLVKELEKRGIGRPSTYAAIISTIQDRGYVRVENRRFYAEKMGEIVTDRLEDNFRELMNYDFTARMENSLDLVANSQAEWKAVLDEFFAEFSQQLETAEQEPDEGGMKPNQMVLTSIDCPTCGRKMGIRTASTGVFLGCSGYALPPKERCKTTINLIPEAEVLNVLEGDEAETNALRARRRCSKCGTAMDSYLIDNQRKLHVCGNNPSCDGYEIEQGEFRLKGYDGPVVECEKCGSEMHLKMGRFGKYMACTSDSCGNTRKILRNGDVAPPKEDPVPLPELPCEKSDAYFVLRDGAAGVFLAANTFPKSRETRAPLVEELVRFRDRLPEKLRYLADAPVTDPQGNKTLVRFSRKTKQQYVSSEKEGKATGWSAFYVDNKWVETAR

SEQ ID NO: 4153 - protein, 866 aa, Pectobacterium carotovorum PC1
MGKALVIVESPAKAKTINKYLGNDYVVKSSVGHVRDLPTSGSVSKKSADSTTKDKTKKKVKKDEKSALVNRMGVDPYHGWQANYEILPGKEKVVSELKTLAENADHIYLATDLDREGEAIAWHLREIIGGEDERFSRVVFNEITKNAIKQAFEKPDTLNIDRVNAQQARRFMDRVVGYMVSPLLWKKIARGLSAGRVQSVAVRLIVDREREIKAFVPEEYWELHADLLAGSDIQLQMQVTHHSGKPFKPVNKEQTQAAVSLLENARYVVADREDKPTSSKPGAPFITSTLQQAASTRLGFGVKKTMMMAQRLYEAGYITYMRTDSTNLSQDALTMVRGYIGEEFGKRYLPESANLYSSKENSQEAHEAIRPSDVGVLADSLKDMETDAQKLYQLIWRQFVACQMTPAQYDSTTLIVEAADYQLRAKGRTLRFDGWTKVMPALRKNDEDRTLPTVAVGEALSLQKLLPGQHFTKPPARYSDASLVKELEKRGIGRPSTYASIISTIQDRGYVRVENRRFYAEKMGEIVTDRLEENFRELMNYDFTARMESRLDQVANNQAEWKAVLDEFFNEFSQQLEKAEQDPEEGGMRPNAMVLTSIDCPTCSRQMGIRTASTGVFLGCSGYALSPKERCKTTINLIPENEVLNVLEGDDAETNALRARRRCEKCGTAMDSYLIDNQRKLHVCGNNPACDGYEIETGEFRIKGYDGPIVECEKCGSEMHLKMGRFGKYMACTSETCSNTRKILRNGDVAPPKEDPVPLPELPCEKSDAYFVLRDGAAGVFLAANTFPKSRETRAPLVEELVRFKDRLPEKLRYLAEAPVVDKDGNKTQVRFSRKTKQQYVSSEKDGKATGWSAFYIDGKWVEGKK

SEQ ID NO: 4154 - protein, 321 aa, Escherichia coli BL21 (DE3)
MKQQAGIGILLALTTAICWGALPIAMKQVLEVMEPPTIVFYRFLMASIGLGAILAVKKRLPPLRVFRKPRWLILLAVATAGLFGNFILFSSSLQYLSPTASQVIGQLSPVGMMVASVFILKEKMRSTQVVGALMLLSGLVMFFNTSLVEIFTKLTDYTWGVIFGVGAATVWVSYGVAQKVLLRRLASPQILFLLYTLCTIALFPLAKPGVIAQLSHWQLACLIFCGLNTLVGYGALAEAMARWQAAQVSAIITLTPLFTLFFSDLLSLAWPDFFARPMLNLLGYLGAFVVVAGAMYSAIGHRIWGGLRKHTTVVSQPRAGE

SEQ ID NO: 4155 - protein, 306 aa, Haemophilus somnus 129PT
MKQKPLLGFIFALTTAIAWGSLPIALQQVMNAMSMQTIVWFRFMVATVALAILLKLANRLPKLSDLNRYFFGLVILGVIGLSGNFSLFNSSLKFIEPSVTQIFVHFSSFAMMFCGVVIFKEKLGLHQKIGLVILIIGLILFFNERAEQLFDINIYSIGVFLSMSASLIWVTYGLAQKLLLRRFNSQQILLMIYTGCAFVFTPFVEIEQLQNLNTFTLICFIYCCLNTLIGYGAYAEALNHWDVAKVSVVITLVPLFTILFAHLLNLIYPQYFSAPELNTLSYIGAFIVVFGAMTSAIGYKFIKNKI

SEQ ID NO: 4156 - protein, 321 aa, Enterobacter sp. 638
MKQQAGIGILLALTTAVCWGALPIAMKQVLEVMEPPTVVFYRFLMASIGLGAILAIKGKLPPLRIFRKPRWLILLAIATAGLFGNFILFSSSLQYLSPTASQVIGQLSPVGMMVASVFILKEKMRVTQIVGASMLLCGLVMFFNTSLIEIFTRLTDYTWGVIFGVGAATVWVTYGVAQKVLLRRLGSPQILFLLYTLCTIALLPLAKPGVITQLSDWQLACLIFCGLNTLVGYGALAEAMARWQAAQVSALITLTPLFTLLFSDLLSMAWPDFFVKPMLNLLGYLGAFVVVAGAMYSAIGHRLWGRWRKNEAVVVVPRSGE

SEQ ID NO: 4157 - protein, 328 aa, Yersinia pseudotuberculosis IP 31758
MDTKQQAGLGIFLALTTAVFWGALPIAMKQVLEVMEPFTIVWYRFMMAAIGLGIILASRRQLPSLKLFRQRRWLALLIIATCGLLGNFIFFSSSLQYLSPTTSQVIGQLSPVGMMVASVLVLKERMRITQVIGAGMLICGLLLFFNTSLHEIFTRLTDYTLGVALGVCAAVVWVSYGVAQKVLLRRMASQQILLLLYTLCAIALFPLAKPAVIFQLSGWQFACLLFCGVNTLVGYGALAEAMARWQAAQVSALITLTPLFTLFFSILLALAWPDMFAAPSLNLVGYAGAFVVVAGAMFSAIGHRWWPRRTEINLVALQKQPVNDLRRK

SEQ ID NO: 4158 - protein, 321 aa, Escherichia coli HS; identical to SEQ ID NO: 4154

SEQ ID NO: 4159 - protein, 321 aa, Escherichia coli E24377A; identical to SEQ ID NO: 4154

SEQ ID NO: 4160 - protein, 334 aa, Serratia proteamaculans 568
MHRPVSAGKGKMETKQQVGIGISLAVTTAVCWGALPIAMKEVLVVMDPFTIVWYRFTMAALGLGLILAVRGKLPPVTLFRQPRWLLILAIATAGLLGNFIFFSSSLQYLSPTASQVIGQLSPVGMMFASVLILKERMRITQVIGALMLICGLLLFFNVSLIEIFTRLTDYTLGVLLGVCAAMVWVTYGVAQKVLLRRLASPQILVMLYTLCAVALFPLARPEGIFQLSGWQLACLLFCGANTLIGYGALAEAMARWQAAQVSALVTLTPLFTLLFSDLLALAWPHVFAAPTLNVVGYVGAFVVVAGAMFSAIGHRWWPRRAEPRLVAPLKQPGE

SEQ ID NO: 4161 - protein, 321 aa, Escherichia coli C ATCC 8739; identical to SEQ ID NO: 4154

SEQ ID NO: 4162 - protein, 321 aa, Escherichia coli SMS 3 5; identical to SEQ ID NO: 4154

SEQ ID NO: 4163 - protein, 321 aa, Shigella boydii CDC 3083 94
MKQQAGIGILLALTTAICWGALPIAMKQVLEVMEPPTIVFYRFLMASIGLGAILAVKKRLPPLRVFRKLRWLILLAVATAGLFGNFILFSSSLQYLSPTASQVIGQLSPVGMMVASVFILKEKMRSTQVVGALMLLSGLVMFFNTTLVEIFTKLTDYTWGVIFGVGAATVWVSYGVAQKVLLRRLASPQILFLLYTLCTIALFPLAKPGVIAQLSHWQLACLIFCGLNTLVGYGALAEAMARWQAAQVSAIITLTPLFTLFFSDLLSLAWPDFFARPMLNLLGYLGAFVVVAGAMYSTIGHRIWGGLRKHTTVVSQPRAGE

SEQ ID NO: 4164 - protein, 321 aa, Salmonella enterica serovar Newport SL254
MKQQAGIGILLALTTAMCWGALPIAMKQVLEVMEPSTIVFYRFLMASIGLGAILAVKRKLPPLRIFRKPRWLVLLAIATCGLFGNFILFSSSLQYLSPTASQVIGQLSPVGMMVASVFILKEKMRGTQVIGALMLLSGLVMFFNTSLIEIFTRLTDYTWGVIFGVGAAMVWVSYGVAQKVLLRRLASQQILFLLYTLCTIALLPLAKPMVIAQLSDWQLACLIFCGLNTLVGYGALAEAMARWQAAQVSAIITLTPLFTLLFSDLLSMAWPDFFARPMLNLLGYLGAFVVVAGAMYSAIGHRIWGGLRKHETVVSQPRSGE

SEQ ID NO: 4165 - protein, 321 aa, Salmonella enterica serovar Heidelberg SL476; identical to SEQ ID NO: 4164

SEQ ID NO: 4166 - protein, 321 aa, Salmonella enterica serovar Schwarzengrund CVM19633; identical to SEQ ID NO: 4164

SEQ ID NO: 4167 - protein, 321 aa, Salmonella enterica serovar Agona SL483; identical to SEQ ID NO: 4164

SEQ ID NO: 4168 - protein, 321 aa, Escherichia coli O157 H7 EC4115
MKQQAGIGILLALTTAICWGALPIAMKQVLEVMEPPTIVFYRFLMASIGLGAILAVKKRLPPLRVFRKPRWLILLAVATAGLFGNFILFSSSLKSLSPTASQVIGQLSPVGMMVASVFILKEKMRSTQVVGALMLLSGLVMFFNTSLVEIFTKLTDYTWGVIFGVGAATVWVSYGVAQKVLLRRLASPQILFLLYTLCTIALFPLAKPGVIAQLSHWQLACLIFCGLNTLVGYGALAEAMARWQAAQVSAIITLTPLFTLFFSDLLSLAWPDFFARPMLNLLGYLGAFVVVAGAMYSAIGHRIWGGLRKHTTVVSQPRAGE

SEQ ID NO: 4169 - protein, 306 aa, Dickeya dadantii Ech703
MKQNAGIGLSLALTTAVCWGALPIAMKQVLANMEPYTVVWYRFVIASVGLWLFLRAKGNLPTVRLFNHQRWWILLFIATGGLLGNFMLFSSSLRYLSPTTSQVIGQLSPVGMMIASVFILKERMRLNQVIGVIILISGLVMFFNSSLVEILTRLTDYTLGVLLGMAAATVWVSYGVAQKVLLRRLSSQQLLFLLYALCALCITPLAKPWAIFQLSNWQLVCLLFCGINTLVGYGALAEAMARWQAAQVSAIITLTPLFTLFFSDILALVWPSVFASLELNPLGYIGAFVVVAGAMFSAIGHRIIGR

SEQ ID NO: 4170 - protein, 314 aa, Dickeya zeae Ech1591
MKQNAGIGFCLALTTAICWGALPIAMKQVLVAMEPYTIVWYRFLIASAGLGIFLYSKGALPKPQMFDHQRWWILLLVATGGLLGNFVLFSSSLQYLSPTASQVIGQLSTVGLMVASVVILKEKMRLNQVIGAVVLICGLLMFFNSSLVELFTRLTDYTFGILLGVAASTVWVAYGVAQKVLLRRLTSQQLLFLLYTLCVLFITPLAKPEVVFQLTGWQLACLLFCGANTLVGYGALAEAMARWQAAQVSTIITLTPLFTLFFSDLLSLAWPSLFAAPSLNLLGYAGSFIVVAGAMFAAIGHRLIAAKRSKYPQV

SEQ ID NO: 4171 - protein, 320 aa, Pectobacterium carotovorum PC1
MNTKQQTGIGLCLALTTAVCWGALPIAMKQVLVVMEPYTIVWYRFIIASIGLGIILSSRKNLPPMRVFRHRRWWVLLLIATAGLLGNFVFFSSSLQYLSPTASQVIGQLSPVGMMFASVLILKEKMRGTQVIGAIMLICGLILFFNTSLIEIFTRLTDYTLGVLLGVCASAVWVSYGVAQKVLLRRLTSQQILFLLYVLCVVFITPFAKPEVIFQLSGWQLICLLFCGANTLIGYGALAEAMARWQASQVSAVITLTPLFTLLFSDLLALGWPTFFAAPVLNWVGYVGAFVVVAGAMFSAIGHRFLPGKKEPVPPLMVKK

SEQ ID NO: 4172 - protein, 375 aa, Escherichia coli BL21 (DE3)
MQSVTPTSQYLKALNEGSHQPDDVQKEAVSRLEIIYQELINSRPPAPRTSGLMARVGKLWGKREDTKHTPVRGLYMWGGVGRGKTWLMDLFYQSLPGERKQRLHFHRFMLRVHEELTALQGQTDPLEIIADRFKAETDVLCFDEFFVSDITDAMLLGGLMKALFTRGITLVATSNIPPDELYRNGLQRARFLPAIDAIKQHCDVMNVDAGVDYRLRTLTQAHLWLSPLNDETRAQMDKLWLALAGAKRENSPTLEINHRPLATMGVENQTLAVSFTTLCVDARSQHDYIALSRLFHTVMLFDVPVMTRLMESEARRFIALVDEFYERHVKLVVSAEVPLYAIYQGERLKFEFQRCLSRLQEMQSEEYLKREHLAG

SEQ ID NO: 4173 - protein, 371 aa, Colwellia psychrerythraea 34H
MIKLSPIDKYKQDLTRDDFLFDAAQENAVIHLQRLYDDLQSKPLAVSGFKKVLNRWKKVYKKQEQEPIKGLYFWGGVGRGKTYLVDTFFESLPFNNKMRVHFHRFMHRVHQELKSLSGQSDPLKIIAKKFADETQIICFDEFFVSDITDAMILGTLFEELFAHNVTLVATSNIIPDELYRNGLQRERFLPAIKLINKHTLIVNVDSGVDYRLRTLEQAEIFHYPLDAQADENLKHYFKQLSTDEGKSGQSIEIHNRPLKTVLVSDGVVYFDFSVLCESARSQGDYMEISQLYHTVLMANVKEMGPDSDDTTRRFIALVDEFYERNVKLIMSAELPLDDLYSGGRLAFEFKRCLSRLQEMQSHDYLASEHLP

SEQ ID NO: 4174 - protein, 393 aa, Saccharophagus degradans 2-40
MLTWRFKVPALFGLYVVVGNMDLHDSPLVRYEKDLLQPGFSRDPAQAMAVEHLQSFYERLLAAHNKVEPRSLVASVKSLFVKPKNEPVKGLYMWGGVGRGKTYLMDVFYDALPFEQKMRTHFHRFMRRVHAELTKNKGKQDPLKLVADTIASEAKVICFDEFFVVDITDAMILGNLLQELFARGVSLVATSNIEPDGLYKDGLQRVRFLPAIEQLKKYVEVVNVDGGVDYRLRALEQAALYYTPLSDSADEQMSACFERLVPDPLSVRRDVHIEVGGRKIRAKCAADDVAWFDFDAICDGPRSQNDYIDLACEHHAVLVSGVPELGARNDDKARRFIYLVDEFYDRNVKLILSAELPIEKLYGAGRLEFEFQRTVSRVLEMQSHEYLSRAHKA

SEQ ID NO: 4175 - protein, 391 aa, Chromohalobacter salexigens DSM 3043
MSATMPPSRGASTPLEKYRQDLQRDDFQYDPGQEEAVKHLQRLYDELMQAPRQSPSAPASSSGGLKSKVAKLFGKPSAPSPFEEPPAVLGLYFWGGVGRGKTYLVDTFYETLPFADKMRTHFHRFMQRVHNELTHYKGEKNPLTLIAAKFASEARVICLDEFFVKDITDAMILANLLEALFAQGVVLVTTSNIVPDDLYKDGLQRARFIPAIDLLKRHCEVVNVDSGVDYRLRALEQVKIFYHPLGDEAEHALEKSFRAIAGAGGEPDADIHVNHRVLPARRLHEDVVWFEFRTLCDGPRSQNDYIELSREFHTVLLSNVPQMSAHSEDQARRFINLVDEFYDRGVKLLLSAAVAIESLYTHGQLEFEFERTLSRLQEMQSKEYLALPHKP

SEQ ID NO: 4176 - protein, 377 aa, Marinobacter aquaeolei VT8
MTAATSSDTVANLTPWERYQKDLERPDFHKDPAQVDAVQRLQALYDKLVAAENERNKGLAKLRRKLKKGREEPVKGLYFWGGVGRGKTYLMDTFFESLPFERKMRVHFHRFMQRVHNELKALKGEKNPLEMVAKKFADETRVICFDEFFVSDIGDAMILATLMDGLFGRGVTLVCTSNIVPDGLYKDGLQRARFLPAIELVKKYTDVVNVDGGVDYRLRTLEQAELYHCPLDDEADISLRNSFDALAVEAAKHSKTMEINGRKIPAQAHADDVVWFDFKDVCDGPRSQNDYIEMARQFHAIIVSNVPVLGGDKDDQARRFINMIDEFYDRNVKVIISAAAPITELYSGGRLSFEFERTESRLLEMQSQEYLEAPHKP

SEQ ID NO: 4177 - protein, 374 aa, Enterobacter sp. 638
MQSLSPTSRYQQALDEGTHQPDDVQRDAVNRLNSIYQKLMTEPTETAQTSGLKAAFGRLLGKKYPQTVPPVRGLYMWGGVGRGKTWLMDMFYQSLPGTRKQRLHFHRFMLRVHEELTALQGHADPLEIVADRFKAETDVLCFDEFFVSDITDAMLLGGLMKALFARGITLVATSNIPPDDLYRNGLQRARFMPAIDAIKEHCDIMNVDAGVDYRLRTLTQAHLWLSPLNEQTQSQMDKLWLALAGAKRDKSPELEINHRPLQTLGVENQTLAVSFATLCVDARSQHDYIALSRLFHTVMLLDVPVMTPLMESEARRFIALVDEFYERHVKLVVSAEMPLYEIYQGERLKFEFQRCLSRLQEMQSEEYLKRAHMP

SEQ ID NO: 4178 - protein, 367 aa, Vibrio cholerae O395
MTPKQRYEKDLQRTDFYSDEAQARAVDALDNLYHQWLNYLNQPVVRPSVWQKLIGKKPTVTQPPQGLYMWGGVGRGKTYLMDTFFEALPTEKKLRVHFHRFMYRVHDELRTLSDVSDPLEIVADRFCAEANIICFDEFFVSDITDAMILGTLFEALFRRGIVLVATSNIAPKDLYRNGLQRARFLPAIALVEMHCQILNVDSGVDYRLRTLQQAEIYHYPLDSKATDNLQRYFQQLISSEQTPETQIDVNHRMITVEAAGDGVLYATFAQLCQTARSQNDYIELSKIYHTVLLADVKQMNKSSDDAARRFIALVDEFYERHVKLIISAEVPLTDLYTDGLLEFEFKRCQSRLIEMQSHDYLAKEHLG

SEQ ID NO: 4179 - protein, 366 aa, Marinomonas MWYL1
MTPITRYKQDLTRTDFNYDPAQEEAVEALQDLFDRLIANQADKSTNGFLGRFLKKKAPTVEQGLYFWGGVGRGKTYLMDTFFDCLPTEKKMRLHFHRFMQMVHQELRKLHDVKNPLEIVGKEISSKAKVLCFDEFFVTDITDAMILAGLLEVLFENGTTLVATSNIEPDGLYKNGLQRARFLPAIDLVKKYTKVMNVDGGVDYRLRTLKQAKLYHYPLSKEADDELNNRFMSLISDASHVVEGGAVEIEGRNIPLLRSCEGMAWFDIKALCDGPRSQIDYIEIARLYSTVIISNLPQMDASRDDLARRFINLVDEFYDRHVKVIFSAEVAIPEIYKGTRLAFEYDRTVSRLLEMQSEEYLSLEHRP

SEQ ID NO: 4180 - protein, 375 aa, Yersinia pseudotuberculosis IP 31758
MQQSSPITLYQQALDAGGYQPDDVQRRAVARLETIYQALNQYQNVPAASASLRNRLGRLFGKPARRPPVSPVQGLYMWGGVGRGKTWLMDLFFHSLPGERKLRLHFHRFMLRVHQELTELQGHENPLEIVADGFKAQTDVLCFDEFFVSDITDAMLLATLLEALFARGITLVATSNIPPDNLYHNGLQRGRFLPAIALIKQHCEVMNVDAGIDYRLRTLTQANLYLTPLNSQTEQAMAAIFVKLAGKEGGKATVLEVNHRPLPAICVAEGVLAVDFHTLCEEARSQLDYIALSKRYHTVLLHNVRCMAARDENTARRFLALVDEFYERRVKLIIAAEASMFEIYSGERLKFEYQRCLSRLQEMQSEEYLSLPHLP

SEQ ID NO: 4181 - protein, 367 aa, Vibrio harveyi ATCC BAA-1116
MTPLQRYQQDIAEHGFQRDEAQYNAVVALDKLYHAIAEFQSAPIPQLSTWQKLLGKKPEMPEPPKGLYFWGGVGRGKTYLMDAFFDALPTERKMRVHFHRFMYRVHDELKRLGEVENPLSKVADLFKKEADIVCFDEFFVSDITDAMILATLLQEMFKRQMILVATSNIEPENLYRNGLQRARFLPAINMIVQRCDVLNVDSGVDYRLRTLQQAEIYHYPLDEQASVNLNKYYHQLIGERKVAANSIEISHREVAVIEASDGVLHASFEQLCQTPRSQNDYIELSRIYHTVLLADVKQMDRKIDDAARRFIALVDEFYERNVKLIISAEVAMESLYTQGQLEFEFKRCLSRLTEMQSHEYLAREHLA

SEQ ID NO: 4182 - protein, 375 aa, Escherichia coli HS; identical to SEQ ID NO: 4172

SEQ ID NO: 4183 - protein, 375 aa, Escherichia coli E24377A
MQSVTPTSQYLKALNEGSHQPDDVQKEAVSRLEIIYQELINSRPPAPRTSGLMARVGKLWGKREDTKHTPVRGLYMWGGVGRGKTWLMDLFYQSLLGERKQRLHFHRFMLRVHEELTALQGQTDPLEIIADRFKAETDVLCFDEFFVSDITDAMLLGGLMKALFARGITLVATSNIPPDELYRNGLQRARFLPAIDAIKQHCDVMNVDAGVDYRLRTLTQAHLWLSPLNDETRAQMDKLWLALAGAKRENSPTLEINHRPLATMGVENQTLAVSFTTLCVDARSQHDYIALSRLFHTVMLFDVPVMTRLMESEARRFIALVDEFYERHVKLVVSAEVPLYEIYQGDRLKFEFQRCLSRLQEMQSEEYLKREHLAG

SEQ ID NO: 4184 - protein, 376 aa, Serratia proteamaculans 568
MQAQSPLSRYQRLLAAGEYQADEVQMEAVTQLDHIYQALLQQTPVVSAPAAGLRGKLNRWLGKSSETTQQRPVQGLYMWGGVGRGKTWLMDMFFHSLPGERKLRLHFHRFMLRVHEELTELQGQENPLEIIADGFKAQTDVLCFDEFFVSDITDAMLLATLLQALFARGITLVATSNIPPNDLYRNGLQRARFLPAIDLINEFCDVMNVDAGIDYRLRTLTQAHLYLTPLDEQTRLTMDRMFVKLAGKPGEAAPVLQINHRPLQAINAVDGVLAVDFHTLCEEARSQLDYIALSRLYHSVILYNVRVMGPLKENTARRFLALVDEFYERHVKLVIAAEASMFDIYQGERLKFEYQRCLSRLQEMQSEEYLKLPHLP

SEQ ID NO: 4185 - protein, 375 aa, Yersinia pestis Angola; identical to SEQ ID NO: 4180

SEQ ID NO: 4186 - protein, 375 aa, Escherichia coli C ATCC 8739; identical to SEQ ID NO: 4172

SEQ ID NO: 4187 - protein, 375 aa, Escherichia coli SMS 3 5
MQSVTPTSQYLKALNEGSHQPDDVQKEAVSRLEIIYQELINSTPPAPRTSGLMARVGKLWSKREDTKHTPVRGLYMWGGVGRGKTWLMDLFYQSLPGERKQRLHFHRFMLRVHEELTELQGQSDPLEIIADRFKAETDVLCFDEFFVSDITDAMLLGGLMKALFARGITLVATSNIPPDELYRNGLQRARFLPAIDAIKQHCDVMNVDAGVDYRLRTLTQAHLWLSPLNDETRAQMDKLWLALAGAKRENSPTLEINHRPLATMGVENQTLAVSFTTLCVDARSQHDYIALSRLFHTVMLFDVPVMTRLMESEARRFIALVDEFYERHVKLVVSAEVPLYDIYQGERLKFEFQRCLSRLQEMQSEEYLKREHLAG

SEQ ID NO: 4188 - protein, 375 aa, Shigella boydii CDC 3083 94
MQSVTPTSQYLKALNEGSHQPDDVQKEAVSRLEIIYQELINSRPPAPRTSGLMARVGKLWGKREDTKHTPVRGLYMWGGVGRGKTWLMDLFYQSLPGERKQRLHFHRFMLRVHEELTALQGQTDPLEIIADRFKAETDVLCFDEFFVSDITDAMLLGGLMKALFARGITLVATSNIPPDELYRNGLQRARFLPAIDAIKQHCDVMNVDAGVDYRLRTLTQAHLWLSPLHDETRAQMDKLWLALAGAKRENSPTLEINHRPLATMGAENQTLAVSFTTLCVDARSQHDYIALSRLFHTVMLFDVPVMTRLMESEARRFIALVDEFYERHVKLVVSAEVPLYEIYQGDRLKFEFQRCLSRLQEMQSEEYLKREHLAG

SEQ ID NO: 4189 - protein, 374 aa, Salmonella enterica serovar Newport SL254
MQSFSPTSRYLQALNEGTHQPDDVQKEAVDRLETLYQALTAKKSSATPPGGLIARLGKLLGKNEPDAQIPVRGLYMWGGVGRGKTWLMDLFYHSLPGERKLRLHFHRFMLRVHEELTALQGQIDPLDIIADRFKTETDVLCFDEFFVTDITDAMLLGGLMKALFARGITLVATSNIPPDELYRNGLQRARFLPAIDAIKQHCDIMNVDAGVDYRLRTLTQAHLWLTPLNDETRRQMDKLWLALAGAAREHAPTLEINHRSLSTLGVENQTLAVSFATLCVEARSQHDYIALSRLFHTVLLFDVPVMTPLMENEARRFIALVDEFYERHVKLVVSAAAPLYEIYQGERLKFEFQRCLSRLQEMQSAEYLKREHMP

SEQ ID NO: 4190 - protein, 374 aa, Salmonella enterica serovar Heidelberg SL476
MQSLSPTSRYLQALNEGTHQPDDVQKEAVNRLETLYQALTAKKSSATPPGGLIARLGKLLGKNEPDAQIPVRGLYMWGGVGRGKTWLMDLFYHSLPGERKLRLHFHRFMLRVHEELTALQGQIDPLDIIADRFKTETDVLCFDEFFVTDITDAMLLGGLMKALFARGITLVATSNIPPDELYRNGLQRARFLPAIDAIKQHCDIMNVDAGVDYRLRTLTQAHLWLTPLNDETRRQMDKLWLALAGAAREHAPTLEINHRPLSTLGVENQTLAVSFATLCVEARSQHDYIALSRLFHTVLLFDVPVMTPLMENEARRFIALVDEFYERHVKLVVSAAAPLYEIYQGERLKFEFQRCLSRLQEMQSAEYLKREHMP

SEQ ID NO: 4191 - protein, 374 aa, Salmonella enterica serovar Schwarzengrund CVM19633
MQSLSPTSRYLQAINEGTHQPDDVQKEAVDRLETLYQALTAKKSSATPPGGLIARLGKLLGKNEPDAQIPVRGLYMWGGVGRGKTWLMDLFYHSLPGERKLRLHFHRFMLRVHEELTALQGQIDPLDIIADRFKTETDVLCFDEFFVTDITDAMLLGGLMKALFARGITLVATSNIPPDELYRNGLQRARFLPAIDAIKQHCDIMNVDAGVDYRLRTLTQAHLWLTPLNDETRRQMDKLWLALAGRARARAPTLEINHRPLSTLGVENQTLAVSFATLCVEARSQHDYIALSRLFHTVLLFDVPVMTPLMENEARRFIALVDEFYERHVKLVVSAAAPLYEIYQGERLKFEFQRCLSRLQEMQSAEYLKREHMP

SEQ ID NO: 4192 - protein, 374 aa, Salmonella enterica serovar Agona SL483
MQSLSPTSRYLQALNEGTHQPDDVQKEAVDRLETLYQALTAKKSSATPPGGLIARLGKLLGKNEPDAQIPVRGLYMWGGVGRGKTWLMDLFYHSLPGERKLRLHFHRFMLRVHEELTALQGQIDPLDIIADRFKTETDVLCFDEFFVTDITDAMLLGGLMKALFARGITLVATSNIPPDELYRNGLQRARFLPAIDAIKQHCDIMNVDAGVDYRLRTLTQAHLWLTPLNDETQRQMDKLWLALAGAAREHAPTLEINHRPLSTLGVENQTLAVSFATLCVEARSQHDYIALSRLFHTVLLFDVPVMTLLMENEARRFIALVDEFYERHVKLVVSAAAPLYEIYQGERLKFEFQRCLSRLQEMQSAEYLKREHMP

SEQ ID NO: 4193 - protein, 374 aa, Salmonella enterica serovar Dublin CT 02021853
MQSLSPTSRYLQALNEGTHQPDDVQKEAVDRLETLYQALTAKKSSATPPGGLIARLGKLLGKNEPDAQIPVRGLYMWGGVGRGKTWLMDLFYHSLPGERKLRLHFHRFMLRVHEELTALQGQIDPLDIIADRFKTETDVLCFDEFFVTDITDAMLLGGLMKALFARGITLVATSNIPPDELYRNGLQRARFLPAIDAIKQHCDIMNVDAGVDYRLRTLTQAHLWLTPLNDETRRQMDKLWLALAGAAREHAPTLEINHRSLSTLGVENQTLAVSFATLCVEARSQHDYIALSRLFHTVLLFDVPVMTPLMENEARRFIALVDEFYERHVKLVVSAAAPLYEIYQGEQLKFEFQRCLSRLQEMQSAEYLKREHMP

SEQ ID NO: 4194 - protein, 368 aa, Aliivibrio salmonicida LFI1238
MTPLEKYQLDLTQDTFHHDSAQQHAVECLDELYHRLLQPKTTPKAERKSWLSVFKKSEPQTVVPEKGLYFWGGVGRGKTYLVDTFYDALPTERKMRVHFHRFMQRVHDELGELQQQADPLLIVADKFKQETDIICFDEFFVSDITDAMILATLLEALFERGIALVATSNIVPQELYRNGLQRARFIPAITLIEQHCQIVNVDSGIDYRLRTLEQAEIYHFPLDSLAQQNMLDYFHQLTSETEHEEKEIEINHRILSVNAEGDGVVHFEFTSLCESARSQHDYIELSRLYHTVLLSNVKVMGELNDDAARRFIAMVDEFYERNVKLIISAEVQLADLYQNGRLTFEFKRCQSRLIEMQSHEYLAKEHLS

SEQ ID NO: 4195 - protein, 375 aa, Escherichia coli O157 H7 EC4115
MQSVTPTSQYLKALNEGSHQPDDVQKEAVSRLEIIYQELINSTPPAPRTSGLMARVGKLWGKREDTKHTPVRGLYMWGGVGRGKTWLMDLFYQSLPGERKQRLHFHRFMLRVHEELTALQGQTDPLEIIADRFKAETDVLCFDEFFVSDITDAMLLGGLMKALFARGITLVATSNIPPDELYRNGLQRARFLPAIDAIKQHCDVMNVDAGVDYRLRTLTQAHLWLSPLHDETRAQMDKLWLALAGGKRENSPTLEINHRPLATMGVENQTLAVSFTTLCVDARSQHDYIALSRLFHTVMLFDVPVMTRLMESEARRFIALVDEFYERHVKLVVSAEVPLYEIYQGDRLKFEFQRCLSRLQEMQSEEYLKREHLAG

SEQ ID NO: 4196 - protein, 376 aa, Dickeya dadantii Ech703
MQRITPLSLYQQALSAEEYQPDEVQRQTIMRLDEIHQALTEQVWVNVEPATGMWSRWRSLLGGKHEPHREPVTGLYMWGGVGRGKTWLMDMFFHSLPSERKLRLHFHRFMLRVHEELNQLQGQENPLEKVADGFKAQTDVLCFDEFFVSDITDAMLLAELLKALFERGIALVATSNIPPDELYRNGLQRSRFLPAIELIKQYCEVRNVDAGIDYRLRTLTQAHLYLTPLNDETDAVMRTMFGRLSGHEYRHPGPVLEINHRAMPTLSAGDGVLSIDFPTLCLEARSQNDYIALSRLYHTVLLHHVTVMGAKEENAARRFLALVDEFYERRVKLVISAESPMFEIYQGHHLKFEYQRCLSRLQEMQSEEYLRQPHLP

SEQ ID NO: 4197 - protein, 376 aa, Dickeya zeae Ech1591
MQRTTPLALYQQALAAQTYQPDEVQHQTVVRLNAIHQTLTEQVWGPSESRAPGLMSKWRSWLGQKETSSTPVQGLYMWGGVGRGKTWLMDLFFHSLPSERKLRLHFHRFMLRVHEELNQLQGQENPLEKVADGFKAQTDILCFDEFFVSDITDAMLLAELLRALFSRGIALVATSNIPPDELYRNGLQRARFLPAIDLIKRYCDVLNVDAGIDYRLRTLTQAHLYLSPINADTDAEMQAVFRRLSGRDAGQPGPVLEVNHRPLATLSAGDGVLAVDFATLCFEARSQNDYIALSRLYHTVLLHHVPVMEVKDENAARRFLALVDEFYERRVKLIISAQAPMFDIYQGEHLKFEYQRCLSRLQEMQSEEYLRQPHLP

SEQ ID NO: 4198 - protein, 383 aa, Pectobacterium carotovorum PC1
MATPQTTRQQTTPLALYQQALSAGEYQPDEVQRQTVVRLEAIHQALCERAADDNAGASGRVGKWRSWLGLREKRESAPVQGLYMWGGVGRGKTWLMDMFFHSLPAERKMRLHFHRFMLRVHEELNQFQGQENPLEKVADGFKAETDVLCFDEFFVSDITDAMLLAELLRALFARGIALVATSNIPPDDLYRNGLQRARFLPAIELIKQHCEVRNVDAGIDYRLRTLTQAHLYLSPLNEDTEATMQQMFTRLTGKRWQTPGPVLEINHRPLATLGVSEGVLAVDFHTLCTEARSQNDYIALSRLYHTMLLHNVTVMETKEENTARRFLALVDECYERRIKLIISAQASMFEIYQGEHLKFEYQRCLSRLQEMQSEEYLRQPHLA

SEQ ID NO: 4199 - protein, 326 aa, Yersinia pseudotuberculosis IP 31758
MHETFRPLAGASNPHLQTLLPRLVRRHVQLSPYWQRLELPDGDFIDLAWSENPELAREKPRVVLFHGLEGNFYSPYAHGLLRAWQAAGWLGVVMHFRGCSGEPNRKSRIYHSGETEDANFFLHWLQETYGQVPTAAVGISLGGNMLACYLAKKGKNSGLRAAVVVSAPLMLEPCADRMDQGFSRVYQRYLLNQLKLNATRKLLQYPNSLPVNLFQLKKLRRVRDFDDAITAKIHGFNDAGDYYRRCSALPLLPQIRVPLLIIHAKDDPFMTAEVIPNIETLPDNIDYQLTEHGGHVGFVGGSLKHPQMWLEQRIPAWLSPYLEQQS

SEQ ID NO: 4200 - protein, 326 aa, Serratia proteamaculans 568
MHESFRPLTGASNPHLQTLLPRLVRRRVQLKPHWQRLELPDGDFVDLAWSEDPAQASGKPRVVLFHGLEGNFYSPYAHGQLNAWREKGWLGVVMHFRGCSGVPNRKQRIYHSGETEDARFFLQWLRATYGEAPTAAVGVSLGGNMLACYLAQQGADSLLQAAVVVSAPLMLEPCSWRMDQGFSRVYQHYLLGQLKQNATRKLLHYPDTLPLKLPQLKALRRIRDFDDAITSRIHGFSDATDYYRRCSALPLLPSIQTPLLIIHAKDDPFMTDEVIPETATLPHNIEYQLTEFGGHVGFVGGTLKKPHMWLEYRIPSWLAPYLETTK

SEQ ID NO: 4201 - protein, 326 aa, Yersinia pestis Angola; identical to SEQ ID NO: 4199

SEQ ID NO: 4202 - protein, 326 aa, Yersinia pseudotuberculosis YPIII; identical to SEQ ID NO: 4199

SEQ ID NO: 4203 - protein, 330 aa, Dickeya dadantii Ech703
MNTYPLHNSAFQPLGGMRNPHLQTLLPRLFRRRPSLTPVWQTLDTPDGDFVELAWSEPPQPAAHKPRVVLFHGLEGNFRSPYAHGLMAACRERGWLAVIMHFRGCSGVPNRRTRIYHSGETGDADYFLQWLEKTLGPAPTAAIGISLGGNMLACLLGRQGERCSLNAAAVVSAPLLLEPCSRRIEQGFSRIYQSYLVNSLRQSALRKLAAYPGTIPVSPSRIKQVRGLREFDDLITARLHGFHDAADYYRRCSAMPLLPQIRTPTLIIQAKDDPFMTPEVIPDPSQLPPCVEYQLTEHGGHVGFVSGSWRHPEMWLEHRIPDWFTPYLEQ

SEQ ID NO: 4204 - protein, 331 aa, Dickeya zeae Ech1591
MNHSSYRNTCFQPLSGAHNPHVQTLLPRLLRRRPALQPVWQRLTLPDGDFVDLAWSEAPAQAAHKPRVVLFHGLEGSFHSPYAHGLMAACRQRGWLAVVMHFRGCSGQPNLLPRAYHAGETEDARYFLHWLRRTFGAAPTVAVGFSLGGNMLACLLAQQQESLLNAAAVVSAPLMLEPCSNRLEHGFSRFYQRYLLHSLRRNALHKLTMYPDCLPISAGQLRQVRRLRQFDELITARLHGFADATDYYRRSSALPLLPRIRQPLLIIHAKDDPFMTPAVIPEPSQLPANIDYQLTEHGGHVGFVGGTWHQPELWLEQRLPNWFTPYLEQIA

SEQ ID NO: 4205 - protein, 334 aa, Pectobacterium carotovorum PC1
MYDHFHPLSGAHNPHLQTLLPRLIRRHAQFSPVWQPLELPDGDFVDLAWSEAPEQARNKPRVVLFHGLEGSFHSPYAHGLLHACKQRGWLAVVMHFRGCSGKPNRMKRIYHSGETSDASYFLRWMQETLGDAPTAAIGVSLGGNMLAYLLAQQGESCYLSAAVIVSAPLMLEPCSRRMEQGFSRVYQHYLLRLLKQNAGRKLAAYPDTLPIQLPQLKRIRQLREFDDVITSRIHGFHDAADYYRRCSALPLLPQIRTPLLIIHAKDDPFMTSEVIPDLSQLPSNIEYQLTEHGGHVGFVGGTLLKPKMWLEQRIPNWLSPFLDHATDSPLTQEP

SEQ ID NO: 4206 - protein, 801 aa, Bacillus anthracis Ames 0581
MKKRLVMIGNGMAGIRCMEEILKHDCDSYEITIFGDEPHPNYNRIMLSHVLQGKTNIQDIIMNEYSWYEENEITLYTNERVQSIDREEKVIMTEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLDFDHIKEILQDANMVTKLNERFQTARGTYKEAWGQALETKSLKAMYEVETVK

SEQ ID NO: 4207 - protein, 801 aa, Bacillus anthracis str Sterne; identical to SEQ ID NO: 4206

SEQ ID NO: 4208 - protein, 801 aa, Bacillus thuringiensis konkukian
MKKRLVMIGNGMAGIRCMEEILKHDCDSYEITIFGDEPHPNYNRIMLSHVLQGKTNIQDIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYNVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 4209 - protein, 801 aa, Bacillus cereus ZK
MKKRLVMIGNGMAGIRCMEEILKHDCDSYEITIFGDEPHPNYNRIMLSHVLQGKTNIQNIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEEIELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 4210 - protein, 814 aa, Dechloromonas aromatica RCB
MSKPRLVLIGNGMAGVRTVEELLKIKPDHYDITIFGAEPHPNYNRILLSPVLAGEMTISEIVLNELEWYKENNIKLHTGKQIKTIDRVKRKVIAEDGTEEEYDRLLIATGSTPFMLPIPGNDLPGVIGYRDIKDTDEMIEAAKLHKHAVVIGGGLLGLEAANGLKLRGMDVTVVHLGPWLLERQLDEVAGKMLQKSLEDKGLKFLLQKQTEMLVQGESGRVAAVRFKDGMTIPADLVVMAAGIRPNYALAESSGIYCNRGIVVNDTMQTYDPKVYAVGECVTHRGIAYGLVAPLFEQAKVAANHLAGYGIGRYTGSVTSTKLKVTGIDLFSAGNYMGGEGTEEIVLNDPYGGVYKKLVLKDNKLVGGVMYGDTADGPWYFQLLKDGRDIHDIRDQLIFGQSLVGDVGHAGNSKAADMPDSAEVCGCNGITKGVIVQAIKAKGLFTLDEVKKHTKAASSCGSCAGLVEQILASTIGGAYTPAASDKKPVCGCTEQSHKAVREAILNQHLITKEAVFAALEWKTPNGCDKCRPAVNYYLISTWPHEAKDDPQSRFINERSHANIQKDGTYSVVPRMWGGLTNPKELRAIADAAEKYNVPTVKVTGGQRIDLLGVKKEDLPAMWADLNAAGMVSGHAYGKSIRTVKTCVGMEHCRFGTQLAMSMGVKLEKMLFDMYAPHKVKLAVSGCPRNCAEAGIKDVGIIGVDSGYEIYIAGNGGIKTEVAQFLCKVSSDEDVMEYSGAFLQLYRLEGWYLERTCHYLERVGMDYIKGRILEDEEGRKALYAALLDSLKDAKDPWATSREPEAIKQFIPIMVEA

SEQ ID NO: 4211 - protein, 821 aa, Acidovorax sp. JS42
MVKQSRLVMVGNGMAGVRALEELLKIAPDLYDITVFGAEPHPNYNRILLSPVLAGEQTLEEIVLNDWSWYADHHITLHAGCTVTHVDRTRRTVHGVAQDGRTVEAPYDRLILATGSNPFMLPIPGRELPGVLAYRDIADTQAMIDAAASYKHAVVIGGGLLGLEAANGLMKRGMQVTVVHAGEWLMERQLDDVAGKLLQQSLAERGMQFLMQAQTQELVAGGDGRVAAVRFKDGSEVPAQLVVMAVGIRPNTALAEQMHLHVNRGIVVSDTLQTVTDPRIYAVGECAAHRGIAYGLVAPLFEQGKVLANHLAEWGIGRYQGSLTSTKLKVTGIDLFSAGDFQGGEGTEEIVLSDPHAEGGGVYKKLVLKDDRLVGACLYGDTVDGSWYFKLLRDGRSVADIRDRLMFGESHLGDAGHQGQNKAAAMADSDEVCGCNGVTKGQICKAIKDKGLFTLDEVRKHTKASASCGSCTGLVEQILMATAGGDYSATPKTKPVCACTDHGHQAVREAIRTHRLLTVDGVFRFLEWKTPNGCATCRPAVNYYLISTWPKEARDDPQSRFINERSHANIQKDGTYSVVPRMWGGETSAAELRRIADVVDKYQIPTVKVTGGQRIDLLGVKKEDLVNVWRDIGMPCGHAYAKALRTVKTCVGSEWCRMGTQDSTQLGKDLEHAFVGMYAPHKVKFAVSGCPRNCAESGIKDVGIIGVDSGWEMYVAGNGGIKTEVAQFFTKLKTAEEVLEYTGAFMQLYRLEGWYLERTVHFVARVGLDYVKRRVLQDAPGRQALWRELQDALAGEPDPWFEFEPAAVDRRQFIPITPIPA

SEQ ID NO: 4212 - protein, 825 aa, Verminephrobacter eiseniae EF01-2
MKKPQLVLVGNGMAGVRTLEELLRIAPDRYDITVFGAEPHPNYNRILLSPVLAGEQSMDQIILNDWSWYAEHHITLHSGCTVTDADRARRVVRASDAAGKVISAQYDRLIIATGSTPFMLPIPGTDLQGVLTYRDMADTRAMIAAAASYRHAVVIGGGLLGLEAANGLMKRGMQVTVVHVADWLMERQLDAVAGKMLQQSLQERGMQFLLGAQTQALLGHADGNGPGQGQGAAPRVRAVRFKDGSELPADLVVMAVGIRPNTALAERMRLHVQRGIVVSDTLQTTTDARIYAVGECAAHRGIAYGLVAPLFEQGKVLANHLAEFGIGRYQGSQTSTKLKVTGIDLFSAGNFHGGGHSEEIVLSDPGAGVYKKLVIQDDKLVGACLYGDTVDGNWYFKLLRDGRSVDDIRDKLMFGESQLGDTGHQGQHKAAALQDSDEVCGCNGVTKGRICKAIREQGLFTLEEVRKHTKASASCGSCTGLVEQILMFAAGGDYSATPKTRALCGCTGHGHQAVRDAIRTLKLLSIQAVFEHLQWRTPNGCASCRPAVNYYLVSTWPKDARDDPQSRAINERSHANIQKDGSYSVIPRIWGGETTADELRRIADVADKYRIPTIKLTGGQRIDLLGVKKEDLVGVWKDLAMPSGHAYAKALRTVKTCVGSEWCRMGVQDSTRLGKELERAMWRMYAPHKLKFAVSGCPRNCAEAGIKDVGIIGVDSGWEMYIAGNGGIKTEVAHFFTKLKTAQEVLEYTGAFCELYRQEGWYQERSVHYVGRVGLEHVKKRILQDPAGRKALWERLQCALADEPDPWVEFDKAALDTRQFAALNA

SEQ ID NO: 4213 - protein, 446 aa, Geobacter sulfurreducens
MTENKYLYVETFGCQMNVNDSEKIATLLKDEGYLPTDDPERADLVILNTCSVRAKAEQKVYGHLGRFKGVRSRKKGFLLGVGGCVAQQEGERLLQKVPWLDLVFGTHNLHLLPEIVRAAERGERRAEVGFIDNETRLDLFPETGGEGGVTRFVTVMQGCDNFCSYCIVPYVRGREISRRSSDIIDEVRKSVAEGVKEVTLLGQNVNSYGLKTEGELSFAGLIRRIAEVEGLERIRFTTSHPKDISPELIACFAEVPKLCGHIHLPAQSGSDAVLARMNRGYTRAGYLEKVEALRAARPGIQFTGDMIVGFPGETEEDFQATISLMEEVRYADLFSFIYSPRPETAAAGIRDTVSRKEKQSRLDRLQTLQQQMKRERNISFVGTRQLVLVEGVSKRGDQLYGRIDGNRIVNFAADQSLIGTMAEVTITQDYQNSLLGEIVTDKGDAR

SEQ ID NO: 4214 - protein, 441 aa, Geobacter metallireducens GS-15
MTGEKLLYIETFGCQMNVSDSEKVASLLRGEGYSQTPDSSEADLIIVNTCSVRAKAEHKVYSYLGRFRKLKRDRRLLLGVGGCVAQQEGERLLKRVPWLDLVFGTHNLHLLPEMVRAAEQGERRAAVDFIDNEARLDLFPQADEGGGVTRFVTVMQGCDNFCSYCIVPYVRGREISRRSVEIIGEIRSAVAGGVREVTLLGQNVNSYGLKTPGELSFAGLLREISAIDGLERIRFTTSHPKDISPELIACFAELPKLCGHIHLPAQAGSDSILARMNRGYTRQEYLEKVAALRAARPEILITGDIIVGFPGETEADFLQTLSLMEEVRYTDIFSFAYSPRPETAAASLGDRIMRKETTERLERVQGLQRDMTIERHAGFVGTCQAVLVEGMSKRGDQLYGRTDGNLIVNFAGNPSLAGSLVDVRITRGYPNSLLGELAVFQ

SEQ ID NO: 4215 - protein, 464 aa, Desulfovibrio desulfuricans G20
MHERTFHIMTFGCQMNVNDSDWLARALEARGFTQVPEHEAAIYIINTCSVRDKPEQKVYSLLGRIRRETKNRRNVTVCVGGCVAQQIGKGFFKRFSQVRLVFGTDGAASAPQAIERLVQEPHARISLLDFSEEFPERDAGWENGEVPVSAYVNIMQGCNNFCAYCIVPYTRGRQKSRSSAAVLDECRTLVGNGAREITLLGQNVNSYGLDPHGDGTTFARLLHDVAAIPGLERLRFMTPHPKDIAGEVIEAFGALKNLCPRVHLPLQSGSDRVLKAMGRKYDMARYMDIVTRLKAVRPDIQITSDLIVGFPGETEADFEQTLEAMRTVPFVQSFSFIYSDRPGTRAEMLPGKLSREEKTARLVRLQEVQNEYSEAALQAMVGKTVMVLFESPSPKSAAGSGTDAQNAAEESGRTASSWQGRDEHGFILNVHLPAPADLYGKIMPVTVTAARKHSLTGEPAGESC

SEQ ID NO: 4216 - protein, 444 aa, Candidatus Koribacter versatilis Ellin345
MPVSSDPKTFYIETFGCQMNFHDSEKVVGTLISQGYRQVETELDAGLILYNTCSIRDKAEQKVFHRLSEFRQLQKEGKRFAVLGCVAQQEGEKIFERAPHVSLVAGSASYRNLAEMLVQIESGSQRITGLDDRETDQTFETEFTARGNAHRGYITIIEGCDKFCAYCVVPYTRGKERSRSAESVLREARQMADAGFTDVQLLGQNVNSYHDPSGTMTFAELLTAVGEITGIKRVRFTTSHPRDFTRDIVEAIDNHPTLCDHVHLPVQSGSSKVLREMFREYTREQYLERISWMKATKNRKLSITTDVIVGFPGETETEFEETLALLDHVQYDGVFSFKYSPRPNTPALKYIDTVPEQEKSRRLQILMEHQREIQRANYRKHIGETIEVMVEAENATRAQWIGRTSQNKTLNFTVPQTVQPEIGSYHQVLVTQAFPNSLVGELVG

SEQ ID NO: 4217 - protein, 444 aa, Moorella thermoacetica ATCC 39073
MVKARKTFKIITYGCQMNQRDSEMMADLLQDAGYEPVAREEEAGVIILDTCCVREKAENKVYGKLGQIEKLKSANPDLVIAVAGCMVQQPGVAEKIRQQAPYVDLLLGTGNLQELPQLIEEIKAMHRPRIVVGEQEGPVVEDLPRRRARGAQAFVTITYGCNNFCTYCIVPYVRGRERSRRPENIIKEVKELVDQGVIEVTLLGQNVNSYGRDLRDGINFAGLLERVNAVEGLKRIRYVTSHPRDFTPELVTTISRLDKVCEHVHLPVQAGSNRILELMHRGYTREHYLELVADLRRHIPGISLTTDLIVGFPGETEADFEDTLDLVARVQFDNAFTFMYSPRRGTEAATMPGQLPTAIKKERLKRLMELQNSISLAKNEALVGQEVEVLVEGPSKTDPDQLSGRTRTNKLIIFPGDQSLTGRLVRVRLTRAQTWLLKGEMVDG

SEQ ID NO: 4218 - protein, 456 aa, Syntrophobacter fumaroxidans MPOB
MITPLAKTAPAPRYLYVRTFGCQMNEYDSQRALRLLCAVGYRPTSDIADADVIFLNTCSVRDKAEQKVYSFLGRLRRLKAHRPWLKIVVAGCVAQQLGDGLLKRFEHVDLVVGTRGIGSIASLLEEVERSKRRVAHLPAEELQGFTTDKCRTVGTGDVVAQVTIMQGCNNFCTYCIVPHVRGRERSRAPDDILREIDFLASRGAREVLLLGQNVNSYGRGLPDPISFPDLLRRIGKETSIRRVRFTTSHPKDLTEDLIECFAGLPFLCKHLHLPFQSGSDGILKLMHRGYTARQYLEKIARLREVCPEIALSTDVIVGFPAESEEDYLQTLRLIEEVRFDSLFSFRYSDRPLTRAAGFPDKVPMDVKVRRLARLQSIQADITLQKNLAETGTVREVLVEGPSKASNGQMTGRTQQNRIINFQCPVDLTGKIVPVRIVAAYSHSLKGELLSQPGKES

SEQ ID NO: 4219 - protein, 476 aa, Desulfovibrio vulgaris DP4
MPRPDRHRSTVPRNTLRASAQADTIPPMHDRTFHIETFGCQMNVNDSDWLARALMERGFSPAPFGEARLTIVNTCSVRDKPEQKVYSLLGRIRQATGKKPDAFVAVGGCVAQQIGSGFFSRFPQVRLVFGTDGLAMAPQALDRLVEEPDLKLSLLDFSEDYPERDAVLGQGAVPASVFVNIMQGCDNFCAYCIVPYTRGRQKSRATGTILDECRALLDRGAREITLLGQNVNSFGQDSHGDGTTFAQLLHKVAALPGLERLRFVTPHPKDIAPEVVEAFGTLPNLCPRLHLPLQAGSDRILKLMGRRYDMARYLRIVDDLRAARPDIVLSSDIIVGFPGETEEDFMETMGALETVGYAASYSFCYSDRPGTRAEMLPDKLSREVKLERLERLQTLQNRLTERCLQDMVGKKVEVLLEGMSRKPGDEGDSWQGRDPYGNLVNVALPQGSDVRGRFLPVVVAQAKKHSLLAEQAGAPW

SEQ ID NO: 4220 - protein, 440 aa, Geobacter uraniumreducens Rf4
MTREKLLYLETFGCQMNVSDSEKIAALLKGIGYFPTQDSSQADLVILNTCSVRAKAEEKVYNHLVQYKGLKRKKPGIILGVGGCVAQQEGERLLANVPHLDIVFGTHNLHLLPELVRAAEKGERLAEVGFIDNETRLDLFPVDERTDGVSRFVTVMQGCENFCSYCIVPYVRGREISRRSADILGEVRGMAGNGVKEVTLLGQNVNSYGLKSSGEMSFIALLREVSLIPGIERIRFTTSHPKDFSQPLIDCFAEIPKLCRHIHLPAQSGSNAVLAAMNRGYTREEYLGSIARLKAACPSIQITGDIIVGFPGETEEDFQATLSLMEEVRYTDVFSFIYSKRPETKAAGYADEVGQDEKQGRLSRLLDLQRRITLETNKSFVGTVQQVLIEGESRRGGQFYGRTSGNRVVNLAADVSLVGSIVNVMITRGDQNSLQGELCR

SEQ ID NO: 4221 - protein, 466 aa, Candidatus Desulfococcus oleovorans Hxd3
MKRFYIHTIGCQMNVYDSSQLSAILTAMGHRSVNAPEQADLVFVNTCTIRAKAKQKATSFVGRLAAMKRARPDMIVGVGGCLAQEEGRQLLDAFPCVDIVFGTHALGRLPGHIQAVAHQGDRIVDVEMTAAIDESVHALQGPDSSGVTGFITIMRGCDNFCTYCVVPYVRGRETSRAPEHILDEIRARVAGGLREITLLGQNVNSYGQKEGLCSFADLLARVNEIDGLHRIRFTTSHPKDLSPELAAAFTSLDKLCSHVHLPAQSGSDAVLKRMNRRYTRQAYLEKLHWLREAQPGMALSTDIIVGFPGETEQDFLQTLDLIEKVRYDSIFAFMYSDRPLAPARAFDGKVDEAEKQQRIYALLELQNRITAEKNRALEGRVEQVLVEGKSKSSGRNDITADTVQWTGRTTCNRVANFTVPRELASGNAVGPGAMVRVEIMSGLAHSLSGIAVGVEKPGAGGDAHAA

SEQ ID NO: 4222 - protein, 437 aa, Sulfurihydrogenibium YO3AOP1
MKFYIKTFGCQMNVNDSEKMAGILQTLGYTPTENWEEADVILVNTCSVREKPDQKVLSALGEFKKVKKHNPNAVIGVCGCLAQRAGYEIYQKAPFIDIVFGTTNIHHLPNLLEEAKSGNKAIEILEEIDENENLLDQFPTVRENKYTAFVTVIRGCDKKCTYCIVPTTRGRERSRRIGDILREVQYLVEDGVKEIHLIGQNVTAYGKDFGDVKFWELLKAVAEVDGVERIRFTTGHPRDLDEDTIKVMADLPQICEALHLPIQAGSDRILQAMDRGYTQKEYLQKIELLKKYIPNIALSTDIIVGFPGETYEDYLETVKVIKEVEYDQVFAFKYSPRPGTPAADLPMTESPEELSKRLNDLINLQKDITFKKNLEYQDKIVEILVEEINQENKLVGRTRTNKLVYAEGSPEYLGKLVNVKIEKVNRFSLEGSIIGGD

SEQ ID NO: 4223 - protein, 441 aa, Geobacter bemidjiensis Bem
MNQAKKLYLETFGCQMNVSDSEKIVTLMKGMGYQQTQDPVDADLVLLNTCSIRATAEQRVYGHLGKFKSIKKTKPGLIIGVGGCVAQQEGEKLLKKAPFVNLVFGTHNLHLLQGMVAAAEEGKRSSQTDFLDDEKRFDLFPHSEAEGGVTRFVTVMQGCDNFCAYCIVPHVRGREISRSAAKVVEEVRALADSGVTEVTLLGQNVNSYCSKQPGEPDFPDLLRLVAQVDGIERIRFTTSHPKDMSPRLIECFADLPKLAPHIHLPAQSGSDRVLERMNRGYTAQQYLAKVAALKEACPAIQFTGDMIVGFPGEDEAAFQDTMALMEQVQYADLFSFIYSARPGTKAAEYADDATRAEKQGRLERLQAAQKKTTLARNRSLEGTVQKVLVEGLSSTGDSLFGRTGGNRGTVMAGDPSLAGRVLDVKIVEGLQTLLKGEIVHD

SEQ ID NO: 4224 - protein, 478 aa, Desulfovibrio vulgaris  Miyazaki F
MSDRTFHILTFGCQMNVNDSDWLARALVARGFTEAPLGKARVNIVNTCSVRDKPEQKVYSVLGRIRQATRKLPDAFAVVGGCVAQQIGSGFFTRFPQVRLVFGGDGSSMAPQAIERLCAEPGLRLSLLDFSEEYPERDAQLDAGPVPPSAFVNIMQGCDNFCAYCIVPYTRGRQKSRAADAVVRECAELVERGAKEITLLGQNVNSYGQDAEAARQATVAGDGNAVTFAELLHRVAALPGLARLRFVTPHPKDIAPEVIDAFGTLDNLCPRLHLPMQSGSDRILKAMGRKYDMARYMDIVHRLKAARPDIQLSTDIIVGFPGETEQDFEDTLSAMRAVGFAASFSFCYSDRPGTRAEMLPGKLDAAEKAARLARLQEWQNDYTEQCLRNMVGLHTMVLLDGMSRKPGMATPESHEGVHDGATGTPGGESWQGRDPYGQAVNVVMPPRTEGGPEGWLGRIVPVTIVEAKKHSLRGVLRA

SEQ ID NO: 4225 - protein, 454 aa, Desulfovibrio desulfuricans ATCC 27774
MIEKSYHIITFGCQMNVHDSQWLGRALTARGFVEASLEDAQVVVVNTCSVREKPEQKVMSALGRIRHVTGGNPDVLVGVAGCVAQQLGEGFFSKESQVRLVAGSDGISGAPAAIERLLEEPTLHLSLLDFTSHYIEREAGPGTSGSSSGPVAFVNIMQGCDNFCAYCIVPFTRGRQKSRSAAAILDECRAVLERGAREITLLGQNVNAFGQDKSGDGTSFAQLLRQVAGLPGLERLRYVTPHPKDMGPEDVAAFAELPQLCPRLHLPLQAGSDVVLRSMRRRYDSAAFLRLVDDLRAARPDLALSTDLIVAFPGETEEDFQDTLAMMRACNFMSSFSFIYSDRPGARAALFPGKIAPDVAQDRLRRLQALQDDLGARWLAARVENRDKTTLLMEGPSPKPGESAEPSWQGRDPYGVPVHVPLPAGADHTGFLVQTVITEAKKHSLLAVRTGEPW

SEQ ID NO: 4226 - protein, 444 aa, Desulfomicrobium baculatum DSM 4028
MRFHILTFGCQMNVADADWLTQSLVSRGWTEAGESDAQVFVVTTCSVREKPEQKVYSLLGRLKSYADRSPDVFVAVGGCVAQQIGEEFWNRFPFVRLVFGTDGTAMVPQALERLANDPALRISLLDFLDHYPEREQPEGGTVQAQAFVNIMQGCDNFCAYCIVPFTRGRQKSRSSDAVVAECEALVRRGARELTLLGQNVNSYGQDKHGDGTSFASLLERISAIPGLMRLKFTTSHPKDIAPEVVTAFGKLPNLCPQLHLPVQSGSDAVLKAMGRKYTRARYLDTIRELRRVCPQITLTTDIIVGFPGETLQDFEDTLELMREVRYESSFSFKYSDRPGVRAEKMDFKVPEEEKSRRLAVLQEMQDRITVEELAAQVGSMAEVLVEGPSKMQDSEYIFWRGRDGGGRIVNFSSPIPCLTGRMVRVRIVDAKKHSLVGEIRGEPW

SEQ ID NO: 4227 - protein, 441 aa, Geobacter M21
MNQAKKLYLETFGCQMNVSDSEKIVTLMKGMGYQQTQDPVDADLVLLNTCSIRATAEQRVYGHLGKFKSIKKGKPGLIIGVGGCVAQQEGEKLLKKAPFVNLVFGTHNLHLLQGMVAAAEQGKRSSQTDFLDDEKRFDLFPHAEAEGGVTRFVTVMQGCDNFCAYCIVPHVRGREISRSAVKVVEEVRALAGGGVTEVTLLGQNVNSYCSKQPGEPDFPDLLRLVAQVDGIERIRFTTSHPKDMSPRLIECFADLPKLAPHIHLPAQSGSDRVLERMNRGYTAQQYLAKVAALKEACPAIQFTGDMIVGFPGEDEAAFQETMALMEEVRYADLFSFIYSARPGTKAAEYADDATRAEKQGRLERLQAAQKKTTLARNRSLEGTVQKVLVEGLSSTGDSLFGRTGGNRGTVMAGDPSLAGRVLDVKIVEGLQTLLKGEIVHD

SEQ ID NO: 4228 - protein, 445 aa, Desulfohalobium retbaense DSM 5692
MRFHIITHGCQMNVCDSDWLHRALVDLGGEPADEESAEVFVVNTCSVREKPEQKVYSLLGRLQGYWQRNPNVFVAVGGCVAQQVGTRFWKRFPHVRLVFGTDGIAMVPQAVDRLRSDPQLRLSLLDFEEHYPEREQLWPEAEVPAQAFVNIMQGCDNYCAYCIVPYTRGRQKSRSSAAVLQECRELARRGAREITLLGQNVNSYGQDANGDGTSFAALLEQVCAIPGIEQVRFTTSHPKDIAPEVIAAFGRLPELSPHLHLPLQSGSDRILKAMRRRYTRQRYLDIVTGLRQARPEITLTTDLIVGFPGETEADFEQTLEMMREVGFASSFSFKYSDRPGVAAEQMEDKVPEEIKSHRLQRLQSLQEELTGEALQAEVGRHVTVLLREPGRQDGGGVIWRGRDPGGRVVNCRTELDSALIGSYVGVRVTEAKKHSLFGEVETGPW

SEQ ID NO: 4229 - protein, 121 aa, Brucella suis 1330
MATVTVTIDGKAYRMACDEGQEEHLTGLADRFDQYVAHLKNSFGEIGDLRLTVMAGIMVMDELAEMQKRITGLENEAETLRRSRDEALSRADSNDAALTGMLSDVASRIEQVASRIAPRNG

SEQ ID NO: 4230 - protein, 127 aa, Nitrobacter winogradskyi Nb-255
MSHVNVTINSRQYRMACEDGQEDRLLKLAGDLEGRIGQLRGKFGEIGDQRLEVMAALVTSDELMDAQQRIRALEEELKALRDVRAAAAERARATQTAVVAALNMAAHRIEKTTQVLNRTVGGGIAIG

SEQ ID NO: 4231 - protein, 136 aa, Rhodopseudomonas palustris HaA2
MNPKDAAASANHVSVTINGRQYRMACEPGQEPQLLGLADNLESRIQSLRGRFGEIGDARLTVMAALMMADELLDVHGRLATLQQEVEVLREDRTQALDRTVTTNRAVAAALNSAAERIERTTQVLNRTIGGGIAIG

SEQ ID NO: 4232 - protein, 127 aa, Rhodopseudomonas palustris BisB18
MSEATSHVNVTINGRQYRMACEEGQEERLIRLADDLAARIVHLREKFGEIGDARLIVMAALMVSDELLDTQSRVTALEQERDALRQGGAAAKVVETAVVAALNSAAERIEKTTQVLNRTIGGGIAIG

SEQ ID NO: 4233 - protein, 136 aa, Rhodopseudomonas palustris BisB5
MNPKDAAASANHVSVTINGRQYRMACEPGQEPQLLGLADNLESRIQSLRGRFGEIGDARLTVMAALMMADELLDAHSRLAALQQEVDTLRDDRSQSIDRTVTTNRAVAAALNSAAERIERTTQVLNRTIGGGIAIG

SEQ ID NO: 4234 - protein, 127 aa, Nitrobacter hamburgensis X14
MSYVNVTINGRQYRMACEDGQEDRLLKLAGDLESRIGELRGKFGEIGDQRLEVMAALTASDELMDAHQRIRALEDELNALGDVRAAAGEHARATQTAVAAALNMAAQRIEKTTQTLNRTVGGGIAMG

SEQ ID NO: 4235 - protein, 119 aa, Mesorhizobium BNC1
MAQVTVTIDGKAYRMACEEGQEEHLVDLAQRFDRYVAHLKDSFGEIGDQRVTVMAGIMVMDELSELQRRMRGLESEIATLRKTRDDALLKADQNDAALTGALAQIAERIEAVAAKLAGS

SEQ ID NO: 4236 - protein, 141 aa, Maricaulis maris MCS10
MSRVTVKLNGRDFTIGCEEGQEAYLRELAGSLDKRVSEISGQVGQIGDLRLLLMASLILVDDLKESDRKIAELEGQVQRLRHENHGAASLQAEARGQLTEHLARLADRMENFAATLEADDADPQGGDRTSAPDASLAEAGA

SEQ ID NO: 4237 - protein, 127 aa, Bartonella bacilliformis KC583
METISVTIDGKVYRMACDKGQEDYLTKLAAQLDQYITHLKNNFGEIGDHRLSVMAGIMILDEREEIKQEYQKLQESYATLLQQSQEQDHHIIQIIQETTKRIEKLTQELRKDAHPLNLQQESEPTDR

SEQ ID NO: 4238 - protein, 127 aa, Bradyrhizobium BTAi1
MSHINVTINGRQYRMACEEGQELRLLKLAESLESRITNLRGKFGEIGDARLTVMAALTVCDELIDANQRVQMLEQELEGLRNVRNQSADRARATQVAVAKALNAAAERIERTTQVLNRTIGGGVAIG

SEQ ID NO: 4239 - protein, 121 aa, Brucella ovis; identical to SEQ ID NO: 4229

SEQ ID NO: 4240 - protein, 125 aa, Sinorhizobium medicae WSM419
MAQVTVTIDGKAYRMACEEGQEDHLSDLATRFDQYVGHLKAQFGEIGDLRLTVMAGIMVMDELSEVNRRLKSIEAEVDDLKRGRDTALSDQTRSEEALAFALGEVTAQIQDIAAKLNGRPIPPAN

SEQ ID NO: 4241 - protein, 107 aa, Ochrobactrum anthropi ATCC 49188
MACDEGQEEHLSGLADRFDQYVTHLKTSFGEIGDLRLTVMAGIMVMDEMAEMQKRINGLESEVETLRRARDEALGRADSNDAALTGMLSDVASRIEQVASRIAPRNS

SEQ ID NO: 4242 - protein, 119 aa, Parvibaculum lavamentivorans DS-1
MGQVKVSINDRSYSVACGDGEEAHVRELASHINRHVVSLAQEVGQVGDARLLLMAGLLVADELSDALQKTKLLEQEIESLSGTRASAQERTREAEESLAEVLDTAARRIEDLAKRIEAA

SEQ ID NO: 4243 - protein, 123 aa, Methylobacterium extorquens PA1
MPHVNVTIAGKSYRMACGPGEEDHLAALAKSFDDRVTEMRGTFGEIGDMRLHVMASLTLADELLEARRRIADLEQHAAQGAADHARLASGVGIAAERIDRLARALSGQPGGAPGGKGEAERGG

SEQ ID NO: 4244 - protein, 123 aa, Methylobacterium radiotolerans JCM 2831
MPQINVTIDGRSYRMACGEGEEAHLTGLAATLDGRIAEMRKSFGEIGDMRLQVMAALTIADELAELRSRIATLEGNVAELRAAAETAERGRTEDAERAAFGIGRAAEHIGRLADALGASAPRA

SEQ ID NO: 4245 - protein, 146 aa, Beijerinckia indica ATCC 9039
MAQVSVTIAGRVYRIACGEGEETHLRGLARQVDDKIDQLRGTFGEIGDQRLTVMAAITLADELLEAQRKLADLAAEHALAEARVAAQTRGEAEWTDHLAHSLNGLAERIERVATKLNAAERPDGAATNEALPRASTTSPEAVRQPG

SEQ ID NO: 4246 - protein, 123 aa, Methylobacterium populi BJ001
MPHVNVTIAGKSYRMACGPGEEDHLAALAKSFDDRVTEMRGTFGEIGDMRLHVMASLTLADELHEARRRIAELERNAAHGAAEQARLAGGVGIAAERIDRLARALSGQPVGSSSGKGEAERGG

SEQ ID NO: 4247 - protein, 136 aa, Rhodopseudomonas palustris TIE 1
MSSSDSAGSANHVSVTINGRQYRMACEPGQEPQLLGLAENLETRIQSLRGRFGEIGDARLTVMAALMMADELLDAHGRIASLQQEVDALRNDRAAALDRTVSTNRAVAAALNSAAERIERTTQVLNRTIGGGIAIG

SEQ ID NO: 4248 - protein, 127 aa, Methylobacterium sp. 4-46
MPQVTVSIAGKTYRMACGEGEERHLEELARGFDARIGEMRKAFGEIGDMRLHVMAALMVSDELAETRRRVEALERETAALREAAAAAGSEREAVEGRIAEGIGRAAERIEAAVRRLVPGPQPGAAEP

SEQ ID NO: 4249 - protein, 125 aa, Rhizobium leguminosarum bv  trifolii WSM2304
MAQVTVTIDGKAYRMACEEGQEDHLTDLATRFDRYVGHLKGQFGEIGDLRITVMAGIMIMDEIAELTRRVTGLESELESLRGNRDTVLAATARTEENLAAALSEVSSRIRGITDKLNGRPAPELN

SEQ ID NO: 4250 - protein, 124 aa, Methylocella silvestris BL2
MAQVAMQIAGRVYRVACDEGEEPHLEGLARLVDGKIAGMRDKFGEMGDQRLTIMAAVTLADELHESQRRVSELEARLAEVQENAADALSGREAWIDRVTEAVGEASARIERAAQDMSGASRGED

SEQ ID NO: 4251 - protein, 123 aa, Methylobacterium chloromethanicum CM4
MPHVNVTIAGKSYRMACGPGEEDHLAALAKSFDDRVTEMRGTFGEIGDMRLHVMASLTLADELLEARRRIADLEQHAAQGAADQARLASGVGIAAERIDRLARALSGQPGGAPGGKGEAERGG

SEQ ID NO: 4252 - protein, 123 aa, Methylobacterium nodulans ORS 2060
MPQVTVSIAGKTYRMACGEGEEGHLEELARGFDARIGEMRKAFGEIGDMRLHVMAALTVSDELAEMRRRVEALERETASLREAAAAAAAEREAAEGRIAEGIGRAAERIEAAVRRLAPGPAEA

SEQ ID NO: 4253 - protein, 121 aa, Agrobacterium vitis S4
MAQVTVTIDGKAYRMACEEGQENHLTDLASQFDRYVSHLKSQFGEIGDLRVTVMAGIMVMDELSELKRRIAAAEATSAGAIGREDDILAAIMELTERLNGLTRKLTEKPQAAASPTENQHH

SEQ ID NO: 4254 - protein, 125 aa, Rhizobium leguminosarum bv  trifolii WSM1325
MAQVTVTIDGKAYRMACEEGQEDHLTDLATRFDRYVGHLKDQFGEIGDLRITVMAGIMITDEIAELTRRVAGLESELETLRGNRDTVLAATARTEENLAAALSEVSSRIRGITDKLNGRSAPELN

SEQ ID NO: 4255 - protein, 648 aa, Sphingopyxis alaskensis RB2256
MPDLIGAFSTLGFEAHPLGNGADATDVGAETSRELLRAVAVSGFAMMNIMLLSVSIWSGAAGATRDLFHWLSAAIALPTITYAGRPFFRSAWRALRHGGTNMDVPISIGVALVCAMSLYETASSGPHAYFDGAVMLLFFLLTGRWLDSVMRDRARGGVAALLRNMGTGAMVIGVDGDSRWVDATALEPGMEMLVAAGERLAADGVVVAGESRFDLSLLTGESAPVAAQVDDRVHAGTLNLDAPIRVRVTAAGADTAIADIARLMGEAAQGKSRHVRIADRAARFYAPAVHALALLAFAGWMIAGAGWHQSLLVAAAVLIITCPCALGLAVPAAQIVAAGELMRAGVLVKDGSALERLAEVDLALVDKTGTLTLGRPEAMGLDRLDAEVRSLTLALARASRHPLSAALTRELQAGGVRAARVEAIRETPGVGIEARWRGRVVTLGRPQGSDLGNALATELAVDGRPVATITFADPLRPDAAEAVDALERDGVAAMILSGDRAEAVAPVARDLRLTAQTGMSPQDKLAAIARQAARGRKVLMIGDGLNDGPALAAGHASMAPGSASDVGKNAADCIFLGDRMMPVVQALRMARRTQAVVRQNFLLAIGYNVVAVPLAFMGLVTPLVAAIAMSGSSLIVVGNALRLKRAIR

SEQ ID NO: 4256 - protein, 809 aa, Rhodospirillum rubrum ATCC 11170
MDGLSETRPADSADGGTACRHCGLPVPANGPAGAEFCCVGCRGAYGLIRDSGLDQYYQRRCLDPDTPPPRPEDLGPIDFSAHILRQPTADGGEEAVLHLMVEGIHCAACVWLIETLLGRQPGVSQARLNMTTRRLTLRFRPAKGETAADLGANTLLAPVARVGYRLVPYDPALLDQETRRTEKALVQAMAVAGFASANVMLLSVSVWAGVDMGPRTRDLMHWISALIAVPAVIYAVRPFAHSAFAALRAGRASMDMPITLAVTLATGVSLWETANGGAHAYFDAAVTLLFFLLIGRFLDHRARGRARSTAEHLLALGATAVTVLRDDGTLEHRPPRQVTPGATVLVATGERIGVDGTVSQGCSDVDTSLLTGETLPEPVHPGSAVFAGTLNLTGPLRLSAGAVGEGTLLAEIVRMMEVAEQGRARYVAIADRVARAYVPVVHALALASFLGWLTLMGAPWQQALMVAAAVLIVTCPCALALAVPVVQVVATGRLLRQGILVKSPTALERLTGVDHVVFDKTGTLTLGRPDLRPADPARADAWSAEDLAAAAQLAAASHHPLARALALAAPEAKPAALAREWPGQGMSLPLAEGEARLGRAVFCGLEDTPAEDGGGPELWFTRPGHAPVRFGFIDRPRPDAAEVVAALRAQGIGVELLSGDRPAVAAALAARIGLNDWRAGCSPADKVARLAELAAAGKTVLMVGDGLNDAPALAAAHVSLSPASAVDVTQTAADVVFQGERLTPVIEALGVARRADRLVRQNFVLSFAYNIVTVPLAICGLVTPLIAAVAMSSSSVVVILNALRLSRRR

SEQ ID NO: 4257 - protein, 737 aa, Rhodobacter sphaeroides 2 4 1
MSLAERIDLPSSEAPGGASACPACLAAPSAERLAAMAGPAGGRLVLSLPTAHCAACMTTVEGGLEKLAGVRSARVNLTLRRVSVDAEPEVTAAQLVEALSRLGYEAHELDAGMLSATETDRQGRDLLMRLGVAGFSMMNVMLLSVAVWSGAEAATRDLFHWISAAIALPTVVFAGQPFFRNAWTALRAGRLGMDVPISLAIILASSISLFETFHSGHHAYFDAAVMLTFFLLAGRYLDHRTRAVARSAAEELAALEVPRAMLLRDGEEVTVPIAELAAGDLVRVRPGGRMPVDGVVAEGFSELDRSLLTGESLPVPAGPETVVSAGEVNLTGPLTVRVTAAGRDSSLHRMADLVAVAESAKTRYTSLAERASRLYSPLVHILSFTAFGVWMWITKGDVRTSINISAAVLIITCPCALGLAVPAVVTAASGRLFRKGLLIKDGTALERLAEVDTVVFDKTGTLTLGTPEPTNLATLPPADLTLAAALAASSAHPLAMALALAARGQGVQPAAVTDLREVPGFGIEGRLEGRTVRLGRAEWVGAAPEPVTATYLSTGAATRAITFSDRLRPGAEEAVRALAGQGKRILLLSGDTEGAVAELAGRLGIGEWRSGQLPAEKAQRVADLTAEGRRVLMVGDGLNDTAALAAAHVSISPASALDAARVASDIVLLGKDMAPIADAARISVKATKRIRENFAISAAYNVVAVPLALVGLATPLAAALAMSLSSISVSLNALRVK

SEQ ID NO: 4258 - protein, 737 aa, Rhodobacter sphaeroides ATCC 17029
MSLAERIDLPSSEAPGGASACPACLAAPSAERLAAMAGPAGGRLVLSLPTAHCAACMTTVEGGLEKIAGVRSARVNLTLRRVSVDAEPEVTAAQLVEALSRLGYEAHELDAGMLSATETDRQGRDLLMRLGVAGFSMMNVMLLSVAVWSGAEAATRDLFHWISAAIALPTVVFAGQPFFRNAWTALRAGRLGMDVPISLAIILASSISLFETFHSGHHAYFDAAVMLTFFLLAGRYLDHRTRAVARSAAEELAALEVPRATLLRDGEEVTVPISELAAGDLVRVRPGGRMPVDGVVAEGYSELDRSLLTGESLPVPAGPETVVSAGEVNLTGPLTVRVTAAGRDSSLHRMADLVAVAESAKTRYTSLAERASRLYSPLVHILSFTAFGVWMWITKGDVRTSINISAAVLIITCPCALGLAVPAVVTAASGRLFRKGLLIKDGTALERLAEVDTVVFDKTGTLTLGTPEPTNLATLPPADLALAAALAASSAHPLAVALALAARGQGVRPAAVTDLREVPGFGIEGRLEGRTVRLGRAEWVGAAPEPVTATYLSTGAATRAITFSDRLRPGAEEAVRALAGQGKRILLLSGDTEGAVAELAGRLGIGEWRSGQLPAEKAQRVADLTAEGRRVLMVGDGLNDTAALAAAHVSISPASALDAARVASDIVLLGKDMAPIADAARISVKATKRIRENFAISAAYNVVAVPLALVGLATPLAAALAMSLSSISVSLNALRVK

SEQ ID NO: 4259 - protein, 757 aa, Sinorhizobium medicae WSM419
MSCCAVGAATMVAEGRQASPASEELWLASRALGGGLRQTELSVPGAYCGACIATIEGALRTKPEVERARVNLSSRRVSIVWKEEVGGRRTDPCDFLHAIAERGYQTHLFSPGGEEGDDLLKQLILAVAVSGFAATNIMLLSVSVWSGADAATRDLFHWISALIAGPALIYAGRFFYKSAWNAVRHGRTNMDVPIALAVSLSYGMSLHETIGHGEHAWFDASVTLLFFLLIGRTLDHMMRGRARTAISGLARLSPRGATVVHPDGSREYRAVDEIKPGERLIVAAGERIPVDGRVVYGTSDIDRSVVNGESSPAVVATGDTVQAGTLNLTGPLTLEATAAARDSFIAEIIGMMEAAEGGRARYRRIADRAARFYSPAVHLLALLTFVGWMLVEGDVRHALLIAVAVLIITCPCALGLAVPVVQVVAAGRLFQGGVMVKDGSAMERLAEIDMVLLDKTGTLTIGRPRLVNAHEIAPCRLAKAAAIALHSRHPIAVAIQNSARAVSPLAGGIREIPGAGIEVKTEDGVYRLGSRNFAVGNPGSDGGQSQAILSLDFRELACFRFEDRPRPASRESIEALARLDIATGILSGDREPVVAALAGSLGISNWHGDLSPREKVKACDAAAEAGHKALVVGDGINDAPVLRAAHVSMAPATAADVGRQAADFVFMHEPLSAVPFAIETSRHAGRLIRQNFALAIGYNVIAVPIAILGYATPLIAAVAMSTSSLVVVFNALRLKRTLAAGKVAKAAALIQSGAVTS

SEQ ID NO: 4260 - protein, 752 aa, Ochrobactrum anthropi ATCC 49188
MSCCVENAQIATVVQAVSVDEMQVASRALGDGFRQLDLSVPGVHCGLCIKNIEETLGKIAGVVYVRVNLTARRVTVRWKDGETPPDVVDPLRRLGYEAHIFDMAQDKDPTFTRLLIALGVAAFASSNVMLLSVAVWSGADAATRDMFHWISGLIALPTLIYSGRIFYVSAWNALRARRVNMDVPIALAITLAFGMSVYETMNHGQHAYFDASVTLLFFLLIGRTLDYMMRARARSAVRGLAQLGSRGAVVIGENDERNYLPVNEIRPGMRIILAAGERVPVDAKVEEGRSELDCAIASGESDAVPVGPGSDIRAGTLNLSTPLVIRATAEAKDSFLAEMVRLMDVAEGGRAYYRRLADRASELYVPMVHTIAFAAFVGWMIYTGGDWYRSIYIAICTLIITCPCALALAVPIVQVVAARRLFENGIMIKDGSAMERMAEIDTAIFDKTGTLTLGQPRLINADAIDPHNLEIAAELSLYSRHPLSRALALFSGAKPMTAFTRIEEVPGAGIEAELNGSIYRLGKRDWADGTAVMPHADGPETCLSIDGKLVQTFRFEDQPREDAAGAIATLKRNGLKLGIISGDRLPAVERLAGYLGVDNFQAQVLPADKSELVQKLSREGSKVLMVGDGLNDAPALVAAHVSMAPATAADIGRNAADFVFLRESLSAVPLAFAVSKEAGRLISQNFALSIGYNIIAVPIAIFGYVTPLVAALSMSLSSIVVVSNALRLRAGKQKQQTQKTIAPVAIIKEAHK

SEQ ID NO: 4261 - protein, 743 aa, Xanthobacter autotrophicus Py2
MAEAIDYSVFVARSEDGLAQMSLAVDGIDCAACIAEIEDGVKALPGVVRARLNYSTHRLTVAWREETSPDRVVSQLEALGYRAHPFAGRAEESEARHARWLLRCLGVAGFAAMNIMLLSVSVWSGNVTDITPETRDFFHWVSALIALPAAAYAGQPFFQSAFRAVRSGRLNMDVPITIGVTLALGMSVLETALSQPHAYFDSAIMLLFFLLAGRYLDHEARRRTRATAGNIAALRGEMAHRLGTDGVPVLVPVQALQPGDTILVAPGERVAADGVIASGQSSIDESLVTGETLPRALKAGDAVYAGSLNGEGALHLTVTAGGENTLVDDVQRLLDGALAEKGAYVRLADRVARLYAPMVHLTALVSAIGWLLAGADLHHAVMIAVAVLIITCPCALALAVPAVQVTATGRLFRAGLLINAGDMLERLAAVDTVVFDKTGTLTLPEPALALPRGADRALVGLAGRLALSSRHPLARALAPRADGPAIEGVTEVSGQGVEALVDGAVVRLGSLAFCGAAPPADLPAGASLIALRRGGQTLVMGVEQALRPDAPEVVAALKARGLDVRILSGDREAAVTPVAQALGIAHWDAGLKPADKIAALDHLKAEGRRVLMVGDGLNDAPALAAATVSLSPATGAAVTQAHADAVFLGRRLAPVMAAVDGAGVAARLMRQNLAIAVLYNVIAVPLAIAGFVTPLVAALAMSGSSILVTVNALRAARPGRKDEATDAAAPAGGDARTLEEAAA

SEQ ID NO: 4262 - protein, 729 aa, Dinoroseobacter shibae DFL 12
MSDLSAHSLGPSANSACPACAAAPLAEQLSKRPVRGGIVLSLPGIHCASCISGVERLLDATPGVVGARVNLTRKRVLIDAEEGITPEALAQLLTDKGFEAYELDPGQLGNAEADRPARDLLMRLAVSGFAMMNIMLLSVAVWSGAEAATRDMFHWISAAIAIPTIGFCAQPFFSNSWRALKAGRLNMDVPISLAILLAVGMSLYETANSGAHAYFDAAVSLTFFLLAGRYLDFRTRASARSAAQELAALEVPRAIKLVGGTEVKTVVADLAVGDLIRVTPGSRVPADGLVVDGVSELDRSLLTGESLPVHAAPDTPVSAGEMNLTGVLTLRVTAAGQDSSLHRMAELVAVAENARSKYTSLADKAAGLYAPGVHILAALTGLGWMLYSMDLRLSLNIASAVLIITCPCALGLAVPAVVTAASGRLFRRGLLIKSGTALERLAEVDEVVFDKTGTLTLGQPILENADRIAARDLAVARALAQGSAHPLARAIAATDAGGASAEVTELREVPGYGVEGRWQDQPVRLGRADWVGAAQGDVTATWLRIGQAAPVAFEFKDALRPGAAEAVAALQARGLKVSLLSGDAPGAVARVARELGITDYRAECRPEEKAAHVTARGEAGYKVLMVGDGLNDTAALAAAHASVSPASALDAARVASDIVLLGQDLSPLADMLQTARKSTKLIRENFTISTVYNVVAVPLAIAGLATPLIAALAMSVSSITVSLNALRVR

SEQ ID NO: 4263 - protein, 732 aa, Rhodopseudomonas palustris TIE 1
MLQTRDFSHYVKDVDGRIAHLDLAVEGVHCASCMAKIERGLQSIPDVTLARVNLTDRRLAVEWNKGSTLEPGQFIDRLAELGYKAYPYEPVRAEVEEAERTKFLLRCLGVAVFATMNVMMLSVPVWYGGDLSPEARDFFHWLSALVALPCAAYAGQPFFQSAFRALKAKSVNMDVPITIGITLALGMSLVETINHAEHAYFDAAVMLIAFLLAGRFLDQKMRQKTRAVAGNLAALKAETATKFVGPDEISEVPIAAVRAGDIVLLRPGERCAVDGTVIEGRSEIDQSLITGETLYVPAERGTQVYAGTLNISGTLRVRVAAAAEGTLLSEITRLLDHALQARSRYVRLADRASQLYAPVVHATALLTIIGWVLAGASWHDAIVIGIAVLIITCPCALGLAIPAVQTVASGAMFRAGVLLNAGDAIERAASVDTIVFDKTGTLTLPELDVVNAAGIPLEVFDLAGRLALASHHPVAAAVARAAHAKSPLPNVVEEPGRGVRTVFGGQELRLGSPAFCGADAEANQILSEDPEVSVVAFSRGEQRVVFAVRQLLRPDAAKTIDALTNRGIAVELLSGDREPAVRHAAAALGVSAWRASVTPAEKIAHIEALKKQGRIVMMVGDGMNDAPSLAAAHVSMSPISATHLSQATADLVFLGKELAPVLAAVDYSRKAMAVMRENLGLAIGYNVLAVPIAIAGYATPLIAALAMSGSSLLVMLNAMRARRVRRGAASWK

SEQ ID NO: 4264 - protein, 758 aa, Methylobacterium sp. 4-46
MCCTDAALAYVEAHAAWSAANTRSSLPRDYAAFLAEEPDGASRAVFAVEGVRCAACLGTIEGGIGLLPGVRAARLNVTDRRLSVTWAPGAPAEIGEVLAALTRLGYRGHPFDPHRRGDAVAARETERLIRALAVAGFASMNVMLLAVSVWAGNVSDMTPENRDLFHWIQALVALPAAAYAGRPFYEGALRGLRAGRITMDFPITLGVVLTLAMSVVETAMSAPHAYFDGAIMLLFFLLIGRVLDQVMRRRTLALAENLAALRAETAARVGADGAVRDVPVADLSPGDTVLVRPGERVPVDGVVAQGRSELDRSLVTGETAPVTAGPGDMVHAGSLNASGALTVRVTAATRGTLLDQVEALMRRALEAKSRALVLADRATRLYMPVVHAAALLTLAGWLAAGAGFHAALLTAVAVLIVTCPCALGLAIPAVQVVAAGALFREGVLLNSGEALERFAAIDTVAFDKTGTLTLPEPVLAGRYESEALALAARLALSSRHPMAAALATAVPEARALPDAEEAAGLGVRAVVEGRLVRLGAPRFCEAEAEAERALAQDPGSSAICLKDGDAPPVVFRVRQALRPDAERVLGSLRAEGYRVLILSGDRPEAVAAAAGALGVAEWEGGLAPQDKIRRIEALGAQGRRVLMVGDGLNDAPALAAAHASLSPVTAAHVSQAAADALFLGRDLAPVLAVLRIGRAARRLMLENLWVSAAYNVAAIPLAAAGLLTPLIAALAMSGSSVIVTLNALRARRTPRRPEIAQP

SEQ ID NO: 4265 - protein, 749 aa, Methylocella silvestris BL2
MTEALDLSAFVQRLEEGGCRIEFAVEGVKDAAAIHAIEHALRPLPGLTRARVNFSEQRLLVEWTDGLEPALIVERVRALGHRIYPFSPRLREEDFEAAQARWLLRCLAVAAFAAMNIMLLSISVWAGNVSDITPETRDFFHWVSALVVLPAAAFAGQPFFRSAIRALSRRSLNMDVPISLGVLLALAISVFETLRHAEHAYFDSAIMLLVFLLAGRYLDQAMRRKTRSYAANLSALRAPTASRIDADGTVALVPAAALRPGEIVLLRPGERAPVDGIIVEGRSEIDQSLVTGETAPVAVGAGHEVYAGSLNFGGALSIRVKTAGAGTFLDEIERLLDGAIQQKSAYVRLADRAARLYAPVVHSMAALTVIFWLVAGASVHDAIIAAIAVLIITCPCALALAVPAVQVVAAGALFRAKIILSAGDAIERFADVDMVVFDKTGTLTLPELGVEADDDAPSGLVERAARLALASHHPLAVALARLSREQTPVADAQELLGSGVRAMIDGAEARLGSPGFCGLEAEAARLRETHPGASLIAFRHGGQATIFRIRQKLRADAASVVAALRRRGLEIVILSGDAAPAVRSCAQALGVADWRADMRPGEKLAFLAELKKNGRKPLMVGDGMNDAPALAAAHASLSPITASGLAQAAADALFLGDLLAPVDAALDISRRAKSLMRQNLAFAVIYNMVAVPLAVAGLATPLIAAAAMSGSSIVVTLNSLRARGAARPVSPGAASAAARGASRLNEARP

SEQ ID NO: 4266 - protein, 787 aa, Agrobacterium vitis S4
MSCCAAGSEAALDLERSGALLPSSEEIRLASRDLGEGLTQVDFSVPGVYCGACITKIETALKRLPAVERARVNLSTRRVGVVWRTRVAEEGPFIDREAGPFTHDSGFDPAELARAIASTGYSCHLFTPQDLASDLLLKQLIRAVAVTGFAATNIMLLSVSVWSGADASTRDLFHWISALIAAPALIYGGRFFYQSAWTALRHRRTNMDVPIAIGISLSYFSSLWETIHHGEHAYFDATASLLFFLLIGRALDHMMRDRARSAISGLARLNPRGATVVGADGSREYRLVDDIKVGEHVAISAGERIALDGTVIAGTSDLDVSIVNGESAPQTVGPGDAVQAGTLSLTGSLTVKATAQARDSFLSEIIRLMEAAEGGKAHYRRIADRASQLYAPVVHLLALTSFIVWGLYDGDWKHALMVAIAVLIITCPCALGLAVPVVQVVAAGKLFQRGIMVKDGSAMERLAKVDAVAFDKTGTLTLGRPMPVDINKASPGMISIAAGLAAHSRHPLSQSLWRSASSNYAAGAIRNFSGVTEIPGSGVEADAAEGRYRLGNRRFALGSGEGEADGPALSEVILSLNGYSLGCFRFEDSLRPSAAEVIAGLQAEGMRVTILSGDRTPVVKALAARLGVDAAEAELSPSGKAKFCASADEAGQHLLMVGDGINDAPALSAAYVSMAPATAADVGRQAADFVFMHEGLDAVPFAINVSRRAGQLIRENFVLAIGYNVLAVPVALLGYATPLIAAVAMSTSSIIVVANALRLNGLGGFTRKADAHALQPASNRKPLGIAA

SEQ ID NO: 4267 - protein, 761 aa, Rhizobium leguminosarum bv  trifolii WSM1325
MTCCTMDAESVLALSTTSFSAEEVRLASQPLGEGLRQLDLSVPDVHCGGCISAIERALLTLPFVKTARVNLTARRVTCVYQEEIETHAADPSEILAAINSAGYRAHLFTPSAPENDKTRNQLLLAIGVSGFAAANIMLLSVSVWSGADAATRDMFHWISAMIAAPALVYAGRFFFKSAWNALRHGRTNMDVPISLAVSLSYAVSLWETVHHGEHAWFDASVSLLFFLLIGRTLDHIMREKARAAINGLARLAPRGALLINPDGSRRYIAVEEIAAGDEISIAAGERVPVDGIVVSGESDLDLSIVTGESSPVAVASDSEVSSGAMNLTGSLVLRATRIAKISLLSEIIGLMEAAEGGRARYRRIADRAATLYSPVVHLLALVSFLAWGFLGGDWKQAMLVAVAVLIITCPCALGLAVPVVQVVAAGELFRKGIMVKDGSALERLAETDTVAFDKTGTLTMGSSRLVRVDAMDESATAIAGGLAAHSRHPLSRALVRDTETAPISFDRVTEIPGGGLEARNGADIYRLGNAAFACGTSFVPRTADSPFSEVVLSKNGVDLARFFFDDTLHPGACEAIDRLDAAGLETLILSGDRQTVVDNTAHALGIDRALGSLTPKQKVEECQRLNGEGRRVLMVGDGINDAPALAAAHVSMAPATASDIGRQAADLVFFNDRLDAVPEAIAVARRSASLIRQNFALAIGYNVLAVPIAIAGLATPLIAAVAMSTSSIIVVTNALRLNALSKRPGMHTRGGIGRSAEVKAA

SEQ ID NO: 4268 - protein, 235 aa, Methanosarcina barkeri fusaro
MTHQKRLSIPRSWKAGKKGYKWVSTTRPGPHSQARSLPLGIIIRDILKLVDNSREGKRILSEGKVLVDGIPRKDLRFPVGLFDVITLPLVNETYRMFQDEKGRLALHKLNATNVNKLCRINNKTTLKGGKVQLNLNDGTNILGSNEYSTKDSLILSLPDKQIVKHLQFKVGNLAMVVGGQHSGEIGKITEIREVKSSRHNTVAISGETDFETIEDYVIVIGEDKPEIRLGGEVIE

SEQ ID NO: 4269 - protein, 241 aa, Methanospirillum hungatei JF-1
MGHHLKRVVSPKSWGIPRKTDKFVTKTSPGPHNKNALPIVVWARDQMGIVRNMKEAKHVLREREIIVNGRPVRHPDMGIGIFDIVSIPKSGKHYRILRDKKGRHVTIPIDEDAASSRLVKITNKTIVKGGRIQLNLRDGSNVLTDKQYKSGDSIVLSLKEGQKNEIIDHFPFQPGNMAMIIGGKHSGVVGRIIEHIPVPGSLPNRVILKDESSGESFETIDEYVVMVGRESPAIDRWGIEE

SEQ ID NO: 4270 - protein, 236 aa, Methanococcoides burtonii DSM 6242
MATHQKRISVPKSWQISKKSNKWITSTRPGPHNRLQSIPLAVILRDMLGVVDNRAEAKRVLSEGNVLVDGVARKDLRFPVGLMDIITIPLNNVEYRVMLDGKSRLVLNKLDGTGADKLCRIEGKTSIKEGKIQMRLNDGVNIIGSNNYNTKDSIILSVPDKKVVKHIKYEVGNLAMIVGGSHAGEVGSIKEINTVKSSKNNTVTISGEIEFETIEDYVFVIGESKPEIFIGGETVE

SEQ ID NO: 4271 - protein, 233 aa, Methanosaeta thermophila PT
MHRKRVTIPRSWLIPRKTSKWIATPRPGPHSAEESLPLMVVVRDLLKLADNAREVKRILHEGGVLVDGTVRRDARFPVGLFDVITVPALNKQYRMVKSTKGYFVLIEIQPDTPRKLVRVENKTTLKGNRMQLNLSDGSNIIAEGDVGTGDSLLISLPERSIEDIIKFEVGNLAMVTGGSHTGMTGRIKSVQIVRSSMPNRVTISTDDGDIETIIDYVFVIGRDAPVIELEAGI

SEQ ID NO: 4272 - protein, 251 aa, Thermofilum pendens Hrk 5
MGRKVKGSLRHLRRSVAPPFWPIKRKEYVWTVKPSPGPHSLLSSIPIGIVLRDVFGYAKTMKEARRILASRVIEVDGRVVTDYKFPVGLMDVLHIIPEEKYYRVVPDPARKLRFVEIKPEEAGYKLAQIRRKMTVKNGDLQFTLHDGRNVLIRKGSEAYSTAISYKTYDALLITIPRQSIVSHVPFEVGTLAIVVDGRNVGFMGRINAIQQVFKRSRALVELEDASGAKSRTILQYVLPVGKEKPLVTVTA

SEQ ID NO: 4273 - protein, 238 aa, Pyrobaculum islandicum DSM 4184
MVHLRRTTAPYWWPIPRKIGGVWVVRSSPGPHSLAYSLPLAIIIRDVLKYAKTMREARYIISRGYVKIDGVIRKDYKFPVGLMDVVEIVPTGEIYRVVPDEKKYYALIPISSEEATLKLLRVEGKTAVKGGKLQLHFHDGRNLIVSQDVGRHIKTFDTVLYDLQNKNIKMHIPFKLGAYAVVTRGGNVGFSGKLYEIVWTLKRRQSVVALKRNEEVRRTILDYIMITGSEAPVIKISP

SEQ ID NO: 4274 - protein, 239 aa, Methanocorpusculum labreanum Z
MTRTKRMTAPDAWQIARKESKYVVSTSSGPHDGSALPIGIWLRDHMQFALNTKEVRKILHDRQVLLNGHIVTDEHIGIDVFDIISFPKIDKHYMILVDEKGRHNEYEISADAAKLQLVKVANKTTIKGGKTQINLTSGANFIGEENCKGKDSLVIGIAGDDRFAVQQHFPYAVGNMAIIIGGQHTMKTGKLVEILVQESSLPNRVIIEDADGNKFETIEDYVYMIGTTESFLKTWGVDA

SEQ ID NO: 4275 - protein, 242 aa, Methanoculleus marisnigri JR1
MSKYLKRLVAPGSWHIPKKVQKFVMKTAPGPHNAGALPVGVWLREHIGLAQNASEVKKILHQRDVLVNGRACKDSRMGLGVFDIVSIPKLGKHYRIQLDVKGNLVAIEIPAESAKTRLCKIRNKTTVKGGKVQLNFAFGANVLADNTYKAKDSVVVTLGTDGEDRFRIVDHFPYAEGNVAMIVGGKHSGKVGRIVEIIRTASSVPNHVILTDDSAGERFETIEEYVFMVGRSAIAPELEASA

SEQ ID NO: 4276 - protein, 237 aa, Pyrobaculum calidifontis JCM 11548
MVHLRKSLAPYWWPIPRKAGGVWAVRPSTGPHSLEYSLPLAVVVRDVLRYAKTLREARYIISRGYIKVDGVVRKDYKFPIGLMDVVEIVPTGEIYRVVPDEAKYYDLKPIPSSEAALKPLRVEGKTAVSGGRIQLHFHDGRNLILPPDVGRQIKTFDTVVYDLENKAIKTHLPLRLGQLAVVTHGGNIGFVGQFFEVVWTLKRRQSVVALRKGEEVRRTILDYIMVIGTEAPVVKIS

SEQ ID NO: 4277 - protein, 244 aa, Methanococcus maripaludis C5
MAIKGPRKHLKRLAAPANWQLPRKVKAFTVRPSPGPHSMDKSLPLLLVVRDVLKYADNAREAKKIIQTGKILIDGLKRKEYKHPAGLMDVLSIPEMDENYLVLFDESGRISLKKTDKADAKLCKIVNKTVIKGGHIQLNLHDGRNQIVKVSDATKAEEDVYKTGDSVLVSIPEQSIVGHVAFGEGKLAYVTGGKHVGEFAKIVEVENRALYSDIVTLENKDGEKFKTVKPYVFIVGQDEPVISM

SEQ ID NO: 4278 - protein, 238 aa, Pyrobaculum arsenaticum DSM 13514
MVHLRRSLAPYWWPIPRKAGGVWVVKPSPGPHSFAYSLPLAIVIRDVLRYAKTLREARYIVSRGYIKVDGVVRKDYRFPVGLMDVIEIVPTGEVYRVVPDQDRYYNLLPIPSSEASLKLLRVEGKTTVNGGRLQLHFHDGRNLITSPDMGAKIKTFDTILYDLENKTIKTHIPMKLGVVAVVTHGSNVGFSGKLYEIVWTLKRRQSVVGLKKGEEVRRTILDYIMAVGEESPVIKITP

SEQ ID NO: 4279 - protein, 241 aa, Metallosphaera sedula DSM 5348
MTHITRLEAPWFLRASKKEYKWTVRASPGPHPLGKSIPLGLLLRDYLAFTSSLKESKKIISDGKVLVDGRVRRDYKYPVGLMDVIAIPHADLYLRIVPDRARLLKPVKISEEESKFKLVRLLNKTLVKGGLLQFNLEDGRNLLISKESTEMFKLPTLTTLKISIPNQEILGVYGFKENVYVMAVGGKNAGIIGQLKRIQTSPYKTRRYSIVVIRSPDGSEYETNLENAMVIGEEKPEVKVE

SEQ ID NO: 4280 - protein, 244 aa, Methanococcus vannielii SB
MAIKGPRKHLKRLAAPANWQLPRKERTFTVRPSPGPHSMDKSLPLLLIVRDTLKCADNAREAKKIIQMGKILIDGVKRKEYKHPVGLMDVLSIPELNENYLVLFDENGRISLKKTEKTGVKLCKIVNKTVIKGGHIQLNLHDGRNQIVKVANALKAEEDIYKTGDSVLVSLPEQAVVGHVEFNEGKLAYITGGKHVGEFAKVVEVEKRTLYSDIVTLENKDGEKFKTIKPYVFIVGQDEPVISM

SEQ ID NO: 4281 - protein, 244 aa, Methanococcus aeolicus Nankai-3
MANKGPRKHLKRLPAPKNWQISRKTNKYTTRPSAGPHAMGSSLPLLLVLRDLLGYADNAREAKKVIKMGKVLVDGVKRKDHRYPTGLMDVISLPDANESFLVVLDEKGRIKLNKIKDNTKKLCKIENKTVIKGGHIQLNLHDGRNQIVKLADATKAEEDIYKTGDCVILSIPEQSIVGHVQFGEGKLAYITGGKHVGDFAKIIGIEKKQLYPDIITLETENGEQFKTIRDYVFIVGDDKPVISM

SEQ ID NO: 4282 - protein, 244 aa, Methanococcus maripaludis C7
MAIKGPRKHLKRLAAPANWQLPRKVKAFTVRPSPGPHSMDKSLPLLLVVRDVLKYADNAREAKKIIQTGKILIDGLKRKEYKHPAGLMDVLSIPEMDENYLVLFDESGRISLKKTDKTDAKLCKIVNKTVIKGGHIQLNLHDGRNQIVKVSDATKAEEDVYKTGDSVLVSIPEQSIVGHVAFGEGKLAYVTGGKHVGEFAKIVEVENRALYSDIVTLENKDGEKFKTVKPYVFIVGQDEPVISM

SEQ ID NO: 4283 - protein, 241 aa, Candidatus Methanoregula boonei 6A8
MSDHLKRLNAPDSWHITKKTTKFVAKTAPGPHNANAMPVAVWLRDQQGLARTMKEVKQILKQKDVVINGRPVRDPKMGIGIFDVIALPRIGKYFRVLRDLKGRHKTVEIDAEAAQKRLCKIENKTIVPGGKVQLNLRYGANIIADNTYKSNDSVVISLKPEDRFKILEHYPFVAGNMATIIGGRHSGKVARIIEIIKTPGSVPNKVILEDEKTKERFDTITPYIYMIGKETVSKASWGLDQ

SEQ ID NO: 4284 - protein, 237 aa, Caldivirga maquilingensis IC-167
MTHLRRSTSPEWWPVERKGAPWSIKPSPGPHPANSSIPLAVLLRDVFHYAKTLREARLIIGKGYVKVDGKVRRDYKYPVGLMDVIELTPINEYYRIIPDPVNFLRPIRIDKSEAGVKVCRIEDKTMVKAGKIQLNLHDGRNIIVDQDEGRKYETLGSVVVNLEDGKLMDYYPMQPNQYVIAFNGVNVGRHGTLINWVRSFRKRDAIATVKAKDSEFRTVLNYLLVIGKESPVVKVTE

SEQ ID NO: 4285 - protein, 244 aa, Methanococcus maripaludis C6
MAIKGPRKHLKRLAAPANWQLPRKVKAFTVRPSPGPHSMDKSLPLLLVVRDILKYADNAREAKKIIQTGKILIDGLKRKEYKHPAGLMDVLSIPEMDENYLVLFDESGRISLKKTDKTDAKLCKIVNKTVIKGGHIQLNLHDGRNQIVKVSDATKAEEDVYKTGDSVLVSIPEQSIVGHVAFGEGKLAYITGGKHVGEFAKIVEVENRALYSDIVTLENKDGEKFKTVKPYVFIVGQDEPVISM

SEQ ID NO: 4286 - protein, 238 aa, Nitrosopumilus maritimus SCM1
MVSISGSKKLKRQMAPQFWGIARKDKRFVITTRPGPHKKHHAVPTAVFLRDMLKIVTSLREAKTSIYTGKVKIDGVVRKSLHHAIGLMDVVELENVSDIYRLVPTDGKLLKPIKINESEKTKKLVRVTSKTTISKGKMQIGFHDGRSTISDTKVSVGDVCLIQVPDQKILEVIKLESGNHGLVTRGINAGQIGKIESIEEGTFILPKRVILSLGDRKIEIPADIIMPIGKEEPVIQLK

SEQ ID NO: 4287 - protein, 238 aa, Thermoproteus neutrophilus V24Sta
MVHLRRTTSPYWWPIPRKAGGVWAVRPSPGPHSLAYSIPLALVIRDVLRYAKTLREARMIISRGYIKVDGVVRRNYKFPVGLMDVVEIVPTGEIYRVVPDERSYYALVPITSEEADLKLLRVEGKTAVKGGRLQVHFHDGRNLIMPAETARQIKTFDSVLYDLKARTVRSHIPMRLGVYAVVTHGGNVGFHGQLSEIVWTLKRRQSVVLLKRGEEAKRTILDYIMAVGAEAPVIKISP

SEQ ID NO: 4288 - protein, 240 aa, Halorubrum lacusprofundi ATCC 49239
MTRHQKRLAVPNSWPVERKTNTFTVKAGAGPHGEAGVPLVVLLRDVLGYVDSTKEARYALNNDSVLVNGDAISDEQRPIGMFDILAFPERGEFFRVFPDEGGRLALTSVDEEAAGSRLGKITNKSVVPGGDAQLTLHDGTNVLVDADTEYDTKDSIVVDNESKDVVAHFEYEEGALVTAVAGQHAGRIGEVADIDVTLGSGSNTVFVGDDEDGYETVEEYLVVIDENFTGDDADEVDSDE

SEQ ID NO: 4289 - protein, 286 aa, Halorhabdus utahensis DSM 12940
MSNHQKRLSVPNSWPIERKTETFTVKADAGPHGEAGVPLLIVLRDVLGYVDSRKEARFALDQDQVLINGDPESDETRPVGMFDILAFTEREEFYRVFPGEGGRLALTPIDEDSAQSKLGKIVGKQFVPGGDLQLTLHDGETLLVSEDAPYEGNDSVVVENDSEEIVAHFEYEEGALVTAVDGQHAGEIGTIEEIQVTPGSAENNVRIDREDGSIIETIEEYVVVIDENFVEDDEGVEADDEAEADADDAADADADDEDAEADEADADAEAEEADGDDDEADGGDDE

SEQ ID NO: 4290 - protein, 241 aa, Candidatus Methanosphaerula palustris E1 9c
MSEHLKRLVAPRAWHIAKKTNTFISKTAPGPHNGQALPIGVWLRDTMGFAQTLKEVKQILNERSVIVNGRPCRDPKMGIGIFDIIAIPKMGKYYRILLAKNGRLVAISIEAEDAKSRLCKVQDKTIVSGGKTQVNLTYGANVLTEEACSPKDSLVLSLEPEQRFTVLDHFPYKEGNMAMVIGGRHSGKIGKIQTITTVMGSTPNTVILEEVGTGTQFDTIDSYIYMVGRETPVIAEWGIEE

SEQ ID NO: 4291 - protein, 265 aa, Halomicrobium mukohataei DSM 12286
MSNHQKRLSVPKSWPVERKTETFTVKADAGPHGEAGVPLLIVLRDVLGYVDSRKEARYALNNDSVLINGKAVSDEERPVGMFDILAFVERDEYYRVFPGEGGRLALTPIDEDSAQSKLGKIVGKRAVSGDQIQLTLHDGQTLLVEEDTDYDGGDSIVVANEDSESQGDSDSSSGDEPREGEIVAHFEYEAGALVTAVDGAHAGEIGEIDEIQVTPGSSSNNVLVEQTDGDGFETVEEYVVVIDENFVDEDAEDAASQDPEGGDDE

SEQ ID NO: 4292 - protein, 803 aa, Moorella thermoacetica ATCC 39073
MRVPYKWLQQYVDVTLPPAELADKLTMAGLAVEGVEDLTPGFQKVVAGKIKTITPHPDADHLVICNVDAGRELQLVTGAPNVHEGQMVAVALEGARLPGGREIHRATFRGVVSEGMLCSAQELGLDVSLVSPEDREGIITLPPDASPGADAAEVLGLKDVVLVLELTPNRADCLSILGVAREVAAITGAPIHLPATLPGEDGPEITGLATVEITAPDLCARYVARLVQGVRIGPSPAWLQAFLRAAGMRPINNVVDITNFIMLEMGQPLHAFDYDLLEGHRIIVRRAGPGEKITTLDGVERELDPEMLVIADAARPVAVAGVMGGLATEVTPATTNILIESAHFDGASIRRTSRRLGLRSEASTRFERGVNLEGAPAAADRAARLMAELAGGRVAPGRIDCYVKRRQPVTIELRPERVNYLLGTELAPTTMKELLERLHLEVRGEGPFQVTVPAYRGDLTGEIDLVEEIARLYGYNRIPVTLPGNLTAREKQAPAQRWEEAGREAAAAAGLAEVITYSFIGPRALDQLRLPEDHPWRRTVKIQNPLREEQSIMRPSLLPGLLEVAGRNASRRVLPVAIYELGRVFIPAGSRRPGEPLRLAGLVMGTTPRGWNWPAGEMDFYYLKGILESIFSRLRVRDVSWEASNAYPFLHPGRAATIKAGTRVLGYLGELHPDVLAAVELPARACAFELDWEAAGDLALRVPRYEPLPRFPAVERDLAVVVPATTPAAAVAGVIREAGGELLRAIALFDVYEGAPVPEGCKSLAYSLVYQLPDRTLTDAEVNAAQERIQRALEERLGASLRQ

SEQ ID NO: 4293 - protein, 800 aa, Candidatus Desulforudis audaxviator MP104C
MRVSINWLKEFVDIPVTSAELADRLTLAGVAVDRIDKPSAGVTGVVTGRVVEVRPHPNADRLLIAAVDIGGEILQIVTGAANFKVGDVVPVAPVGATLAGDLAIRRAKFRGVESWGMMCAADELGIGDDHEGILILPSDTPVGVAAGPILGLDDEILELDLTPNRGDCLSVLGVAREVATLLGKPLKRRKPAFPELDLQAQRMVRVDIEDPRLCSRYVARVLVDVRVGPSPLWMQTRLFTAGVRPISNIVDVTNYVMLELGQPQHAFDYDAVHNAHVIVRRARPGETLVTLDGNERSLAPDMLLITDPRTVIGVAGVMGGLDSEVTADTRRVLLESACFNPVSIRRTSRALGLRSEASIRFEKGVDPEGCLKAADRALELMQIIGAGHAAAGAVDVYPDPYTPRTLIVRPERVEEILGLAVPAKTIRDILERLEFAPRETGGRFLVRVPSHRTDVFREIDLIEEVARIHGYHRIPDTLPFGVTVPGVRTKAQVLESRLRELLVACGLTEVITYTFTNRKVFDRLRLPGTSPLRRTVPLRNPLNEDQTEMRTLLYPSLLDVLARNYQRRNTNAALFEIGRVYHPRDNAPLPEEGLRLAAALMGRTPAGWRRKDEPLDFFFLKGVLESVAREIGLETLTFTAEQDEPSFHPGRTARLRAGEANLGIIGELHPEVLEAYDLPPGVVVTEIDLDLVLAVDKKTPTFVPLPRFPSVERDLALVIRKDIPAREVMALIRKAGGELLRELRLFDVYEGRQIREGYRNLGFSLVFRAEDRTLTDEEVGRYLEAIIRTLEDTYGAQLRA

SEQ ID NO: 4294 - protein, 819 aa, Natranaerobius thermophilus JW NM WN LF
MQVSYNWLCEYLDLDISPQELAEKLTNGGVEVEGIEQLNPDLDDIVVGEVKEVTEHPNGDKLSVTKVDVGDASDSSELQIVCGAPNVAVGQKVPVALVGSMLPDGFIIESCSIRGERSYGMICSCEELELLSPEEEEGIMVLDDDAPIGESIVTYLELDDTILEFDLTPNRADCLGMLGVAREVAALLDIPFHEPEVTDYKQNKTLDEININIEDSNLSERYIGMLIEDINIETSPMWLQQKLRSYGIRPINNLVDITNFIMIEYGQPLHAFDYDWIKGKNISVRSAQKDEQIKTLDEKQRTLTPQDIVIADEERPIAIAGVMGGYDTEVSLNTNRILLEAASFNNISVRRTANRLNLRSEASLRFEKGVDPNNTLKAAFRAIDLIEQLDVGKVKIGAADEYPQIRECVEVELRTSRVRALTGLDISDDEIKDIFRRLDFDIDGEKSLSNTDSERGLKLTVKVPTRRNDISLEVDLIEEIARIYGYDRIPTSMPQGKITQGRKTHSQKVADISRETLLTAGFSEIISYTFISPDDFDRIKLTEDDQFRTAVPLANPMTKEQSIMRTTMIPSILKILEHNSNHGEKDFQVFEIGKVYFPKELPLKELPREQTNLIFGGMGKLTPKTWMEQPGEIDFFHLKGVFELLIERLNLNISDFDFMPEKHPSFHPTRTATIKYRGERVGLMGEIHPELASEFNLDNAVIAELNFEKIIGSANLFDSYQPLPKYPAVLRDLAVLVPEDTPEEHVAGKIADTGSGLIENIQLFDLYQGDRIPEGMKSLAYSISFRDPESTLTDEYVDNIFEEIERRLESELGAKLRKS

SEQ ID NO: 4295 - protein, 801 aa, Desulfitobacterium hafniense DCB 2
MKVSLEWLREYVDIAQTAEDLAESLTRGGIEVGGVEYLNQGLEAVVVGEITRMEHHPNADKLWICEVNLGDRSTTIVTGAQNLLVGDRIPVALPGTTLPNGVHIEVSKLRGVESSGMLCSTEELHLDSGLGDPRSEGGILILEKETPLGATMDTVLGEGDCVLDLELYPNRPDCLGMVNVAREVASLTGEALHLPAWAEGSQGPDYPGDPKARIVLDDPGLCQRYAGLVVEDVNIEPSPEWMQKRLKAAGVRPISNIVDITNYIMLEMGQPLHAFDRDAIAGAVHVRRARAGEKLVTLDDIERELDPEMLLIADDEKALGLAGVMGGLNSEITDSTKRIFVESAHFSSVSIRRTSRRLGLRSEASNRFEKGVNPHGVAATLGRVAELVIQLGAGKPVGFVEQAGQLPEPAAVSLTVEKTNSLLGTALTEEEITGVLKRLRFPYQEKDRGYEVQIPTYRSDITIEEDLIEEVARLTGYDRIPTTLPQGDQTQGRRTPEQEFKRTLRHLLVGLGLNEVMTYSFTRPDADRQFGDMDQAIPLLNPLREELSVMRTALLPSIMEIAARNISRRNLDIRLFEMGSIYKSKERPLVRLPQEELHLAGVIWGKSSRHWLTPVTEYDFYTVKGILEEVAREFGLEFDYRLPNNQELTHPGRSADIYLNGVKIGLMGEIHPALGKEWELERALIFELAVAPMLEAGNRTIRAFSIPKFPAMQRDLAVVVPLEVSAQDVMKRIKELGGTLLVQVNIFDVYTGKPIPEDRKSLAFALKYQALDRTLKDEEVNALNQQVLEGIEKEFGAAWRK

SEQ ID NO: 4296 - protein, 799 aa, Halothermothrix orenii H 168
MRVPVNWLKSYIDFQYSPQELADKLTMLGLEVEGIEYMGEGLEGIIVGEIKKVKPHPNADKLVICEVDTGQELLQIITGAPNVKEGIKVPVAPVGVTLPGGLKIKKARLRGENSYGMICSIDELGLSEKRASGIMILDEDAEVGTDIIDYLHLDEYVLKLDLTPNYARCLGLLGIAREIKSVLGNEIKKPDTDLVESESESIENYISIEVEDKDLCPRYTGRVIKNIKIGPSPRWMQARLRAAGIRPINNIVDITNYVMLEYNQPLHAFDYDKIDKKIIVRRGKEQEKLITLDNKERELDEEVLVIADTEKALGLAGVMGGANSEVCDDTTTVFLESAYFNPVNIRKTAKKFALPSEASHRFEREVDIEGVIAASNRAAYLMQKYAGGEIVRGIVDVYPEPRRLHAINLDTGYVNKILGLNLDKTEIEDMLTRLEFKVEERDSKSLKVMVPSFRSDIEREADLIEEVARMYGYNNIPVTRPESKQRGRKTYKQHLEDITRNYMSAMGLDEVITFSLTGKKVYDDLDIPEDSSLRNWVKVKNPLNEALSILRTSLLPSIIEVLSNNAKRQVETMSVYELGKIFTRIKEKKRPEERVVLAGGCMGKTDDPWKTGAPDFFYLKGVVVDYLRELGLDGLDFTPSKLPFLHPGRTAEIYYRDTRIGIMGELMPDIADRFNLRSGTAVFQLDFETIVEEADLDRQYEQLPRYPAVERDMAVVVENEVFAGSLLKLIRENGGKLLKKAGLFDLYQGKQIPEGYKSLAFKLVFQAHDRTLTDDEVNEVFNSIMDQLKDKFGAEIRGV

SEQ ID NO: 4297 - protein, 804 aa, Desulfotomaculum acetoxidans DSM 771
MLVSYNWLKEYVDIDIPPQELADRLTLAGVAVEKVEYLGEGIEKVYTGKILKIDKHPNADKLVVCSITTGSETLQIVTGATNVREGHIVPVSVVGASLAGGLKIKKSKLRGVESYGMLCSGQELGMDAKFLPPEQQTGVMILPEDTPIGVDAKEVLGLNDTILELDLTPNRGDCLSMIGVAREVAAMLGYTLRVPQPVVQELPDAIAGKARVDIAAPSLCRRYAARVLVNVKIGSSPGWMQQRLRAAGVRPISNIVDVTNYVMLELGQPMHAFDYDTLENHHIIVRRAAAGESIMTLDGSQRKLEQDMLVIADTTGAIAVAGVMGGLRTEVTGNTVAVLLESAQFNPISVRRTSKELGLRSESSLRFEKGIDLDGCLRAADRACQLMQEMGAADVLAGSVDNYPEVLLEKTVLLRTGRVSRILGVEVPKEQIVAVLSSLDFNVRDNGDELLVTVPSHRNDVSIEADLIEEVARMYGYNRIPATLMQGDNTRGAKTPVQLIETRLKDTLAACGLTEVITYSFVNPHVFDALGLAEDNDLRRAVKVKNPLSEDQSVMRTTLLPNLLEVLQRNYNRRVQNGAVFETGRCFLPTDRQLPDEIPVLGAAAMGNQASAWNKPAVPMDFYYLKGVLEAMFDTIGLSGIAFVTSEAPGYHPGRTAVIQLDGRQIGVLGEVHPDVLENYDLPERVTACEINLTEVFMLAGKIKKYQALPRYPGVDRDLAVVVKQSLAVEALFHVIHNTGGKLLRSVKLFDVYRGGQVKEGYQSLAFALNLQAEDHTLTDAEINETMENIRGALEKELGAELRG

SEQ ID NO: 4298 - protein, 803 aa, Alicyclobacillus acidocaldarius DSM 446
MRASYKWLAEYLDLAGLSPAELADRLTSAGLAVDAVDPLNRGVEGVVIGKILEVRPHPQADRLKVCRVDVGGRQLEIVCGAPNAAPGLVVPVALPGAKLPGGVEIRIAEFRGVSSHGMLCSADELGIETRYLPKRDVEGLFVLPEDLPLGEDVVPHLHLDDVVLDLDLTPNRSDCLSIRGLVHELSAILRRPHRFPASVPAPAAEGESPLQVRLETPRCPRYEAQLLEGVEVRETPLWMKMRLLAMGVRSIDLVVDVTNYVMLEWGQPLHAFDADAIAHATIVVRQAREGERLVTLDGQERALTPDMIVIADPEKAIGLAGVMGGENSEIGPSTRRIALESARFDGASIRRTGQALSLRSEAQQRFEKGVDPAAVSSALHRATELLVQLAGSRPVGAPRRVPAQADVSKPTVISFSPRACARFLGVDVPEEEMRACFESLGFDVTQGENEWRVEVPTRRPDVQLPADLYEEVARLYGYDHIPATSMRLPVEAPESSGQLMLVRKVRRALVDWGLHEVRTYALTSPEAEAPVAPSGVPVPLLRPMSDDRRTLRRHLLPSLAEVARHNLAHQVLGGAIFEVGKVFLAASWPQEALPEERAVLGMLWFGEPEGDPFERPRRYDFYDAKGVCDALLARLGIQATYRVSQHAYLHPGRQASIEVNGEPVGLVGELHPDVGEAYEVERAVYAEFDLGRLLSLASSEVRVLPIPRHPASRRDLAVVVPRELESQALVDAAWRTLGDRGDLRLVRVFDVYTGVGVPEGHKSLAVALWFQRDERTLTDAEIDEAVEAVLRAWEAAFGAKLRA

SEQ ID NO: 4299 - protein, 340 aa, Syntrophomonas wolfei Goettingen
MAVKYLDYYKILGVERDADAKKIKAAYRKLARKWHPDLHSGKKREEAEEKIKEINEAYEVLSDPEKKALYDRLGPNWKNGERVDSSGFGDGVFYRSSNIDPEDLQGFSEFFSSLFGAEPGRQSRRASYRSAPVRGQDIESTIELSLEEAYHGLSKSITLSTAAACPECQGSGFVGRGFCRRCGGTGSISEARTLQVRIPPGVHEGSSIRLKGQGGEGLGGAERGDLYLQVHILPHPVFTLRGRDLETEITLRPEQAVLGDRVTVATLDRQLTLKVPPGSRSGQKLRLKGKGMPARQGENGDLYARIKIDLPRDLSEEEKELYRQLAELRAPRQAERGVAE

SEQ ID NO: 4300 - protein, 324 aa, Syntrophobacter fumaroxidans MPOB
MAVKFRDYYEVLGVPRTATQEEIQRSYRKLARKFHPDVNKARDAEDKFKEINEAYEVLKDPEKRKKYDLLGENWKTGQEFRPPPGWDYQYDFGRGGGQGEFQWGGSGGFSDFFEMLFGGQRGGRARGGARRGGGPVWSQAGADQEATVRISLEDAFHGATKSITLQMQSLTPDGQVAVQEKTYEVKIPVGIMSGRKIRLSGQGGEGMGGGPRGDLYLKIEIEPHAVYRLKDRDIYVDLPVAPWEAVLGADVQLTTLSGQVTLKIPPGTQSGQKLRLRGKGMPNPKETAGDLYVVVQIMVPKHPSRREQELFEELRKESAFNPRL

SEQ ID NO: 4301 - protein, 348 aa, Frankia EAN1pec
MSAGTTGRASPDFYELLGVPRDADTDAIQRAYRKLARRYHPDINSDPSAEERFKDLSEAYDVLSDPDTRARYDRFGRDFRRVPEGAERWADAPRGGFGPGAGPGAGADGTAGRGGGFGFEGFQGFDFEDLFGGVRGFARRRGRVGPVPGADQEAEIEILLAEAYRGARRRITLPGPRGLREVDVAVPAGVRDGQRLRLAGQGGRGRDGGSPGDLYLVVRLAPDPRFRVEGRDVHTDLPLAPWEAVLGTAAGLDTPAGERMTVTVPPATSSGRRLRLRGRGLPAPGRDASREATGGSAGAAGGGGGPGGAAGDLYAHARIMVPPNPAERETELFRELARVSSFNPRERS

SEQ ID NO: 4302 - protein, 314 aa, Geobacter lovleyi SZ
MNNYQDYYKTLGVEKKATQDEIQRAYRKLARKYHPDINKESSAEEKFKQLNEAYEVLGDPEKRAKYDHLGSGWDGQFANQGYQDGDNVQYHYSNADPGQFSDFFQNLFGGGGWNFTEESNFHGGGVRRRRGRDHETAINISLADAYHGAKKSIELERAELGSDGRPTRTRRSYDITIPQGVTDGSLIRLANQGGSGSGGGDAGDLFLRVNILPDSRFTLNGHDLATTVDIAPWEAALGGKVLVPTVDGRINLSVPAGTQSGQSLRVRGKGMPVAPGRFGDLLVNVRIVVPQHLTARERHLFEELAKESRFEPRK

SEQ ID NO: 4303 - protein, 297 aa, Micrococcus luteus NCTC 2665
MAEDLYSVLGVSRSADQKEIRRAYREKARKFHPDVNKAPGAEETFKRISEAHDVLSDPETRSQYDRFGENFRQYAAADAARSSEQPRRSGGTRYTWSGGSAQSVNWEDLFGGGFGGFGGGFGGFGRGADRTAELEITVEEAYRGGRRTVQVASPYGGAQEYTIDIPAGAVDGQRLRIADADGQDGDLLITLRVKDSKRYRLSGADIETDLPISPWEAALGADVSMPTPGGPVTVHVPPGSSTDRRLRLRGQGMPRRGQPGDLYARVKVVVPRTLSKKERELFEQLRDESSFDARRGS

SEQ ID NO: 4304 - protein, 324 aa, Catenulispora acidiphila DSM 44928
MARDYYEVLGVPKTADAEQIQQAFRKLARRHHPDVNKDPAAEERFKEINEAYQVLSDPKTRARYDRFGPDFRQIPEDYDEQVAAGRAARAGGFRGGGPEGGEYVDFGGAGVRFEDLFGDIFGGQGGPAGRGGQGGRGSRGGRGGVRMAGADQTAELELSVEEAYRGGKRKITIGGAGGRDYDVTIPAGVVDGQRIRLAGQGGRGYGDAPAGDLYLQIRIAPHPRFRLSGRDITVDLPVSPWEAALGATVPVPTPGGTAKVVVPAGSSTGRKLRLRGEGMPNPKGPPGDLYAEVRIMVPATPTDRERELFEQLAAASSFDPRRRS

SEQ ID NO: 4305 - protein, 324 aa, Nakamurella multipartita DSM 44233
MAQDFYEVLGVNRDADPADIQRAYRRLARQHHPDVNKHSGAEERFKDIAEAYDVLSDPELRRRYDAFGEDFRRVPPDTDPAAWRQARTYADAGAGTRGRWSSGAGPSGGFGAGDFGDVDIEDLLGGIFGGRGRGGRGRAGWGPGPVPGSDHEAEVEVSVEEAYHGTERSVTISGPDGPRTLDVTIPAGVVDGQRIRLRGQGGSGGGSAAAGDLYLVVRIADHPRYRVEGRDLHALLPVAPWEAALGASVSVDTPGGAATVKVPAGSSSHRRLRLQGRGLPDRRGKPGNFYAELQIRVPTRLTDDEQRLFEELARVSSFDARSRR

SEQ ID NO: 4306 - protein, 310 aa, Syntrophomonas wolfei Goettingen
MYKLAAIVGPTAVGKTNISLEVARQINGEIISCDSMQLYRGMNIGTAKASKEEQNIVAHHLIDIADPHENFTVARYQSLVKDLISTINARGKIPILVGGTGLYYQSVVDDYTFFPMEVRQSIRDKWNAIIQEKGLPHVYRLLEQIDPAYAQIISPNDQKRVVRALEVYELTGKAFSTLQDRAENTYYLAVVGLYLERRELYARIERRVDEMIKKGLIEEVAALREKGIDLSYNSMQALGYKQVFYFLEGFINREELLNEIKRETRRYAKRQLTWFKKDQRIKWFNVGDFSDEELLVKNICTFMEGQFGIV

SEQ ID NO: 4307 - protein, 283 aa, Desulfotomaculum reducens MI-1
MISADSMLVYRDMDIGTAKPTLEEMAGIPHHMIDIVNPNEEFSVATYQSRVEELINQIIDRGNLPLLVGGTGLYIRSVIDHYDFTTAPKDDRLRECLKREAEQVGAAAMHKKLSEVDPQSAERLHPNDLRRVIRALEVYYQTGKTIAEYQYKDQVEKPKYNLKMFGLTMDRQLLYQRIEQRVDLMMARGLLTEVKELVEQYNGLGTALQGLGYKEIIGYLKGEYSLPEAVEILKRNTRRFAKRQLTWFRADNRIFWIEMDRFENKKAVANEIMKQMAGDFLTL

SEQ ID NO: 4308 - protein, 305 aa, Thermotoga petrophila RKU-1
MKIAIVGGPTAVGKTDIMIEVCEEIGAEIISMDSRQIYRYMDIGTAKPTSEQRRRVPHHMIDIIDPDEYYNAFMYRKDSLRAMEDVLRRGKIPVYVGGTGLYADALVRGIFEGVPADENIRKELRELERREPGILRKMLEEFDPEAATRIHPNDLKRTIRALEVYMKTGRRISELQKEAKGDDRFFIIVLTRERYELYERINKRVDKMIEMGLVDEVKRLLGMGYSKDLNSMKTIGYREVIDYLEGKYDFDKMVHLIKRNTRHFARRQIIWFKRYKEAVWYNLTFEDVGEVKEKLKKLIVENFSV

SEQ ID NO: 4309 - protein, 303 aa, Petrotoga mobilis SJ95
MNKVLVIAGPTAVGKTEISIEIARRINGEIICMDSRQIYSHLIIGTATPDEETKKLVPHHLYGSVDPRTHFTAFDYKKLAEKKIGEVLNRGNTPVLVGGTGLYLDALRKGFLNVKSDYGLRTYLRKLETNNPGVLRKILVDLDPQRAQKIHPNDLKRIIRAIEIYVITGIKMGEIVKENRQDENSFDYHIIVLDRERQELHERINKRVHQMIDEGLIEEVRNLLSLGYSTTLNALNTIGYKEVVQYLYGKIDFNEMVHQIKVNTRNYARRQIIYFRKIEGAKWINLSKTSQEEVVDQILSEFI

SEQ ID NO: 4310 - protein, 310 aa, Candidatus Desulforudis audaxviator MP104C
MTVPPPLVVITGPTATGKTEVGINVALACGGEIVSADSMMVYRGMDIGTAKPSASEMRGVPHHLIDVVDPDEEFNVARYQQLAGEAIVGILGRKRVPLLVGGTGLYIRSVVEDYRFPVRADRRLRNRLQEAAELYGCARLHRHLAVVDPVTARRLHPNDQRRIIRALEVYYQSGIPFSRYPDRRDRAPKYLPVMFGLNMERGRLYRRIEDRVDAMIRAGLVREVQSLLEKGYGPELVAMKGLGYKEIAAHLRGSLTLEEAIHILKRNTRRFAKRQLTWFRRDEQIRWLDVEECGGPVGAAREIVGSIEQE

SEQ ID NO: 4311 - protein, 305 aa, Thermotoga RQ2
MKIAIVGGPTAVGKTDIMIEVCEEIGAEIISMDSRQIYRYMDIGTAKPTPEQRKRVPHHMIDILDPDEYYNAFLYRKDSLKAVEAILKRGKIPVYVGGTGLYADALVRGIFEGVPADENIRKELRELERREPGILRKMLEEFDPEAATRIHPNDLKRTIRALEVYMKTGRRISELQKETKGDDRFFIIVLTRERYDLYDRINRRVDRMIEMGLVDEVKRLLSMGYSKDLNSMKTIGYKEVIEYLEGKYDFEKMVHLIKRNTRHFARRQIIWFKRYENAIWYNLTFVSKEELKKTLKELIVKNFSV

SEQ ID NO: 4312 - protein, 314 aa, Desulfitobacterium hafniense DCB 2
MKPLIIIVGPTAVGKTALGVALAQALQGEIISGDSVQVYRKLDIGSAKPTLAEQGNVPHYLLDALDPAEPFTVAQFQTLANQSIQNIQSRGKVPIVVGGTGLYIRSLIDPFQFAEHGSESIRSFWTAFLSEQGKEALHRELAKRDPLSAQRLHPNDTVRIIRALEMCQLTGKPFSEIRGNQDMNYPPLPPSLLYVGLTAPREIIYERINRRCEQMVAAGLIEETHNLIKEGYSPKLKPLQSIGYRHALLYLYGKVTLPEMMRIFQRDTRHFAKRQLTWFRRDPRVVWYDTYSGNLTNILESLIGTCSGMESRVE

SEQ ID NO: 4313 - protein, 326 aa, Desulfotomaculum acetoxidans DSM 771
MINISTGQGPGGNKNPIPLIVIVGPTAVGKTECGVLLAKTINGEIVSADSMQIYRYMDIGTAKPTIEEMCGIPHYMLDIINPDEEYSVALYQEAAENYIRDIFNRGSSPILVGGTGLYVRSITDHYNFSRAEINWEYRAKLNQSADLRGNEYIHNLLKTVDPLAAEKIHCNDRKRIIRALEVFDQTGRPISSYHDRDTFTKPKYKLHIFGLIMERSQLYRRIEIRIDKMMEQGFLKEVRGLLDRGYSSQLTSMKSLGYKELGAYLNGNMSLEEAVEMLKRNTRRFAKRQLTWFKRDNKITWLDISRQPAMDDIVQEIIKIVAGVSC

SEQ ID NO: 4314 - protein, 333 aa, Alicyclobacillus acidocaldarius DSM 446
MTDRKPIVCVVGPTGVGKSELSVEIALRYGGEVVSADSMQIYRGMDIGTAKLRPDEMRGVPHHLLDIADPARKFTVAEWKRQADMVIDEIVARGRLPVVCGGTGLYVRALLDDLDFSQTPENVHLRAALDRRADEEGVQALYEELRARDPERARMIHPHDRKRIVRALEVAMVRGTGMSEDYDWTPRQGRYEALVLGITMPREALYQRIDRRVEHMWRLGLVDEVKRLLAAGVPMGGTAMQAIGYKEVVSYLSGAVSEEEAIRIIQQNTRRFAKRQWSWFRRDPRVHWFAKGSDGLFSTDEIARLWACIDHFLQDIGWSTANRSSTCRLESES

SEQ ID NO: 4315 - protein, 282 aa, Rhodoferax ferrireducens T118
MKAVKYFRYFWPLAIMKQALVATVLVAFMGLPVSAQTPSIVVASTTSTEQSGLFSVLLPEFKKASGIDVKVVALGTGQAIDMGRRGDADVLFVHDKVAEEKVVAEGFAVKRLEVMYNDFVVVGPASDPVKVKGNDVVEALKKLSAANGPFISRGDKSGTHAAELRFWKMADLADKQGSGYKSCGCGMGPALNMASSSNAYALADRGTWLNFKNRGDLKVLVEGDQRLFNQYGVMLVNPAKHPHVKAVDGQKFVDWVISPAGQGVIASYKIGGEQLFFPNAVK

SEQ ID NO: 4316 - protein, 275 aa, Mesorhizobium BNC1
MLPCPMFSALAALFMLAGVAAAQDQSIVVASTTSTQDSGLFDHILPLFEEKTGIEVKVIAQGTGQALDTGRRGDADVVFVHAREQEEKFIEEGFGVRRFDVMYNDFVLIGPKSDPAGIGGSGDIAAALVAIQSRQAPFISRGDKSGTHSAELKLWEAASVDIETAKGQWYKEIGQGMGAALNTASAMNAYVLSDRGTWLSFKNRGDLDIMVEGDRRLFNQYGVMLVNPEKHPSVQAEAGQRFIEWLISPEGQQAIGEYKIGGQQLFFPNAEQDRS

SEQ ID NO: 4317 - protein, 268 aa, Alkalilimnicola ehrlichei MLHE-1
MIRSVCWILIGLAALTLAGTAQARDYITLASTTSTEQSGLFQHIIPKFSEATGIDVRVIAVGTGQAFALARRGDVDSLLVHDPVGERAFVEAGYAVERRDVMYNDFVLIGPADDPADVGHADDIADALQRIAGARAPFTSRGDDSGTHRAEQRLWQAAGIAPSGRWYRALGGGMGPTLNTAAAMDAYVLSDRATWVAFDNRQRLEILFQGDEALHNPYGTLLLSAERHPHLNHERARQWHEWLLSETGQSAIARYTLRGERLFFPNAD

SEQ ID NO: 4318 - protein, 274 aa, Acidovorax sp. JS42
MKNHKRFWPLALTQTAVAAIALVAYGSAAAQAITLASTTSTEQSGLFTHLLPAFKQATGIDVKVVAVGTGQALDMARRGDADVLFVHDQVAEEKFVADGWGVKRYPVMYNDFILVGGKGDPAATKGNDIAAALKKVATVNAEFVSRGDKSGTHAAELRYWKIATDGVKGNGYKECGCGMGPALNIAASSGAYVLSDRGTWLNFKNRDNLAVLVEGDKRLFNQYGVMVVNPAKHPHVKQAEAQKFVDWVISPAGQNVIASYKINGEQLFFPNANQ

SEQ ID NO: 4319 - protein, 278 aa, Methylibium petroleiphilum PM1
MVKFDRRALLRHLGMFAITLGVAGAAVAQDKSIVMASTTSTEQSGLFAHLLPAFKKASGIDVKVVALGTGQALDMGRRGDADVLFVHDQAAEEKFVAEGYGLKRSPVMYNDFVLIGPKADPVGVKGADIVAALGTLAKSPSSFVSRGDKSGTHAAELRYWKAAGIEAPKGTYAGYQECGCGMGPALNIAASSNAYVLADRGTWLSFKNRADLAVLVEGDKRLFNQYGVIVVDPAKHPHTKTALAQAFADWVVSAEGQATIASYQIGGQQLFFPNAATK

SEQ ID NO: 4320 - protein, 274 aa, Sinorhizobium medicae WSM419
MLTRRLFCVGMLLILAGVTPALAQSIVVASTTSTQDSGLFDYILPLFEKETGIDVKVVAQGTGQALDTGRRGDADVVFVHAKAQEEKFIQEGFGVKRSDVMYNDFVLIGPKSDPAGVSGMTDIAAALVSIKAKEAPFVSRGDRSGTHSTELTLWKEAGVDIEAAKGPWYKDIGQGMGAALNTASAMNAYVLSDRGTWLSFRNRGDLAISVEGDKRLFNQYGVMLVNPEKHPDVKAELGQIFIDWLIGPEGQTAIGEYEIDGQQLFFPNASGQRI

SEQ ID NO: 4321 - protein, 276 aa, Dinoroseobacter shibae DFL 12
MRLALISSLFAACLGAATTLAGVAQASEPSILVQSTTSTQNSGLFDHILPIFEAETGIDVQVVAVGTGQALRNAANGDGDVLFVHAKAAEEKFVADGFGVSRADVMYNDFVIVGPAADPAGVGGSSDAVAALAQIAEAQAPFLSRGDDSGTNKAELRLWSETGIDAQAASGDWYRETGSGMGATLNTGIAMNGYVMTDRATWIAFGNKQNHEILVEGDPKLFNQYGIILVNPERHAHVKADLGQQFVDWILSEEGQAAIASFKVDGQQLFFPNAGG

SEQ ID NO: 4322 - protein, 275 aa, Methylobacterium extorquens PA1
MDRLRRSFLTLSLLAALGTASPLRAEPASIVVASTTSTEQSGLFKHILPLFKQKSGIEVKVVALGTGQALDAARRGDADVVLVHDRPAEDKFVAEGFAKARQDVMYNDFVLIGPKADPAGIRGKGVDDAFKAIAAGQAPFVSRGDRSGTHSAELRSWKEAGIDLPAVRGDWYRDVGQGMGPALNTASSLGAYILADRGTWLSFKNRGDLTILVEGDKRLFNPYGVMLVNPEKHPTVKVKEGQAFIDWLVSPEGQRAIADYKINGEPLFFPSAKKG

SEQ ID NO: 4323 - protein, 281 aa, Methylobacterium radiotolerans JCM 2831
MDPFRRRLLTLGLAALLSAAGLLPSADAEPTAIVVASTTSTEQSGLFKHILPLFRETSGIDVKVVALGTGQALDAARRGDADVVLVHDRPAEDKFLAEGFAKRRYDVMYNDFVLIGPASDPAGVRGLGVREAFAKLAASKAAFVSRGDRSGTHSAELRSWREAGVDLAAVRGPWYRDVGQGMGPALNAASALGAYILADRGTWLAFKNRADLVILVQGDPSLFNPYGVMLVNPDRHPGVKAKEGQAFIDWLVSPEGQGAIAGYKVGGEELFFPSASALTTR

SEQ ID NO: 4324 - protein, 275 aa, Methylobacterium populi BJ001
MDLLRRGFLTLSLLAALGAATPLSAEPASIVVASTTSTEQSGLFKHILPLFKQKTGIEVKVVALGTGQALDAARRGDADVVLVHDRPAEDKFVAEGYAKARQDVMYNDFVLIGPKDDPAGIRGKGVEEAFRKIAAAKAPFVSRGDRSGTHSAELRSWKEAGIDLGAVRGDWYRDVGQGMGPALNTASSLGAYILADRGTWLSFKNRGDLTILVEGDPRLFNPYGVMLVNPDKHPTVKVKEGQAFIDWLVSSEGQKAIEGYTINGEQLFFPSAKKS

SEQ ID NO: 4325 - protein, 271 aa, Methylobacterium sp. 4-46
MDRLRRLFCLTLAAWLAAAPARAGESITVASTTSTEQSGLFGHLLPRFTEATGIGVRVVALGTGQALDVGRRGDADVVFVHDQPAEEAFVRDGFGVERFPVMYNDFVVIGPRDDPAGIAGRDVAQAFRKIAAARAPFVSRGDRSGTHAAELRMWREAGLDLGAVRGEWYKEIGQGMGPALNAAAATNAYLLADRGTWLAFKNRQDLKVLVEGDPRLFNQYGVILVNPAKHPHVKARAGQAFIDWLVSPAGQGVIAGYRIGGEPLFVPNAGT

SEQ ID NO: 4326 - protein, 275 aa, Methylobacterium chloromethanicum CM4
MDRLRRSFLTLSLLAALGTAAPLRAEPASIVVASTTSTEQSGLFKHILPLFKQKSGIEVKVVALGTGQALDAARRGDADVVLVHDRPAEDKFVAEGFAKGRQDVMYNDFVLIGPKADPAGIRGKGVDDAFKAIAAGQAPFVSRGDRSGTHSAELRSWKEAGVDLPAVRGDWYRDVGQGMGPALNTASSLGAYILADRGTWLSFKNRGDLTILVEGDKRLFNPYGVMLVNPEKHPTVKVKEGQAFIDWLVSPEGQRAIADYKINGEPLFFPNAKKG

SEQ ID NO: 4327 - protein, 272 aa, Methylobacterium nodulans ORS 2060
MDRLRRLLCLTLLAVLAAAPLRAAESITVASTTSTEQSGLFGHLLPRFTEATGIAVRVVALGTGQALDVGRRGDADVVFVHDQAAEEAFVRDGFGVKRFPVMYNDFVVVGPKDDPAGAAGRDVAEAFRRIAAAKAPFISRGDRSGTHAAELRVWREAGLDLGAVRGAWYYKEIGQGMGPALNAASATNAYVLADRGTWLAFKNRGDLKILVEGDPRLFNQYGVILVNPARHPHVKAREGQAFIDWLVSPAGQGVIASYRINGEPLFVPNAGQ

SEQ ID NO: 4328 - protein, 274 aa, Diaphorobacter TPSY uid29975
MKSYKRFWPLALTQTAVAAIALVAYGSAAAQAITMASTTSTEQSGLFTHLLPAFKQATGIDVKVVAVGTGQALDMARRGDADVLFVHDQVAEEKFVADGWGVKRYPVMYNDFILVGGKADAAGTKGNDIAAALKKIAAANAEFISRGDKSGTHAAELRYWKIATEGVKGSGYKECGCGMGPALNIAASSGAYALTDRGTWLNFKNRDNLAVLVEGDKRLFNQYGVMMVNPAKHPHVKQAEAQKFVDWVVSPAGQSAIAGYKINGEQLFFPNANP

SEQ ID NO: 4329 - protein, 286 aa, Variovorax paradoxus S110
MNPFLKQHRAGAGIRASLAVAVFFLAAGAARAETITMASTTSTEQSGLFSHLLPAFKKASDIDIKVVAVGTGQAIDMAKRGDADVLFVHDTAAEEKFVAEGFSAKRYPVMYNDFVLVGPQADPVGAKGGDIVAALKKIAAANAPFVSRGDKSGTDAAERRLWTQTGVAEAGQPVPNERKGTGYKECGCGMGPALNIAASSGAYVLADRGTWLSFKNRAGLAVLVEGDKRLFNQYGVMVVSPAKFPSLNSRGAQKFVDWVISPAGQQTIAAYKIGGEQLFFPNALSN

SEQ ID NO: 4330 - protein, 98 aa, Mycobacterium MCS
MTAPDRPEPGPDAGMEDIEADIEATRRELGETVEALSAKLDVKQQAKDKVDETKHRVVEKAHTAQHVVADNPQKSIPVAAFVVAVVVAVGVVVWRRRH

SEQ ID NO: 4331 - protein, 82 aa, Nocardioides JS614
MSSNGTSPQRLEADIARQREDLATTVDQLHAKLDVKARAQDKAHELKDRATTADGRPRPDLTAAAVAAVVLAAGLLAWRRRR

SEQ ID NO: 4332 - protein, 98 aa, Mycobacterium KMS; identical to SEQ ID NO: 4330

SEQ ID NO: 4333 - protein, 87 aa, Mycobacterium vanbaalenii PYR-1
MAAGPDPRPEPGPDAGIAELQADIEQTRGELGATVGALSDKLDVKARARQAVADAKQNAKSRPAVQVGALLAAGAGIGLVVWLRRRR

SEQ ID NO: 4334 - protein, 98 aa, Mycobacterium JLS; identical to SEQ ID NO: 4330

SEQ ID NO: 4335 - protein, 104 aa, Salinispora tropica CNB-440
MTGNGRASGDTEALREEIRRTRIELSETMEALAAKADVKKRLRSSAEQAKGRMREQATVAAARVRGRARPRGERVHGSSVPFTALAAGAVAAVVVLMIVRGRRR

SEQ ID NO: 4336 - protein, 104 aa, Salinispora arenicola CNS-205
MTGNGRASGDTEALREEIRRTRVELGETMEALAAKADVRKRLRSSTEQVKERMREQATLTAARVRGRARPPGERVRGAPVPLTALAAGALAAVVVLMIVRGRRR

SEQ ID NO: 4337 - protein, 196 aa, Actinosynnema mirum DSM 43827
MTGPGGIPQNRRELELDIQLTRQELGDTVEALVHKVDVPARAREAAEDVKARASDVVDEVKGKAAEVAGEAKVKAEELADGAAAVAGQARAKAEELAGEAKVKAAEAAEKAAEKVGAVAGEAKVKVGAVADEAKVKAAEVADRAAVVADQARGRASYAVEQLPPPARRALREHPAAVIAGVVAVGLLVWRLARRGR

SEQ ID NO: 4338 - protein, 156 aa, Brachybacterium faecium DSM 4810
MSTAADRPEQGEDLRVNPGADRRTPEQGTPRLPTDAAGEAAGVGHREPADDAGPDEIEADIARTRRDLGETVAALSDRLDPTAQAEQQLHHLSHRAHEQLDRALEQVDQARDSARSAFTRARHTVAETDSPLPPLLAAAAGAAVFAGIGLLLIRRP

SEQ ID NO: 4339 - protein, 135 aa, Catenulispora acidiphila DSM 44928
MSTDPTANPTANGARRPATVEKLREQVAHDRDELAETVTALHAKTDVKGRVREKTAGAEIAAAAIATRAGRAAGSVPRLIRWAAATASGQVHKSAPPAGSSSERPTLSLRDRLRIYFAIVTAILAFMRIRRWRSR

SEQ ID NO: 4340 - protein, 85 aa, Saccharomonospora viridis DSM 43017
MSTSDDDFPQTMDQVRTDIELTRQELGETARELFYRLNVGERAKERFQDRSQTVLRVLRANPVAVAIGGGVLTVLLGGLLTWKLK

SEQ ID NO: 4341 - protein, 445 aa, Escherichia coli BL21 (DE3)
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGNRGRVLLRKSGTEPLIRVMVEGEDEAQVTEFAHRIADAVKAV

SEQ ID NO: 4342 - protein, 445 aa, Baumannia cicadellinicola Homalodisca coagulata
MKKKRYFGTDGIRGKVGDNPITPEFILKLGWAAGKVLARHGSNKIIIGKDTRISGYMLESVLHAGLASAGLSAVFTGPIPTPAIAYLTKTLRAEAGIVISASHNPFYDNGIKFFSIEGTKIPDAIEQAIEAELGKKLICVASAKLGRISRIDDAAKRYIAFCKGTFSESISLNGLKVVVDCANGATYQIAPNILRELGAKVVAIGCQPDGMNINKDCGTTDIRKLQHRVLAENANIGIAYDGDGDRMIMVDHLGYKVDGDQIIYIIARDKMQQGKLVGGVVGTLMSNMGLELSLKRLGIPFIRTSVGDRYVLNKMQETGWRIGAENSGHVILLDHNTTGDGIIAGLQVLSAMVNNSMTLHNLCRDIQLFPQKLINICLTSKYNPLISTTVIHACKVAEQELAKHGRILIRKSGTENIIRVMVEGKDENQVTDLANYIADAVKASS

SEQ ID NO: 4343 - protein, 443 aa, Psychromonas ingrahamii 37
MKKKYFGTDGIRGKVGASLITPEFTLKLGWAAGRVLAKSGSKKVLIGKDPRISGYMLEAALEAGLAAAGLRPVLMGPMPTPAVAYLTQTFRATAGIVISASHNPYYDNGIKFFSDQGTKLSEEIELEIEAEIDKELKCVDSSELGKAYRIEDAAGRYIEFCKSTFPSKYNLNGLKVVVDCANGATYHIAPLVISELGADVIAMGVEPDGLNINLNCGATSMQAISERVVKENADFGIAFDGDGDRVMMVDHTGYVLDGDELLYIIARDKLRSGTLKGGAVGTKMSNLGLEQSLKTLGIPFERSDVGDRHVMELMIKNNWCIGAENSGHIICSDHLSTGDGIVSGLQVISAMQSSRMKLYELRQGIKKYPQILLNLGFDNKIDPLQDNDVLAEAKRIETLLGDKGRVLLRKSGTEPVFRIMVEADESEKVVRGYAKSIADKVKV

SEQ ID NO: 4344 - protein, 445 aa, Enterobacter sp. 638
MSNRKYFGTDGIRGRVGDAPITPEFVLKLGWAAGKVLARHGSRKIIIGKDTRISGYMLESALEAGLSAAGLSASFTGPMPTPAVAYLTRTFRAEAGIVISASHNPFYDNGIKFFSIDGTKLPDEVEEAIEAEMEKELTCVDSSELGKASRIVDAAGRYIEFCKGTFPNELSLSHLKIVVDCANGATYHIAPNVFRELGAKVIAIGCEPDGLNINEEVGATDVRALQARVLAEKADLGIAFDGDGDRVIMVDHEGNKVDGDQILYIIAREGLRQGQLRGGAVGTLMSNMGLELALKQLGIPFARAKVGDRYVLEKLQEKGWRIGAENSGHVILLDKTTTGDGIVASLQVVAAMVRNHMNLHDLCSGMKMFPQILVNVRFTAGKGDPLENENVKAVMAEVEAALGNRGRVLLRKSGTEPLIRVMVEGEEEAQVTEFAHRIADAVKAA

SEQ ID NO: 4345 - protein, 446 aa, Vibrio cholerae O395
MSDKRRYFGTDGVRGKVGQYPITPDFVLKLGWAAGRVLAKQGTRKVIIGKDTRISGYMLESALEAGLAAAGLKATFTGPMPTPAVAYLTQTFRAEAGIVISASHNPYYDNGIKFFSYEGAKLPDDIELAIEAELDKDIECVESAELGKASRMVDAAGRYIEFCKSTFPSKLSLSGLKLVVDCANGATYHIAPNVFRELGAEVIAMGVEPNGLNINDQVGATDVRALQKRVVEEHAHLGLAFDGDGDRIIMVDHLGNKVDGDQIAYIIARDALRRGELKGGVVGTLMTNLGMENGLKQLGIPFVRAAVGDRYVMEKLLEKGWKIGAENSGHVILLDKVTTGDAIVAGLQVLASVVGSEMTLHELAKGMTLYPQVLENVRFAGDNNPLEADAVKAAVSEVEAELGSKGRVLLRKSGTEPLIRVMVEGEDETLVKQSALKIAQAVKDNC

SEQ ID NO: 4346 - protein, 446 aa, Yersinia pseudotuberculosis IP 31758
MSNRKYFGTDGIRGKVGESPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDDVEEAIEAEMEKPLTCVESAELGKANRIVDAAGRYIEFCKGTFPSELSLNELKIVVDCANGATYHIAPSVLRELGATVITIGCEPDGMNINEECGATDVRLLQERVLAEGAHVGLAFDGDGDRLMMVDHLGNKVDGDQILYIIAREGLRQGQLKGGAVGTLMSNMGLQLALKDLGIPFVRAKVGDRYVLEAMQEKGWRIGAENSGHVILLDKTTTGDGIVAGLQVLTAMVRNHMSLHDLCSGMKLLPQILVNVRFSGEHNPLKSDEVEEVTRQVEKELGGRGRVLLRKSGTEPLIRVMVEGDAEESLIAEMANRIADAVKAAG

SEQ ID NO: 4347 - protein, 446 aa, Vibrio harveyi ATCC BAA-1116
MSDKRRYFGTDGVRGKVGQYPITPDFVLKLGWAAGRVLAKQGTKKVIIGKDTRISGYMLESALEAGLAAAGLKATFTGPMPTPAVAYLTQTFRAEAGIVISASHNPYYDNGIKFFSSEGTKLPDDIELAIEAELDKDIECVESAELGKATRLNDAAGRYIEFCKSTFPSDLSLANVKIVVDCAHGATYHIAPNVFKELGADVVAMGVEPNGTNINAEVGATDVRALQKRVVEEQAHLGLAFDGDGDRIIMVDHLGNKIDGDQIAYIIARDALRRGELKGGVVGTLMTNLGMENGLKQLGIPFVRAAVGDRYVMEQLLAKGWKIGAENSGHVILLDKVTTGDAIVAALQVLASVVGSEMTLHDLSQGMTLYPQVLENVRFVGNSNPLEAQAVLDSVAAVEAELGDKGRVLLRKSGTEPLIRVMVEGEDAELVQSSALKIAEAVKASC

SEQ ID NO: 4348 - protein, 445 aa, Escherichia coli HS; identical to SEQ ID NO: 4341

SEQ ID NO: 4349 - protein, 445 aa, Escherichia coli E24377A; identical to SEQ ID NO: 4341

SEQ ID NO: 4350 - protein, 445 aa, Serratia proteamaculans 568
MSERKYFGTDGIRGKVGDTPITPEFVLKLGWAAGKVLARHGSRKIIIGKDTRISGYMLESALEAGLAAAGLSASFTGPMPTPAVAYLTRTFRAEAGIVISASHNPFYDNGIKFFSIDGAKLPDDVEEAIEAEMEKPLTCVESSELGKASRIIDAAGRYIEFCKGTFPSELSLKGLKIVVDCANGATYHIAPSVLRELGATVIAIGVEPDGMNINEKCGATDVRQLQERVLQEKAHVGLAFDGDGDRVMMVDHLGNKVDGDQILYIIAREGLRQGQLRGGAVGTLMSNMGLELALKQLGIPFARAKVGDRYVLEKLQELGWRIGAENSGHVILLDKTTTGDGIVAGLQVLTAIVRNSMSLHDLCSGMKLLPQILVNVRFAGEHNPLESEEVRKITEQVEVELAGRGRVLLRKSGTEPLIRVMVEGEDEQQVTALAHRIADAVKSAG

SEQ ID NO: 4351 - protein, 446 aa, Yersinia pestis Angola; identical to SEQ ID NO: 4346

SEQ ID NO: 4352 - protein, 445 aa, Escherichia coli C ATCC 8739; identical to SEQ ID NO: 4341

SEQ ID NO: 4353 - protein, 446 aa, Yersinia pseudotuberculosis YPIII; identical to SEQ ID NO: 4346

SEQ ID NO: 4354 - protein, 445 aa, Escherichia coli SMS 3 5
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGSRGRVLLRKSGTEPLIRVMVEGEDEAQVTEFAHRIADAVKAV

SEQ ID NO: 4355 - protein, 445 aa, Shigella boydii CDC 3083 94; identical to SEQ ID NO: 4341

SEQ ID NO: 4356 - protein, 445 aa, Salmonella enterica serovar Newport SL254
MSNRKYFGTDGIRGRVGNAPITPDFVLKLGWAAGKVLARHGSRKIIIGKDTRISGYMLESALEAGLAAAGLSASFTGPMPTPAVAYLTRTFRAEAGIVISASHNPFYDNGIKFFSIDGTKLPDDVEEAIEAEMEKEITCVDSAELGKASRIVDAAGRYIEFCKGTFPNELSLNGLKVVVDCANGATYHIAPNVLRELGATVIAIGCEPNGVNINEEVGATDVRALQARVLAEKADLGIALDGDGDRVIMVDHEGNKVDGDQIMYIIAREGLRQGQLRGGAVGTLMSNMGLELALKQLGIPFARAKVGDRYVLEKLQEKGWRIGAENSGHVILLDKTTTGDGIVAGLQVLAAMVRNHMSLHDLCSGMKMFPQILVNVRYTAGSGDPLENEAVKAVTADVEATLGNRGRVLLRKSGTEPLIRVMVEGEDEAQVTAFAHRIADAVKAV

SEQ ID NO: 4357 - protein, 445 aa, Salmonella enterica serovar Heidelberg SL476; identical to SEQ ID NO: 4356

SEQ ID NO: 4358 - protein, 445 aa, Salmonella enterica serovar Schwarzengrund CVM19633; identical to SEQ ID NO: 4356

SEQ ID NO: 4359 - protein, 445 aa, Salmonella enterica serovar Agona SL483; identical to SEQ ID NO: 4356

SEQ ID NO: 4360 - protein, 445 aa, Salmonella enterica serovar Dublin CT 02021853; identical to SEQ ID NO: 4356

SEQ ID NO: 4361 - protein, 445 aa, Aliivibrio salmonicida LFI1238
MAERKYFGTDGVRGLVGQSPITPEFVMKLGWAAGKVLAKQGTKKVIIGKDTRISGYMLESALEAGLAAAGLKAKFTGPMPTPAVAYLTQTFRAEAGIVISASHNPYYDNGIKFFSSEGTKLPDDVEMAIEAELDKPMTCVESALLGKASRLNDAAGRYIEFCKSTFPKELSLAGVKMVVDCAHGATYHIAPNVFKELGAEIITIGCEPNGTNINHEVGATDVRALQAKVLEEKADFGVAFDGDGDRIIMVDDLGNKVDGDQIAYIIARDALRRGELKGGVVGTLMTNMGMEVALRNLGIPFVRSNVGDRYVMEKLLENNWKIGAENSGHVILLDKVTTGDAIVAALQVIASIVGSKMSLKELCNGMTLFPQVLENIRFVGDNNPLDTELVKAAQADVETKLGDNGRVLLRKSGTEPLIRVMVEGENAELVQQYALQIVDAVKESC

SEQ ID NO: 4362 - protein, 445 aa, Escherichia coli O157 H7 EC4115
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVETALGSRGRVLLRKSGTEPLIRVMVEGEDEAQVTEFAHRIADAVKAV

SEQ ID NO: 4363 - protein, 445 aa, Azotobacter vinelandii DJ
MSKKYFGTDGIRGRVGEYPITPDFMLKLGWAAGKAFRRQGICRVLVGKDTRISGYMFESVLEAGLSAAGADVLLLGPMPTPAIAYLTRTFHAEAGIVISASHNPHYDNGIKFFSGQGTKLPDELELVIEELLDNPMTVVDSAQLGKVSRINDAAGRYIEFCKSSVPTGTSFAGLKMVVDCAHGATYKVAPNVFRELGAEVAVLAAQPNGLNINDRCGSTDIVALQAEVLMQRADLGVAFDGDGDRVLMVDHTGAVVDGDELLFLIARDMHEHGKLQGGVVGTLMSNLGLELALQDMGIPFVRAKVGDRYVMAELLARNWQLGGEGSGHIVCCHHSTTGDGIIAALQVLRALKHRGQRLAEARQGMRKFPQVLVNVRYAGDKDPVGHPVVQEACERVTEQMAGRGRVLLRKSGTEPLVRVMVEGDDESQVRLHADNLAKIVSDVCA

SEQ ID NO: 4364 - protein, 445 aa, Dickeya dadantii Ech703
MSCRKYFGTDGIRGKVGDTPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDEVEEAIEAEMEKPLTCVESAELGRASRIVDAAGRYIEFCKSTFPNELSLNNLKIVVDCANGATYHIAPSVLRELGAKVTVIGCEPDGMNINQQCGATDVESLQERVLRDKADVGLAFDGDGDRLIMVDHLGNKVDGDQILYIIAREALRQGQLRGGAVGTLMSNMGLEVALKQLGIPFARAKVGDRYVLELMQEKGWRMGAENSGHVILLDKTTTGDGIIAGLQVLTAMARNHMNLHDLCSGMKLFPQILVNIRFSGEHDPLEHESVKRITQDVETQLGNKGRVLLRKSGTEPLIRVMVEGEDEVQVTEMAHRIAEAVKSAG

SEQ ID NO: 4365 - protein, 445 aa, Dickeya zeae Ech1591
MSSRKYFGTDGIRGKVGDLPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDEVEEAIEAEMEKPLTCVESAELGRASRIVDAAGRYIEFCKSTFPSELSLNGLKIVVDCANGATYHIAPSVLRELGARVIAIGCEPDGVNINEQCGATDVTQLQARVLSEKADVGLAFDGDGDRLIMVDHQGNKVDGDQILYIIAREALRQGQLRGGAVGTLMSNMGLEVALKQLGVPFARAKVGDRYVLELMQSKGWRLGAENSGHVILLDKTTTGDGIIAGLQVLTAMVRNHMSLHDLCSGMKLFPQILVNVHFSGEGDPLESDAVKQASQDVEAQLAGRGRVLLRKSGTEPLIRVMVEGEDEATVTQMANHIADAVKAAG

SEQ ID NO: 4366 - protein, 445 aa, Pectobacterium carotovorum PC1
MSNRKYFGTDGVRGKVGDTPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDEVEEAIEAELEKPLTCVESAELGKASRIVDAAGRYIEFCKGTFPSELSLNGLKIVVDCANGATYHIAPSVLRELGAKVIAIGCEPDGMNINEECGATDVRQLQARVLAEKADVGLAFDGDGDRLIMVDHLGNKVDGDQILYIIAREGLRQGQLRGGAVGTLMSNMGLEVALKQLGIPFARAKVGDRYVLEMMQAKGWRIGAENSGHVILLDKTTTGDGVIAGLQVLTAIVRNHMSLHDLCSGMKLFPQILVNVRFTGENDPLEDKKVQQITQDVEKELAGRGRVLLRKSGTEPLIRVMVEGEHEETVIALANRIADAVKAAG

SEQ ID NO: 4367 - protein, 281 aa, Bacillus cereus ATCC 10987
MKEKQVFYVNGFLGIIGILILAAIGVFFLVQEIFIGAALTIILAAVLATGIGIVQPNQAKVITFFGNYLGTIRQNGLFLTIPFAFRQTVSLRVENFNSKKLKVNDVDGNPIEIAAVIVYKVVDSAKAMFGVEHYDRFVEIQSETAIRHVATKYPYDNFQDETCITLRGNTEEISEELKRELEARLEIAGVEVLETRLTHLAYATEIAHAMLQRQQAKAVLAARKEIVEGAVKMAKDSIHMLDEEGVLELDDERKANMVNNLLVAIVSDKGAQPVINTGSLY

SEQ ID NO: 4368 - protein, 281 aa, Bacillus anthracis Ames 0581
MKEKQVFYVNGFLGIIGILILAAIGVFFLIQEIFIGAALTIILAAVLATGIGIVQPNQAKVITFFGNYLGTIRQNGLFLTIPFAFRQTVSLRVENFNSKKLKVNDVDGNPIEIAAVIVYKVVDSAKAMFGVEHYDRFVEIQSETAIRHVATKYPYDNFQDETCITLRGNTEEISEELKRELEARLEIAGVEVLETRLTHLAYATEIAHAMLQRQQAKAVLAARKEIVEGAVKMAKDSIHMLDEEGVLELDDERKANMVNNLLVAIVSDKGAQPVINTGSLY

SEQ ID NO: 4369 - protein, 281 aa, Bacillus anthracis str Sterne; identical to SEQ ID NO: 4368

SEQ ID NO: 4370 - protein, 281 aa, Colwellia psychrerythraea 34H
MNENIGFSINGYGIFIALLAAAAFIVSQAAIGNIEIVTVIVFIVTMAAIPGFFMVQPNQAKVMTFFGSYVGSVKACGLRWTIPLFMRKNISLRIRNFESNQMKVNDNHGNPIEIATVVVWSVDDTAEASFEVDDYISFVNIQSESALRNMAISYPYDQHEGDEIALRSHPQEVSEALKIEIQQRLGKAGVRVHEARISHLAYAPEIANAMLQRQQASAIIAARRLIVDGAVGMVEMALSQLSEKGIVELDEERKAAMVSNLLVVLCSDKSTQPVVNTGSLY

SEQ ID NO: 4371 - protein, 313 aa, Thermobifida fusca YX
MAREAAVAVENLETQVEERLIEGASGIPVLIFSLVMMLAGAGGAIGGVVRINTLDAADVSAVALIVVGALLFLAGLFLLCGLTMIDPNQARVVQLFGRYIGTLRIDGLRWVNPLTTRKPVSTRIRNHETAVMKVNDADGSPIEIAAVVVWQVEDTARAVFEVDDFVQFVSTQTEAAVRHIANNYPYDNHEGTDRLSLRDNADEITEKLSAELAERVASAGVRIIESRLTHLAYAPEIAQAMLQRQQAGAVIAARQQIVESAVGMVELALNRLAEQGVVDLDEERRAAMVSNLLVVLCGDRPTQPVVNTGTLYS

SEQ ID NO: 4372 - protein, 302 aa, Novosphingobium aromaticivorans DSM 12444
MSDSKTHSASTETAAWSTSGYFMLILMLVLIGLTAARVVGFAGGNPGEDEVPGFVATIAALPVAIVFIASGFYMIQPNQAAAITLFGSYRGTDRNHGLRWVWPWMAKTRISVRANNVVSEKLKVNDLRGNPIEIAANVVWRVSDTAQALFDVDDYKAFVFVQIESAVRSIGSRYPYDDIEHHEVTLRGHHDQINDELRTELNARLVLAGITVDECGLTHLAYAPEIAGAMLRRQQAEAVISARRKLVEGAVSMVEMALTQLSEKNVVELDDERRAAMVSNLMVVLCGERDTQPVVNTGTLYQ

SEQ ID NO: 4373 - protein, 305 aa, Deinococcus geothermalis DSM 11300
MNKLEQAPLTVGPEGGVSPASGVASVERRAFGLPGVPAVLLWLVLVALAFWVTLSGLSIGLGFVLGLLALFTLLGFFVVQPNQAKVLTLFGRYVGTERRNGFYWTNPFTVRQNVSLRIRNFNSERLKVNDQTGNPIEIAAVIVWRVVDTARAVFDVEDYAEFVAIQSETALRHLAAGYPYDDYDGKSLSLRGNPDEVSEALARELATRLRHAGVEVLEARLSHLAYSPEIAGAMLQRQQASAIIAARQQIVQGAVGMVEMALTQLSEQDIVQLDEERKAQMVSNLLVVLTSERGTQPVVNAGSLY

SEQ ID NO: 4374 - protein, 300 aa, Sphingopyxis alaskensis RB2256
MVESGAPALNRSRETRANTQSGYWMLFIWLVLLGIAVWAAITNANADVVMAWKWIVAATAAVVGTLILCGFYLINPNEAAAIQLFGAYKGTDRQEGLRWVLPWLTRKKIAVRANNVISDKIKVNDLRGNPIEMAAQVVWRVTDTAQALFDVDDYKEFVMAQIEAAVRSIGSRYPYDDIEHQEVTLRGNHEEVGAELRKALIERLTVAGITVDECGLTHLAYAPEIAGAMLRRQQAEAVIAARKKLVEGAVTMVEMALQHLSDKKVVDLDDERKAAMVSNLMVVLCGERDTQPVVNAGSLY

SEQ ID NO: 4375 - protein, 281 aa, Shewanella amazonensis SB2B
MVQEKRGFSLSGYLVFVVLIALHLVFFAMMATTSQYGGVIGNVLTALCWPGFFMVQPNQAKVLTLFGSYVGSVRNTGLRWTIPLFAKRTISLRIRNFESAKIKVNDNLGNPIEIATIVVWSVTDSAEAVFEVDDYESYVSIQSEAALRNMASSYAYDPQDENEVALRSHPQAIADKLKQEIQERLGRAGVTVLEARISHLAYAQEIASAMLQRQQATAIIAARAKIVEGAVGMVEMALERLKAQNVVELDEERKAVMVSNLLVVLCGDKSTQPVVNTGSLY

SEQ ID NO: 4376 - protein, 300 aa, Sphingomonas wittichii RW1
MDESSFVELQASRERSAATASGWFMLFVALVLLGIAIATVVGLIANEGPLSMLPVAVLAVLGFVLSISGFYVLQPNQAAAILLFGAYRGTDRATGLRWVWPWMSRRLISVRANNVVSEALKVNDRRGNPIEIAAQVVWRVSDTAQALFDIDDYRDFVIVQIEAAVRTIGSAYAYDDMGPEEITLRGHHEEVNAALKTELKARLAVAGLTVDECGLTHLAYAPEIAGAMLRRQQAEAVVAARQTLVSGAVSMVELALDQLSTRGVVELDDERRAAMVSNLMVVLCGERDTQPIVNAGTLYQ

SEQ ID NO: 4377 - protein, 281 aa, Bacillus cereus cytotoxis NVH 391-98
MKEKQVFYVNGFLGIIGLLVLAGIGVFCLVQEVFIVAALCIILAAILATGIGIVPPNQAKVITFFGNYLGTIRENGLFLTIPLSFRQTVSLRVENFNSKKLKVNDIDGNPVEIAAVVVYKVVDSAKAIFGVEHYDEFVEIQSETAIRHVATKYPYDNFQDDKCITLRGNAEEISEELKRELEARLEIAGVEVLETRLTHLAYATEIAHAMLQRQQAKAVLAARKEIVEGAVQMAKDSIQKLDEEGILDLDDERKANMVNNLLVAIVSDKGAQPVINTGSLY

SEQ ID NO: 4378 - protein, 315 aa, Frankia EAN1pec
MSTETPQVDVEHVVVDMPEPSVREHHAKDHSGLLALLASLLGMLACLALGIAGIVVAADHSAPVGAVLIVVGVLGLIAAFFALCGLTAVAPGEARVVALFGRYVGTIRTTGLRWVNPFTTRKKVSTRIRNHESGVAKVNDADGNPIEIAAVVVWQVKDTAQAVFEVDDFVEFVAIQSETAVRHIATSYPYDAAPEVMSLRDNAEEITAKLSLEIAARVASAGVHVIESRITRLAYAPEIAQAMLRRQQAGAVVAARSRIVEGAVGMVEAALERLDRENIIELDEERKATMVSNLLVVLCSEQSTQPVINAGSLYT

SEQ ID NO: 4379 - protein, 281 aa, Bacillus weihenstephanensis KBAB4
MKEKQVFYVNGFLGVIGILVLAAIGVFCLVQEMFVIAILALILASVLATGIGIVQPNQAKVITFFGSYLGTIRQNGLFLTIPFAFRQTVSLRVENFNSKKLKVNDVEGNPIEIAAVIVYKVVDSAKAMFGVEHYDRFVEIQSETAIRHVATKYPYDNFQDETCITLRGNTEEISEELKRELEARLEIAGVEVLETRLTHLAYATEIAHAMLQRQQAKAVLAARKEIVEGAVKMAKDSIHMLDEEGVLELDDERKANMVNNLLVAIVSDKGAQPVINTGSLY

SEQ ID NO: 4380 - protein, 293 aa, Caulobacter K31
MSDAPNINRSAERAFGGIGGGLPLLSLPLLIAAAVFAFAAAQVMWGVIGSLMIVLFVLVACGFYSLQPNEAYVITLFGTYMGTDRRTGLRWVLPWYGRKKISLRVRNVTSERLKVNDKRGNPIEIAANIVWRVSDTAQALFDVDDYIAFVNIQIETALRETASHYAYDHDDSGEPTLRADADQVGEGLRTDLRGRTAVAGVSIDETHLMHLAYAPEIAGTMLKRQQAEAVLAARRTIVAGAVGMVEHALQQLSDRGVVTLDEERKAAMVSNLLVVLCADREAQPVVNTGTLYG

SEQ ID NO: 4381 - protein, 303 aa, Opitutus terrae PB90 1
MSTSATHPTPDQRAVSQEKPALAASGWPALFVVLLLYLASIGLIIGGVSVLRGPAIVLGVLLLIVAIIGSCGFFMLQPNSAAVLLLFGDYRGTVRKTGFLFANPFYQKLKISLRTRNFNGEKLKVNDKRGNPIEIAAVVVWRVRDTAQAMFDVDNYENYVVVQSESAVRHVATSYAYDDAEHNELTLRAGGEEVSAALLRELQERLSRAGVEVQEARLTHLAYAPEIAQAMLRRQQAEAVIAARQKIVQGAVSMVEMALNELSSKKVVALDEERKAAMVSNLLVVLCGESEAHPVINTGTLYH

SEQ ID NO: 4382 - protein, 293 aa, Stenotrophomonas maltophilia R551 3
MKEKSLSSLNGLGTLAGALLVALAGGALFVLGVAAKASTGSPNLLLMLAGILVAALAIFALAGLYTVQPNQAAVLSLFGKYVGTVKDNGLRWNNPFYSKRRVSQRVRNFESGKLKVNELDGSPIEIAAVIVWQVVDASEAVYNVDDYESFVHIQSESALRAMATSYPYDQHEEGQLALRSHASEISQHLKNELAERLADAGVQVIDARISHLAYAAEIAQAMLQRQQANAVIAARTRIVAGAVGMVEMALAELQKNGVVQLDEERKAHMVSNLLTVLCSDRGTQPIVNAGSLY

SEQ ID NO: 4383 - protein, 282 aa, Alteromonas macleodii  Deep ecotype
MQEKNGFSINGYLMIGVLLLAQSAAFFYAVGGNAEAGGVLSLLVASLWSGFFMVQPNQAKVMTFFGSYVGTVSDVGLRWTIPFFRKVNISLRIRNFESAKIKVNDNQGNPIEIASIVVWKVTDTAEAVFDVDDYESFVRIQSESAIRNMASSFPYDPRDDEQAEVALRSHPLEISERLQQEIQARLAKAGITILESRISHLAYAQEIASAMLQRQQASAIVAARKQIVDGAVGTVEMALQRLNEKGVVELDEERKATMISNLLVVLCGDKSTQPVINTGTIY

SEQ ID NO: 4384 - protein, 281 aa, Bacillus cereus AH187; identical to SEQ ID NO: 4367

SEQ ID NO: 4385 - protein, 281 aa, Bacillus cereus B4264
MKEKQVFYVNGFLGIIGILILAAIGVFFLAQEIFIGAALTIILAAVLATGIGIVQPNQAKVITFFGNYLGTIRQNGLFLTIPFAFRQTVSLRVENFNSKKLKVNDVDGNPIEIAAVIVYKVVDSAKAMFGVEHYDRFVEIQSETAIRHVATKYPYDNFQDETCVTLRGNTEEISEELKRELEARLEIAGVEVLETRLTHLAYATEIAHAMLQRQQAKAVLAARKEIVEGAVKMAKDSIHMLDEEGVLELDDERKANMVNNLLVAIVSDKGAQPVINTGSLY

SEQ ID NO: 4386 - protein, 281 aa, Bacillus cereus G9842
MKEKQVFYVNGFLGIIGILILAAIGVFFLAQEIFIGAALTIVLAAILATGIGIVQPNQAKVITFFGNYLGTIRQNGLFLTIPFAFRQTVSLRVENFNSKKLKVNDVEGNPIEIAAVIVYKVVDSAKAMFGVEHYDRFVEIQSETAIRHVATKYPYDNFQDETCITLRGNTEEISEELKRELEARLEIAGVEVLETRLTHLAYATEIAHAMLQRQQAKAVLAARKEIVEGAVKMAKDSIHMLDEEGVLELDDERKANMVNNLLVAIVSDKGAQPVINTGSLY

SEQ ID NO: 4387 - protein, 281 aa, Bacillus cereus AH820; identical to SEQ ID NO: 4368

SEQ ID NO: 4388 - protein, 280 aa, Desulfitobacterium hafniense DCB 2
MKEKKAWVLNGYLAVVVVLASLIGGTALLIQTQFTLGIALILIGVILSSGIVVIQPNKSHVITFFGSYIGTIREPGLWLTIPLSTRKSVSLRVRNFNSKTLKVNDVEGNPIEIAAVIVFRVVDTAKAIFDVDRYEQFVEIQSETALRHVTSRYPYDNFEKDGYSLRGHSEEVARELSLELQERLKVAGVEVMEARLTHLAYSTEIAGAMLQRQQANAILDARQIIVEGAMGMVQMAVERLETNNVVQLDEERKAAMINNLLVAIVSDRSAQPVINTGTLY

SEQ ID NO: 4389 - protein, 289 aa, Clostridium cellulolyticum H10
MQEVKGKTYSGGLTLLMTMLVLILSVVTFIVGVNMEFAVLVILGLVLFTGFIFIIPGFFTIQPNQAMVLVLFGKYVGTVKNEGWHWANPFYSKKKISLRSRNINGDKIKVNDEMGNPIEIAAVIVWRVENTAEAIFDVDNYVDYVNVQSESALRHLAGMYPYDNTEDTHTISLRGSTDEVAEALKNELQQRLGKAGVIVEEARLSHLAYAPEIAAAMLQRQQAAAIIAARQKIVEGAVGMVQMALTKLSENEIVELDEERKAAMVSNLLVVLCGEKNTQPVINTGTLHN

SEQ ID NO: 4390 - protein, 305 aa, Actinosynnema mirum DSM 43827
MSVTTSEVQARMPAPAVREHELTGVGGAIVAVVGFLAVLGGAGLVALGVAQAANIPLILVGALVSAVAMVVLGGLFTVAPGEARVVQFLGRYTGTVRADGLRWTNPFTTKAKVSTRIRNHETTTLKVNDADGNPIEIAAVVVWQVDDTARAMFEVDDFVQFVATQTETAVRHIATSYPYDNHDEAGLSLRENADEITETLSVEIAARVQAAGVKVIESRLTHLAYAPEIAQAMLQRQQAGAVVAARSRIVEGAVGMVQLALDRLAEEDVVELDEERKAAMVSNLLVVLCGDKATQPVVNTGSLYH

SEQ ID NO: 4391 - protein, 281 aa, Geobacillus WCH70
MKETKAWYMNGFAGIIGIAVLVAVAIISLLQQLVIIAALFVVAAIVLASGITIVQPNQAKVLIFFGRYLGTIRDSGLFLTVPLTIRQNVSLRVRNFTSKKLKVNDVQGNPIEIAAVIVFRVIDSAKAIFDVDDYEEFVEIQSEAAIRHVATKYPYDTFTADDEITLRGNADIISDVLANELQERLKVAGVEVIEARLTHLAYSPEIASAMLQRQQAAAILAARKKIVEGAVSMAQMAIEQLDKEGILELDDERKANMVNNLMVAIVSERATQPVINTGSLY

SEQ ID NO: 4392 - protein, 310 aa, Eggerthella lenta DSM 2243
MLALLLAVVALCVALIVTGATMAPPDDAPITTATQTLGIALLVAGIVAVCVAPVLLLMGFFTIQPNQARVLILFGDYKGTVRDEGFHWANPFYSRNAGSTVDVATGKPIAKSTKVSLRARTYNGEHLKVNDKCGNPIEIADVIVWRVENTAKALFDVDDYNTYVHTQSETALRHVATTYAYDQMPGEPEDEITLRSNIEEVSEALKEELAVRLEKAGVVIDDARLTHLAYAPEIAQAMLRRQQAEAVIAAREKIVQGAVSMVDMALAELSAKNVVDLDDERKAAMVSNLMVVLCGESDAQPVLNTGTLYQ

SEQ ID NO: 4393 - protein, 287 aa, Dyadobacter fermentans DSM 18053
MIEKELRSMSGYLLFVIGLLLLLGGFVNIVSSGQGLTSVLIIAAALIILIGLTVINPNEGVVTTFFGDYMGTMKQNGLRWVNPLFRRKKISLRARNLNGQKLKVNDKLGNPIEIAAVVVWRVGDTAKASFEVDDYVKYVEIQSEAAVRHLAGIYAYDTMEDEEANIQEVTLRDGSGKINEMLEAELTERLSRAGIDVLEARISHLAYAPEIAGAMLQRQQASAVVAARRQIVNGAVGMVDMALAMLSDKQIVELDEERKAAMVSNLLVVLCGEKAATPILNAGTLYP

SEQ ID NO: 4394 - protein, 291 aa, Chitinophaga pinensis DSM 2588
MEKIVKPVSGYLAIVLGIIAFLAAVYLFLVGTQTGTGIFTLLGIVFFIAFVFTVKGIIIVNPNHSRVLTFFGKYIGTVKENGLMWVNPFYKTAHLSLRAHNHNGQQLKVNDKMGNPIEIAAVTVWRVTDTYKSSFEVDNYLQYVNVQSEAAVRHLAVSYSYDRMEDTDVDTDITLRDGGDKVNEMLEKELNERLSPAGITVLEARISHLAYAPEIAGAMLQRQQATAIVAARTKIVEGAVGMVELALDRLSQKEIVVLDEERKAAMVSNLLVVLCGESKVAPVVNTGTLHQ

SEQ ID NO: 4395 - protein, 309 aa, Catenulispora acidiphila DSM 44928
MTTDQGGQEPTPVAEAAEVQAAEVPISEQSARDVSGWGALGAVIVLAGIAIAVAALTMDATRAWAVIPGGAGLFLLVGLTPVSPGQARVVTLFGQYVGTIRTTGLRWVNPLTSRRQVSTRVINSETATLKVNDADGNPVEIAAVVVWQVRDTAKAVYAVDDFNDFVAIQTETAVRHIAGGYPYDARTEGQVSLRQNADEITARMSEEIAERVVLAGINVIESRITRLSYAPEIAQAMLRRQQADAVVAARQRLVQGAVGMVRSALDALSEEDIVELDEERKAAMVSNLLVVLCSEQATQPVVNTGTLYQ

SEQ ID NO: 4396 - protein, 352 aa, Anaerococcus prevotii DSM 20548
MDKLEKKLENSDNVEEKILKAKKNGLLMLLVYFILLAGAILTIAVNGNIIDSGNYTSLNIVFLVIGIVFVALGWIMLLGLKLLKPQESLVLTLFGKYIGTIKGEGFYYVNPFVSAVNPAANTKLGQSGDVSDGIKIFDKSNSYQSTNKKISLKVMTLNNSKQKINDYLGNPVEIGIAVMWKVNDTAKAVFNVDNYKEYLSLQTDTALRNIVRQYPYDVNPHYQIDTTGDGEPDDGSLRGSSEIVARRIKEEIQKRVEFAGLEIIEARITHLSYSSEIAAAMLQRQQASALIDARAMIVDGAVGMVEMALAKLEENGVVDLDEERKAAMVSNLLVVLCGNHEASPIVNTGSLY

SEQ ID NO: 4397 - protein, 328 aa, Atopobium parvulum DSM 20469
MSTEKIIKSKSGWLFLLIAIALFVIAVLFLANFVISAIAADRNPRLEPSVPSIIGALVFFFAGLFVSSGLFSLQPGQARVCVLFGKYIGTVKDEGLRWANPYYAKTLSAGNLSTLVTVGDTSSVNVHTSIISTRARTLNGDVLKVNDRMGNPIEIAEVVVWRVSDTAKALFDVDDYDSYVAMQAETALRHVASIYSYDHMEDESESNTAITLRSNIEEVSEALQSELSRNLSVAGITVDDARLTHLSYAPEIAQAMLRRQQAEAIIAARKKIVEGAVSMVDMALTQLSENGVVEFDEDRKAVMASNLMVVLCGESEAQPVLNTGSLQQ

SEQ ID NO: 4398 - protein, 280 aa, Desulfotomaculum acetoxidans DSM 771
MQERSAWKINGFLALLLLLLLLAAVLSSLVFLRIGIAVILIILFVVLSAGMVIVQPNQAKAVTFFGKYMGSINTNGIWLTIPFSQHKKVSLRVRNFNSAKLKVNDVEGNPIEIAAVIVFRVVDSAKALFDVDNYEQFVEIQSETALRHVATKYPYDNFEEAGYSLRGNTEEVASELAKELQSRLTLAGVEVTEARLTHLAYATEIASAMLQRQQANAIIAARQKIVEGAVGMAQMAIEKLLKEGTVSLDDERKIAMINNLMVAIVSEKAAQPVINAGSLY

SEQ ID NO: 4399 - protein, 399 aa, Thermobifida fusca YX
MTERVVLAYSGGLDTSVAIGWIAEETGAEVIAVAIDCGQGGEDMEVIRQRALACGAVEAVIADAKEEFANDYCVPAIQANALYMDRYPLVSALSRPLIVKHLAEAARYHGATMVAHGCTGKGNDQVRFEAGLAALFPELKVLAPVRDSGMTRDKAIAFAEEKGLPIDVTKKSPYSIDQNLFGRAVETGFLEDIWNGPIEDIYDYTQNPAEPREPDEVVITFTAGVPTALDGKELSPLEIIQELNRRAGAQGVGRIDMVEDRLVGIKSREVYEAPGAITLITAHQELENVTVERELARFKRWVDQRWGELVYDGLWFSPLKNALDKFILEANKHVTGDIRMVLHGGRAVVTGRRSEASLYDYHLATYDSGDTYDQSLARGFIDIWSMPAKIANMRDRRLS

SEQ ID NO: 4400 - protein, 399 aa, Chlorobium chlorochromatii CaD3
MSKEKIAIAYSGGLDTSVMIKWLKDKYDADIVAVTGNLGQQKEIENLESKALATGASSFHFVDLRTEFVEEYIWRALKAGALYEDVYPLATALGRPLLAKALVDVAVAENCTMLAHGCTGKGNDQVRFEVTFASLAPHMKILAPLRVWEFTSREAEIAYAMEHNIPVSATKKNPYSVDENIWGISIECGVLEDPMIAPPEDAYQITTSPEKAPDTPAVVELEFVEGVPVAMDGKKMNGLDIIVQLNTIGAAHGIGRLDMIENRVVGIKSREIYEAPAATILHFAHRELERLTLEKSVFQYKKNISQDYANIIYNGTWFSPLRTSLDAFVNETQKPVTGLVRLKLYKGNVTLLGRTSPYSLYNEALATYTEADTFNHKAAEGFIHLYGLGLKTFNQIHKG

SEQ ID NO: 4401 - protein, 400 aa, Frankia CcI3
MTERVVLAYSGGLDTSVAIGWIGAETGADVVALAVDVGQGGEDLEAIRQRALTCGAVESIVVDAREEFAESFVAPAIKSNALYMDRYPLISSLSRPVIVRHLVAAAREHGADAIAHGCTGKGNDQVRFEVGVAALAPGLSVLAPVRDSGMTRDKAIAFAEERGLPIDVSKKSPYSIDQNLWGRTAECGVLEDPWAQPPEDVFVYSADPTVARIPDEVTISFIDGVPVGLDGRSLPLADLVAELNVRAGAHGVGRIDLIEDRLVGIKSREIYECPAAITLLTAHRDLEDLTLERDVARFKRGIDQRWGEIVYDGLWYSPLKSALDAFVDSASAGVSGEVRIRLVGGVAQVVGRRSPASLYDHALATYDAGDQFDQRDARGFIELWGLPTKVWAAREQRLNP

SEQ ID NO: 4402 - protein, 401 aa, Acidothermus cellulolyticus 11B
MTERVVLAYSGGLDTSVCIGWITEQTGAEVIAVAVDVGQGEDMEVIRKRALACGAVEAEVIDARAEFAADYCVPALRANALYMGRYPLISALSRPLIDKHLVAAAHRHKATAVAHGSTGKGNDQVRFEVGIGSLDPELRILAPVRDSGMTRDRAIAFAEAKGLPIEVTKKSPYSIDANLWGRAIETGFLEDIWNAPIEEIYAYTADPAVPRPADEVVVSFSDGVPVAIDGRPVSPLEAITELNRRAGAQGVGRIDLVEDRLVGIKSREVYEAPGAVALITAHQELENVTVERDLARFKRLVDQRWAELVYDGLWFSPLKRALDAFIDTAQRHVTGDIRLVLHGGRAVVTGRRSPQALYDYRLATYDTGDLFDQSLAKGFVELWGLPSRTAARRDLAAGAGE

SEQ ID NO: 4403 - protein, 400 aa, Mycobacterium gilvum PYR-GCK
MSERVILAYSGGLDTSVAISWIGKETGKEVVAVAIDLGQGGEDMEVVRQRAIDCGAVEAVVVDARDEFAEQYCLPAIQSNALYMDRYPLVSALSRPLIVKHLVDAAREHGGGIVAHGCTGKGNDQVRFEVGFASLAPDLKVLAPVRDYAWTREKAIAFAEENAIPINVTKRSPFSIDQNVWGRAVETGFLEHLWNAPTKDVYDYTEDPTVNWSSPDEVVVGFEKGVPVSIDGNPVTVLQAIEQLNERAGAQGVGRLDVVEDRLVGIKSREIYEAPGAMVLITAHTELEHVTLERELGRYKRLTDQKWGELVYDGLWFSPLKSALESFVANTQEHVSGEIRLVLHGGHIAVNGRRSSESLYDFNLATYDEGDTFDQSSAKGFVHVHGLSSSLSARRDLAGK

SEQ ID NO: 4404 - protein, 402 aa, Salinispora tropica CNB-440
MTERVVLAYSGGLDTSVAIPYLAEQTGAEVIAVAVDVGQGGEDLEAIRQRALDCGAVESELVDAREEFAAEYCLPAVRANSLYMDRYPLVSALSRPLIVKHLVAAARKHGGTIVSHGCTGKGNDQVRFEVGLGALAPDLRIVAPARDFAWTRDKAIAFAEEKGLPIDVSAKSPYSIDQNLWGRAVETGFLEDIWNPPIEDLYSYTADPAEPRDADEVVITFDAGNPVAIDGETVTPYQAILELNRRAGAQGVGRLDMVEDRLVGIKSREVYEAPGAIALITAHQELEAVTVERDLARFKRSVDQRWGELVYDGLWFSPLKDALDAFVDDAQQHVSGEVRLTLHGGRVTATGRRSEASLYDFGMATYDTGDTFDQSLAKGFVQLWGLPSKLSAARDARLGGAR

SEQ ID NO: 4405 - protein, 398 aa, Mycobacterium tuberculosis F11
MSERVILAYSGGLDTSVAISWIGKETGREVVAVAIDLGQGGEHMDVIRQRALDCGAVEAVVVDARDEFAEGYCLPTVLNNALYMDRYPLVSAISRPLIVKHLVAAAREHGGGIVAHGCTGKGNDQVRFEVGFASLAPDLEVLAPVRDYAWTREKAIAFAEENAIPINVTKRSPFSIDQNVWGRAVETGFLEHLWNAPTKDIYAYTEDPTINWGVPDEVIVGFERGVPVSVDGKPVSMLAAIEELNRRAGAQGVGRLDVVEDRLVGIKSREIYEAPGAMVLITAHTELEHVTLERELGRFKRQTDQRWAELVYDGLWYSPLKAALEAFVAKTQEHVSGEVRLVLHGGHIAVNGRRSAESLYDFNLATYDEGDSFDQSAARGFVYVHGLSSKLAARRDLR

SEQ ID NO: 4406 - protein, 400 aa, Frankia EAN1pec
MTERVVLAYSGGLDTSVAIGWIGAETGAEVIALAVDVGQGGEDLEAIRQRAFTCGAVESIVVDAREEFAASFVAPAIRANALYMDRYPLISSLSRPIIVKHLVEAAKQHGADAISHGCTGKGNDQVRFEVGVMALAPGLRVLAPVRDSGMTRDKAIAFAEERGLPIDVSKKSPYSIDQNLWGRTAECGVLEDPWAQPPEDVFVYTADPTVSRPSDEVTISFTDGLPTGLDGRALSLVDLVAELNTRAGAQGVGRIDMIEDRLVGIKSREIYECPAAITLLTAHRDLEDLTLERDVARFKRGIDQRWGEIVYDGLWFSPLRAALDAFVDSASVGVTGDVRIRLAGGVAQVVGRRSPGSLYDHALATYDAGDQFDQTDARGFIELWGLPTKVWAAREQRLNP

SEQ ID NO: 4407 - protein, 402 aa, Chlorobium phaeobacteroides BS1
MKREKIALAYSGGLDTSVMIKWLKDKYDADIIAVTGNLGQEKEIENLEQKAFDTGASGFSFLDLRKEFVENYIWPALKAGALYEEVYPLATALGRPLLAKALVDVALSEDCTMIAHGCTGKGNDQVRFEVTFASLAPHLKVLAPLREWEFNSREAEMAYAEKHGIPVSATKKSPYSIDENIWGISIECGVLEDPMVAPPEDAYQITTSPEKAPDNAAVIDIEFEQGVPVALDGRKMEGLDLIVELNKHGAAHGVGRLDMIENRVVGIKSREIYEAPAATILHFAHRELERLTLEKTVFQYKNTISQDYANLIYNGTWFSPMREALDGFVDATQKHVTGLVRVKLFKGSVTLLGRTSPWSLYNEELATYTEADTFNHKAAEGFIHLYGLGLKTYSEVQANNRK

SEQ ID NO: 4408 - protein, 413 aa, Beutenbergia cavernae DSM 12333
MSSTSSKRVVLAYSGGLDTSVAIGWIGEATGAEVIAVAVDVGQGGEDLDVIRQRALDCGAVEAYVADARDEFATEYCMPALAANAMYLDRYPLVSALSRPVIVKHLVRAARQFGADTVAHGCTGKGNDQVRFEVGITSLAPDLACLAPVRDLALTRDKAIAYANEHALPIETTKNNPFSIDQNVWGRAVETGFLEDIWNSPTKDVYSYTDDPTFPPVEDEVVITFEQGVPVAIDGVAVTPLRAIQEMNRRAGAQGIGRIDIVEDRLVGIKSREVYEAPGAIALIAAHAELENVTVEREQARFKRTVGQRWTELVYDGQWFSPLKHSLDAFIADTQRYVSGDIRMTLHGGRAVVTGRRSDTSLYDFSLATYDTGDAFDQSNAKGFIEIFGLTSKLAAARDVAFGNGPDLGTQQL

SEQ ID NO: 4409 - protein, 464 aa, Eggerthella lenta DSM 2243
MAQQQTQQTQQKDKAVLAYSGGLDTSVCIKWLQEEKNLDVIAVVGDVGQEHEGLEKIKQKALKTGAVECLVVDMRDVFAQDFLSKALAANALYENKYPLVSALSRPLISKHLVDAAHKFGAKYIAHGCTGKGNDQVRFEASILMLDPDIEIIAPVREWDLHTRSEEMEWAQAHGIEVPTTKKSPYSIDDNLWGRAIECGVLEDPWMEPPTDIYTMTVDPTEAPDEPQYVELEFARGLPYAIDGSQKSFLGIIYALNEIAGKHGYGRIDMIENRLVGVKSRECYEVPGALSLIQAHKALEDLVLEREVLHFKLGMEQEWAKCVYNGQWFSPLKEAVDAFLASTQRCVAGTVKLKFYKGSCTVVGRKSAYSLYDYALATYDKDDSFDHAAAKGFIQLQTLSAKTWASNRRQEGAPAELFDAQKKVGPLTKGAYEDVTPVWKQVAEAENAAVVEEAEAALQGAAEKA

SEQ ID NO: 4410 - protein, 402 aa, Saccharomonospora viridis DSM 43017
MTERVVLAYSGGLDTSVAIGWIAEETGAEVVAVAVDVGQGGEDMETIRKRALECGAVEAVVSDAKDEFAEEYCLPALQANALYMDRYPLVSALSRPLIVKHLVRAAERYGATTVAHGCTGKGNDQVRFEVGIGALAPDLKVIAPVRDFAWTREKAISWAEERNLPIDVTKKSPFSIDQNVWGRAVETGVLEDLWNEPPKEVYSYTQDPTVHFQAPDEVIITFEKGVPVAIDGKKVTVLEAIQEMNQRAGAHGIGRLDMVEDRLVGIKSREVYEAPGAIALITAHQELENVTVERDLARFKRQVEQRWGELVYDGLWFSPLKDALDGFIAKAQEHVSGDIRMVLHGGTATVTGRRSDESLYDFNLATYDEGDTFDQSLAKGFVQLWGLPSKIAAKRQQNKNNN

SEQ ID NO: 4411 - protein, 413 aa, Jonesia denitrificans DSM 20603
MTERIVLAYSGGLDTSVAIGWIAEATGAEVIAVAVDVGQGGEDLEVIRQRALDCGAVEAYIADARDEFAGEYCMPALQANALYLDRYPLVSALSRPTIVKHLVRAARQFDATTVAHGCTGKGNDQVRFEVGITSLAPDLKCLAPVRDLALTRDKAIAYAEKNSLPIATTKHNPFSIDQNVWGRAVETGFLEDIWNAPTKDVYNYTDDPTFPPVADEVVITFDRGVPVALDGVAVTPLQAIQEMNRRAGAQGVGRIDIVEDRLVGIKSREIYEAPGAMALIAAHQELENVTLEREQARFKRTVEQRWTELVYDGMWFSPLKRSLDTFIADTQRYVSGDIRMTLHGGRATVTGRRSDASLYDFNLATYDEGDAFDQSQARGFIEIFGLTAKLAAARDVKFGNGVDLSGQSVATQE

SEQ ID NO: 4412 - protein, 531 aa, Methanosarcina barkeri fusaro
MQHHIDSFNKFIDYGLQKIIDEQKIIETDIEDTYLKLGKIRVEHPVVKEADGAIEKLYPNEARLRNLSYSGPLYLEMSVVKEGIESEPMEAKIGQLPIMVKSKICNLPGLSETEKVRYGEDPLDPGGYFIIGGTERVVMTLEDLAPNKILVEYGERYGDTIEVAKVFSQKRGYRALVIVERGRKSLLEVSFPSISGRVFFITLMRALGIVTDEDIVNAVSSDPEIIKFMLENLEEAEVETQDEAIEKIGARVAAGQAKEYQIKRANYVIDRYLFPHLGNDMKDRISKAHFLARMAESCFELALGKRSEDDKDHYANKRLKLAGDLMEDLFRVSFNRLARDIKYQLERANMRNRELNVATIVRADVLTDRLQHPLATGNWVGGRTGVSQLLDRNDYISTLSHLRRVISPLSRAQPHFEARDLHATQWGRLCPSETPEGPNCGLVKNFAEMVELSTGIEDIDGIKKILHDLNVERVVVKVPELPSKMKETLLDEFGEEIVEEYEEPSESESKFKDDEFYDYSDMDDSGSMFGD

SEQ ID NO: 4413 - protein, 518 aa, Methanospirillum hungatei JF-1
MIDLSILSQAYFSREHVARHQLDSYNHFLLNNLQKVVDEQRVIETDIETRGKGNEPVSVELGDLKILKPLVREADGSQSELYPGEARLRNITYAAPIQLDLTLVQGGVRHEPVTATIGQLPIMVGSVACNLYGMTDEERTSHGEDPLDPGGYFIVNGTERVLMTLEDLASNKIMTEYTERYNERIYVAKVFSQFRGYRALVVVERNRKNLLEVTFPSVAGHLRFVDMMRALGMTSDADIVRAVSTDEEILTFMMQNLEESECETVECGVMYVGKKLAPNQTRDYQRKRAEFVLDNYLLPHLNYLMPRTVNEEDEECMKIVHSVRLAKAHFLGRMAEACFDLVLDRRRIDDKDHYANKRLKLAGDLMEDLFRISLNRLTRDVKYQLERASMRHRDLSIATAVRADVLTERLLHPLATGNWVGGRTGVSQLLDRVDHMSVLSHLRRVISPLSRSQPHFEARDLHPTQWGRICPSETPEGPNCGLVKNFAQMVEISKGVHSDEEIIRMLYGMGVERIGVEI

SEQ ID NO: 4414 - protein, 542 aa, Methanococcoides burtonii DSM 6242
MQHHIDSYNKFVKHGLQKIINEQGIIETDLEDIYVKLGKIRVEHPVVKEADGAIEKLYPNEARLRNLSYSAPLFLEMSVVQNGEEGEPKEAKVGQLPVMIKSDICNLVGISDAEMVQHGEDPLDPGGYFIVNGTERVVMTLEDLAPNKILTELGERYGDSIEVSKVFSQRRGYRALVVVERGRKSLLEISFPSISGRINFITLMRALGVETDEDVAKIVSTDPEIMKFMFENLEEAEVFTIEDAIEKIGGRVASGQAREYQMKRANYVIDRYLLPHLGNDPADRIPKAHFLGRMAESCFELALKRRSDDDKDHYSNKRLKLTGDLMEDLFRVAFNRLARDVKYQLERANMRNRELNVATLVRADVLTDRLQHPLATGNWVGGRSGVSQLLDRTDYISTLSHLRRVISPLSRAQPHFEARDLHPTQWGRLCPSETPEGPNCGLVKNFAQMVELSTGLEDKDVVKNVLYGLGVAHVELYVPEIILELAADVDYEEDLELAPHTDTDEPAEKVEVKAEPGPNDVDYHEFMDENADPVGGDETEAQ

SEQ ID NO: 4415 - protein, 496 aa, Methanosaeta thermophila PT
MLDRSVLYRAYFTKDKLVHHHINSFNEFIDRGLQKVIDEVRIIETNIENTYVKLGKIRVEKPVVMEADGSVERLYPNDARLRNLTYASPIKLEMSIVDRGEEKEPVEAMIGMLPIMVMSKVCNLYGMSEEEMVSYGEDPLDPGGYFIVNGSERVIMTLEDLAPNKILVEYNQRYDEFIEVAKVFSQRQGYRSLVIVERGKRSILEVSFPSVAGRINFVTLVRALGLETDMDIVKAVSDNPEIMKFMLENLEEAEVSTTEEALEKIGNRVAAGQAKEYQKKRAAYVLDRYLLPHIGVEEKDRYAKALFLSRMAEACFELALGKRGEDDKDHYANKRLKLSGDLMEDLFRVAFNRLTRDIKYQLERASMRNRELNVITTVRADVLTERMIHPLATGNWVGGRTGVSQLLDRTDYMASLSHLRRVISPLSRSQPHFETRDLHATQWGRICPSETPEGPNCGLVKNFAQGVELSKGVEDYEEVKTMLINLGVRPVGGYGG

SEQ ID NO: 4416 - protein, 1130 aa, Thermofilum pendens Hrk 5
MSSRAVQAKLSREDRWRVVKAYVDELGLVRQHLDSFNAFLERGLQEIVDEVGGIKVESQGVEIKFGKIEVGQPTFREADGSDLALTPMIARLRNITYAAPLYLTMTLYVDGEERRTESVYIGSLPIMVKSKKCVLYGLKSEDEIVKYGEDPYDPGGYFIVNGSERVIVMQEDLSVNRVLVDYGGASGSVTHTAKVFSVAAGQRSPLTVERTKDGMIYASFPACPSKIPVVVLMRALGLKTDQEIAYAIGNDPIIQQEFLPVLMEQSKIAATPEEALDYIGSRVSPGQPRNVRIERAQAVLDENLLPHIGRGPAARISKAFFVGQMVSRLLELKLGMRGPDDKDHLANKRIRQAGELIAQVFRSAFRQLVKEMTYSIERHTSKTRDINLVSIVRPDIITERLNHALATGNWVGGRTGVSQILDRTNYLSTISHLRRVVSPLSRTQPHFEARELHPTQWGRLCPVESPEGQNCGLVKHLALLATLSNGTDEKQVYDLLVGRLGVVPVEKTVGKNISGARVYLNGRLIGYVEDGKGLAETLRKLRREGRISHEVNVAFYSHEYTVGGVKGRIEEVYVNCDAGRIRRPLIVVENGEPRLKHEHVELLRKGEWTWSDLIENGIVEYLDAEEEENAYIATDVSELTPQHTHLEIVPAAILGIIAMTIPFIEYNQSPRNSYQAAMAKQSLGIPHYNFKLRMDPRMHVMYYPQKPLVKTRIFDLLPLDNLPYGTNMVVAVLTGGGYNIQDAVVINKAAIERGMSRSVFFRTYEAEERRYPGGLEDRFEKPSLEKDLLDVKPPQAYEAIDPVDGIAYVEAELYGGQAVVSRTSPPRFYTSTLEPRVMTKRKDTSLLLRHGEKGIIDRVFIMESPGGIKLAKVRVRDLRPTELGDKFASRHGQKGVVGMLVPQEDMPFTEEGITPDLIINPHAIPSRMTVGQLLEAITGKAAALAGRRIDATAFEPPSLDEIREILRSYGFRSDGKEVLYDGVTGEKLEAEIFIGVVYYEKLHHLVADKMHARARGRVQILTRQPTEGRAREGGLRFGEMEKDCLVGHGASMLLRERLLESSDKTTIWVCENCGYMGWFDARKNTPVCPVCGDKGRLSPVEVSYAFKLLLQELTGLGLSVRLILKDKIQS

SEQ ID NO: 4417 - protein, 1127 aa, Pyrobaculum islandicum DSM 4184
MVDLLPLPVVTSQQDDSFPTKDDRWTLVERFIRDKGLANHQIKSFNDFLDKKLPKIVEDFKVIETEIKGLKLVLERIEVGWPRIKESDGSESLIYPMEARLRNATYSAPLYLTATLYVDDEPYVTETFYIGELPIMVKSKRCNLTRLKPSEYVKKFEDPQDFGGYFIINGSERVIISQEDLVTDRPIYDKGDKPSVKYIAKTISTGIGYRSTLVVELNKDGIIYVTLSAMPVKIPFPVYMKALGLETDEDVVKAVSDDPEIQKELLPSLIAANQIAITKEDALDFIGGKVAVGQPKPIRVEKALQLLDRYFLPHLGTTVPDEKKQQEIRLKKALMLGQIVKGLIELDLGRRKPDDKDHVANKRVRLVGDLMTQLFRTVFKQFLQELKSQLEKYYARGRIPHIQTIVRPDIITERVRQALATGNWVGGKTGVSQILDRTNYMSTLSYLRRVVSSLSRTQPHFEARDLHPTQWGRLCAVETPEGQNVGLVKNLALLAEITTGVDEGEVEQLLYNLGVVPILKARDEGIRGAEVYINGRLIGIHPNPDELARTVRSLRRQGKISDEINIAVLNNAVYVNCDGGRIRRPLLVVENGKLKLTKEIVEKVRRGELTWDDLVKMGVIEYLDADEEENAYIATDPHDDLSKYTHVEIIPSAILGAVASIIPYLEHNQSPRNQYEAAMAKQSLGLPQSNFLYKLDSRGHMLYYPERPIVTTRGLELIGYSKKPAGQNAVVALLTYTGYNMEDAIILNKAAVERGMFRSVFYRTYETEEQKYPGGEEDKIEVPDSSVKGYRGPEAYSHLDEDGIAPPEVYVSSNEVIIGKTSPPRFYTTLETERILKERRDSSVAVRRGEKGIVDRVIITESPEGNRLVKVRLRELRIPELGDKFASRHGQKGVVGMILRHEDMPFTEEGIVPDIIVNPHALPSRMTVGQLLESIAGKIGASLGALVDATPFEGVKEEELRKLLMKLGYKWDGKEVMYSGITGEKLVADIFIGVVYYQKLHHMVADKIHARARGPVQILTRQPTEGRSREGGLRLGEMERDVLIAHGASALLYERLVESSDKYTMYVCELCGLPAYLDARTNKPRCPIHGDTGQFAKVIVPYAFKLLLQELIALGIYPKLELSEILE

SEQ ID NO: 4418 - protein, 516 aa, Methanocorpusculum labreanum Z
MIDRSVLSGAYFSQEHVARHQLDSYNNFVQFNLQKVVDEQRIVETEIVNRGKNQEAVWVELGKIRVEKPIVREADGSQSKLYPAEARLRNLSYAAPMILEMTLHQGDKVYPVQETTIGQLPVMIGSQVCNLCGLSQEERTEQGEDPSDPGGYFIVNGTERVLMTLEDLASNKIMTEFTERYNEQIHVSKVFSQFRGYRALVVVEKNKKNLLDVSFPSVAGHLRFADLMRALGLESDEEIVSAVSLSEDVLTYMMQNLEESECATVEEGVMYVGKKLAPNQTKDYQRKRAEFVLDSYLLPHLNYAIPGSLKPGDEGYEVYAKDVRIAKAEFLGRMAEACFDLALNKRRIDDKDHYSNKRLKLAGDLMEDLFRISLNRLTRDVKYQLERASMRHRELAIGTVVRADVLTERLIHPLATGNWVGGRTGVSQLMDRVDHMSVISHLRRVISPLSRSQPHFEARDLHPTQWGRICPSETPEGPNCGLVKNFAQLVEISKGTDEDEVLRVIQGMKIQPIRSE

SEQ ID NO: 4419 - protein, 513 aa, Methanoculleus marisnigri JR1
MSRAYFAREHVARHQLDSYNNFLLHNLQKVVDEQRVIETDIETRGKGKEAVWVELGKVEVKKPLVREADGSQSELFPSEARLRNLTYAAPIQLEMTLVQGEEAQDPIVTTIGQLPVMVGSAACNLYNMSDPERIEHGEDPLDPGGYFVVNGTERVLMTLEDLASNKIMTEFTERYNERIYVAKVFSQYRGYRALVIVERNRKNLLEVSFPSVAGHLRFIDLMRALGLQGDHDIVEAVSTDEEILTFMMQNLEEGECDTVDEGVMYVGKKLAPNQTRDYQRKRAEFVLDNYLLPHLNYLMPVGLKEEDPGYRTAVEGVRLAKAHFLGRMAEACFDLVLDRRRIDDKDHYSNKRLKLAGDLMEDLFRISLNRLTRDVKYQLERASMRHRDLSIGTAVRADVLTERLLHPLATGNWVGGRTGVSQLLDRVDHMAVLSHLRRVISPLSRSQPHFEARDLHPTQWGRICPSETPEGPNCGLVKNFAQMVEISKGVINEEEVKNILYDMGVIALRRETA

SEQ ID NO: 4420 - protein, 1127 aa, Pyrobaculum calidifontis JCM 11548
MVDLLPLPILSKDGDGEFPSRDDRWALVERFIKDKGLANHQIKSFNDFLDKRLPRIVEEFKVVETEIKGLKLVLEKIEVGWPRIKESDGSESLIYPMEARLRNATYAAPLYLTATLYVDDEPYVTETFYIGELPIMVKSKRCNLTRLKPSEYAKKFEDPQDFGGYFIINGSERVIISQEDLVTDRPIYDVGDKPSVKFLAKTISTGIGYRSTLTVELNKDGVIYVTLSAMPVKIPFPIYMKALGLETDEDVVKAVSDDPDIQKELLPSLIAANQVAITREDALDYIGGKVAVGQPRPVRIERALQLLDRYFLPHLGTTTPDEKKQQEIRLKKALMLGQIVKGLVELQLGRRKPDDKDHVGNKRVRLVGDLMTQLFRTVFKQFLQELRSQLEKYYARGRIPHIQTIVRPDIITERVRQALATGNWVGGKTGVSQILDRTNYLSTLSYLRRVVSSLSRTQPHFEARDLHPTQWGRLCAVETPEGQNVGLVKNLALLAEITTGVDEREVEQLLYNLGTVPVLKAREDGIRGAEVYLNGRLIGIHPNAEELVATVRSLRRQGKISDEINIAHINGSVLVNCDGGRIRRPLLVVENGRLKLTKDIVERVRKGDLTWDDLVKMGVVEYLDADEEENAHIAVDPRGDLSGYTHVEIIPSAILGAIASIIPYLEHNQSPRNQYEAAMAKQSLGLPQSNFLYKLDSRGHMLYYPERPIVTTRGLELVGYSKRPAGQNAVVALLTYTGYNIEDAVILNKASVERGMFRSVFYRTYETEEQKYPGGEEDRIEVPDSSVKGYRGPEAYSHLDEDGIAPPEVYVSSNEVLIGKTSPPRFYTTLETERILKERRDASVAVRRGEKGIVDRVIITESPEGNKLVKVRLRELRIPELGDKFASRHGQKGVVGMLLRQEDMPFTEDGIVPDIIVNPHALPSRMTVGQLLESIAGKVGAATGQLVDATPFEGVGEEDLRKLLLKLGFRWDGKEVMYSGITGEKLVADIFIGIVYYQKLHHMVADKIHARARGPVQILTRQPTEGRSREGGLRLGEMERDVLIAHGASALLYERLVESSDKYVMYVCELCGLPAYLDAKTNKPRCPIHGDTGQFAKVVVPYAFKLLLQELMALGIYPKLELSEVLD

SEQ ID NO: 4421 - protein, 499 aa, Methanococcus maripaludis C5
MESRVVVDAFFKENSLVKHHIDSYDDFVKNKIQKIIDEVTGVETEIKGGYKVSFAKVRVTKPINKEADGSVKEITPMEARIRNLAYSAPLYLEMIPTVGEDEEEKVLSPVEVYIGELPVMLGSEICHLCGKSDEELIKYGEDIQDPLGYFIVNGSEKAVVAQEDLIPNRIICEKVEKNNKVVDIAKVFSTRHGFRALCTVERNPDGLLNVSFPGMPSTIPLVILMRALGAESDREIIELISDEPTVVMQLIANLQEAREEHAINTTEDALEHIGKRVAPGQPKEYKLKRAETILCNYLLPHMGVESEKLGAKCKYLGRMAKNSIELYLGLRVEDDKDHYSNKRLKLAGDLMEDLFRHSFNQLIKDIKYQLERQAIRNKEPSIQAAVRSDVLTERMRHAMATGNWVGGRTGVSQLLDRTSYLATVSQLRRVVSPLSRSQPHFEARDLHATQWGKICPSETPEGPNCGLVKNLAVMCKVTTDEGDDSVIELLRELGLTKEN

SEQ ID NO: 4422 - protein, 1127 aa, Pyrobaculum arsenaticum DSM 13514
MVDLLPLPVISPSGDGGLLTKDDRWALVERFIKDKGLASHQIKSFNDFLDKKLPRIVEDFKVVDTEIKGLKLVLEKIEVGWPRIKESDGSESLIYPMEARLRNATYSAPLYLTAVLYVDDEPYATETFYIGELPIMVKSKRCNLTRLRPSEYPKRFEDPQDFGGYFIINGSERVIISQEDLVADRPIYDKGDKPSVKFLAKTISTGIGYRSTLTVELNKDGVIYATLSAIPVKIPFPIYMKALGLETDEDVVKAVSDDPDIQKELLPSLVVANQIAITREDALDYIGGKVAVGQPRPVRVERALQLLDRYFLPHLGTTVPDEKKQQEIRLKKALMLGQIVKGLVELQLGRRKPDDKDHVANKRVRLVGDLMTQLFRTVFKQLLQELRSQLEKYYARGRIPHLQTIVRPDIITERVRQALATGNWVGGKTGVSQILDRTNYLSTLSYLRRVVSSLSRTQPHFEARDLHPTQWGRLCAVETPEGQNVGLVKNLALLAEITTGVDENDVEQMLLQQGVVPILKAREEGVRGAEVYLNGRLIGIHPEPEELVKTVRSLRRQGKISDEINIAYLNGVVYVNSDGGRIRRPLLVVEDGKLKLTKDIVERVKRGELTWDDLLKMGVVEYLDADEEENAHIAVDPEGDLSNYTHVEIIPSSILGAIASIIPFLEHNQSPRNQYEAAMAKQSLGLPQSNFLYKLDSRGHMLYYPERPIVTTRGLELVGYSKRPAGQNAVVALLTYTGYNIEDAVILNKASVERGMFRSVFYRTYETEEQRYPGGEEDKIEIPDSSVKGYRGPEAYSHLDEDGIAPPEVYVSSSEVLIGKTSPPRFYTTLETERILKERRDASVAVRRGEKGIVDRVIVTESPEGNKLVKVRLRELRIPELGDKFASRHGQKGVVGMLLRQEDMPFTEEGIVPDIIVNPHALPSRMTVAQLLESMAGKVGAATGNLVDATPFEGVKEEDLRKLLLKLGYKWDGKEVMYSGITGEKLVADIFIGIVYYQKLHHMVADKIHARARGPVQILTRQPTEGRSREGGLRLGEMERDVLIAHGASALLYERLVESSDKYTMYVCELCGLPAYLDAKSNKPKCPIHGDTGQFAKVTVPYAFKLLLQELIALGIYPKLELSEVLD

SEQ ID NO: 4423 - protein, 1124 aa, Metallosphaera sedula DSM 5348
MLSVDDRWVIVEAYFKSRGLVRQHLDSFNDFIKNKLQEIIDEQGEIITEIPGLKIRLGKIRVGKPRVREADKGDKEITPMEARLRNLTYAAPIFLTMTPVENNIEGDPTEVHIGDIPIMLKSIADPTSEFSQDKLVEIGEDPKDPGGYFIINGSERVIVTQEDLATNRVLTDVGKAGSNVTHTAKIISSTSGYRVPITIERLKDSTIHVSFPSAPGRIPFAILMRALGVETDEDITLAVSLDPQIQNELLPSLEQASSISSKEDALDFIGNRVAIGQKREMRIQKAEQILDKYFLPHIGTNPSDRVAKAYYLAFAVSKLIELYLGRREPDDKDHYANKRLKLAGDLFASLFRVAFKAFVKDLVFQLEKSKVRGRRLAINALVRPDIISERIRHALATGNWVGGRTGVSQLLDRTNWLSMLSHLRRVVSSLARGQPNFEARDLHGTQWGRMCPFETPEGPNSGLVKNIALLAQISVGINEKSLERTLYNLGVVPIDDAIKKVKSEEGQSENYQTWSKVILNGRLIGYYPDGRELAEKIRESRREGELSDEVNVSYNITETFNEVYINSDSGRVRRPLIVVKHGKPLVTKEDIENLKKGKITFDTLVKEGKIEFLDAEEEENAYIALEPKDVTKDHTHLEIWAPAILGITASIIPYPEHNQSPRNTYQSAMAKQALGLYAANYQIRTDTRAHLLHYPQKPIVQTRALEAIGYTERPAGNNAIFALMSYTGYNMEDAVIMNKSSVDRGMFRSTFFRLYSAEEIKYPGGQEDEILLPEPGVRGYKGKDYYRLLESNGIVSPEVDVKGGDVLIGKVSPPRFLQEFKELSPDQAKRDTSIITRHGERGTVDLVLVTETSEGNKLVKVRVRDLRIPEIGDKFATRHGQKGVIGMLIPQVDMPYTTSGLVPDIILNPHALPSRMTVGQIMEAIAGKFVAATGNPIDATPFYNTPIEEIQRKLLEHGYLSDGSEVVYDGRTGEKLKGRILFGIVYYQKLHHMVADKMHGRGRGPVQILTRQPTEGRAREGGLRFGEMERDCLIGYGAAMLIKDRLLDNSDRATVYVCEQCGYVGWYDRTKNKYICPIHGDKTTLYPVVISYAFKLLLQELMSMVIAPKLVLGDKVPVGGNSNE

SEQ ID NO: 4424 - protein, 499 aa, Methanococcus vannielii SB
MESRVIVDAFFRENSLVKHHIDSYDDFVENKIQGIIDEVTGVETEIKGGYKVSFGKVRVTKPINKEADGSVKEITPMEARIRNLAYSAPLYLEMIPLIGEGDEEKTLSPIEVYIGELPVMLGAKICHLSGKSEEDMINYGEDPKDPLGYFIVNGSEKAVVAQEDLIPNRILCEKVEKNNKIVDIAKVFSTRHGFRALCTVERSPDGLLNVSFPGMPSTIPLVILMRALGAESDREIMELISDEPTVVMQLVANLQEAREEHGINTTEDALEHIGKRVAPGQPKEYKLKRAETILCNYLLPHMGIESEKLGAKCKYLGRMAKNSIELYLGSRVEDDKDHYANKRLKLAGDLMEDLFRHSFNQLIKDIKYQLERQAIRNKEPSIQAAVRSDVLTERMRHAMATGNWVGGRTGVSQLLDRTSYLATVSQLRRVVSPLSRSQPHFEARDLHATQWGKICPSETPEGPNCGLVKNLAVMCKVTTDEEDEGIIQLIKEIGLSKDI

SEQ ID NO: 4425 - protein, 510 aa, Methanococcus aeolicus Nankai-3
MESRIIVDEFFKENSLVEHHINSYNKFVENSIQKVIDEAAPIEAEVKGGFKVKFGKVRVGKPINKEADGSVKEIYPVEARIRNLSYSAPLYLEITPIMGGGEDEEGNKYEVEEGETVEAYIGELPVMLGSIICHLNGKSEDELVKMGEDARDPMGYFIVNGSEKAVVAQEDLIPNRILCEKVEKTGKPVYIAKVFSTRHGFRALCAVEKHDDGRLNVSFPGMSGNIPLVILLKALGAENDSAVFKIISEDPAVSMQLIANILETREEHQVITREDALEYIGKRVAPGQPKEYRLKRAETILCNYLLPHMGVKKENLFEKCIYLGRMAKNAIELYLGLRVEDDKDHYANKRLKLAGDLMEDLFRYSFNQLNKDMKYQLERQAIRNKSPSIQAAVRSDVLTERIRHAMATGNWVGGRTGVSQLLDRTSYLATVSQLRRLVSPLSRSQPHFEARDLHATQWGKICPSETPEGPNCGLVKNIAVMCEITTQEQDDKIIDLLKESGYVKSAKDSY

SEQ ID NO: 4426 - protein, 499 aa, Methanococcus maripaludis C7
MESRVVVDAFFKENSLVKHHIDSYDDFVKNKIQKIIDEVTGVETEIKGGYKVSFDKVRVTKPINKEADGSVKEITPMEARIRNLAYSAPLYLEMIPTVGEDEEEKVLSPVEVYIGELPVMLGSEICHLCGKSEEELIKYGEDTKDPLGYFIVNGSEKAVVAQEDLIPNRIICEKVEKNNKIVDIAKVFSTRHGFRALCTVERNPDGLLNVSFPGMPSTIPLVILMRALGAESDREIIELISDEPTVVMQLIANLQEAREEHAINTTEDALEHIGKRVAPGQPKEYKLKRAETILCNYLLPHMGVESAKLGAKCKYLGRMAKNSIELYLGLRVEDDKDHYSNKRLKLAGDLMEDLFRHSFNQLIKDIKYQLERQAIRNKEPSIQAAVRSDVLTERMRHAMATGNWVGGRTGVSQLLDRTSYLATVSQLRRVVSPLSRSQPHFEARDLHATQWGKICPSETPEGPNCGLVKNLAVMCKVTTDESDDNVIELLKELGLTKEN

SEQ ID NO: 4427 - protein, 522 aa, Candidatus Methanoregula boonei 6A8
MVYLIDRSVLSRAYFAREHVARHQLDSFNYFLTENLQKVVNEQKIIETDIENRGRNNDPVWVELGNIEVKKPLVREADGSQGELYPSEARLRNLTYAAPIQLGLTLVHGEDRQEPIVTTIGQLPIMVGSVACNLYGMSDEERVSHGEDAFDPGAYFIVNGTERVLMTLEDLASNKIMTEFTERYNERIYVAKVFSQFRGYRALVVVERNKKNLLEVSFPSVAGHLKFVDLMRALGMTNDQEVVNAVSTDEDILTFMMQNLEESECDSVEGGVMYVGKKLAPNQTKDYQKKRAEFVLDNYLLPHLNYALPTTLKEGDEGYDEAVASVRLAKAHFLGRMAEACFDLVLNKRRIDDKDHYSNKRLKLAGDLMEDLFRISLNRLTRDIKYQLERASMRHRDLSIATAVRADVLTERLLHPLATGNWVGGRTGVSQLLDRVDHMAVLSHLRRVISPLSRSQPHFEARDLHPTQWGRICPSETPEGPNCGLVKNFAQMVEISKGVNDEEEIMRILHSLNVEHIRGEVR

SEQ ID NO: 4428 - protein, 499 aa, Methanococcus maripaludis C6
MESRVVVDAFFKENSLVKHHIDSYDDFVKNKIQKIIDEVTGVETEIKGGYKVSFDKVRVTKPINKEADGSVKEITPMEARIRNLAYSAPLYLEMIPTVGEDEEEKVLSPVEVYIGELPVMLGSEICHLCGKSEEELIKYGEDTKDPLGYFIVNGSEKAVVAQEDLIPNRIICEKVEKNNKIVDIAKVFSTRHGFRALCTVERNPDGLLNVSFPGMPSTIPLVILMRALGAESDREIIELISDEPTVVMQLIANLQEAREEHAINTTEDALEHIGKRVAPGQPKEYKLKRAETILCNYLLPHMGVESEKLGAKCKYLGRMAKNSIELYLGLRVEDDKDHYSNKRLKLAGDLMEDLFRHSFNQLIKDIKYQLERQAIRNKEPSIQAAVRSDVLTERMRHAMATGNWVGGRTGVSQLLDRTSYLATVSQLRRVVSPLSRSQPHFEARDLHATQWGKICPSETPEGPNCGLVKNLAVMCKVTTDEGDDSVIELLRELGLTKEN

SEQ ID NO: 4429 - protein, 1115 aa, Nitrosopumilus maritimus SCM1
MADSSTKRWPVIQDILKREGIARQHLNSFDEFLERGLQSIINEVGQIDIENAEYPYKIQLGKVKLQQPRMMELDGSITHITPAEARLRNVSYSAPVMMEASVVEDGKILESRFVHIGDVPVMAKSNACILHNFSTQKLVEHGEDPNDPGGYFIINGSERVIVGLEDLSYNKIIVDRETVGGNIVHKAKVYSSIVGYRAKLELVMKNDGLIVARIPGSPVDIPVVTLMRALGLESDREIAAAVSLVDELQDELEASFEKAGDVPTAKDAIVYISKRIAPGMLEEFQIKRAETLLDWGLLPHLGKHPENRKEKAQFLGEAACKLLELKLDWIRPDDKDHYGNKVIKFAGQMLADLFRTAFRNLVRDMKYQLERSGQKRGINAVAAAIRPGIITDKLNNAIATGNWGRGRVGVTQLLDRTNYLSTISHLRRIQSPLSRTQPNFEARDLHATHFGRICPSETPEGSNCGLVKNLALSGIISVNVPSEEIVEKLYDLGTVHFFDAKEDLKKDGTRIFVDGRLIGYYKDGEQLAESLRDLRRNSKIHPHVGVSFHKSEIEGSTRRLYVNCNAGRVLRPLIIIKDNKPLLTADLLDKISKKLISWTDLLRMGVLEMIDANEEENCYVTLDEKDTKKHTHLEVFPPAILGAGASIIPYPEHNQSPRNTYESAMAKQSLGFSTPMMNTSTYVRQHFMLYPQVPIVNTKAMKLLGLEDRPAGQNCVVAVLPFDGYNIEDAIVLSKASVDRGLGRTFFFRIYDAEAKQYPGGMRDAFEIPNAEDNIRGYKGERAYRLLEEDGVVATEAPVKGGDILIGKTSPPRFMEEYREFESSGPYRRDTSIGVRPSETGVVDTVVMTQSNEGGKMYKIRARDMRIPEIGDKFASRHGQKGVLGILAKAEDLPYTASGMSPDVLINPHAFPSRMTVGMMMESICGKSAALRGKRFDGSAFVGEKMDEVREVMDAHGFEYSGKEIMYDGRTGKSFPVEVFIGVVYYQKLHHMVADKIHARARGQVQMLTKQPTEGRARGGGLRFGEMERDCLIAYGASMILKDRLLDESDKSDIFVCERCGLVAYHDVKQRKYVCRVCGDKAKVSSVSVAYAFKLLLQEMQSLNVAPRLLIKEKL

SEQ ID NO: 4430 - protein, 1127 aa, Thermoproteus neutrophilus V24Sta
MVDLLPLPVIVSQQDGKFPTRDDRWVLVERFIKDKGLANHQIKSFNDFLDKKLPKIVEDFKVVETEIKGLKLVLERIEVGWPKIKESDGSESIIYPMEARLRNATYSAPLYLTATLYVDDEPYVTETFYIGELPIMVKSKRCNLTRLRPGEYIKKFEDPQDFGGYFIINGSERVIISQEDLVADRPIYDRGDKPSVKYIAKTISTGIGYRSTLTVELNRDGVIYVTLSAMPVKIPFPIYMKALGLETDEDVVKAVSDDPEIQKELLPSLIAANQIAITREDALDFIGGKVAVGQPKPIRVEKAYQLLDKYFLPHLGTTTPDEKRQQEIRLKKALMLGQIVKGLVELQLGRRKPDDKDHVANKRVRLVGDLMTQLFRTVLKQFLQELKSQLEKYYARGRIPHIQTIVRPDIITERVRQALATGNWVGGKTGVSQILDRTNYMSTLSYLRRVVSSLSRTQPHFEARDLHPTQWGRLCAVETPEGQNVGLVKNLALLAEITTGVDEGEVEQLLYNLGVVPLLKAREEGIRGAEVYINGRLIGVHPNPEELAKTVRGMRRQGKISDEINIAYLDGSVYVNCDGGRIRRPLLVVEGGRLKLTKEIVEKVRRGDLTWDDLVKMGVIEYLDADEEENAHIAVDPDVDLSNYTHVEIVPSSILGAVGSIIPYLEHNQSPRNQYEAAMAKQSLGLPQSNFLYKLDSRGHMLYYPERPIVTTRGLELVGYSRRPAGQNAVVALLTYTGYNIEDAVILNKASVERGMFRSVFYRTYETEEQKYPGGEEDKIEIPDSSVKGYRGPEAYSHLDEDGIAPPEVYVSSNEVLVGKTSPPRFYTTLEAERILKERRDASVAVRRGEKGIVDRVIITESPEGNKLVKVRLRELRVPELGDKFASRHGQKGVVGMLLRHEDMPFTEDGIVPDIIVNPHALPSRMTVAQLLESMAGKVGASLGALVDATAFEGVKEEDLRKLLLKLGYKWDGKEVMYSGITGERLVADIFIGVVYYQKLHHMVADKIHARARGPVQILTRQPTEGRSREGGLRLGEMERDVLIAHGASALLYERLVESSDKYTMYVCELCGLPAYLDAKSNKPKCPIHGDTGQFAKVVVPYAYKLLLQELIALGIYPKLELTEVLE

SEQ ID NO: 4431 - protein, 521 aa, Halorubrum lacusprofundi ATCC 49239
MNRQDRRVVSREYFSDERLAEHHFRSFNNFLDRGMQEVVDEKETIETDIGDKEGQEPVYVELGDVRMVTPRVREADGSEELLYPQEARLRNITYSAPVFMEMSIVRGGEDEPEQVVDTTETKVGRMPIMVGSNKCNMAGFSDDELIDIGEDPVDPGGYFIVNGSERVLMTSEDLAPNKILAEYDSKYGDEIQVAKTFSQRRGYRALVLCERNREGLLEVSFPSVSGSIDFVTLVRALGLESDEEIVHRVSDDPEIVKFMLENLEEAEVQTTEGAIETLGERVASGQGKNYQLKRANYVIDRYLLPHLHEEGVDEEDVRINKAYYLCRMAEACFELALERREADDKDHYANKRLKVSGDLMRDLFRTALNKLARDVKYQLERANMRNRDLTVNTVVRSDVLTERLEHPIATGNWVGGRSGVSQLVDRTDYMGVLSHLRRLRSPLSRSQPHFKARDLHATQWGRICPSETPEGPNCGLVKNFAQAMELSQTVDDEQGLKRELASMGVEGIPGIEGVDRQTADD

SEQ ID NO: 4432 - protein, 521 aa, Halorhabdus utahensis DSM 12940
MDTENRRTISREYFSRDRLAEHHFRSFNAFLDRGMQEVVDEKATIETDIGDKEGEEPVWVELGDVRIVTPRVREADGSEELLYPQEARLRNITYAAPVFMEMAIVKGGEEEEERVVDQTETKVGRMPIMVGSQKCNIAGFSDEELIDIGEDPADPGGYFIVNGSERVLMTSEDLAPNKILAEYDTKYGDEVQVAKTFSQRRGYRALVLTERTRDGLLEVSFPSVSGSVNFVTLVRALGLESDEEIVHQVSDDPEIVKFMLENLEAAEVQTQEEAIETLGQRVASGQGKNYQLKRANYVIDRYLLPHLHEEGIDEEETRINKAYYLCRMAEACFELALDRRESDDKDHYANKRLKVSGDLMRDLFRTALNKLARDVKYQLERANMRNRQLSVSTVVRSDVLTERLEHPIATGNWVGGRSGVSQLVDRTDFMGVLSHLRRLRSPLSRSQPHFEARDLHATQWGRICPSETPEGPNCGLVKNFAQAMELSQHVEDERELKQTLAEMGVQGIPAIETAAQQPADD

SEQ ID NO: 4433 - protein, 503 aa, Candidatus Methanosphaerula palustris E1 9c
MARHQLDSFNNFLQYNLQKVVNEQRVIETDIENRGKSNEPVWVELGTIEVKKPLVREADGSQSELFPTEARLRNLTYAAPMHLDMTLVQGDDRQEAVLTTIGHLPIMIGSSACNMYGMPNSERILHGEDPLDPGGYFIVNGTERVLMTLEDLASNKIMTEFTERYNERIYVAKVFSQFRGYRALVVVERNKKNLLEVSFPSVAGHLKFVDLMRALGMDSDHAVVEAVSTDEDILTFMMQNLEESSCDSIESGIMYVGKKLAPNQTRDYQRKRAEFVLDNYLLPHLNYLMPANLTEEDPGYQTAVEGVRLAKAHFLGRMAESCFDLVLDKRRIDDKDHYSNKRLKLAGDLMEDLFRISLNRLTRDIKYQLERASMRHRDLSIGTAVRADVLTERLLHPLATGNWVGGRTGVSQLLDRIDHMAVLSHLRRVISPLSRSQPHFEARDLHPTQWGRICPSETPEGPNCGLVKNFAQMVEISKGVQDEDEIVGVLYNLGVEALKGEMR

SEQ ID NO: 4434 - protein, 520 aa, Halomicrobium mukohataei DSM 12286
MDVNDRRAISREYFSRERLAEHHFRSFNSFLDRGMQQVVDEKETIETDIGDKEGQEPVFVELGDVRVVTPRVREADGSEELLYPQEGRLRNITYSAPVFMEMAIVRGGDEEEEVVVDQTETKIGRMPIMVGSNKCNIDGFTDEELIDIGEDPADPGGYFVVNGSERVLMTSEDLAPNKILAEHDTKYGDDVQVAKTFSQRRGYRALVLCERTRDGILEVSFPSVSGSINFVTLVRALGLESDEEIVHRVSDDPEIVKFMLENLEAADVQTTEGAIETLGERVASGQGKNYQLKRANYVIDRYLLPHLHEEGVDEEDVRINKAFYLCRMAEACFELALGRRDADDKDHYSNKRLKVSGDLMKDLFRTALNKLARDVKYQLERANMRNRQLSVSTVVRSDVLTERLEHPIATGNWVGGRSGVSQLVDRTDYMGVLSHLRRLRSPLSRSQPHFEARDLHATQWGRICPSETPEGPNCGLVKNFAQAMELSQNVEDEQDLKQELADMGVQGIPGIERIEQPADD

SEQ ID NO: 4435 - protein, 340 aa, Dechloromonas aromatica RCB
MKPRLLLTALCLSLSLSAMPAVAGDGHDHGDAPPAASGSGPKRQPDGSVFLPKPAQRQIGVRTLLVELGELPRTHELAGKVVMDPNAGGKVQAIVAGRVTPGPRGLPLPGQAVKKGEVLAYVTPEVGGNSRSLAESRLRRLRELSDTVPRKVIEEAEAAVANEQLVAPVSGVIASANVVSGQVLEARETLFEIVNPERMLIEALAFDMAVASDVAGAFVAVGEQKLPLRLVGVARSLREQALPLTFRGEGGALAALAVGQPVRVFVQTRSTVPGIRVPMAALMKNPANQSIVWIKTAPERFEPRTVTAEPLDGTHVAVTSGLKAGDRVAVRAATLINQIR

SEQ ID NO: 4436 - protein, 372 aa, Acidovorax sp. JS42
MKRASLHRLAWLGVVLALVGPLTAQAGEGHDHGDAPAAPSANGPQRQPDGSVFLPKPAQRQLGVRTMVAAEAELPRSVELNGKVLMDPNAGGKVQPLNAGRIEPGPRGLPNPGQVVRKGEVLAYVVPSTAPIERSNQSAQLAELRAAKSLADKRVTRLKELSDTVPRKDIEAAESEAASLAERMAAVGGGLATREALVAPVSGVIASAHVVAGQVVDARELLFEIIDPSRLRIEALAFEPSLAANVGSATLAVGDQRVPLEYLGAARSLREQALPLGFRAQGAALNGLAVGQPVRVFVQTKQKVKGIAVPVASLMKNPANQTVVWVKTSPERFEPRSITTEALDGVNVAVTSGLKAGDRIATQGATLINQVR

SEQ ID NO: 4437 - protein, 377 aa, Polaromonas naphthalenivorans CJ2
MKTRFVISAAGAAFSAALLTFTVPVWASGDHEGGHGAAEADLSVIGSGPKRLPDGSVFLPKPAQRQMGVRTLVGESKQLPRATELSGKVVMDPNAGGKVQALVAGRLQAGPRGLPSVGQAVRKGEVLAYVLPSVAAIERSNQAAQLAELGADRSLANKRLARLKELADTVPRKEIEAAESEVASLGARLAAVGVGLSARDTLVAPVSGVIASANAVAGQVVDARELLFEVIDPSRLRIEALAFDAALAADVGGAFLTVGGQKVPLVFVGASRSLREQALPLAFRAEGAALSQLAVGQPVAVVLQSRSQVTGVPVPAASLTKNPANQTVVWIKTAPERFEARVVTVEPLDGATVAVTSGLKAGDRVATQGATLINQIR

SEQ ID NO: 4438 - protein, 370 aa, Methylibium petroleiphilum PM1
MKRALIASSLALLIASTGLAPVHAGEGHDHGDAPAAPSANGPQRQPDGSVFLPKPAQRQLGVRTLVTEAAELPRTVELGAKVLMDPNAGGKVQPLNAGRIEPGPRGLPNPGQAVRKGEVLAYVVPSAAPIERSNQAAQLAELRAAKALADKRIARLQELADTVPRKEIEAAESEAASLTARIAAVGGGLSTREALVAPVSGVIAAANVVAGQVVDARELVFEIIDPSRLRIEALAFDAAIAANIGTATMAVGNQRVPLTFIGATRSLREQALPLAFRAQGDALTLLAVGQPVRVFVQTKDKIKGISVPVASLMKNPANQTVVWVKTAPERFEPRTVTTEPLDGVNAAVTSGLEPGDRVATQGATLINQVR

SEQ ID NO: 4439 - protein, 372 aa, Methylibium petroleiphilum PM1
MKRPALTAAGAALLIALTTCIPMARAGEGHDHGDAPAAPSANGPQRQPDGSVFLPKPAQRQLGVRTVVSTAADLPRTVELGARVLMDPNAGGRVQALHAGRIEPGPRGLPHPGQAVRRGEVLAHVLPSAAPIERSNQAAQLAELRAARALADKRVARLQALADTVPRKEIEAAESEAASLAARIAAVGGGLALREPLTAPVAGVIASAHVVAGQVVDARELVFEIVDPTRLRIEALAFDAALASNIGSATMAVGERRVPLVFVGAARSLREQALPLAFRAEGAALEALAVGQPVRVFVQTRDKVQGIAVPVAALMKNAANQTIVWVKTAPERFEPRAVTTEALDGVHAAVTSGLKPGDRVATQGATLINQVR

SEQ ID NO: 4440 - protein, 369 aa, Delftia acidovorans SPH-1
MKYFLSALMVALCASVHAAPGAHGPNGEHLDGPSVPTTSNSLSRLPDGSVNVPMLAQRRLAIRTTFITEQDAGVTVQLPARIVMDPNAGGRVQTALGGRIEAGPRGLPVAGQAVRKGDVLAVVAHQPDPIALANQHAALAELRSGLELARQRVKRLEGLEGSVPRKDIDAARAERSGLEARSSAVGASLSTRERLVAPITGVISRADAVAGQFIEPRDVVYEIVDPGRVLVEASTADAALAGKLSSASLSGIPDAELQLIGAARALRDGVLPLTFRLSSKQALAVAVGQPVTVLATRKDTTKGYVLPAQAVTRNAANEPVVWIKSGAERYIPQPVQFRPLDAQRVVVTQGLGSDNRVVVQGAPLIAQIR

SEQ ID NO: 4441 - protein, 368 aa, Leptothrix cholodnii SP 6
MKIILTLLSLALVATAHAGPGAHGPNGEHLDTPSVSTPDGLARLPDGSVNVPMLAQRRLGLRTLLAVESDAAATVELPARVVMDPNSAGRVQTLIGGKVEPGPKGLPIAGQRVRRGDVLGYVAHHVDPLAAASQQAQLVELRSSRQLAEQRVQRLQSLEGTVPRKEIDAAKLELDSYTARENAIGASLGSKERLVAPVSGVIARADVVNGQVVESKDVLFEVIDPARMLIEASVADVKLSTQLAGATLAGIADWKLQFLGAAGALRDGTLPLTFKATGTGATPLALGQPVTVVAALTNKVKGIVLPAQAVTRNSANETVVWIKAGAERYIPQPVQVRPLDAQTVVITQGLGADNRVVVQGAPLIAQIR

SEQ ID NO: 4442 - protein, 370 aa, Thauera sp. MZ1T
MKPGILLVMLCLVTASASWNAFAGDGHDHGDEGSAPVGGNGPRRLPDGSVFLPKPAQRQIGVRTLVTEAGELPRTVALAGKVVMDPNAGGKVQALVAGRLEAGPRGLPGVGQTVKKGEVLAYVVPSAGQIERSNQMAQLAELQAAKVLAEKRVARLKELADTVPRKEIEAAESELASLAARATAVGAGLSNRDALVAPVAGVIASSNAVAGQVVDARELVFEIVDPKRLRVEALAYDADTAIDVAGASVAVGEQRVRLDFLGAARSLREQALPLAFGAAGDSLARFAVGQPVEVFVQTRSTLQGVSVPAGSVLKNPANQIIVWVKTAPERFEPRTVTIAPLDGANVAVTSGLAAGERVATNAATLINQIR

SEQ ID NO: 4443 - protein, 371 aa, Diaphorobacter TPSY uid29975
MKRNFRFLMTTAMAAALALAAPAFAHDGHDHGDEAPAASSNGPQRQPDGSVFLPKPSQRQIGVRTQLIKQEPLARSHELAGKVIMDPTTGGKVQAMVMGRLVPGPDGLPQIGQSVRKGQVLAYIEPASGVLERSGQMAQVAELRAGQALAQKRLARLRELSETVPRKEIEAAESEVNSLTERARALSGGLAGRDVLKAPVSGVIASSPAVAGQVVDARELVFEVVDPTQLRIEALAYDPAMAQNLAGAALAVGGQKVPLSFVGAASSLREQALPMLFKGTSESLSRLAVGMPVVVFVQEATTVPGYRVPSGALMKNPANQNIVWVKDQAERFEPRVVNITPLDGASIAVTSGLADGDRVVVEGASLINQVR

SEQ ID NO: 4444 - protein, 366 aa, Azotobacter vinelandii DJ
MKANFLIFAACLSLGAPALADDGHDHGEAAPVANANGPQRLPDGSVFLPKPAQRQLGVRTLPVSLDELPRSFELSGKVVMDPNAGGRVQAMLAGRLEAGPRGLPGIGQTVKKGEVLAHVVASSDVLERANQAAQLAQLRAARQLAEQRVARLRELSDTVPRKDIEAAASEVASLAAQIAALGAGAGAREALVAPVSGVIASASAVAGQVVGAGELIFEVIDPTRLRVEALVYDPQQAADVAGASLAVGGERVPLTFVGSARSLREQALPMLFQGEGEALARLAVGQAVRVFVQSASRVSGIRVPAASLMKNAANQNVVWVKTAPERFEPRVVVFAVLDGASVAVTAGLQAGERVVTQAAGLLNQIR

SEQ ID NO: 4445 - protein, 314 aa, Thermobifida fusca YX
MVVAALLTLIAGGCLLAAHHLLRAQWPSRGPHVAVVAWQALGLAWGISTIGALLAFGLAPYGQGILLGLAALAEDAAANGLQLGVLAEGHFAATRVAAIVAAVGLTTVLLWGLAVSFIQVVRTRRRHRALLALVARDHPEIPGARVLDHPAAAAYCLPGVLNPQIVISAGALEVLDRRELAAVLAHEHAHLRQRHDLVLLPFSSLKRAFPKIRLMERCYNAVALLIEMCADDHARRYHSPRELATALVRFGAAGKAAIPLGAMAVVPNENQPEVLARVSRLLNPVKLSRRATAAVLSGSASLMAVTLTLWHLPL

SEQ ID NO: 4446 - protein, 407 aa, Frankia CcI3
MTTAALLALFAGVLAWPVPRLLAAARWPYRCPRAAIVLWQAVGLAGGVSALLAAIAFTVSPLSGDTPTAIVDHLDNIAAGAPLTGLGLINLIGLAVAAALASRLFGVLGTSSAATLRERHRHRDLVDLAGRRHRRHETCVPPGHASHHSGTAADSGAATDPGTTADGGGATGCCLCEHRDRAGILLRILDHPVAVAYCVPGVRHARVVVSRGLLNTLDATELDAVLAHEAAHVAGRHDLVIQPFVAWERTFPFLDPAREATAAVSLLVEMLADDAAARQTSRRSLARALARLGGARAPVPAGALGIIDSPAAVLPALGSHEPTAVGVRDSGPPGPGNPDAGGPDPGDAAPGQTRPVGGGPRRGTANPVISRITRLLDPPEVPWWMPPCAYFGAIIVLAAPPLILLVG

SEQ ID NO: 4447 - protein, 316 aa, Mycobacterium MCS
MSALAFTLVALLLVGPVPALLARASWPMRAPRAAVVLWQSIALAGVLSAFSAGIAIASRLFVPGPDGRPTATITSEIEVLGWPLWLLYVVVFALTLLIGVRLIVSVLQVAVATRRRRAHHRMMVDLLGVSRDSVPTDVRRQATGLRVLDVKQPLAYCLPGVRSRVVLSDGALKTMTRDEIAAILTHERAHLRARHDLVLEMFTAVHAAFPRFVRSASALDAVRLLVELLADDAAVRTAGPTPLARALVACAAGRAPSGALAAGGPSTVIRVRRLGGLPNSLAIAAVAYLAAAVVLVGPTVAVAVPWLTELHRLFIR

SEQ ID NO: 4448 - protein, 334 aa, Arthrobacter FB24
MFWTSYLLAVLAIVLAWPVPILLSRAQWPARSPFTAMLLWQAIGLAGGLSMIGAMLVYGLEPIGDNLLAGLRGLAGMVLFDAPTTALGFWHLFALSAAALLTAHLVFTLLLTYYRIERQRRRHRELLALLASPSTDGPGTVVINHDSPVAYCLPGGARSVTVLSDGLMAALEPAELRAVLIHENAHLSQRHHLLLWAFAAWRQALPWLPTTRLAQEAVSSLIEMLADDVALKTESKATLIKAIAIVASGPSGVPASRVGFNGAGLPSAADGIVDGGIQGASGGAGSAGTTASRVSRLLSPQDPLPAPLRGLVLAGCLLLLALPTALLIVPGLLG

SEQ ID NO: 4449 - protein, 316 aa, Mycobacterium KMS; identical to SEQ ID NO: 4447

SEQ ID NO: 4450 - protein, 311 aa, Mycobacterium vanbaalenii PYR-1
MSALAFTIVALLLSGPVPALLARASWPLRAPRAAIVLWQSIALAAVLSAFSAGIAIASRLFVPGPDGRPTATIVSEIEVLGWPLWTAYVVVFVLTLMIGARLIVSVLQVAIATRRRRAHHRMVVDLVGSHDHRHRSGAGLRILDVAEPLAYCLPGVRSRVVVSEGALKALSDNEMAAILEHEHAHLRARHDLVLEMFTAVHAAFPRLVRSGHALNAVRLLIELLADDAAVRAEGPTPLARALVACASGRAPRGALAAGGPTTVVRVRRLGGAPNSRILAAGAYITAAAVLVVPTVALAVPWLTELQRLFSA

SEQ ID NO: 4451 - protein, 316 aa, Mycobacterium JLS; identical to SEQ ID NO: 4447

SEQ ID NO: 4452 - protein, 311 aa, Mycobacterium gilvum PYR-GCK
MSALAFSLLALLLSGPVPAMLARAAWPLRAPRAAIVLWQSIAAAAVLSAFSAGIAIASRLFVPGPDGRPTSTIVGEIAVLGWPLWTAYVVVFLLTLVIGARLVVSVLNVAIATRRRRAHHRMVVDLVGAHHSRTRSRSSLRVLDVDEPLAYCLPGVRSRVVVSEGALKTLADNEMSAILEHEHAHLRARHDLVLEMFTAVHAAFPRLVRSGHALNAVRLLIELLADDAAVRAEGPTPLARALVACASGRAPRGALAAGGPTTVVRVRRLGGKPNSRMLAAGAYAAAAAVLVVPTVAFAVPWLNELHRLFLV

SEQ ID NO: 4453 - protein, 301 aa, Salinispora tropica CNB-440
MTYALHFGLAVLACWLTAQVMARSTWTWRSPRVAILCWQAIGLAAGLAAMGLPMALGLAAYDLPTGSALWALAGELRGGAAPIRVNALQLGLVGLGCGIGVVLFTTTLRSLHSAVRAQRRHRDLLTLVARQDPTVPGALVLDHPSAAAYCLPGVRPRVVVSAGALDLLDQAELAAVLTHERAHAQERHDLVLLPFTALRRVLPWFRWVRDAHERVALLVEMRADDKARELHAEAPLAGALRRFAAAGDRLAPAGTLGIGDHDLELRVHRLLESGRPPRLVGTAALAVTTTLVALPVSLFLS

SEQ ID NO: 4454 - protein, 316 aa, Mycobacterium tuberculosis F11
MSALAFTILAVLLAGPTPALLARATWPLRAPRAAMVLWQAIALAAVLSSFSAGIAIASRLLMPGPDGRPTTSFVGAAGRLGWPLWAAYITVFALTVLVGARLAVAVVRVATATRRRRAHHRMVVDLVGVGHNGALAQPCARARDLRVLDVAQPLAYCLPGVRSRVVVSEGTLTALADAEVAAILTHERAHLRARHDLVLEAFTAVHAAFPRLVRSANALGAVQLLVELLADDAAVRAAGRTPLARALVACASGRAPSGALAVGGPSTVLRVRRLSGRGNSAVLSAAAYLAAAAVLVVPTVALAVPWLTQLQRLFIA

SEQ ID NO: 4455 - protein, 431 aa, Frankia EAN1pec
MTTAALLALFAGALAWPVPRLLAAARWPHRCPRAAIVLWQAIGLAGGVSALLAAAAFTVAPLSQGIPSALADHASNLLAGEPLVGLGRTNLVGLAIAAALAARLFGVLAMSTAATLRERHRHRHLVDLAGHRHRHRGHDHGDPEHPDSLGGSGGSGGSGGSGGSGGSGGSGDVAGHEEHGTGCRLCEHRDRAGTRLRILDHPVAVAYCVPGVRHARVVVSAGLLRTLTPEELDAVLAHEEAHVSGRHDLVIQPFVAWERTFPFLRPAREATAAVSLLVEMLADDAAARRTCGRTLARALARLGVTRAAVPAGTLSVTGPDLPSQRPPTTGASPSAPANGSVPPFEPARLGPASTPESPAVLGVAGAGRLAAVAAAVATDRSDPARNGGVRTPVVARIARLLDPPAVPIWLPGTAYLTAAMVFLTPVVLLLT

SEQ ID NO: 4456 - protein, 301 aa, Salinispora arenicola CNS-205
MVYVLHFGLSVLACWLTAQVLTRSTWTWRSPGVAILCWQAVGLGAGLSTIGLPMALGLTAYDLPPGSALWALAGDLRRGALPGGMSAVQLGLVGVGGGIGVVLFSTTVRSLRSAVVAQRRHRDLLALVARQDPTVPDALVLDHPSAAAYCLPGVRPRVVVSAGALDLLDRAELAAVLTHERTHAQERHDLVLLPFTALRRVLPWMRWVRDAHERVALLVEMRADDKARKFHAEAPLAAALRRFAAAGDRIAPAGTLGIGNQDLDLRVRRLLESRRPPRLLGAAALGVATILVALPISLFLS

SEQ ID NO: 4457 - protein, 330 aa, Arthrobacter chlorophenolicus A6
MFWASYLLAVLAIILAWPVPILLSRAQWPARSPFTAMVLWQAIALAGGLSMIGAMLVYGLEPIGDNLIAGLRSLAGMVLFNAPTTALGFWHIFALSAAALLTAHLVFTLLLTYYRIQRQRRRHRELLALLASPSSQDTGTLVISHDSPVAYCLPGGARSVTVLSDGLMAALEPAELQAVLTHENAHLSQRHHLLLWAFAAWRQALPWLPTTRLAQESVSSLIEMLADDVALRTASKATLIKAIAIVASGSPAGPNGHGASQAAPGMALSGLDAAAGTAGSDSARTTASRVSRLLSPQTELPRAARSLVLTACVLLLAIPTALLVVPGLLG

SEQ ID NO: 4458 - protein, 329 aa, Kytococcus sedentarius DSM 20547
MSPTLVLAVLAVLLTLGTPALLPLLPGLRRTPAAGLLLWQGCAVGGFSAIVLLPVVAAHEFGGLFTANDTVHPWLVAAAAALSVALIARLLLAAHTVGTDLRTLRRRHQEAVDLLDPRHREGDRLRVIDSPSPVAWCLPGRRARIVMSRAALEDLSVEELHGVYLHERAHLRHRHDLVVEFFTVMDAAVPRALRHPRALAEVGLMVELLADRAAAREVGPVTMGRALAHLGAGRALGRGRGPGQARDDDPCDGDDRGRGAGSVATRAPSPSAGVALTAGGHLRATVVRVTALQEARRPHRAQAALVTTAAVVAALGPGAVAVTAAVTGA

SEQ ID NO: 4459 - protein, 314 aa, Catenulispora acidiphila DSM 44928
MFADAWPLAVLAILLAWPVPVFLARAAWPRRHARAAIALWQAVGVAGGLALIGAPLAVGVAPLDGHLRTGLVELWRDAFHLRVPAALGLAQEIALALAAVLTVRLVGVTLLSAWRIERDLRRQRDAVDLAAEHADRDLRVLEHAAPAAYCLPGTRPRIVITEGTIAALAPDELEAVLAHERAHARWRHELVVQPFVAWESALPLPPARRATASVTALVEMLADDHAARSVGRPALARALVAIGGTAGPVPNQRTDGAPGSGSDPNPVRATPTLDRVQRLVRRPKATSLAERLIGPAAWLAAVLLVAGPTWYVLR

SEQ ID NO: 4460 - protein, 297 aa, Saccharomonospora viridis DSM 43017
MILVGHQVAAGAVAVLVMVWLLRSRWTHAHPRPALVLWQISGLTFVISVVGVLLGFGLAPFRRGFLPALFDLPTRWAELDLWHFAAVVAGLVLGAWLVLNQILCLLDTARARARHRLLLQLVAQPNSDAFVVDHPAAVAYCVPGRRPRIVVSAGARKLLSETELDAVLAHERAHAHERHDLVVAPFQALRRLFPRSGVLTRVCSVIELLVEMCADDKAARQHGREPLARALERFHANGAGGIPVGALAVVGADEAVRARIQRLRQPQQGGFPLIWPLACGLLLTAFGTSVGVFAMPL

SEQ ID NO: 4461 - protein, 334 aa, Nakamurella multipartita DSM 44233
MDADLAPAAGPTPVAAIGCLLVLIGVTLAAPVSLALAHARWPRRAPACSLLLWQGVCLGAGFSVVAGLALLAVEPSGHTLVGAGLSWWGSLFAGELAPWRAVCGLLGLAVAVLLLTTLIRTAWRTVRRRRGHRQLLDLLTRPIPPRVPIGAGCQVRLMDHRSAVAYTLPGLHARLVVSTGLVDLLTPVELAAVVEHERAHLRARHDILILPFQSWVAAVGRVRGVREAGRSVTELTEMLADDVARARSAPGALASALTRVALEGRTRAGTDGPDTIGGQAAGSDAHRAGSGTCVTDRVRRMNDPRPLPLFARALIVLTAAGLLAIPATVLTLTW

SEQ ID NO: 4462 - protein, 512 aa, Synechococcus sp. CC9605
MQFPPTSGQPQMQVQKLPTGIEGFDDVCQGGLPIGRSTLISGTSGTGKTVFSLHFLHNGIKQFDEPGIFVTFEESPLDILRNAASFGWNLQEMVEQDKLFILDASPDPDGQDVAGSFDLSGLIERINYAIRKYKAKRVAIDSITAVFQQYDAVFVVRREIFRLIARLKEIGVTTVMTTERIDEYGPIARYGVEEFVSDNVVILRNVLEGERRRRTLEILKLRGTTHMKGEFPFTMGTHGISIFPLGAMRLTQRSSNVRVSSGVPRLDDMCGGGFFKDSIILATGATGTGKTMLVSKFIEDACRNKERAILFAYEESRAQLLRNGTSWGIDFEQMEQDGLLKIICAYPESTGLEDHLQIIKTEISQFKPSRMAIDSLSALARGVSHNAFRQFVIGVTGYAKQEEIAGFFTNTSEEFMGSHSITDSHISTITDTILLLQYVEIRGEMARALNVFKMRGSWHDKGIREFVITGNGPQIKDSFSNFERIISGVPHRVTTDERSELSRIARGVSTED

SEQ ID NO: 4463 - protein, 504 aa, Rhodospirillum rubrum ATCC 11170
MTLPLLTEVEKLPTGIPGFDLIAHGGLPAGRTTLIVGTAGSAKTIFSAQFLAAGIQSFDQGAVFVTFEESVADIRRNLAGFGWDIPAWEAAGKWSFVDASPYPLEDGDVVGSYDLGGLLARIEHAVRQTPATRVVLDSLGAVFMRFADPATLRNELLRIAAALKDMGVTTLMTAERSEEEGPLTRTGIEEFVADNVVILRNLREGERRRRTCEILKYRGAYHQKGEFPFAILPGSGVQVIPLSAMELRQGSSDLRIPSGSVDLDGMCGGGFFRDSVVLVSGATGTGKTLMSTHFLNGGLQAGERCLLFAFEESRPQLFRNASGWGIDFQAAEDSGQLRVVCDYPEVASIEDHLIKIKEEIDTFHPHRVAVDSLSAIARICSERGFREFVIGLTSFIKHQEVAALFTSNTPTLMGGSSVTEAHISSITDSIILLRYVETFGEISRGVMVLKMRGSRHEKEIREFAIDATGMHIGRPFRTVTGILAGNPQYSHQSEADRLDRLFPK

SEQ ID NO: 4464 - protein, 509 aa, Prochlorococcus marinus MIT 9515
MKEKKINKSNKMQVQKLPTGIDGFDDVCRGGLPASRSTLVSGTSGTGKTVFSLQYLHHGICNFDEPGIFITFEESPLDIIRNAASFGWDLQKLIDQNKLFILDASPDPDGQDVAGNFDLSGLIERISYAIRKYKAKRVAIDSITAVFQQYDAIYVVRREIFRLIARLKEIGVTTVMTTERVDDYGPIARYGVEEFVSDNVVLLRNVLESEKRRRTLEVLKLRGTVHMKGEFPFTMGDDGISVFALGAMRLTQRSSNIRISSGVKDLDEMCGGGYFQDSIILATGATGTGKTMLVSKFIEDAYNNNERAILFAYEESRAQLNRNATSWGIDFEKMESDGLLKIICAYPESTGLEDHLQIIKTQINQFKPKRLAIDSLSALARGVSLNAFRQFVIGVTGYSKQEEIAGFFTNTAEEFMGSHSITDSHISTITDTILLLQYVEIKGEMARAINVFKMRGSWHDKRIREYIITSRGPEIKDSFSNFEQIFSGAPHRVISDQNIQNVFKGIDKI

SEQ ID NO: 4465 - protein, 509 aa, Prochlorococcus marinus MIT 9301
MNDKKIGKSNKMQVQKLPTGIEGFDDVCRGGLPVSRSTLVSGTSGTGKTVFSLQYLHHGICNFDEPGIFVTFEESPLDIIRNAASFGWDLQELIDQNKLFILDASPDPDGQDVAGSFDLSGLIERISYAIRKYKAKRVAIDSITAVFQQYDAIYVVRREIFRLIARLKEIGVTTVMTTERVDDYGPIARYGVEEFVSDNVVLLRNVLESEKRRRTLEVLKLRGTVHMKGEYPFTMGTDGISVFALGAMRLTQRSSNIRISSGVKDLDDMCGGGYFQDSIILATGATGTGKTMLVSKFVEDAYDNNERAILFAYEESRAQLLRNATSWGIDFEKMESDGLLKIICAYPESTGLEDHLQIIKTQINQFKPKRMAIDSLSALARGVSLNAFRQFVIAVTGYTKQEEIAGFFTNTAEEFMGSHSITDSHISTITDTILLLQYVEIKGEMARALNVFKMRGSWHDKRIREFIITNSGPEIKDSFSNFEQIFSGAPHRVVPDQNVQNVFKGLDKN

SEQ ID NO: 4466 - protein, 510 aa, Roseiflexus sp. RS-1
MSLNLRQPAIEKLPTGISGFDLIANGGIPAGRTTLVSGTAGSAKTVFAAQFLAEGIRKYGEHGVFVTFEEPPSDIRRNMESLGWDIATWESEGKWAFVDASPQPGEEMLFAGNYDLGALLARIENAVRRIGARRLSMDSLGAIFTQFADSAVVRRELFRVVSALKRLGVTAIMTGERTQEYGDIARYGVEEFVADNVIILRNVLEDEKRRRTIEILKFRGTSHQKGEFPFTIISGEGMVVIPLSAIELKQRSSDIRVTSGNPELDRMCGGGFFRDSILLVSGATGTGKTLMTTEFMAGGVRRGERCLLFAFEESREQLFRNATGWGIDFEQMERDGLLRVVCEYPETAGLEDHLIAMKKLIQEFRPNRVAVDSLSALERVSTIRGFREFVISLTSFIKHQEIAGLFTATTPSLMGGESVTETHISTLTDSIILLRYVEMFGEMRRGLTVLKMRGSMHDKDIREFTIDNRGMHIGRPFRQVTGILSGNPIHIAPGEIDRMNQLFNDDEPQT

SEQ ID NO: 4467 - protein, 573 aa, Candidatus Methanoregula boonei 6A8
MKKNKTAAIVGAAEIEKVHSGIKGLDDITGGGLPKGRPSLVSGGPGCGKTLFAMEFIIRGIIDYGEPGVFVAFEEKIDDLKLNFRSMGFDLDNLIRRKKLVLDHITIDRSEIEEAGEYDLEGLFIRLGALIDEVGAKRVSIDTLEALFSGFANEAILRSELRRLFLWLKDRGVTAVVTGERGDRTITTYGLEEYVADCVITLDHRVTNQIATRRLHIVKYRGSIHGTDEYPFLISEDGISVLPITSLSLTHKASGERIFTGIPRLDTMLEGKGFYRGSSILISGQAGTGKTSIAATFIDAACRRNEKCLFFIFEESESQLLRNMKSIGINLEPWVKSGLLKFHAVRPTAYSLEMHLSVMLKLIGEFKPRVVAVDPISNLYPIGDDIQVRSMLMRLIDFAKSLQITGLFTSLSNDVNVGVYSVEPTEMHVSSLMDAWLILKNIEGNGERNRAFSIIKVRGMAHSNQLREFILSDKGIRLLDVYKGSEGVLFGSARIAQEGNEIDDRLCKNEEIERKKRELESRRKLMENEISLLRERFAQEEDEMMILIGQDVSREKVAAKTKREIATQRHVDR

SEQ ID NO: 4468 - protein, 510 aa, Roseiflexus castenholzii DSM 13941
MTQNPRQPAIEKLPTGISGFDLIANGGIPAGRTTLVSGTAGSAKTVFAAQFLAEGIRKYGEPGVFVTFEEPPSDIRRNMESLGWDIPAWESEGRWAFVDASPQPGEEVLFAGNYDLGALLARIENAVRRIGAKRLSMDSLGAIFTQFADSAVVRRELFRVVSALKRMGVTAIMTGERTQEYGDIARYGVEEFVADNVIILRNVLEDEKRRRTIEILKFRGTSHQKGEFPFTIMSGEGMVVIPLSAIELKQRSSDIRVTSGNPELDRMCGGGFFRDSILLVSGATGTGKTLMTTEFMAGGVNRGERCLLFAFEESREQLFRNATGWGVDFEQMERDGLLRVVCEYPETAGLEDHLIAMKKLIQEFRPNRVAVDSLSALERVSTIRGFREFVISLTSFIKHQEIAGLFTATTPSLMGGESVTETHISTLTDSIILLRYVEMFGEMRRGLTVLKMRGSMHDKDIREFTIDNRGMHIGRPFRQVTGILSGNPIHIAPGEIDRMNQLFNDDEQQS

SEQ ID NO: 4469 - protein, 788 aa, Shewanella sp. ANA-3
MLTLLDQLDKGTLWRSPGGIHPPEVKFLSNTTPISQLPLAQEYLVPVPQVGENCTLAVKVGDKVLKGAPLTQGTSIWHLPVHAPTSGTVVTIEPRASNHASALPVNTCVIAADGEDRWCELTPGSIELSNHEMIAKIHGAGIAGMGGAAFPSHIKLNPVSEIELVIINGVECEPYISADDRLMREYSQDILAGIGIIHRLLAPKRIVIAIEDNKPEAIKAMQQAVSQSALPAGSTRVTAIPTKYPSGGEKQLIQIITGREVPSGAIPAKLGIVVHNVGTAFAIHQAVTQGKPLIERVVTVTGQNVGKPGNYWLPIGTPVEHVLKYTEFNAEADQKVIIGGPMMGHALPTIQVPILKGTNCILVPSSQEIGTTPEEKACIRCGECANACPALLLPQQLFWHAKAEEYDKAASYNLKDCIECGCCSYVCPSDIPLVEYYRIAKSALKQAADEKHQAERAKQRFEARIQRLEEEKLAREAKAKEAAARRQATMTSTDKNAVAEAMARIAAKKAAAAETTADNAPVEVVAADASSTEAPKGKAAVAAAIARAKAKKAAAAQGADDAESSQQAVSPEQSEPTEQTESLSQKDKVAAAIARAKAKKAALKADSDANSDTDAATSNTDKSATETTANAEADDKKAKVAAAVARAKAKKAAAQQAESSEVAEVQPERVADAKPESESGSIPSTPLSPEDEKKAKVAAAVARAKAKKAATQQAESTEVAEVQPKLAVDAEPDSESGSQSGDESSSVAEPSAPLSPEDEKKAKVAAAVARAKAKKAAREANAISDANE

SEQ ID NO: 4470 - protein, 537 aa, Verminephrobacter eiseniae EF01-2
MLYHLYETQRSLMEPFTDFAQAASKLLSNPGSPLSQTGTAQRMAAAYDLLYRLGKDYEKPAFGIHTVDVDGVGLAIHERVEIDKPFCALRRFKRFSDDPATLTGLKGQPVVLIVAPLSGHYASLLRDTVRTMLREHKVYITDWKNARMVPLSEGPFHLDDYVNYMQEFIRHLQAKYGHCHVVSVCQPTVPVLAAVSLMASRGEQTPLTMTMMGGPIDARKSPTAVNNLAINRSFEWFENNVIYRVPEKFPGAGRRVYPGFLQYTGFVAMNPDRHASSHYDYFKNLVKGDDASAEAHRNFYDEYNAVLDMDADYYLETIQTVFQDYKLVHGTWDVRSPEDRIERVRPQDITSTALFTVEGELDDISGSGQTEAAHGLCSGIAHQAQRHLEVKGAGHYGIFSGRRWRDMVYPQVRDFILAHPSPPKNALAPAVAAATAAAEAPVAVPVTPASKAGSEPAQQTAQTVEAVPPATSAPRAAAKTPAAPAIATRWVSPEPASAVAAVAAVAAVAAESAGPGTARRAAKAAATPAPRSKARKA

SEQ ID NO: 4471 - protein, 885 aa, Shewanella baltica OS185
MLTLLDQLDKGTLWRSPGGIHPPEVKFLSNATPIGQLPLASTYLVPVPQVGENCTLAVKVGDSVLKGTPLTQGTSIWHLPVHAPTSGTIVAIEPRASNHASALPVNTCVIAADGKDTWCELVQNQLDDLSHQQIVDKVRSAGIAGMGGAAFPTHIKLNPVSEIDLVIINGVECEPYISADDRLMREYSQDILAGIGIIHRLLTPKRIVIAIEDNKPEAAKAMQAAVSQCGLPAGSIRVTVIPTKYPSGGEKQLIQIITGREVPSGAIPAKLGIVVHNVGTAYAINQAVTQGKPLVERVVTVTGRNVGKPGNYWLPIGTPVDHVLTATEFTPEPDQKVIIGGPMMGHALANIQVPILKGTNCILVPSSQEIGSTPEEKACIRCGECATACPALLLPQQLFWHAKAEEYDKAASYNLKDCIECGCCSYVCPSDIPLVEYYRIAKSALKHAADEKQQAERAKQRFDARLARLEEEKLARETKAKEASERRQASMTGTDKNAVAEAMARIAAKKAAAAQAVTGESINEESSVTTTDTTEVPKGKAAVAAAIARAKAKKAAQANADGTDTNGAATDSAKTDNAVNIDANDSISATVAIAQEAPSSQKDKVAAAIARAKAKKAAQQTDTAPLEPAETADSTSELSAADDKKAKVAAAVARAKAKKAAQQGETAASDTEVSNTDVSVNDVNDVNDAEAIKKAKVAAAVARAKAKKAAQQAETNAENGLNQTATPAVDSAANVQAVVNADAETAVNAAATDIEVSNTDVSVSDAEAIKKAKVAAAVARAKAKKIAAASAESKTESEIESVDEIRAEANVASPSIAATLETAITGAETVLPSVESAAEPIETAPLSSDELKKARIAATIAKAKAKKAALAQEANASSDSSVTND

SEQ ID NO: 4472 - protein, 912 aa, Vibrio harveyi ATCC BAA-1116
MLSLIEQIRTGSLWDFPGGVHPAENKKQSNKTELVHAAIPSEIVLPLKQHIGKAGNLLIAVGDTVLKGQQLTASDSGFTVPVHAPTSGQITAIEPRTVAHPSGLSELCAVMTPDGNDTWCEKTPVADYTQESADALIDVIRLAGISGMGGAGFPTAKKIQSGIARTEILIVNAAECEPYITADDKLMQEHADELIQGIEIVEHILKPKLTIIGIEDNKPAAIKALEQAAMNKDIVIRVIPTKYPSGGEKQLIKILTNKEVPSGAIPADIGILVQNVGSLYSIKRAVIDGEPVVNRIVTLTGKTFKQPRNVWTLLGTPVQALLDEFGYKADKKLQRLIMGGPMMGFTLPHAQVPITKTANCILAPKRREIASDQYEMECIRCSQCAEACPASLLPQQLQWYAKSQEYEKLEELNLKDCIECGACAFVCPSEIPLVQYYRQAKAEIRTRAQEAAAAERAKLRFEEKKARMEREKAERENRFKKAADDRRKDMKASGGDDAIAAAIARVKAQKDNAEAKAEPAVKPAVAAAIAKAKAKQAAAAQSGAAEPDNSEMAKLREERKRIARERKAAKEQDDTSADNADDKKSAVAAAIARAKAKKAQQEDASTPTEAGDKKAAIAAAIARAKAKKAQQEDSTESVETEAPVKQAEDPKKAAVAAAISRAKARKAQQEGSTESEETEAPAKQAEDPKKAAVAAAIARAKARKAQQEGSTESLETDAPAEPAEDPKKAAVAAAIARAKARKAQQESQTEPVEAEAPSEEPEVDPKKAAVAAAIARAKARKAQQEAQTESVEAEAPSEEPEVDPKKAAVAAAIARAKARKAQQEAQTESVEAEAPSEEPEVDPKKAAVAAAIARAKARKAQQEAQTESVEAEAPSEEPEVDPKKAAVAAAIARAKARKAQQEANKNNTEENE

SEQ ID NO: 4473 - protein, 888 aa, Shewanella baltica OS195
MLTLLDQLDKGTLWRSPGGIHPPEVKFLSNATPIGKMPLASTYLVPVPQVGENCTLAVKVGDSVLKGTPLTQGTSIWHLPVHAPTSGTIVAIEPRASNHASALPVNTCVIAADGKDTWCELVQHQLDDLSNQQIVDKVRSAGIAGMGGAAFPTHIKLNPVSEIDLVIINGVECEPYISADDRLMREYSQDILAGIGIIHRLLTPKRIVIAIEDNKPEAAKAMQAAVSQCGLPAGSIRVTVIPTKYPSGGEKQLIQIITGREVPSGAIPAKLGIVVHNVGTAYAINQAVTQGKPLVERVVTVTGTNVGKPGNYWLPIGTPVDHVLTATEFTPEPDQKVIIGGPMMGHALANIQVPILKGTNCILVPSSQEIGSTPEEKACIRCGECATACPALLLPQQLFWHAKAEEYDKAASYNLKDCIECGCCSYVCPSDIPLVEYYRIAKSALKQAADEKQQAERAKQRFDARLARLEEEKLAREAKAKEASERRQASMTGTDKNAVAEAMARIAAKKAAAAQAVTGESITEESSVTTTGSTEVPKGKAAVAAAIARAKAKKAAQANADGTDTNGAETDSTKTDNAVNVDANDSISATDVIAQEAPLSQKDKVAAAIARAKAKKAAQQTDTAPLESTETADNTPALSADNDKKAKVAAAVARAKAKKAAQQVETAASDTEVSNTDVSVSDVSVSDVNDAEAIKKAKVAAAVARAKAKKAAQQAETNAENGLNQTATPAVDSAANVQAVDSTASAETAVNAVATDIEVSITDVSINDAEAIKKAKVAAAVARAKAKKIAAASTESKTDAEIESVDDIQTEANVASPSIAATLDTAATEADAVLPSVGSTAEPIETAPLSSDELKKARIAATIAKAKAKKAALAQEANASSDSSVTND

SEQ ID NO: 4474 - protein, 735 aa, Salmonella enterica serovar Heidelberg SL476
MLKLFSAFRKDKIWDFDGGIHPPEMKTQSNGTPLRQVPLAPRFVIPLKQHIGAEGELCVSVGDRVLRGQALTRGRGRMLPVHAPTSGTVIAIAPHSTAHPSALAELSVIIDADGEDRWIEREGWSDYRAHSREALIERIHQYGVAGLGGAGFPTGVKLQGGGDKITTLIINAAECEPYITADDRLMQDCAAQIVEGIRILAHILQPREVLIGIEDNKPQAISMLRAVLADAHDISLRVIPTKYPSGGAKQLTQILTGKQVPHGGRSSDIGVLMQNVGTAYAVKRAVVDGEPITERVVTLTGEAVSRPGNVWARLGTPVRHLLNDAGFCPSADQMVIMGGPLMGFTLPWLDVPVVKITNCLLAPSVTEMGAPQEEKSCIRCSACADACPADLLPQQLYWFSKGQQHDKATAHHIADCIECGACAWVCPSNIPLVQYFRQEKAEINAIRLEEKRAAEAKARFEARQARLEREKAARLARHKSAAVQPAAKDQDAIAAALARVKEKQAQATQPVVIQAGSLPDNSAVIAAREARKAQARAKQAAHPVADSAIPGDDPRKAAVEAAIARAKARKQEQQAGSEPAEPVDPRKAAVEAAIARAKARKQEQQAGSEPAEAVDPRKAAVEAAIARAKARKQEQQAGGEPAEAVDPRKAAVEAAIARAKARKQEQQTGSEPAEPVDPRKAAVEAAIARAKARKQEQQAGSEPAEPADPRKAAVAAAIARVQAKKAAQQQVVNED

SEQ ID NO: 4475 - protein, 732 aa, Salmonella enterica serovar Schwarzengrund CVM19633
MLKLFSAFRKDKIWDFDGGIHPPEMKTQSNGTPLRQVPLAPRFVIPLKQHIGAEGELCVSVGDRVLRGQALTRGRGRMLPVHAPTSGTVIAIAPHSTAHPSALAELSVIIDADGEDRWIEREGWSDYRAHSREALIERIHQYGVAGLGGAGFPTGVKLQGGGDKITTLIINAAECEPYITADDRLMQDCAAQIVEGIRILAHILQPREVLIGIEDNKPQAISMLRAVLADAHDISLRVIPTKYPSGGAKQLTQILTGKQVPHGGRSSDIGVLMQNVGTAYAVKRAVVDGEPITERVVTLTGEAVSRPGNVWARLGTPVRHLLNDAGFCPSADQMVIMGGPLMGFTLPWLDVPVVKITNCLLAPSVTEMGAPQEEKSCIRCSACADACPADLLPQQLYWFSKGQQHDKATAHHIADCIECGACAWVCPSNIPLVQYFRQEKAEINAIRLEEKRAAEAKARFEARQARLEREKAARLARHKSAAVQPAAKDQDAIAAALARVKEKQAQATQPVVIQAGSLPDNSAVIAAREARKAQARAKQAAHPMADSAIPGDDPRKAAVEAAIARAKARKQEQQAGSEPAEPVDPRKAAVEAAIARAKARKQEQQAGSEPAEPVDPRKAAVEAAIARAKARKQEKQAGSEPAEPVDPRKAAVEAAIDRAKARKQEQQAGSEPVDPRKAAVEAAIARAKARKQEQQAGSEPVEPADPRKAAVAAAIARVQAKKAAQQQVVNED

SEQ ID NO: 4476 - protein, 704 aa, Salmonella enterica serovar Dublin CT 02021853
MLKLFSAFRKDKIWDFDGGIHPPEMKTQSNGTPLRQVPLAPRFVIPLKQHIGAEGELCVSVGDRVLRGQALTRGRGRMLPVHAPTSGTVIAIAPHSTAHPSALAELSVIIDADGEDRWIEREGWSDYRAHSREALIERIHQYGVAGLGGAGFPTGVKLQGGGDKITTLIINAAECEPYITADDRLMQDCAAQIVEGIRILAHILQPREVLIGIEDNKPQAISMLRAVLADAHDISLRVIPTKYPSGGAKQLTQILTGKQVPHGGRSSDIGVLMQNVGTAYAVKRAVVDGEPITERVVTLTGEAVSRPGNVWARLGTPVRHLLNDAGFCPSADQMVIMGGPLMGFTLPWLDVPVVKITNCLLAPSVAEMGAPQEEKSCIRCSACADACPADLLPQQLYWFSKGQQHDKATAHHIADCIECGACAWVCPSNIPLVQYFRQEKAEINAIRLEEKRAAEAKARFEARQARLEREKAARLARHKSAAVQPAAKDQDAIAAALARVKEKQAQATQPVVIQAGSQPDNSAVIAAREARKAQARAKQAAHPMADSAIPGNDPSKAAVEAAIARAKARKQEQQAGSEPVEAVDPRKAAVEAAIARAKARKQEQQTGSEPAEPIDPRKAAVEAAIVRAKARKQEQQTGSEPAEPIDPRKAAVEAAIARAKARKQEQQTGSEPAEPADPRKAAVAAAIARVQAKKAAQQQVVNED

SEQ ID NO: 4477 - protein, 358 aa, Shewanella oneidensis
MNPELITMLKETANMFAFLALELTLLFLVISYLVGMLQEFVTPQKVQSILSSRNGKGYLIAALLGSITPFCSCSTIPFLKGLLRARAGFGPMMVFLFASPLLNPIIIGLFVVTFGVKVAVFYFVMAMGVSVIAGFTLEKLGFERYIRKEAYEQQELGASAGNNKQSSAPSSCCDTTPAPVASSCCGVTSEPVTSSCCGTQPAPVASLCCDDRSSILPPQVRTEHRWLRVWRTTWKDFKQVSPYLFVGVLLGSFIYGFIPTEFIVNYAGEATWYAIPLAAVIGIPLYIRAEAVIPLSAALVQKGMAMGSVMALIIGSAGASITEVILLKSIFKNQMIAAFLGVILAMAIASGFLYGLVF

SEQ ID NO: 4478 - protein, 304 aa, Colwellia psychrerythraea 34H
MTITQQMVFDTLNMFAFLAVELTVLFLLISYIVGVLQEYIPPSKIQSILSSKNGKGYIVAGFLGAITPFCSCSTIPFLKGLLRAKAGFGTMMVFLFASPLLNPIIIGLFAVTFGLKVTAFYFTIAMGVSIAAGYLLEKFGFERYIKPEAYITPESKSCATSCGNNIETVSKWTKIWHSTWSDFKKVLPYLIGGIALGSMIYGFMPTEFVASVASESNPFAVPIAAVIGIPLYIRAEAVIPLSAALAAKGMGLGAVMALIIGSAGASLTEVILLKSLFKNPMIIAFLTVILSMAVGAGYLYSFLF

SEQ ID NO: 4479 - protein, 341 aa, Jannaschia CCS1
MADQTLIPRVLPQIWGRIDKVALTFVLIVAVLAAFDRSAVTPTLQETLEHFGGTLPFILFAVMAIGVMKATGSERLLDGAFAGREARMIVVGALAGGLSPFCSCEVIPFVAALLAAGAPLSAVMAFWLASPLMDPAMFVVTAGGIGFDFAVAKTVAAVALGIFGGVMVMTFARTPVFADPLREQPMKSGCCAPKKTTLNWRFWQEADRRATFAQAAWDNFIFLGKWLMLAYLLQSLLISYVPAALIAQVVGGDGLMPIIVGALVGAPAYLNGYAAVPLIAGLLEQGMSPGAAMSFVIAGGVSCIPAAVAVWALVKPRVFAAYLGLALAGAIIAGMVWSVIA

SEQ ID NO: 4480 - protein, 343 aa, Ruegeria sp. TM1040
MADTSLSLRPMRAALEGMQSPWTLGALILAVVALVDGANFWPVLSFAAQALLSTSKYILFAVTLLAYLKATGAEAMVARAFVGRETRMIFLAALLGGLAPFCSCEVIPFIAGLLALGAPLSAVMAFWLSSPLIDPPTLLITAAALGWPFALAKAVSAVALGLFGGFVVKALRRGGLFAEPLKRAPVKSCCGCAAPATDARPNWRFWQDAERREIFRGQFVENALFLLKWLAFAYVLEALLVTYVRPEWIAAIVGGEGVVPIAIAAVVGMPAYLNSYVAPPLLAGLMSQGMSAGAALAFMIAGAVSSIPAMAAVWSLVKPRVFATYLGLGVSGAILSGVVFQMI

SEQ ID NO: 4481 - protein, 316 aa, Shewanella frigidimarina NCIMB 400
MWKFKMINITQQMLIETLNMFAFLAVELTVLFLVISYFVGILQEYIPPSKIRTILSGKNGKGYIVAGLLGAITPFCSCSTIPFLKGLLRANAGFGPMMVFLFASPLLNPIIIGLFAVTFGLKVTAFYFAIAMGVSVIAGFTLEKLGFDKYVKPEANFAPDVTNAPEKTTCGSSCGGKTKQVSKWRKIWNSTWSDFKKVLPYLIGGIALGSMIYGFMPTEFVVSVASENNPFAIPIAAVIGIPLYIRAEAIIPLSAALAAKGMSLGAVMALIIGSAGASLTEVILLKSIFKNQMIVAFLFVILSMAMGAGFLYQSIF

SEQ ID NO: 4482 - protein, 358 aa, Shewanella sp. ANA-3
MTPETITILKETVNMFVFLAFELTLLFLAISYLVGMLQEFITPQKVQSILSSRHGRGYIVAALLGSITPFCSCSTIPFLKGLLRARAGFGPMMVFLFASPLLNPVIIGLFVVTFGFKVALFYFTVALGVSVIAGYLLEKLGFEQYVRQEAYAQADTATAASCCDTKPSPTASSGCEVTPAPVVSACCDSKTAPAVTLCCVTQAEPIATSCCPSQTVPQNKPQSRWVKVWRATWKDFKQVLPYLFIGVLLGSMIYGFMPTELIVQYAGEATWYAIPIAALIGIPLYIRAEAVIPLSAALIQKGMAMGSVMALIIGSAGASLTEVILLKAIFKGQMIAAFLSVILGMAVGAGFLYSYLFS

SEQ ID NO: 4483 - protein, 358 aa, Shewanella putrefaciens CN-32
MTPETITMLKETVNMFVFLAFELTLLFLAISYLVGMLQEFITPQKVQSILSSRHGRGYIVAALLGSITPFCSCSTIPFLKGLLRARAGFGPMMVFLFASPLLNPVIIGLFVVTFGFKVALFYFTVALGVSVIAGYLLEKLGFEQYVRQEAYAQADTATAASCCDTKPSPTASSGCEVTPAPVVSACCDSKTAPAVTLCCVTQAEPIATSCCPSQTVPQNKPQSRWVKVWRATWKDFKQVLPYLFIGVLLGSMIYGFMPTELIVQYAGEATWYAIPIAALIGIPLYIRAEAVIPLSAALIQKGMAMGSVMALIIGSAGASLTEVILLKAIFKGQMIAAFLSVILGMAVGAGFLYSYLFS

SEQ ID NO: 4484 - protein, 378 aa, Vibrio harveyi ATCC BAA-1116
MNPEIMTMAKEALDMFAFLATELIILFLAISYIVGVLQDFLTPEKIQSILSSKKGKGYFIAALLGSITPFCSCSTIPFLKGLLRARAGFGPMMVFLFASPLLNPVIIGLFVVTFGWKVAVFYFAIAMTVSVVAGYVLEKLGFERYVKPEAYEAAGTSSCGTSCGDSSKKKEQAKPASSCGTSACGEPAPVAAKTSCCSEPAPVVAKTSCCGDSAPKAEPKVEVSCCSSDGSATATIVEEKEPSRWVRIWHSTWKDFKQVFPYLMMGIAIGSFIYGFIPTDLIAEYAGEAKWYAIPVAAIIGIPLYIRAEAVIPLSAALVQKGMALGSVMALIIGSAGASLTEVILLKSIFKNQMIAAFLFVILSMAMGAGYLYTFIFA

SEQ ID NO: 4485 - protein, 333 aa, Escherichia coli E24377A
MSSWLAMLQDAAEMFVFLAVELSLLFIVISAGVSLIRQKVPDHKIQQMMGARKGRGYLLAALLGAVTPFCSCSTIPMLRGLLSAKAGFGPTLTFLFVSPLLNPIIVGLMWMTFGWKVTLLYAIIAAGVSVLASIILDSLGFERHIIASKSSSANCCALAKTSPGTTYTPIKVSCCSPAAKAIENPVVTCCSTKAVVSINPIKLATKDALQQFKDVLPYLLLGVLIGSFIYGFIPSAWIAAHAGADNPFAIPLSAVVGIPLYIRAEAVIPLASVLMTKGMGLGALMALIIGSAGASLTEVILLKSMFRMPMIAAFLTVILGMAILMGYLTQLLF

SEQ ID NO: 4486 - protein, 348 aa, Dinoroseobacter shibae DFL 12
MAETSTQPPDLGHAKRRRLPRPDAALTAIAVILVAVAVLDTAALRPVIENTLGSFGHTLIFILFAIGTVAYLRAAGATTLLAKVFQGNETRMIVLAAAFGGLSPFCSCEVIPFIAALLAVGAPLSAVMAFWLASPLMDPAMFFITSGALGLDFALGKTVAAIGLGMMGGFSVRALAGTALYADPLKSAPKSGCCGCGPTPFDGRPVWAFWREAPRRREFRDVAVHNLLFLGKWLLLAYVLESLMLRYVPADLIASAMGGDGIGPILIASIVGAPLYLNGYAAVPLIAGLLEQGMSPGAAMSFVIAGGVSCIPAAVAVWALVKPRVFASYLGFSLTGAILAGLAWNMIA

SEQ ID NO: 4487 - protein, 307 aa, Shewanella woodyi ATCC 51908
MLSQSTINMLQETLNMFIFLAVELTLLFLAISYLVGVLQEYIPPSKIQNILSSKNGKGYLVAGFLGAITPFCSCSTIPFLKGLLRAKAGFGTMMVFLFASPLLNPIIIGLFAVTFGLKVTLFYFVMAMGVSVIAGYALERLGFEKYIKAEAYEEPKPSCCGTSCGAKPAAISKWRRIWNTTWKDFKKVLPYLIGGIAVGSMIYGFMPTEFVAKVASDSNPFAVPIAAIIGIPLYIRAEAVIPLSAALAAKGMGLGAVMALIIGSAGASLTEVILLKSLFKNQLIIAFLTVIITMAIGAGYLYGFIFS

SEQ ID NO: 4488 - protein, 359 aa, Escherichia coli SMS 3 5
MNSWIPMLQDAAEMFVFLAVELSLLFIVISAGVSLIRQKVPDHKIQQMMGARKGKGYLLASLLGAVTPFCSCSTIPMLRGLLSAKAGFGPTLTFLFVSPLLNPIIVGLMWVTFGWKVTLLYAIIAAGVSVLSSIILDYLGFERHIVEYKNSVSGSCATKCGDSEASVKTNCCTSSAKTIINLKTVKKEQNISACCPSILSEKSSESCCSSESQGNRNLTMNATSGLIKLAMKDALQQFKDVLPYLLLAILIGSFIYGFIPSEWIAAHAGADNPLAIPLSAVVGIPLYIRAEAVIPLASVLMTKGMGLGALMALIIGSAGASLTEVILLKSMFRMPMIIAFLTVILGMAILMGYLTQFLF

SEQ ID NO: 4489 - protein, 333 aa, Escherichia coli SMS 3 5
MSSWLAMLQDAAEMFVFLAVELSLLFIVISAGVSLIRQKVPDHKIQQMMGARKGRGYLLAALLGAVTPFCSCSTIPMLRGLLSAKAGFGPTLTFLFVSPLLNPIIVGLMWVTFGWKVTLLYAIIAAGVSVLASIILDSLGFERHIIASKSSSANCCAPAKTSPGTTYTPIEVSCCSPTAKAIEKPVVNCCNTKAVVSINPIKLATKDALQQFKDVLPYLLLGVLIGSFIYGFIPSEWIAAHAGADNPFAIPLSAVVGIPLYIRAEAVIPLASVLMTKGMGLGALMALIIGSAGASLTEVILLKSMFRIPMIVAFLTVILGMAILMGYLTQMLF

SEQ ID NO: 4490 - protein, 1146 aa, Brucella suis 1330
MAEKPQKIRFTKRQMKRIERLVAESGEGIVSGSVRSARSIVSRCSHALLSICILLVLLGGVGFVILRGGVNSDLLRDEAQKSLSHILGEGASASIGSAALSLDRNGHVTMEARDVSIVDPKQGVAINGIKSVRLGLAPLPLLTGKLRVAQLEVEGLAFDLPEARGGGFWKSLPYDEKGYVDFDAASGEIFAAMRRSLELLSAQDTRVIRIANSSVSFKVGEEEQVLDIERARLTEDRGKIAITGTVVCKGRKIALDGDIERRASDKALSAFRLNVKDIPVVMGSPPQVAPVINGNRVNPAHFELDAYAQLTLSGFAADGDKPERLAADLTVDGIDMQLGKVDNVRGNVRLSLEHRVGSHKIEIKPSRLVLGGLQAQFNGAFGPEQEAESNTDGPSYRFEVLTTSATSMPPESSDPPLSFATRIAGRYMPAQQRIQFVNLDVQTEGGQLYGQGSMGFGDGSPEMIFMLRIPKMPVADAKHLWPIDVADGAREWVLKNLFGGTLQDSRIDISLAGGRFNGPGLPPPLTEEEINADFNVVDTRFDVVGELPAVRDADGTVSVRGAYTTIKLLKGTAYTPNNRKATVSNGTLVIPWGPQRPVMADLDLHVSGEAAAIAEIAGNKPIDVLKNVPFLPQDVTGDINAQVKVSFAVSKDPPPGTLKWNADIGFSELDIAKPVGGSKITDATGNIKVDQSAAIITADARLDNVPAKVSMTEPVDRSGPAKREQKIKLEIDDKTRNAVFPGLNAVFSGPMSVDLGMENGGKRHVSADLLKTQIDLPWLGWRKGAGIPAKATFDLVEHSDKGEFEISNLVFSGDAFGAKGNLSIAKGDFQSADFSEIRLNRSDNLSVKATKSGNSFRVNVRGSQFDARALIKQISDLEAKKSGGGRANSPRVVVSAQVDEVHGFNNETLRNVAVSYESAGSKVSGISVNAVTSSGQPFVATNNDQGDARSISLQSNDAGAVLRFFDFYDKMRGGKITVGLAAQGNGPLRGQIDARNFSIVNEPRLAKIVSSSPSSGGASLTQAVKRDIDVSRVDVERGFSLIEKGQGYLNLSKGVVRGPAVGTTFQGTLYDQQGNMSITGTFMPAYGVNRIFGEVPIFGALLGNGRDRGLLGITYKLVGNAKQPQVIVNPISLIAPGIFRSIFEFQ

SEQ ID NO: 4491 - protein, 1210 aa, Nitrobacter winogradskyi Nb-255
MTKSTPTRDPNPHGDHHVSQGEVAGWGEDDDELHSRRVRRLLSRSDSRFHRAGDRFVRFRNWLAGERWIKRLAVAFLVLSVTFAGGFGALWWRLGAGPLNLDMMTPWLVSAIEGNIGHDNTVEIGGTQIERAGRIRIAVRIRDVVVRDRDRVVIASAPKAEVKLSGLALLTGRLRAESLDLVDAELAVRITPDGQVTVSTGDNAKPLATGVAPPLRSGLPSAVVSSETSPPPQATQQLSDSPAAAPASSESSGNAGALLAGLEWLDGLGVRGLDGQNLNEIGLKNGRLVVDDQQRGNRWSFSNISLSLHRPSAGGVAFTVSEGGSKEWSLHVAVGPPANGVRPIELRAAGIPAKTVLLALRIKDLTYSADMPLSGELKGEIGRDGLPTYLRGNLFAGKGTIIDSDTPDYPMAIDQIEMNVEWDSGRRVLLVPFKIVSGENRITLLARLQPPNGNVPDWQMGLSGGTIVLAGSDGEAPLIFNRIAVGLRFDTGHRQAILTQADISNGEIGIAGTGSIDYSDAPRLKLGFAGTPMSAAALKSIWPAVIVPELREWVIGRIKRGFLKRIEIGVNSPLHNLSRRGPPMPDDGLSVDIVADNVTIYPVDELPLVHDAGLKARVTGRTAAVTIEQAVADTPSGRRLNISDVVFEVPDMAPKPSPAKVRFRIDSPVPAAAEILVSDRLNEFTDNLIDPNSSKGTVAAQIALGLPLTRQITKEDTTYSITADLTGFAADRLVMNQKLEASALKVTANNEGYHVKGDVKINGQPASLDYRKPADGDADIKLQATLDDASRAKLGIDLGAGATGSIPVKLAGKIGRNRDNKFAVDADLTSLKLDNILPGWVKLPGKSGHATFNVVQKAQSTRLEDIIVDGSGVTIKGSLEVDQNGDLVNVNFPVYAPSEGDRASLKAERNADGVLKVVMRGDVFDGRGFLKSAISGKQADARSKSKSIDFDIDLKIGAVAGFYGEAIRSADVKMAQRNGSVRSLTMTGKIGRNTPLTGSLRGRPQGRDVVLIETDDAGAFFRFTDTYGKMFGGQLALAMDPPTAEQRAKQGLINVRDFTIKGESALDRAAAGGPRTAQNGISFSRLRAEFSRQNGQLTVRDGVVKGPTIGATIEGRIDYPANEVRMSGTFVPMYGLNNIFGQLPVVGLILGGGSDEGLIGVTYEVVGTPGQPQLRINPISAMAPGLVRKIFEFQTGRTANQIEFPATSGN

SEQ ID NO: 4492 - protein, 1244 aa, Rhodopseudomonas palustris HaA2
MPPQERILRVGAKPSLGDQAATKRVHREAMASDPSQNASGPHPHHDADHWQESGWDPEHEEAGRHRARKLLARRGLGFHRVDDSMRRWQHRLSGAPWLRRMAIALLVVGFVLAAGFGGLWLRLGAGPINLDMATPWLADAIEENIGNGNTVEVGGTQIERVGRIRVAVRIRDIVVRDRDHVVVATAPKAEVRLSGRALLIGKLRAESLRLVDAELAIRITPDGQVTVSTGDTERPIATGVASTRKPPEFTLPGQSPAAATAPGQDGTVSPAQPGGAAPPAAADRDGDAMKSLLAGLDWLDSLSLTGLDGQNLNEIGLKNGNLVVDDQQRGNRWSFENISLSLRRPSRGGVALSFGEEGAKAWSLRVQVGPPQDGVRTVELHANQVPTRNILLALRLKNLTYGADFPLTGDLKGEIGRDGLPTYFRGKLVAGAGTVIDYDTPDYPMAIDQAEFNFEWDANRRVLMAPFKIIAGANRVTLLAALEPPNGSTPDWRLALSGGTIVLPGAEGEAPLIFNRIAVRVSFDTDHRRVLLTQADINNGEIGVAGSGSIDYSGEPRLQLGLAGTPMSVSALKRMWPILVVPEVREWVYERIDKGSIQSIDIAVNSPVKNLSRRGPPIPDEGLLVNIIGTGATIHPVDGMPWVRDADMRVRVTGRTAAVAIAQAGADTPSGRKIALSDILFEVPDMAPKPSPSRIKFKLDAPVPAVAEVLSSGRLSDVSDVPMDPNTSKGAVSAQVMLGMPIQRELTKADTTYSINADVTGFSADKLVMGQKLEANTLKVNANNQGYQVKGDVKINGQPATLDYRKPAQGEADVRLQSTLDDASRAKLGLDLGSAVSGAVPVKLVGKIGDSDHETKFGIDADLTALKLDNILPGWTKPSGKTTRATFNVIQKPQAIRFEDIQIEGNGTLIKGSLEVDGDGDLINANFPVYSPSEGDKTTLKAERGQDGVLKVVMRGDVFDGRGFIKSALSGTQAEPKAKTKSLDFDLDLKLGAVAGYFGEALRSLDVKMVRRNGAFRTFTLSGKLGRDTPITAELRGKNRGREVIALETNDAGAFLRFSDTYSKMYGGQLALAVEPPTAEPRQKEGLINVRDFTVKGEAALERAAAGAPGGTSTGVAFSRLRAEFTRDNGQLSVRDGVVKGPTIGATIEGSIDYPANQVRMSGTFVPMYGLNNMFGQIPIVGLFLGGGSNEGLIGVTYEVVGTPGQPVLRVNPISAMAPGVLRKIFEFNTGRQNSGADFPAPPN

SEQ ID NO: 4493 - protein, 1093 aa, Jannaschia CCS1
MGEETTSGGGGRGRRVGVVLAIVALVILLSLGGLWARLALAPMHLPAGLQDRIEARINAAAPMGDIAVADMVLALPGGGGAPALEFRDVVLRAPGGDVRAAFPVLRLSVAPGPLGLGQMRVRRIVVEGAGVALTRDADGRVGLDFAGAMAGDGVDRTVAQTLTRLDAMFAHDAFSHLEEVRGVNMQATLTNAGTGRDIRLHSAEVLLTRASGRIDLTIAGELEGSRNAGLTLAIGRDAARGVTDVDVRFDTLAARDLAAASPALAWLDLMRAPIDGQMTAVLTNDGALGAFSGWLEIGGGEVHVPGQDTPLPLTAMEARLSYAPETRRAHIETLRVDAEHLVFSADGHADVSDDGAVLTGQFALRDIIAHPDGLFDGPLLIDGAALDLRVSLGEAVTVEVGQAVIYDDDVRIRASARAVAAADGLTLAVDTEVAEVDVATVLSYWPLDAIPNTRWWVAERLLAGTAHGANFALRMAPEADPIYDLSFDFTGADIIAVPAGPPILGASGYLSLQNDRLSVALDGGGVAADGQGAVALAGSAMAIADVSRPGPLAEFDLNLAGAVPDLMHVLAGPPFRVLDASGYAPDDIGTGQIVAEAALSTHLIERAEPVALTDLNIEASGIITGYSADALIVDRQLTSDRITVTMTPEQLAIGGRGALDRVPVTGQWSVLLDPDAPAGSRVDARATVDRAALGTFGVALPEWLIAGRGAADLTVFLQAGNPARVQVRSDLDGIALAIPPLAWQMPAARTGAFAAEITLGPRPEVRSLTLDGADLSLEGAVTFTADGALNRFSAGRFRVGQWLDVQGGLVGRGAAAPAIEVTGGILDFRTMPSLSETGGSGSGDVGPLNIRLNTMQIAEGISLTDLRADVDGASISGDFRGLVNGAAQISGQLVPSANGPSVRMQSSDGGAILRAAGIFDDLYGGAFDLILAARAEAGQYDGRLTIDNPRLRDAPVMAEMLNLISVVGLLEQLSGDGINLGDIDAAFRLTPQSITLQEGTAVGPAMGFSMDGVYDVASERYEMQGVVSPLYLVNGLIGSLFAPRREGLFGFNYRLIGDSEDTRVTVNPLSILTPGIFRDIFRAPPPDFSTQGN

SEQ ID NO: 4494 - protein, 1237 aa, Rhodopseudomonas palustris BisB18
MPPKERSLLTGERPSGGEQASTPRSHREAMAKNHSTQVPESRAGHPPPHCGDDHWHHDHDEAGWQRARALLSGSRLGFHYVGDRLGAIAHWIIGERWVTRVLITVVVLGVIFTACFGGLWLRLGAGPINLDMATPWLAAAIEDNIGNGNTVEVGGTQIERAGRIRVAVRLRNIVVRDRDHVIVATAPKAEVRLSGSALLTGRLRAESLNLVDAELAVRITPDGQVTVSTGDTNRPLATGVASPRRIGVPGASAEPSTSAAGTPVPQPAAPADSQEAFSGLLAGLDWLDSLSLTGLDGQNLNEIGLKNGNLVVDDQQRGNRWNFENITLSLRRPSKGGVAMSVGEEAVAGEDNARAWSLRVAVGAPSNGVRSVEIRANNVPTQNILLALRLKDVTYSADLPLSGELQGELGRDGLPTYFRGKITAGAGHITDSDTPDYPMAIDQGEINLEWDSGRRVLVAPFKVISGANRVTLLAHLEAPNDNIPDWRLGFSGGTIVLPGSEGEAPLIFNRIAIGLRFDTDNRRIILTQADISNGEIGVAGTGSIDYSGEPRLKLGFAGTPMSLSALKRMWPILIVPELREWVIERIDKGSIQRIDIGVNSPVKNLSRRGPPIPDDGLAVNIVATGAMIHPVDDMPSIRDGDLKARVTGRTATVTIGQSVADTPQGRRLNLSDIVFEVPDLAPKPAPARVRFRLDGPVAAVAEILSSDRLSEFSAVPIDPNSSKGTVSAQVALGMPIKRELTKVDTSYNITADLNGFSADKLVMNQKLEAATLKVIANNQGYQVKGDVKINGQAAALDYRKPNDGDAEIKLQATLDDAGRARLGFDLGTAVTGAMPIKLSGKIGDPDKENRLAIDADLTAMKLDNLLPGWVKLSGKSGRAVFNLVQKPQSTRLEDIVVDGSGSSIKGSVEIDQNGDLLNANFPSYAPSDGDKASLKAERGADGVVKVTMRGDVFDGRGFIKSAMSGKESDPKSKTKAIDYDIDVKLGAVAGYFGEAVRSVDVKLSRRNGAIRTFSLGGKLGRDTALTGDLRGRGQGREVLYLETNDAGAFFRFADIYAKLFGGQLTLAMDPPTAEPREREGLLNVRDFSIKGEAALERVAPSGTNGAQSNVVFSRMRAEFTRQNGQLTIREGVVKGPMVGATIEGSIDYPANQVRMSGTFVPMYGLNNMFGQIPIVGLFLGGGNEGLIGITYEIVGSPGQPVWRINPISAMAPGVLRKIFEFGTGKQNNNNDFPMPNN

SEQ ID NO: 4495 - protein, 1243 aa, Rhodopseudomonas palustris BisB5
MPPQERILRVGAQSSLGDQAATEHVHREAMASYPSPRDSGQDSQSDEHVARNWQDGGWDPEPEEAGRHRARKLLSRSNLGFHRVDESMRRWRHWLTDEPWLKRVAIAAVVVVLVLTAGFGGLWLRLGAGPINLDMATPWLANAIEENIGHGNTVEVGGTQIEREGRIRIAVRIRDIVVRDRDHVIVATAPKAEVRLSGWALLMGKLRAESLRLVDAELAIRITPDGQVTVSTGDTARPLATGVASARRPPEFTLPGQAPNTAAPSGQGDAALPAPLGKPATTDGDDGMKSLLAGLDWLDSLSLTGLDGQNLNEIGLKNGNLVVDDQQRGNRWNFENISLSLRRPTRGGVALSVGEEGAKAWSLRVLVGPAQDGVRSVELHANQVPTRNILLALRVKNLTYGADFPLTGDLKGELGRDGLPTYFRGKLVAGAGTVIDYDTPDYPMAIDQAEFNFEWDANRRVLVAPLKVIAGANRVTLLASVEPPNGNAADWRLNLSGGTIVLPGAADEAPLIFNRIAVRVRFDTDNRRVLLTQADISNGEIGVAGSGSIDYGAEPRLKLGFAGTPMSISALKRMWPVLIVPEVREWVNERIDKGSIQSIDIAVNSPVKNLSRRGPPIPDEGLLVNIIGSGATIHPVDGMPSVRDADMRVRVTGRTATVAVAQANAESPSGRKIALSDILFEVPDMAPKPSPSRIKFKLDGPVQAVAEVLSSGRLSDVSNVPMDPNSSKGAVSAQIMLGMPIQRQLTKADTVYSINADVNGFSADKLVMGQKLEANTLKVIANNQGYQVKGDVKINGQPATLDYRKPAEGEADVRLQSTLDDASRAKLGLDLGSAVTGPVPVKLAGKIGDGDQETKLGIDADLTAVKLDNVLPGWTKPPGKAARASFNVLQKGQSTRFEDIQVEGSGTLIKGALEVDQDGDLINATFPVYSPSEGDKTTLKADRGQDGVLKVVMRGDVFDGRGVIKSALSGTQSDPKSKTKGIDFDLDLKLGAVAGFYGEALRSVDVKLVRRNGAFRTFNLAGKLGRDTPITAELRGKNRGREVIYLETNDAGSFFRFSDTYSKIYGGQLALAVEPPTVEPREKEGLINVRDFTVKGEAALERAAAGAPGGTSAGLAFSRLRAEFTRQNGQLTVRDGVVKGPTIGATIEGSIDYPANQVRMSGTFVPMYGLNNMFGQIPIVGLFLGGGSNEGLIGVTYEVVGTPGQPVLRVNPISAMAPGVLRKIFEFNTGRQNNGVDFPTPPN

SEQ ID NO: 4496 - protein, 1255 aa, Nitrobacter hamburgensis X14
MTRNMIDRESAEVPSQVRSSGIGVRTNDGNCSGPGRHREAMTRKTPIPAPNPRGGEPVSQGVDIDWNNEDHDEVRSRRIRRLLSRSDSRFHRFGDRLGRFKNWLAGERWVRRLAITVGVLTVLFAGGFGALWWRLGAGPVNLDMMTPWLVAAIEENIGHGNTVEIGGTQIERAGRIRIAVRIRDIVVRDRDHAIVASAPKAEVKLSGMALLTGRLRAESLNLVDAELAVRITPDGQVIVSAGDNAKPLATGVASAARPSVPPSPSDIVPSSIAPSVQSTPQLREPAAGATPAISHDRNNASALLAGLDWLDSLSLTGLDGQNLNEIGLKNGKLVVDDQQRGNRWSFGNISLSLRRPSGGGVALSVSEGGSKAWSLHVTVGTPADGVRPIDLRAAGIPAKNILLALRIKDLTYTADMPLSGELKGEIGRDGLPTYLRGSLFAGKGTITDADTPDYPMAIDQIEMNLEWDAGRRVLVAPFKIISGQNRITLLAHLEPPNGSIPDWQMGLSGGTIVLAGSDGEKPLIFNRIAIGVRFDTEHKQVVLAQADISNGEIGVAGTGSIDYSGEPRLKLGFAGTPMSAASLKSMWPTLIVPELREWVIDRVERGSLQRIEIGVNSPIHNLSRRGPPIPDDGLSVNIVASNVTLHPVDEMPSVRDADLKALVTGRTATVTIGQATADTPAGRKLNISDVVFEVPDMAPKPAPAKVKFRIDGPVPAAAEILASDRLSEFTGNLIDPNSSKGTVTAQVALGLPIRRKITQEDTTYSITADLAGFAADHLVMNQKLEANALKVVANNQGYQVKGDVKINGQPASLDYRKPTVGDADIKLQATLDDASRAKLGIDLGAGATGAIPVKLVGKIGTDKDSKIGIDADLTSLKLDNVLPGWVKLPGKSGHATFNVVQKAQSTRLEDIVIDGGGAMIKGSLEIDQNGDLLNANFPVYAPSEGDKASLKAERNADGVLKVVMRGDVFDGRGFIKSAISGKQADTKGKAKSIDFDIDLKLGAVAGFYGEAVRSADVKMARRNGSIRSLTMSGKIGRDTSLTGGLRGRPQGRDIILIETDDAGAFFRFTDTYGKMFGGELALAMDPPTAEPRAKQGLINVRDFTIKGETALDRAAAGGPQGAQNGISFSRLRAEFTRQNGQLTVREGVVKGPTIGATIEGHIDFPGNQVRMSGTFVPMYGLNNIFGQLPIVGLFLGGGSNEGLIGVTYEVVGTPGQPQLRVNPISAMAPGVLRKIFEFQTGKPANQIEYPSQSGN

SEQ ID NO: 4497 - protein, 1155 aa, Ruegeria sp. TM1040
MSDKGKPYIVAAPPEPASEAGGNRVQETGAGASDMGQNTAQPRRNRWRRRLWKSTVWTLALLAGLTVAAWVLLDKRLDAPEWLRSEAERRIERHLGGLQIEFGEIELVVRRGWRPRLSLRDVTLFYPDGSPAVHLEDAQAALAMRPLLRGQLRPKLISLSGLFATLETGSDGAVALSFSDGAAPLRQARNLPQLIEAWDRQLELPILSAVTQVETQAVTLNYIDRRIDRAWTLDGGAVLLSRKGDRVSIDAGFSVLSGREYASTVEANYQSDIGDTAAEFAVVVDQVPSSDIASQSPAFGWLDVLRAPISGALRGAVDSEGALRPLNASLQVGRGVIQPNDQLKPIPLQSAESYFTFDPARQELAFSRLSVESGWISGQMEGRAELVGVRDGRLTQLVGQLSFSDLKLNPLRLYPEPLAFSGVQADFLMELQPFRLRLGEALVQQGETDVLLRGDVRAGETGWHYDLQGAADRLDVAVVKEMWPPSAPPKPRAWFTENVLAGDIHDVQFALRGRDGQKPFVALDLGFLNGEVRFNKFYPPLTQAAGQLSIYGRRLVVTATEGGVDADLGGRMDVAGTSFIIPDTSLKGDNSLGILRAELAGPALAALSLLDREPLSILSKVNLPVALGTGEVDLSATAAMPLKKGVNVAEIDYHYAGQIKQARSEVLVPGYPIESEALQISGDNHHVTVAGPGLFAGVPIEARWRQGIRPGNAPDGTIEAEIELSPRTLAALNIGLPEGMVRGQGQAQVEVVLPPGEPVALSVQSDLRGIGLSLPEVGWRKAENSSGTLSFETVLRDTPSIESFTLEANGLRAAGRITVKPDGGLDQAQFSAVSLGNWLSGAVTLRGRGDATPALSMTGGWIDLERAPFDSRAEGGSGGGGSNTPISLAIDRLQVTKELALTRFQGRFDTLGGFNGAFSGNLNTLTPVEGVVVPQSGGLAMRLRSADAGGVFRAAQVMQNGYGGSFEMTMLPASDPGEYVGQLRVKNIRVKRTPAIAALINALSLVGLFDELSGQGILFTAMEADFRLGSRYLTLVKSSAVGPSMGISLDGVYDLSTSQMNMRGVLSPIYLVNAIGSVLTRKGEGLFGFSFTLKGKAEDPVVSVNPLSGIAPGFLREIFRGEAPRAPGAAPLPEDEQNQTAEELREERERRREAR

SEQ ID NO: 4498 - protein, 1111 aa, Mesorhizobium BNC1
MQFRREEITPLGRFPSACLPPPRGCRSRRSLFRRWLVRPAAIIAVFLLVAGTVFYAVGVDAIGNERLRLQAEQAIERLAGVDVDVSIGSLHLGLGRTSLFALEVRDAEIIRADDKRPIAEFKTLRFGLRAIPLLSGRIELARVAMADALLTPAEMSAGTGPTLTEFLARPSPIGPEELRTAIFDAIDRAFEITRGAGLSSISLSNVGLLAGGRTIPGLLLESFEITRSNDTDLALEGAARYRGRDLTFEGRAHRDPNTNTLSNVELKISAPEGEEASSTEEGLLRSIGAFDLALSGKAPVGKERGFLRIDVAADGILLDFGDDELALDRASVGIAAGADDDVFSVLQAQIQAGRTRINLQGTFGPETVTSGAAGYRMDLVSRDSVLAPADSPEAPLPFAMRLQGRFDPATMQLTADPIDVRSAEGELNASAELTLAEGKSPGIKLNLQVSSMPAAHVKQFWPWFAAPGARNWTLENVFGGTVRDSGMTLEVPPGRLGNGVPLGPKEVFGRFALSDTRFNIAGEIPPVRDADGYVEFHGTDVKVGLSSGRVYMASGRTVDAKDGTLTIDASKTQRRIGNLEINVAGEAPAILEFVSYRPIAASRFYDLQPDDLKGKMSGHVSAEIPLQAGIALDELDWRVALDYENLSVAKPFEGQQVTDAKGSLLVEPTHAEFRASAKLNGIPADLHIVEPFGHAQVEKVRHVELKMDDTSREKLFPGLGTLVSGPFTLVYDREKDNREKVSLKLDSARLDVPWIGWRKGAGIPAMATFHLKRDGQATELSDFSLVGESFSLAGHIRLNGPHLQEASFQKARFNRGDDFSATIRRNGNGYSVSVKGAAFDARALIKQVFGNRQTSGAGNGDGDATPVSVKASLAQVSGFGGETLSQVEFTYASDGRKPDELTLGGATRSHGGLKVSKTSQPGTMGIHASSSNAGAVFRFLDFYEHMEGGQLSVALQGANNEALAGQIDIRDFWIVNEPKMRSLVAATKENGRVDTTRVYFESGAAALAKGRGSLNIAEGVVRGPVIGSTFQGMLYDPNDRMDLTGTFMPLYGVNRIFGELPLIGQILGNGRDRGLIGITFRLSGAVENPRLEVNPLSAVAPGFLREIFEFR

SEQ ID NO: 4499 - protein, 1094 aa, Rhodobacter sphaeroides 2 4 1
MAESGERQASERKGRSRRGRASLWLLLSLALVAAVACFATLAFTGRPLPLPGWAVTEAETRINRALEPALSVSLGGLVLTVEPNWIPRLRLDDVRLRQADGRTLVTLPEARVVFDRGAALRGALHPKTITLSGARIALRRLADGRFDFAMGEQGGTFRLASYAELRETVDRLFAQPVLADLRRIEAEGTTLTLDDRRAGRTWQAGDGRLTLVNGPDRRALEIGLTLLNSKGRAPAQALVTFVTTPGSPEARISATVDHVAAADIAAQAAPVAWLEVLDAALSGRFSAALDGEGRLTRLEAGLDSGEGALQPRPETRPIAFDKAGLAFAYDPGRERLNLTRLEVQGRSIRLSAQGHAYLPGVSRGLPSEILAQIRVEDASADPEGLFETPVHFSEGALDLRMRLDPFRVDIGQLALVEQGRRLSGRGHASAEPGGWRVAFDLGLNEISHSDLLALWPLSLVSKTREWLEENVQEGRLFEVEAGLRMSPGHETRLSLGYEFRDGDVRYLKTLPPIEKGSGYASIEDRRYLMVLEEGQVTPPAGGPIRVTRSVFEVPDVTEKPAQARISLNSESGVTAALSLLDQPPFRFLEKAGRSVDLGEGVAVMETALSLPLKRKVEPEDVEFSVRGTITDFRSDTLVPGRRIVAPRLALEAEPEGLTVTGAGSFGRVPFDATYRLAFGREAEGRSSVEGTATLSPAAVEEFKLGLPAGTVEGRAPGRFRVEMEKGRDPRLTLSSDLVGLRTGLAAIGWSKPANRAGRLEVEASLGKPVTVGKLVLEGGGLAASGRVDLRADGGLDAVRFDRVRLNGWLDAPVTLVGRGANQPPEVQLRGGSVDLTRLGDLGGGGGSGGTPVPILVALDRLQVTSGIALTGVEGRFGTRGGFNGAFRGRVNGRAVVEGSVVPMSGRSAVRLRSRDAGGVIASAGIFPDARGGDLDLSLMPEGRDGYRGRAAVSNFRVTNAPVLAALLNAISVVGLLEQLNGDGLLFAEGDVRFRVQPGAVEISEASAVGASMGVTLEGLYRTADRRLDLQGVISPIYLLNGIGSVLTRRGEGLFGFNYSVTGSADRPAVSVNPLSILTPGMFREIFRRPVPVLP

SEQ ID NO: 4500 - protein, 1162 aa, Maricaulis maris MCS10
MLRKSAKWTLIYLLEAVAALLALTIFAIGFVLWRLSSGPVELEFLREDAQAMLATAFEGEVVALGSLQARFEPSTRAIVLVATDVTVAEASGEVVTRAPRIEAGLAADALIFGRIEPVELTIDGGSVSIVRRADGAVGAGLGGVDRISSTARLPERGGDDSVSLFEILASSGAPAQLDRLRHVRISNAAVRVVDDVAGLAWFIDSAGVSLDRDDARILAEVEGRLATPSGFAPVDLRLRAGTGLESLLLEMSFSDLSPAGILPDTGPASALRALDAPIALDFVVDATRENGIRTASLQLDIGAGQILVDGENHAFEGANLYASFDPVERVMTLHGGQANSVLFAASIEGRLTEIGNYDGALPTRARFDLAIGPGFVDVGPVFERAPEWGLLAASGEIRLDELALTLDRLDVEIDTIRAELTGGLQLEQRPDGSWLPSLQLEGPIAGDIQPETVLAYWPVELADGGREWVSEGILGGRFYNARFFLDLPGSAIEAGVLEDDRMQLSFDFEDAHVLYISTMTPLTAGRGAAVLRGNSFEVMLEHGWVGEVELTEAFVDLPRLNPKGAMARYGGLARGAASDLLALIDEEPLFLVSDYGLDPALVGGQGDMRFEIHRAMLTEVEPDDIPFFISGRLNGASLDIPGTDFSLSEGEVELEASQAGLQATGTARLVDAPVRIDWRESFGLPDDVPSTRIGLQTVINARTLDGFNMPARRFLDGSIRIAAEAVSDGLDFRSVQIEADLLDALVELPGNVWAKEVGEPGLALLDLVQREDGGFDLGTIRMEADGAGLLASARLSEVGALEDLTLDRLFVDGMLDIAGEISPAIAPGQPVRVRLAGQYADVSAFMPDLASMGGEGGITLPLSLQADIGRLTLSEESVLDQFNLIWRSEAAGIRAVSVSGNAFDGPFQASFGASETGGQRDFRIEAQSLQRISALLGMEGYARGGQVSVLGSAPPLGTDGPLTARVEIRDLTLVQVPVLARILAAGSFQGLGALLNGEGIRFDAVDADIAYEDGLLTIGDGRAQGSALGVTAAGTVDFADRRAAIDGNLAPSYVINSMLGGLPVIGEVLVSRPGEGVIGITYSVEGPFDSLTVFANPLSALAPGVFRRMFEGTAAERAARERATDVADDGQSVDVEPTEPERPNPDQAVTDTGATDGPPDDN

SEQ ID NO: 4501 - protein, 1094 aa, Rhodobacter sphaeroides ATCC 17029
MAESGERQASERKGRSRRGRASLWLLLSLALVAAVAGFATLAFTGRPLPLPGWAVTEAETRINRALEPALSVSLGGLVLTVEPNWIPRLRLDDVRLRQADGRTLVTLPEARVVFDRGAALRGALHPKTITLSGARIALRRLADGRFDFAMGEQGGTFRLASYAELRETVDRLFAQPVLADLRRIEAEGTTLTLDDRRAGRTWQAGDGRLTLVNGPNRRALEIGLTLLNSKGRAPAQALVTFVTTPGSPEARISATVDHVAAADIAAQAAPVAWLEVLDAALSGRFSAALDGEGRLTRLEAGLDSGEGALQPRPETRPIAFDRAGLAFAYDPGRERLNLTRLEVQGRSIRLSAQGHAYLPGVSRGLPSEILAQIRVEDASADPEGLFETPVHFSEGALDLRMRLDPFRVDIGQLALVEEGRRLSGRGHASAEPGGWRVAFDLGLNEISHSDLLALWPLSLVSKTREWLEENVQEGRLFEVEAGLRMSPGHETRLSLGYEFRDGDVRYLKTLPPIERGSGYASIEDRRYLMVLEEGQVTPPAGGPIRVTRSVFEVPDVTEKPAQARISLNSESGVTAALSLLDQPPFRFLEKAGRSVDLGEGLAVMETALSLPLKRKVEPEDVEFSVRGTITDFRSDTLVPGRRIVAPRLALEAEPEGLTVAGAGSFGRVPFDATYRLAFGREAEGRSSVEGTATLSPAAVEEFKLGLPAGTVEGRAPGRFRVQMEKGRDPRLTLSSNLVGLRTGLAAIGWSKPANRAGRLEVEASLGKPVSVGKLVLEGGGLAASGRVDLRADGGLDAVRFDRVRLNGWLDAPVTLVGRGANQPPEVQLRGGSVDLTRLGDLGGGGGGGGTPVPILVALDRLQVTSGIALTGVEGRFGTRGGFNGAFRGRVNGRAVVEGSVVPMSGRSAVRLRSRDAGGVIASAGIFPDARGGDLDLSLMPEGRDGYRGQAAVSNFRVTNAPVLAALLNAISVVGLLEQLNGDGLLFAEGDVRFRVQPGAVEISEASAVGASMGVTLEGLYRTADRRLDLQGVISPIYLLNGIGSVLTRRGEGLFGFNYSVTGSADRPAVSVNPLSILTPGMFREIFRRPVPVLP

SEQ ID NO: 4502 - protein, 1097 aa, Rhodobacter sphaeroides ATCC 17025
MTVGGDQQEPGRSGRSRRGRVSLWLLLSLALLAGVAGFATLALTGRPLPLPVWAVSEAEARINRALSPALSVSVGGIVLTVEPSWIPRLRLDDVRLLQADGRVLVSLPEARVAFDRGAALRGALHPKVITLSGARIALRRMRDGRFDLAMGEQGGGLRIASYAEAREAVDRMFALPLLADLARIEAEGTTLTLDDRRAGRTWQAGDGRLALVNRPDRRALELGLSLLDPGGGAPAQAVMTFVTTPGSPEARISATVDQVAASDIAAQAAPVAWLEVLDTALSGGFSAALDGEGRLTRFEATLDSGEGALQPRPETKPIAFDRAGMAFSYDPARERLNLTRLEVQGRSLRLSAQGHAYLPGVSEGLPREILAQIRFEDASADPDGLFETPVHFSEGALDLRMRLDPFRVEIGQLALVEQGRRLIGRGRASAEEGGWRVAFDLGLNEISHSDLLALWPLALVPKTRSWLAENVQEGRLFEVEAGLRTSPGAETRLSLGYEFRDGDVRYLKTLPPIEKGSGYAVIEDRRYLMVLEEGRVTPPTGGPIRVTRSVFEVPDVSERPARARISLNSESGVTAALSLLDQPPFRFLEKAGRSVDLGEGRAVMETVLDLPLKQKVRPDEVDFSVRGTISDFRSETLVPGRTITAPSLALEAMPEGLRVSGAGRFGRVPFDGAYRLAFGPETGGRATVEGTATLTAAAAEEFNLNLPPGTLEGAAPGRFRIEMAKGAEPRLTLSSDLDGLRMGLAAIGWSKPAGRSGRLELAATLGKPVTVEKLVLEGGGLSATGRVTLRADGGLDAVRFDRVRLNGWLDAPVTLAGRGTGQPIEVQVRGGSVDLTRLGAAGGGGAGGSGGGTPMPILVALDRLQVTSGIALTDVEGRFGTRGGFNGGFRGRVNGRAAVEGTVVPMNGRSAVRLRSRDAGGVIASAGIFPDARGGDLDLHLVPEGREGYRGRAVVSNFRVTNAPVLAALLNAVSVVGLLEQLNGDGLLFAEGDAEFRIQPGAVEISQASAVGASMGVTLAGLYRAGDRRLDLQGVISPIYLLNGIGSLLTRRGEGLFGFNYSVTGSADRPAVTVNPLSILTPGMFREIFRRPVPVLP

SEQ ID NO: 4503 - protein, 1232 aa, Bradyrhizobium BTAi1
MARQTSPHRPHLQADTQGQQWDDADWDTAHPHDADAAHDEIAGQRVRRLLSRDDSGSAALSGRSGKARKGGLARRIGIALVALVLILAIGFGGLWLRLGAGPISLDLATPWLAAAIADNIGHGNTVEVGGTQIERAGRIRIAVRIRDIVVRDQEQAIVASAPKAEVRLSGAALLMGQLRAESLKLVDAELAIRITPDGTVTVSTGETSKPLATGVASKRDAGLPPTFPRPGQPVTPPTAPEAATQQAAPANPAAAGTAVPASAQSGLLAGLDWLDSLSLTGLDGQNLNEIGLKNGVLIVDDQQRGNKWTFENISLSLRRPSGGGVALSLGEEGAKPWLLRVLVGPPSNGVRSIDIKADKVSTSNILLALRLKDLTYMADLPLTGEIKGELARDGLPTYLRGKINIGAGNIIDTDTPDYPMAIDSAEMSMEWDAGRRVLVAPFKVISGANRITLNANLEPPNDAVNDWRLGLSGGTILLGAIENEAPLIFNRISINFRFDTEGKRVVLTQAEVSNGEIGVAGTGSVEYAGEPRLKLGFAATPMPALALKRIWPALIVPEVRAWIIERIERGNVQRVDVAVNSPTRNLPRKGPPIPDDGLDVNILATNVTVHPVDGLPSVRDADMKAHVTGRTATVTIGQGVADTPAGRKLNFSDVVFEVPDMAPKPSPSRLRMRVDGQVAAAAEILASDRLNDLSSVPIDPNQTKGTFQANVTLAMPVKGELTKADTNYTVTADLSGFAAEKLVMNQKLEANTLKIVANTAGYQVKGDVKINGQPATLDYRKPTEGDADIKMQAVLDDASRARLGMDLGTAVTGDVPLKLNGKIAGSPDRDSRLGVEADLTKLKLDNLLPGWVKNPGKAGKATFNVVAKQQSTRFEDINVEGGGVAIKGSLEVDQNGDLMNANFPTYSPSEGDKTQLKAERGQDGVLKLSMRGDVFDGRGFLKSAISGTNKDAEKNKARSNLDFDAEVKLGAVAGFNGEALRSVDVKLSRRGGAFKSFNLSGKVGRDTPVTADIRVGREAPSSDPRARRQGREVIYLVTNDAGALLRFADTYTKMAGGELELAMEPPTADSSPKEGLAIVRNFTVRGEQALDRAASGAVQGASQGIAFTMLRAEFTRQNGLLSVRDGVVKGPTLGLTLEGSIDYNVNQVRASGTIVPLYGLNNMFNQIPIVGLFLGGSNEGLFGVTYEVVGTPSQPVVRINPISAMLPGVTRKIMDFNTGKQQYPPGELPPNN

SEQ ID NO: 4504 - protein, 1146 aa, Brucella ovis
MAEKPQKIRFTKRQMKRIERLVAESGEGIVSGSVRSARSIVSRCSHALLSICILLVLLGGVGFVILRGGVNSDLLRDEAQKSLSHILGEGASASIGSAALSLDRNGHVAMEARDVSIVDPKQGVAINGIKSVRLGLAPLPLLTGKLRVAQLEVEGLAFDLPEARGGGFWKSLPYDEKGYVDFDAASGEIFAAMRRSLELLSAQDTRVIRIANSSVSFKVGEEEQVLDIERARLTEDRGKIAITGTVVWKGRKIALDGDIERKASDKALSAFRLNVKDIPVVMGSPPQVAPVINGNRVNPAHFELDAYAQLTLSGFAADGDKPERLAADLTVDGIDMQLGKVDNVRGNVRLSLEHRVGSHKIEIKPSRLVLGGLQAQFNGAFGPEQEAESNTDGPSYRFEVLTTSATSMPPESSDPPLSFATRIAGRYMPAQQRIQFVNLDVQTEGGQLYGQGSMGFGDSSPEMIFMLRIPKMPVADAKHLWPIDVADGAREWVLKNLFGGTLQDSRIDISLAGGRFNGPGLPPPLTEEEINADFNVVDTRFDVVGELPAVRDADGTVSVRGAYTTIKLLKGTAYTPNNRKATVSNGTLVIPWGPQRPVMADLDLHVSGEAAAIAEIAGNKPIDVLKNVPFLPQDVTGDINAQVKVSFAVSKDPPPGTLKWNADIGFSELDIAKPVGGSKITDATGNIKVDQSAAIITADARLDNVPAKVSMTEPVDRSGPAKREQKIKLEIDDKTRNAVFPGLNAVFSGPMSVDLGMENGGKRHVSADLLKTQIDLPWLGWRKGAGIPAKATFDLVEHSDKGEFEISNLVFSGDAFGAKGNLSIAKGDFQSADFSEIRLNRSDNLSVKATKSGNSFRVNVRGSQFDARALIKQISDLEAKKSGGGRANSPRVVVSAQVDEVHGFNNETLRNVAVSYESAGSKVSGISVNAVTSSGQPFVATNNDQGDARSISLQSNDAGAVLRFFDFYDKMRGGKITVGLAAQGNGPLRGQIDARNFSIVNEPRLAKIVSSSPSSGGASLTQAVKRDIDVSRVDVERGFSLIEKGQGYLNLSKGVVRGPAVGTTFQGTLYDQQGNMSITGTFMPAYGVNRIFGEVPIFGALLGNGRDRGLLGITYKLVGNAKQPQVIVNPISLIAPGIFRSIFEFQ

SEQ ID NO: 4505 - protein, 1128 aa, Sinorhizobium medicae WSM419
MSDIRGERVDFRREDIVALHALPSAQAHDPVIVHTPRPGGAWRLCGRILLCCSLLVFIAVASLIAIIESGIVDGPLNARARTALNTALGQDYSADVESTVIRLTGGGALALKARGVTLKERGSGRHLAKLGAISIALDPFALATGRINVSRLEAEGGELDTGLLPRGEPIDLTAIRIADVGTALEELFAQGDRMSRLTAGRSTQTVVLSDFSLTVSGTRGRAVPVEIKTLQFSHDPDSSMRVEGTIAVDGIESQLTAKALGDRGRIAAFEAGLDALPLSPFLHHGKSGNEEAFGIEATANVTLKAARAADGTKPALTAAVKTSRGSFHAGGLASKLNSAELNVSYDFERASVEILSSMVRIGRSSFPFTGALIDLDKIAGADRKGFAVDLLFKNASSDPEDMQAPPLAFDAKASGRFESDTHRLIFDQLAISSPLGSMAGSLSVAFGKTSPRISFAAVSDRMHSSAVKQLWPWWLAKGARRWALGNLFGGMVSDARIEVSIPEGRIASSGGELRLNEKELNINFAVDETRINIAGEIPPLRDTAGRFSLSGERMSVAVEKGAAFFPSGRSVALNGGDFIIADVYKKPLMAEMKIKVAGEADAIAELVRYKPIEALRKTPFTPEDFTGPMTALVGARFGLISDQKPPRPLWQVEMELEDVTIKRPVAGRSIADLDGTMRIDNERAVLQANALIDGAKMRVALTEPVGTSANVARTREISGTLDDAARAKIAPALSGIVSGPVGIDVSLAEDGSQSVKVDLGKAVLSLPWIGWSKGSGIPAKAQFTIRAAGGITEINDLRLTGEGFGGNGELRVDESGLAAARLSGVRLASGDDFSVTVGRSKGGYSVNLTGTAADIRPALARVKGGASSKDGGNVKIKARLDRVTGFNGEVLSNVDLTYSSRGQQIDDVNLSAITASGQAVVARLVKAGADNTLELTTSDAGAFARFIDIYRNMRGGLLNLRLRDRGANSWRGTVDIRKFSLVGEQRLQSMVSTRAGQDGRSLNEAVRRDIDVSTAQFERGFAQLLLDQGAIRVGSGVVRGIDVGATFQGTVRDANGRMDMTGTFMPAYGLNRLFGELPLIGVLLGNGRDRGLLGITFKLAGPFSQPSLTINPLSIIAPGVFRNIFEFQ

SEQ ID NO: 4506 - protein, 1132 aa, Ochrobactrum anthropi ATCC 49188
MKRIERLAADGEGGFLPGPARPSRSFLSRCSHAILSICILLVLIVGAGFVILRSGVDSNLLRDEAQKSLMHILGEGASASIGSAALSLDQDSHVALEARDVSIADPKQGVEISGIKSVRLGLAPLPLLTGKVRVAQLEVDGVSFEMPETKGPGFWKSLPYDEHGIVDFDAVSGELFAAMRRSLELLRAQDTHVIGIFNSTVAFKVGDEQQVLDIEQARLIENGGKIDIAGSVIWKGKKIALDGKIDRHAGDNSLAGFELNVRDIPVALGSPPEVSPVINGNRVNPAHFELEASARLSLTGSAADGDRPERLATELAVDGIDMQLGKVEDVRGGIRLNLEHTVGSRKIEIKSSRLQLGGMQAQFNGAFGPEPEAENNTGGPTYRFEVLTTSATSMPSESTDPPLSFATRIAGRYMADQQRIQFANLDVQTETGQLFGQGSMGFGAGSPEMIFLLRIPQMPVADAKHLWPIDVADGAREWVLKNLFGGTLKDSRIDISLAGGRFNGPGLPPPLTGDEIKADFKVFDTRFDVVGELPPVRDADGEISVRGAYTTIKLLKGVAYTPNNRKVDVSDGTLIIPWGPQRPVIAELDLGVSGEASAIAEIAGNKPIDVLKNVPFLPGDVTGDVKSRVKVNFAVSKDPPPGTLRWNADIGFTGLDISKPIAGSSVSDATGSIKVDQSAAIITADAKLDGVPAKISMVEPVNRSGPVKREQKVKLDIDDKTRDAVFPGLNSIFSGPMSVDLGMDDGGKRHVSADLGKTQIDLPWLGWRKGAGIPAKATFDLVQSADDKSKMDINNLVFSGDAFGAKGDLSIAKGDFQSANFSEIRLNRNDNLAVKAAKSGGGYRVNVRGSQFDARALIKQVSDLGEKGSGGGKSNNPRVVVSAQIDAVSGFNGEALSNVAVSYESAGSKVSGVSVNAVTSSGESFVATNNDQGDARSISLQSNDAGAVLRFFDFYDKMRGGKITVGLAAQGNGPLRGQIDARNFAIINEPRLAKIVSSSPSSGGTSLNQAVKRDIDVSRVDIERGFSLIEKGNGYLNLSKGVVRGPTVGTTFQGTLYDKQGNMSITGTFMPAYGVNRLFGELPIFGALLGNGRDRGLIGITYKLTGSAKQPQVIVNPISVIAPGIFRSIFEF

SEQ ID NO: 4507 - protein, 1169 aa, Parvibaculum lavamentivorans DS-1
MIRRTSKIALEVIGAAVAVTAVLLGVLAWRLSSGPVSVSILNQMIEDAANPSLQGGSLGIGDTVLIWSAEERELSLRLANVRLTGADGNAIADIPQLAFDLSVPAAFRGMLAPTAIDLYGVSATILRRPGTGITLALAPAGAEQPDPDVSFIGPMLEALVDDNDKSTPLGYLDSVGIRQARLRFVDEVNGVSFDAPSASLTISRGEEGLAGVLSAEVVTGDATVHLEMDGVLPMGDDTARIDARVRDLRPAALAHMSPVFADYAVFDAPITAEGSLRIGRDGALHSARLSLEAGEGQIDLPDPWATKIPLEQAQGEITLDGIARRIELQELTFKAGLHEARLKGAVDYRMGEGLNIASALVDLTAERFHTEVPEFFAGPVDLDTAQLKAEIDFDALRADIEELFLAAGGGGVRLSGSIADAERSPAIRVEGVIEPMPFEALTALWPLPLAKGAREWVAANLYGGNVTGASFDIDLAGGMIADMEAHKPIPAESLRFEFAVNGATMKYLGAMPPMLNVDARGLIEGIRFDAWVSSAVIRQEGIGEIAISEGHFYDEEIHIKGAPGHIAFTASGATADILSLLDHEPLTLISDFGLDPRSVAGTGTLRGQITLPLVKSVTMEQVEVSGKAHVENVAIPEIQKGLSITSGVLDVDVTRAGLSAKGPIGINNAAFLDIEWQEKFSREASPTSVYRLRGDIDDLGRAALGLRLDEFLAGSADIDATLMGDGRSVNRGSIKADLTDSIVKLDYAGWWKKAGAPAITSFDLAFLEDGGYRISNFSLTGEGIEAEGQVTLGDDGRMIAANFPVVKLGSHNDFAFIAHGSEDAALAMDVTGARFDARGILGNLFSGEEPGEDQGAQAALPLLTEAEAADPLRRTELKAYVTQVTGHNDTSFSNARVSMVQVDGRTWSLDVEAADEEGTPLSVRVGPDGNGVRTLAVSSSNAGNIFRSLDFTESVRGGALSASGRYDDTKPGSPLAGVVTIGKFRIVEAPVLANILTLGSLTGIGDTLRGEGILFDHLELPFTVTENRIRIKDARMSGPAIGLTMNGQIDRAADLVDMEGTLVPAYTINSFLGQVPVLGPLIVGREGEGIFAITYGVRGKTDEPTVVVNPLSALAPGFLRRLFEFGSTLPPESASSSENTPSEQRATPPDASSEAEPDLAPPEPPAAQN

SEQ ID NO: 4508 - protein, 1177 aa, Xanthobacter autotrophicus Py2
MEDRVRKPEPVRRQPRRSRFHGIMGALTPRSRAARVFTMVCLLLIALGGLAALTLYVLIANGFVTANLATPYIERALEERIGGGHKVAIGSTTMETVRSGATVVVVHDIRVTGPDGQLVASAPSAEVELEGSLLSLMPKARRIDLVGAEMTVRIAASGHLAVATGKGAKAISAPISTAARTPSQPAPVAPALAGAGAPAATPQPAATDPAAASAGSSALDTDPLKPVALARWINELESAGFDGGALADVGLKDGTLVVENESAGRRIVFQHISVRLARPQAGGAQLTFTIQSPQGIATATARIGPAQDGERTIELAIRNLSTRDLLQAFIQDQRRFYMDTPLNASFTARLSVEGEVKAGEASLDFGAGALGNGEDPEERFVIDHARIGLTLDVARRVIVVAPIEAVKTENIISLAGEIKVPATLGAPWPFQMGPKQVLLAGKEMPEPALVVDKVEVAGRFDPPSRRIIVDTGFLGSAAGSFTFTALFDFGVDVPYLKFDGTASPMPVATIKRFWPVNIAPPARQFAIENVSGGTADGITVAVKLPLDLIGQKQVPLPDDGVRFTINGKGVWLRPVKGLPPITNASLAILVTGRSVRITLPEGTAVTPQNRKIAVSDGVMLMPDYFPREPTSQIKVKFDGPADGAIEVLGMEPLKGPTGTAFDPSTTRGKFSALLQVNITFRKVPRPEDFDYSLEATLTDFGVDKVFRGLRLESATVKAFASPAGVVLRGDGKIAGAPMAFEYEKRKDVADADIRVSASLDDAARGKLGVDLPGVSGTVGVRLIGTTNNKDTRATIEADLVNARIADLIPGLSKPAGKPLKAKFALNDKGNSVRLDDMVIDGSGTLLKGSMELSDSGDLVGANFPTFQLSDGDKASAKAERAGDVLKVRITGDVMDARGIMKSLVSAPTGQRRAQKMPDVDVEARIGALTGNNGEVLRQFELSVSRRGVETRDFTLTAKAGRDGTVAGEMRNWQGRQKALLVTTSDAGAMLRFLDIYPKVQGGEAWLVVDPPRSDTTPQEGVIHVRDFAIKGEPGLQQLSSAARDSSGKIEDGTAAFQKAQAQFSRTTGKIVFKEGAIWGSSVGATFDGTLDFAVDRISVRGTFVPAYALNNIFSKLPVIGLLLGGGPNEGLVGVTFEIVGPLSGGPTLRINPISAVAPGFLRKIFEFRDSSDAPPTR

SEQ ID NO: 4509 - protein, 1105 aa, Dinoroseobacter shibae DFL 12
MSDPTVPDPETQHTPAQDSRPRSGLVVLMAAALLLAGIGGLAAFALRGSVAVPEPLVQRAQAVLSRALDGRGDADLGGIELYLTEEGRPRVSLTGLTLRAADSVDSVTLPRLDVVLARRALLRGEVRPESVRLEGARLRLSRDADGLLSLAFQSGGALTRVPSLPALIAEIEAVFDIPALQDLRRVTLSDLTLDLADSRLRQVVTLSGGEAVLDVSETALSLALALDLPGIGTGASLRFTTRKGDPETRVSLRMDAVPAQVLARQSPVLAPLGVFAGPVSARFAGGLRPDGRLSALEGQLALGVGALALGGKAAPLAVSEATATWRYAPDQRRMFIEDIVLDTDRLRLTGSAHGDIADGAASGSAPGGFPDLLLHADLSEIWVDPGARLPGPTTLARVMLDARWRTAARRLEIGQLYAEDAVTEARLHGAGRLELPAGAPPFLQLEVQTTGLPSARVLDFWPVSGRGEKAGAWLRENLTGGILDNVTATLMATPGERPKLAASFDLRDAAARVLPQFPTLMAGSAHGTLFEHEFNIRVSEGEMVVPDRGPVDLAGSSFQILDTRIRGGDARLHLSARGAVPTALALLDSPPISLLDRVALPPDRLSGTVAARAGLTVPLRKGRKVDLDTLWVDASLSDLRFAEVAPGRDFAAPDLDLTITDRTVTLAGTGALQDVPLEVVLARAFDTPAGDGTEISGTAQLTAQGLAALGVVLPEGTVSGQGAVDYRLRLRPDAPPRLELTGDLAGLGLSIPALNWRKPASAPGTLIASLRLGPVPAVDAFRLSAAGLEAEGRITLREGGGGLDRMELDRLSVGDWLTGQAVLTGQGPGVAPTVALTGGRLDLRNLPRGDAGGDGARAPLQIALDTVQVTDDLRLTGVRGAVGRSGGVIGGTLAAQVNGGAPVSLTLARAASGRQAVQVQASDAGAVLRDAGVLRTLRGGTLDMRLEVLDDPRILEGQVRITDGNIVETPGAVQLLSAISIVGLLDQMADGGIAFSEIATGLAISPGGITLREGRATGPSLGITFEGVVMPARDRIDLQGVVSPFYALNALPGSLFARRGEGLVGVSYRLAGSPSAPQVQVNPLSLLTPGLFRDLFRRDPPDLTQ

SEQ ID NO: 4510 - protein, 1175 aa, Methylobacterium extorquens PA1
MNPEESRRGKRTFARTYGCSSERVMDQETARTLLQQAVEAPAPRKARRRRRRPVLWCALLVVFLLGLGGGLVALRLSQGPLRIDGLTHQVAEAVAGRFGPGWRVALRDSALELDSESSLALRVGGLDIFNPEGALVVRAPLAVVSLDTWSLLRLSVQPRSIEFRDIEMTALVHDDGSIAFAASSPTQGDGAGEAAKPHTLPSVDAARGTVSPVSAAVASIFGVVLDPAGVIGALDRARITNGRLTLVDDARHQATFERVNGLFRRGTSDDSRVFELRIDGPHGEWRFGGRVHEAGEGRRAGVITLDDLPITDLLLLSGHSKMPVETDLKLSARADVALSGGRIETMKAEVKTGGGTLLIDEKDFNPVVIDELRAEASWDEARRALAISAIDYKGGGNDAHLTGAFAIGPPDAVDAWTLDFAGKDALLRGAARSDPSFRIGEISGRITGRAGGVNIESIALAGDGLRGRLSGTVGTRADDEGITLHIVASNTDGRKAMRLWPENIAPGVRNYLVDELRGGRLDQADIQIDMSGPELAAATRGDPMPDAALNVAFAVSDAGLTISQDAPPLSHGRVTGTITGRTTTIQNATAEIRLSDTRALAISDASFLIRDPQPDKIIAQLGLRLSGSVDSLAALLETPMFKGITGADIDPATLKGKADLRLDVPINLKHVPDLAEMPVTLTGSITEFSMDRAVGKDRFEAGRFTLSFDRSGFALKGDGRLLGAAVAIDLKQPKPGAPGEAVVSLNLDDAFRAKRGLPTAPQLGGVIPARVVLPVGRPASAGKPPARVEADLTRASINGLMPGWSKPAGKAGRLGFTLVEAAGGGMELRDITLDAAPALARGSATISAEGNLERADLTALKLSPGDDMRVSLDRAGSTYKVAVKGAVVDARPFLKGMTSGDDKGGKEPGKDIEADVAANIVSGFNGESLTNATLKASFKGGDLRAAQFKGRFGGSPLSAVVRSERGAPLLTLDSADSGATLRFLDIYKRMYGGRLALNVYLNDGPQAGVVQIKDFALRNEPALSSIVAQAPPPSDGRRAAPNANDVGFDKMRANFTRSGPRVSFSDAAISNAAMGFTATGWLDTAKERTQIDGTFVPLYGLNNVVAQVPLFGPLLAGGSNEGLFAVNFNVSGPIAKPTVNVNPLSAVAPGFLRKLFGAGSGDTFANGAGPGGPER

SEQ ID NO: 4511 - protein, 1149 aa, Methylobacterium radiotolerans JCM 2831
MADETTPACRPRGKARRVGGVCLVSALALVLLVGAGVGLVALRLSNGPLQIDGLSRRVAAAVAERIGPGWSIGLRGSSLELDRENALSLRFSGLDIRNPQGDLVVRAPLALVSLDLWSLLRLNLQPRSIEFRETQTTALLHRDGSIAFAASEANHPVDVAPHTPPSVDGVRGTVSPLSAAIASIFGVVLDTGGVVGALDRARVTDARLRLIDEDGHERAVFARVNGLFGRDPVNGTRNFELRLDGPHGEWRFGGTLRDGADGQERSGVITLDDLPVTDLLLLSGQSGLPLTTDLKLSARADVSLTAGRIRTMNAKLHTGDGTFLIEEKDFNPVTVESLDASLDWDEANRVMSLTGLDYRGAGNAVHLTGTWKGGPPDASTAWTATLASRDATLRGATPQDAPVKIDALDAQLSGRDGGIAIDALTLSGPGVKGAITGTIGTSADDGGLTLHLAGHDGEVRTGLRLWPEHIAPPARTYLVDQLRRGRVDSVDIKVKMSGSVLAAATRGDPAPDDAVHIDFHVSDAAIDVTADAPPVTKGNVVGVITGRSTTVRNVTAEVHGPDGRGLAISDGSFVIPQITPDRVVAQIGMRLSGGADGMASVLQAKLFKSVMSVDLDPATIKGSADLRVDFPLDLKHIPDLPDLPVTLTGALADLSVDKVMGRDRLESGRFNLVYDRGAFTLKGDGRVAGAPMSVDLRQPKVGQPGEAVVNVSLDEAVRGRKGLPTAPQLTGTIPVRAVVQIGRPGSGKPPIRVEADLAKAGIDGLIPGLTKPPGKPGRLTFTLVDGGQTFELRDFALDAAPASARGTVSITQEGGLERADLSSVKLSPGDDLRVSLDRTGGGYKVVVRGAVADARPFLKSLGGPDSKGGREAKDANPKDIDADIQVPIVTGFNEEALTGATLKLALHGKTLRAANITGRFRAAPFAATVTRGERGVPTLAVESADAGATLRFVDVYRRMYGGRLTAGIGLNDGPQSGVVQIRDFILRNEPALSSIMAQGPEPTDAETARGRRVAPGRGAGDVTFDRMRANFVRTGTRVDFTDAAISNAAMGFTLSGWLDTGRERTDMTGTFVPLYGLNNVASQLPLLGPLLGGGHNEGLFAVNFRVSGKLASPDVSVNPLSAIAPGFLRKLFSAGGGPFADGMPGVPQQ

SEQ ID NO: 4512 - protein, 1240 aa, Beijerinckia indica ATCC 9039
MVDHFEDMPKRHASQIAQRSQGLPFHGASPGSDQEAAREPCHDAVSPAVPLTHAVPPAHGARKRRFGRKSLFGRRGLARRAVTLCGVLTGLAFITILVGGLFYLRIGQRPVLIESLGPRIASALDDRFGHGYRFFLGPTTLTRHGLRPTLSLDGFSLREATGDKEDGHDESRETSGNLLLSAPRAEVSIDSWPLLLGKVVPKRLEIFDVVLHLSVTPEGTLALASETHPDAPVVITPTAPPSTADVKNVPPQSGTAGAAARPVLVKQMGSAIRLLVDTLTNPESPIAAIDKVGITNGRLIVDDRTSNQTLTFENVTLAFNKKGEKTTFELSVEGPNGRWSAGGVASGTPNAPRRLEFQLDHLSLDEILLATGVRLIGADFDTPIAAGFTLALGADDKLLEASGHVDLSPGFVRLDDPDAEPMLVDRLDSRFHWDQTTRRVLIDEARLDAGPSHFSFGGAMALPRIESEPWTLFLKNLAPVIYGPERPKEQPIVLDDAQFTGRLMPSEKKFILDRFAINSANNGGLAMAGTLDWIDGPHLRLGASINPTPVHTALRLWPSFITAPIRAWSLAHMTEGTVQSGTMQLDYDADTLKALRAEQPIPDSAALLDFTITKAAMEFLPGVPALRNIEGTGHITGRTALITLGGGFIETANGQRLLVSDGSFKVEDFAIKPVPAVVAAKISGPAEVVGDLLSREALKAYATLPLDPTTIRGQIDGKMQLDMKIGPETGPGDTVLHVNAMVNNFSVDRLLGKEKLENATLAVIVEPEGLKATGQGHLFGAQATLDMTRAPGKPAEINASLALDEAARAKMGMSMQGLTGTIGAHLATTLANGEKLKGQVELDLTKAGIDGLLPGVSKPLGKPAKINLLAIINDEGLTLDQIVVDAGPLQAKGSIDLNADMGLIGGKFGLLRVSPGDDMKAELLRTGDTLKVIMRATTLDARPFLKNIVSSPPESGPLAAPSLSHDAAKDMSASIKTVDIDLKADVLTGYNKQVLSGADLHLVKQGDDLKQFSCAGRFGRDTIAGNLTPGNANPGSGAPQLSLSTQNAGALLSFIDLYKHMERGRLGVTLRFNGETLAGALMIDNFLLRDEPAMRRLVSEAVDQEKGANQRNIDANAVSFHKLQVRFQRSGTRLDLQEGTMYGDAIGLTVDGWLDYVHDRVDMHGTFVPAFAVNNLFSQIPVFGILLGGGANEGLFGINYRISGAASAPTLSVNPLSAIAPGFLRQMFGVGDQMPAIGQP

SEQ ID NO: 4513 - protein, 1149 aa, Methylobacterium populi BJ001
MDQETARTLLQEAVEPPAPRKARRAVRRRRRPVLWCTLLLMFLIGLGSGLVVLRLSQGPLRIDGLTHQVAEAVAGRFGPGWRVALRDSALELDSESSLALRVGGLDIFNPEGALVVRAPLAVVSLDTWSLLRLSVQPRSIEFRDIEMTALVHDDGSIAFAASAPAQGEAAKPHTLPSVDAARGTVSPVSAAVASIFGVVLDPAGVIGALDRARITNGRLTLVDDARHQATFERVNGLFRRGTSDDSRVFELRIDGPHGEWRFGGRVHEVGEGRRAGVITLDDLPVTDLLLLSGHSKMPVDTDLKLSAKADVALSGGRIDTMKAEVRTGGGTLLVDEKDFNPVVIDELRAEAAWDEARRALAISAIDYKGGGNDAHLTGAFAIGPPGAEDAWTLDFAGKDALLRGAARSDPSFRIGEITGRLTGRAGGVNIESIAIAGDGLHGRLSGTVGTRADDDGLTLHIVASDTDGRKALRLWPENIAPGVRNYLVDELRGGRLDQADIQVDMSGPELAAATHGDPMPDHALNVTFAISDAGLTVSPDAPPLSRGRVAGTITGRSTTIQNATADIRLSDTRALTISDASFLIRDPAPDKIVAQLGLRLSGSADSLAALLETPMFKGLTGADIDPSTIKGKADLRLDVPINLKHMPDLADMPVTLTGTLADFSMDKAVGKDRFEGGRFTVSYDRSGFALKGDGKLLGAAVAIDLKQPKPGSPGEAVVSLALDDAFRAKRGLPTAPQLGGVIPARVVIPVGRPASAGKPPARVEADLTRASINGLLPGWSKPAGKAGRLGFTLVEGAGGGMELRDITLDAAPALARGSAAISAEGNLERADLTALKISPGDDMRVSLDRAGSTYKVAVKGAVIDARPFLKGMTDDAKGSKDPGKDIEADVAASIVSGFNGESLTNATLKANFKGGDLRAAQFKGRFGAAPLSAVVRSERGAPLLTLDSVDSGATLRFLDIYKRMYGGRLALNVYLNDGPQAGVVQIKDFALRNEPALSSIVAQAPPPADGRRAASSANDVNFDRMRANFTRNGSKVSFTDAAISNPAMGFTAQGWLDTAKERTEITGAFVPLYGLNNVVSQVPLIGPLLGGGSNEGLFAVNFAVSGPIAKPTVSVNPLSAVAPGFLRKLFGAGGGDAFANGAQPSGPEQ

SEQ ID NO: 4514 - protein, 1240 aa, Rhodopseudomonas palustris TIE 1
MPPQERILRDGAHPSREEPAPDARVQREAMAKHPTPDQSDPHAGHDCNDPHWHEGHWDREHEEDARHRARKLLKRRNLGLHRIDDWPSRRTPGAPWLKRTLLTIAVVGAVLIAGFAGLWLRLGVGPINVDMVTPWLADAIEENIGQGNTVEIGGTQIERAGRIRVALRIRDIVVRDRDHVVVASAPKAEVRLSGGALLTGKLRAESLRLVGAELAIRIDPDGQVTVSAGSTDRPLATGIAPSGRAAEFKLPTQPAPPDAGAVAPGATAPSGSATTPPPATDTSDTMKGVLAGLEWLDSLSLSGLDGQNLNEIGLKNGNLVVDDQQRGNRWTFENISLSLRRPSTGGVALSVGEEGGLKAWSLRVQVGPAHDGVRSVELHANQVPTRTLLLALRLKNLTYSADFPLTGDLKGEVGRDGVPTYFRGKLTAGAGTVIDSDTPDYPMAIDQIETSFEWDANRRVLIAPFKVLAGPNRVTLLASLEPPNGSVNDWRLGLSGGTIVLPGAQNESPLIFNRIAVRVRFDSANRRVLLTQADVSNGEIGVAGSGSIDYSGEPRLTLGLAGTPMSVSALKRMWPALIVPELREWVNDRILAGSIQTIDIAINSPMKNLSRRGPPIPDEGLLVNILGNGAAIRPVDGMPVVKDGDMRVRVTGRTATVAINQANADTDGGRKVALSDILFEVPDLAPKPAPARIKFKLEGPVPAVAEVLASGRLSDAAALPIDPNTSKGNVSAQVALGMPIQRELTKQDTSYSITADLNGFSADKLAMGQKLEANTLKVIANNQGYQVKGDVKINGQAAALDYRKPVDGDADVKLQATLDDASRARLGVDLGSGLSGPLGVKLTGKIGDNEQDSKFGIEADLTPVKVDNLLPGWSKQPGKPGKATFNVTRKPQSTRLDDVTLEGGGTLIKGSLEVDPDGDLINVNFPVYSPSEGDKAMLKADRGSDGVLKAVMRGDVFDGRGFIRSALSGSSTEAKGKSIDFDLDLKFGAVAGFSGEALRSLDIKTTRRNGSIRSFTMNGKLGRDTPITADLRGRNQGREVIYLETNDAGAFFRFTDSYSKMYGGQLSLAVEPPGGEPREKEGLINVRDFTVKGEAALDRVAAGAPGGPPQGLAFSRLRAEFSRQNGTLTIRDGVVKGPTIGATIEGSIDYGANQVRMSGTFVPMYGLNNMFGQIPIVGLFLGGGSNEGLIGVTYEVVGTPGKPVLRVNPISAMAPGVLRKIFEFNTGRQNNGADFPAPPN

SEQ ID NO: 4515 - protein, 1141 aa, Methylobacterium sp. 4-46
MDQASSPRPAPCPVRRSALSRCVRGVLILKLGLALLLGLASGLAYLRLSSGPMSFAWLEPRLGEAIAARLGPGWRVEMRDSAVEIDREGALALRTTGLEIRNPQGALVVRAPLALVSIDLTSLLGLSIQPRSVEFRDLQLRAVVHRDGSIAASADPSNAAPPTPPVVEAARGSVSPLSATVASILGLVLDPGGVIGSLDRARLTNARLTLTDDAGVERAVFPRVDGLFSRDAVREARVFEMRIMGPHGPWRFGGDVEQAAGDLRRGVLTLDDLPATDLLLLSGQSRLPVTTDVKLSGRATVAMHGARLDTMTLGLRSSEGTVLIEEKDFNPVTVEAVTVEATWDEARRALSLTSLDYRGAGNAVRLSGEWVAGAEGAETAWTATLSGRDAVLRGAVESDAPVRIDSLEAKLAGRDEGVVIERFALTGPTASGTIAGTLGTRADEGGLTLHILVDRAEGRTALRLWPEHIAPPIRSYLVDNLHAGKVDSLDITVDMTREEFAAATRGDPMPDQAVRIAFAVSEGNLQISPEAPPLSRGRVAGLVTGRNTTIRGATAEIRVADGRVLAIQDGSFVIKDAVPHDVKAQIGLRLSGGTDALAALLQAKLFRGLTTTEIDPAATRGQADLRIDFPLSLEAVPDIADLPVTMTGSLAEVSVDRIVGKDRLENGRFAVTYDRTGFSLKGEGKLSGAPMSVDLRQPRAGAPGEAVVALTLDDAMRARRGLPAAPSLAGPVPARFVVPIGRPGRTSTRVEADLSRASIDGLLPGWSKAAGKPGRLTFALSEAGSGSELRDIVLESGSVSVKGSAVVSAEGGLERAELTSLKLSPGDDVRGQVERSGGAYRVNLRGSVADARPFLRALTGPGRKGGGSREGGKDVDADLSFAILTGFNEEALTNATLKLSLRGDDLRQARIQGRLRGASVRVEVARGERAGPPILSADSTDAGAVLRFLDIYRRMQGGRLSLQSTLNDGPQSGALQIRSFTLRDEPALGRIMAQGEPPEEGVRGTGQRRPVNDVGFDRLTAEFVRSGTRIDIADAAISGPAMGFTLGGSLDTGRNTTDIRGTFVPLYGLNNVFSQVPIVGPLLGGGHNEGLFGINFSVTGPMSAPNVAVNPLSAIAPGFLRKLFGAGGGDPSAAAAPRPER

SEQ ID NO: 4516 - protein, 1133 aa, Rhizobium leguminosarum bv  trifolii WSM2304
MSAIRGEKVTFRKKDIVALDRLPSAQAEDPIIVYCPPPRSPMRRTAKLTAGFLGVILLILAAIVFTVESGMFDKPLSQQAQAALNGVAGPRYRAEVGSTVIRFTSDFRLALEARNVNMIDEQSGQHLSTTGSVRLGLDPLQLFRGRIAVTDIEADDIALDTALLPSGNPLTLDDLRIDAMPAAMEKIFSQFDMFDSVVTRGSTSSVRISGINIKLADTANGPLSLVVDDLVFAHAGPSSLQLTGEVALNGEVAELEVLAEKEAGHVSKVVATLKHADLTPFALKRNDQGAIRQGLSAFADLTVSATRERDGVQPALAATVDIDPGQIYADGDPQELSGGQINLVYDFAKLTLEIARSNARFGATMVPINGALIDLDKLDPQAGKGFGIDLLVSGGSAAPGGSGEQPLSFDIQATGRYLVAGREFLFPNMTVSSPLGALYGALHVKLGSKSPEISFAGQSAQLQTTAIKQLWPFWMAPKVRTWVHGNLFGGTVTNGAISVFIPFGRLDEAAGGKGLKLDANQIRIGFDIADARMNIAGDIPPVRDMAAHFDLTGPVATIAIKSGTSFFPSGRSVGLGQGTFTLPATYDKPLMADIDLAISGTADAVGELLTYRPIRVLQRAGFTPDDLKGRIEANVKAHFGLLSSQNPPPAEWTAAMKLTDIDLAKPFSGRTISNLDGTLNGNPKQITLDAKAQIDGVPADIDLAEPVEASDGAKRTRVITATLSEEQRNKLIPGLSGIIGGSVKMVLTRIDDDRQDVQLDLTKSQLDLPWIGWSKGSGIAASAEFETSGPADNTQIKNFRLKGDGFGANGSMNIGKGGLISADFDSVKLSSLDDFALSVKRSKGNFDVSVSGDSADARPVIARLKSGSGDGNDEGDAGDTGVSVRAKLKNVIGFNDEKIGNFQAQVSLRGDKLEALNFSAVTDSGEAVVSQMKDGGVINITSGDAGAVSRFADLYQHMQGGLLNLAIRLSAQGGWDGSLDVRRFSIVNEQRLRSIVSTPVGNEQRSLNEAVKRDIDTSSQRFQRGFARVVSRGGMVGIENGVLRGDQIGATFQGVVRDRKGNMDMTGTFMPAYGLNRLFAELPLIGVILGNGSDRGLIGITFKLTGKFDQPNLQINPLSIIAPGVFRQIFEFQ

SEQ ID NO: 4517 - protein, 1197 aa, Methylocella silvestris BL2
MKGRERLVEQREDSPERAVPDKPAEFPAGVDLPRLKMRGRLPVFARSCAYVAASLLAIFVTAGVFLTVRLAQGPMAIDALGSSIAQALDQRFGHGYDFAFGQTSMLQRGYAPTLGVDRLVVKDQSGRTLLSAPRAEVSVDLLSLVAGKVAPKRLEIFDVEVRLALLPDGSIAQLAGAGSDDAIAITPPLAESLRREAIPAAAAPEPAVPGGAPAAEPPAQPKPRALLVKQLSSAMRLVIDALTSPDSQIAAVDRVGITRGRIVVDDRTSNQKMTFDGVNLAFDKTDAGTRFTLSVDGPNGRWSASGLASGQPGADRRLTFSLENLSIDEILLATGVRSIGADFDMPLSAHVNVGLRADGVLSEAVATFGLGSGYLRFDDPNDEPMLVDEIKGGVHWDGGQRRIVVDPVRLVAGQSHGAVSGFIALPQREGDAWTFELGAPEPLVAAPERPGQQPVVLDLAALTARLFLADKKFIIDKFVLGGPQAGFSMTGDVDWTNGPRVRLGASIDPTPVSVVTRLWPSFMAAPIRNYLLDHVKAGVIRQGSMRLDFNAADIESMRNEHSPPDEALLVDFTVSGGSVEFLNGAPPLTGVDGVGHVTGRSSTFTTTNAGVVEAGAGRILTVAPGGSFHIPDSEQRPVPAAIVANISGAVEAVSELLSRDALKPYASLPLDPATLRGQVDGRLEVDLRLGPKMGPADTSLKINATASNFTAENILGKEPLDAATLSIIVDSTGLKASGQGKMFGAPATVELAQPAGKPAFANVHVLVDDAARARQGLGGVPGVTGVIAAAISAPLGAGPNIKAEVDLDLSRAAIDWPGASKPLGRPGKAKFALIVTDGQSVLDQIAFDAGTIQARGQIELGADQSIQSAKFPQVKFSTGDDARMEALKVGETLKVVVRAQSIDARPFLKTLLASSADSTPAPGAAGGLPAAGASASAIKEIDLDVKSSLLTGYNKQVLSGLELRMLKRGDQFKQLSFAGRFGRDTVSGNLAGPSSASQLTMLSDDAGSLLLFTDLYRHMERGRLQADMQLGPAMSGTLVINSFVLRDEPALRRLVAESAPAGDAADKLRNIDAGAMAFNRLQVRFDRAGTRLQLHDGVINGEAIGLTVDGWLDFARDSVDMKGTFVPAYAVNNLFSKIPVVGLILGGGANEGLIGVNFRVEGSISAPTLSINPLSAIAPGIFRQIFGVGQHIPGPGQ

SEQ ID NO: 4518 - protein, 1151 aa, Methylobacterium chloromethanicum CM4
MDQETARTLLQEAVEARAPRKARRRRRRPVLWCALLLVFLLGLGGGLVALRLSQGPLRIDGLTHQVAEAVAGRFGPGWRVALRDSALELDSESSLALRVGGLDIFNPEGALVVRAPLAVVSLDTWSLLRLSVQPRSIEFRDIEMTALVHDDGSIAFAASSPTQGDGAGEAAKPHTLPSVDAARGTVSPVSAAVASIFGVVLDPAGVIGALDRARITNGRLTLVDDARHQATFERVNGLFRRGTSDDSRVFELRIDGPHGEWRFGGRVHEAGEGRRAGVITLDDLPITDLLLLSGHSKMPVETDLKLSARADVALSGGRIDTMKAEVKTGGGTLLIDEKDFNPVVIDELRAEASWDEARRALAISAIDYKGGGNDAHLTGAFAIGPPDAVDAWTLDFTGKDALLRGAARSDPSFRIGEISGRITGRAGGVNIESIALAGDGLHGRLSGTVGTRADDEGITLHIVASNTDGRKAMRLWPENIAPGVRNYLVDELRGGRLDQADIQIDMSGPELAAATRGDPMPDAALNVAFAVSDAGLTISQDAPPLSHGRVTGTITGRSTTIQNATAEIRLSDTRALTISDASFLIRDPQPDKIIAQLGLRLSGSVDSLAALLETPMFKGITGADIDPATLKGKADLRLDVPINLKHVPDLAEMPVTLTGSITEFSMDKAVGKDRFEAGRFTLSFDRSGFALKGDGRLLGAPVAIDLKQPKPGAPGEAVVSLNLDDAFRAKRGLPTAPQLGGVIPARVVLPVGRPASAGKPPARVEADLTRASINGLMPGWSKPAGKAGRLGFTLVEAAGGGMELRDITLDAAPALARGSATISAEGNLERADLTALKLSPGDDMRVSLDRAGSTYKVAVKGAVVDARPFLKGMTSGDDKAGKEPGKDIEADVAANIVSGFNGESLTNATLKASFKGGDLRAAQFKGRFGGSPLSAVVRSERGAPLLTLDSADSGATLRFLDIYKRMYGGRLALNVYLNDGPQAGVVQIKDFALRNEPALSSIVAQAPPPSDGRRAAPNANDVGFDKMRANFTRSGPRVSFSDAAISNAAMGFTATGWLDTAKERTQIDGTFVPLYGLNNVVAQVPLFGPLLAGGSNEGLFAVNFNVSGPIAKPTVNVNPLSAVAPGFLRKLFGAGSSDTFANGAGPGGPER

SEQ ID NO: 4519 - protein, 1192 aa, Methylobacterium nodulans ORS 2060
MEAHSVRGGLPRDVRHADTRLIAGNRTEKTLGGQVPQAPLPAMTGMDQAPPPRRAPLRVAPGPARRRSVVQRCVRGVLLLKLAVALLLGLGCGLAYLRLSSGPMSFAWLEPRLAAAIAGRLGPGWTVDLRDSAIEIDREGALALRTTGLDIRNPEGALVVRAPLALVSIDLAPLLGLTIQPRSVEFRDLQLRAVVHRDGSIAASADPSDAQPTTPPGVDAARGTVSPLSATMASILSLVLDPAGVIGSLDRARLTNARLTLTDDSGTERAVFPRVDGIFTRDAVRDAKVFEMRIMGPHGPWRFGGDVERAAGNIRRGVLTLDDLPVTDLLLLSGQSRLPLTTDVKLSGRAAVAMHGARLDTMSLSLTSSEGTLLIEEKDFNPVTIEGVSVEASWDEARRALKLDALDYRGAGNAVRLAGEWVAGAAGADPAWTATLAGRDAVLRGAVDGDAPIRIDSIEATLSGRDDGVAIERFALSGPTASGTITGTLGTHADEGGLTLHILADRAEGRTALRLWPEHIAPPIRTYLVDNLRGGHLDSLDITVDMTQAEFAAATRGDPVPDKAVRIAFAVSDGSLVISPEAPPLTRGRVSGLVTGRNTTIRGATAEIRMPDGRALTLQDGSFVIKDAVPRDVTAQIGLRLTGGTDALASLLQAKLFRGLTGAEIDPATTRGQADLRIDFPLSLNAVPEIADLPVVMSGSFSDVSVDRLVGKDRLENGRFSLAYDRSGFSMKGEARLSGAPMSVDLHQPKPGAPGEAVVALTLDEAARARRGLPVAPALAGPVPARFVVPIGRPGKTTARVEADLTRASIDGLVPGWTKAAGKPGRLTFALTDTGNGTELKDLALEAGSVAAKGSAVISAEGGLERAEFTSLKLSPGDDVRGQLERSGGVYKVMLKGGVADARPFLRALSAPARKGGKEAASRDVDADLSFAILTGFNDEALTNATLKLSLRGDDLRQARIQGRLRGASVRVEVGRGERGGTPVLTAESTDAGAVLRFLDIYRRMQGGRLSLQTTMNDGPQAGAVQIRSFTLRDEPALGRIMAQGEPAPEDRGGRSPGRRPEANDVGFDRLTAEFVRTGTRIDFSDAAISGPAMGFTLGGWLDTGRNATDIRGTFVPLYGLNNVFSQVPIVGPLLGGGHNEGLFGINFSVTGPMSAPNVAVNPLSAIAPGFLRKLFGAGGDPSAAAAPRLNP

SEQ ID NO: 4520 - protein, 1141 aa, Agrobacterium vitis S4
MGEIRGEKIRFRKGDIVALETLPSSQVDDPLIVHCPRRRGPLTRLMRFGAYIVLSLMAMLGAAAIAIETGTLDQALSTGARAAFQSAIGDDLKADIDQTSIRLSKNLHLAVAAQNVTLTDPKTQQVVSKAGDVKLVIDPISLLMGRVSVTEIDVTGIDFDSSRLLQGGDLDLATLRIDKFPAFMETMFGNLDDVHGFIVRGGLDRLRLGGITLPAKNGIGQPVDVQVNDLTLTRRKDDSLAIQGETSINGKVSMISAEAMTDGARTTSLTATVTDLIATPFLIKRTPTGVWRDGADTSINIDFYALRQSQSQKPALSARLRTENGILYVDGDKQDLTRADINLAYDFDKLTAEIRPSEVDFGPTHVPFSGGFIDLDRLQSVPGDARGIGIDLLVDQGTASVESSGEQPFPFSLKAFGQFIPSQRHLTFSELAVSTPHGSMQATLNVQFGNASPEIRFNGKLFEMRTAMVKQLWPYWMAMKPRTWVQANLFGGTISNASIDVLIPAGRMKPIPQPLDLGPDELKIAFDISGARMNVTGDLPPIRDLAGHFDLTGPDLEVRIDGGTSYFPSGRKVKLDKGTFAIANTYKKPLMANIAVSVSGPADAMAELATFKPMQALQRTEFVPEDFAGEIKADVQLYGGIIADQKPPPEVWKASLDMKGVDLKRPYMDKKITGFDGTLVVDPQNAVLQGDAQIDGVPVEIDFSQPVDRGSNRAPSWTVKGQLNDSQRAKLVPGLGDIVGGTIDLEVSRLDDNRQLVKSDLSRATLNVPVIGWTKGSGIPAKVSMELQDKSGLFMLDKFNLDGDGFGATGKLVVSKTNGLVGADLDHVKLASADDFGLSVQVNKGVINAKVSGSSVDGRVLLKKLKSGSSSNGATGDGRSSSNSTDVDISVDVDKLIGFNDEALSGVRLVYGSRSGAVTALKMSAVTDTGQAVVVQSAKAGNGNEISLISSDAGTLVRFVDLYSHMRGGMLDVKIRGDLNKNWMGNVDLRNFRVENEDRLQKIVTTPATDDGRSLNTAVKRDLDVSSEKFQRAFARLIYQDGVLRTDNGIVRGEQVGASFQGTIKDTRGQMEMTGTFMPAYGLNRLFAEVPIIGAILGNGRDRGLLGITFKLKGPVDAPHLVVNPLSIIAPGMFRQIFEFQ

SEQ ID NO: 4521 - protein, 1132 aa, Rhizobium leguminosarum bv  trifolii WSM1325
MSAIRGEKVTFRKKDIVALDRLPSAQAEDPIIVHCPPPRSPMRRTAKLTCGFLGLILVILAGIVFTVESGMFDKPLSQQAQAALNGVAGPRYRAEVGSTVIRFTSDFRLALEARNVNMIDQESGQHLSTTGSVRLGLDPLQLFRGRIAVADIEAEDIALDTALLPSGNAVKLDDLRIDAMPAAMEKIFSQFDMFDSIVTRGSTNSVRISGLDIKLADTANGPLSLVIDNLVFAHAGPSSLQLTGEVALNGEVAELDVRAEKDDGHVSKVVATLRHADLTPFALKRNDQGMIRQGLSAFADLTVSATRARDGAQPALTATVDIDPGQIYADGDPQQLSGGQINLVYDFAKQKLEIARSNARFGATTLPINGALIDLDKLDPQAGKGFGIDLLVSGGTAAPGGSGEEPLSFDIQATGRYMVAGREFQFPNITVSSPLGALYGSLHVKLGDKSPEISFAGQSAQLQTIAIKQLWPFWMAPKVRTWVHGNLFGGTVTDASISVFIPFGRLDEAAGGKGLKLDANQIRIGFDITGARMNVAGDIPPIRDTSAHFDLTGPVATIAIKSGTSYFPSGRSVGLGQGTFILPATYDKPLMADIDLAVSGAADAVGELLTYRPIRVLQRAGFTPDDLKGRIEANVKAHFGLLSSQNPPPAEWSAAMKLTNIDLAKPFSGRMISNLDGTLNGNPKRITLDAKAQIDGVPADIDLTEPVEASDAAAKQRVITATLSEDQRNKLIPGLSGIVGGSVKMVLTRIDDDRQDVQLDLTKSLLELPWIGWAKGSGIAATAEFETSGPADNTQIKNFRLKGDGFGANGSLNIGKGGLISADFDSVKLSSLDDFALSVKRSKGNFDVSVSGDSADARPVIQRLKSGSDGDGDGDGGDTGVSVRARLKNVIGFNDEKVGNFQAQISLRGDKLQALNFSAVTDSGEAVVSQMKDGGVINITSGDAGAVSRFADLYQHMQGGLLNLAIRLGAEGGWDGSLDVRRFAIVNEQRLRSIVSTPVGNEQRSLNEAVKRDIDTSSQRFQRGFARVVSRNGMVGIENGVLRGDQIGATFQGIVRDRKGNMDMTGTFMPAYGLNRLFAELPLIGVILGNGSDRGLIGITFKLTGKFDQPNLQINPLSIIAPGVFRQIFEFQ

SEQ ID NO: 4522 - protein, 261 aa, Thermobifida fusca YX
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 4523 - protein, 308 aa, Frankia CcI3
MALLGRGRSERGSDRGSGKNRGSGKDEDGVGKDRSVKGAAGSKGAAGVKGTGRRTLVAGNWKMNLNHLEAIALVQKIAFDLKPAELETVEVVVLPPFTDLRSVQTLVDGDKLAIAYGGQDLSPYASGAHTGDISGAMLAKLGCDYVVVGHSERRADHHEDDALVAAKAKAAFSVGLTPILCVGEPEEIRAAGTQVEHVLRQLERSLAGITAEQAATIVIAYEPVWAIGTGRTASAQDAQDMCAAVRGQLASQYGDEIAAGIRVLYGGSVKAANAGELFTMPDVDGGLVGGASLVAEEFVGIVRSGPPA

SEQ ID NO: 4524 - protein, 261 aa, Mycobacterium MCS
MARKPLIAGNWKMNLNHFEAIALVQKIAFSLPDKYFDKVDVTVIPPFTDLRSVQTLVDGDKLRLSYGAQDVSQHDSGAYTGEISGAFLAKLGCSFAVVGHSERRTYHHEDDALVAAKAAAAFRHGITPIVCIGEHLKVREAGNHVEHNVEQLRGSLAGLTSEQIGQAVIAYEPVWAIGTGRVAGAADAQEVCKAIRDELGKLSSPQLAAGIRVLYGGSVNAKNVGEIVAQEDVDGALVGGASLDGEQFATLSAIAAGGPLP

SEQ ID NO: 4525 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 4526 - protein, 271 aa, Arthrobacter FB24
MTTSTNGKFDRTPLIAGNWKMNMDHVQGITLLQKLAWTLSDAKHDYSRAEVAVFPPFTDLRGVQTLVQGDELEIVYGGQDLSQFDSGAYTGDISGQFLNKLGCKYVLVGHSERRTIHNETDEVLNAKVKAAYRHGITTVLCVGEGLEIRQAGTHVQHTLGQLRADVEGLSADEAAELVVAYEPVWAIGTGEVAGPEDAQEMCAAIRAELTTLFGDEVAAKVRLLYGGSVKANNAAAILNERDVDGVLVGGASLDPAEFANIVRFESHLLTD

SEQ ID NO: 4527 - protein, 264 aa, Nocardioides JS614
MATSRTPLMAGNWKMNLNHQEAVVLVQKLAWTLADKKHDYARAEVVVVPPFTDLRSVQTLVDGDRLLVKYGAQDVSTHDGGAFTGEISAGMLAKLGCSYVVVGHSERREYHTEDDQEVNAKAHQALGAGMVPIVCVGEGLDVRQAGGQVAHCLAQVDGSLAGFTAEQIAGLVIAYEPIWAIGTGEVATPDDAQEVCAAIRERIREVHGDEAADGVRVLYGGSVKAANVAGIMAKDDVDGCLVGGASLQADEFGGICRFYDMPVI

SEQ ID NO: 4528 - protein, 261 aa, Mycobacterium KMS; identical to SEQ ID NO: 4524

SEQ ID NO: 4529 - protein, 261 aa, Mycobacterium vanbaalenii PYR-1
MSRKPLIAGNWKMNLNHFEAIALVQKIAFSLPDKYFDKVDVTVIPPFTDLRSVQTLVDGDKLRLTYGAQDVSQHDSGAYTGEISGAFLAKLGCTFAVVGHSERRTYHNEDDALVAAKAAAAFKHGLTPIICIGEHLDVREAGNHVEYNVNQLRGSLAGLSAEQIGQAVIAYEPVWAIGTGRVASAADAQEVCKAIRDELGNLASPELAAGVRVLYGGSVNAKNVGEIVGQADVDGALVGGASLDGEQFSMLSAIAAGGPLP

SEQ ID NO: 4530 - protein, 261 aa, Mycobacterium JLS; identical to SEQ ID NO: 4524

SEQ ID NO: 4531 - protein, 261 aa, Mycobacterium gilvum PYR-GCK
MTRKPLIAGNWKMNLNHFEAIALVQKIAFSLPDKYFDRVDVTVIPPFTDLRSVQTLVDGDKLRLTYGAQDVSQHDSGAYTGEISGAFLAKLGCTFAVVGHSERRTYHGETDELVAAKATAALKHGLTPIVCIGEQLEVREAGNHVEFNVNSLRGSLAGLSAEQIAQTVIAYEPVWAIGTGRVASAADAQEVCKAIRDELGNLASADVAAGVRVLYGGSVNAKNVGEIVGQGDVDGALVGGASLDGEQFATLSAIAAGGPLP

SEQ ID NO: 4532 - protein, 263 aa, Salinispora tropica CNB-440
MANPTRRPLMAGNWKMNLNHLEANLLVQKLAASLTAKQLTDVETVVLPPFTDLRTVQTAVDGDKLLVGYGAQDLSPHASGAHTGDIAGPMLTKLGCTYVVVGHSERRADHHEDDTIVNAKVQAALTHGLTPILCVGEGLEIRELGNQVAHCSDQLDAALKGLSSEQVAQVVVAYEPVWAIGTGKTATPQDAQEVCGALRQRLAGNVGPETADQVRILYGGSVKSSNVAAIMAQPDVDGALVGGASLDAEEFAKICRFPEHTTG

SEQ ID NO: 4533 - protein, 270 aa, Frankia EAN1pec
MAKGAPARGSAGTGRRTLVAGNWKMNLNHLEAIALVQKVAFDLKPAELERVEVVFLPPFTDLRSVQTLIDGDKLAVGYGGQDLSPHGSGAYTGDISGPMLARLGCSYVVVGHSERRTYHHEDDALVASKVLAAYKHGITPILCVGEHEDIRAAGTHVEHVLAQLEGSLAGVSAEQAATLVVAYEPVWAIGTGRTASAQDAQDMCAAVRGQLTKLYDEPIAAGIRVLYGGSVKAANAAELFTMPDVDGGLVGGASLVAEEFVGIIRSGPAA

SEQ ID NO: 4534 - protein, 263 aa, Salinispora arenicola CNS-205
MANPTRRPLMAGNWKMNLNHLEANLLVQKLAASLTAKQLTDVEAVVLPPFTDLRTVQTAVDGDKLLVGYGAQDLSPHASGAHTGDIAGPMLAKLGCTYVVVGHSERRADHHEDDAVVNVKVQAALTHGLTPILCVGEGLDIREQGSQVAYCNDQLDAALKGLSAEQVAQVVVAYEPVWAIGTGKTATPEDAQEVCGALRQRLAGHFGQDTADQVRILYGGSVKSSNVAAIMAQTDVDGALVGGASLDAEEFAKICRFPEHTAG

SEQ ID NO: 4535 - protein, 267 aa, Bifidobacterium longum DJO10A
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 4536 - protein, 271 aa, Arthrobacter chlorophenolicus A6
MTTSTNGAFDRKPFIAGNWKMNMDHVQGITLLQKLAWTLSDAKHDYSRVEVAVFPPFTDLRGVQTLVQGDDLDVAYGGQDLSQFDSGAYTGDISGQFLSKLGCKYVLVGHSERRTIHNESDDVLNAKTKAAFRHGVTPVLCVGEGLEIRKAGTHVNHTLDQLRAGVAGLTDDQAAELVVAYEPVWAIGTGEVAGPEDAQEMCAAIRAELEKLFGADVAAKTRLLYGGSVKANNAAAILKERDVDGVLVGGASLDPAEFANIVRFESHLVTD

SEQ ID NO: 4537 - protein, 275 aa, Acidimicrobium ferrooxidans DSM 10331
MSRRAPEPEPQAGSGRVRLVVANWKLHHTHLEAIAFLERLWHLLDVEDYRRAEIAICPAFTALRSAQLTIETDGMPYRLGAQDVFWEPSGAYTGEVSVPMLAKLDVKYVIVGHSERRRLFGETDDVVAKKAAAVASGGLVPIVCVGEVAEERAGGTTEAVLERQLDTVLTTYPVEALGELVIAYEPVWAIGSGTPATPEDAEHVARFLRDRLARRASEAVAARVRILYGGSVDVGNAVAFLAQADIDGLLVGGASLDPERFAQLLGGRPRIASTS

SEQ ID NO: 4538 - protein, 261 aa, Actinosynnema mirum DSM 43827
MARTPLIAGNWKMNLNHLEAIALVQKIAFALPEKYYAKVEVAVLPPFTDIRSVQTLVDGDKLLLKYGAQDLSPHDSGAYTGDISGVMLAKLGCSYVTVGHSERRDYHGEDDATVNKKVKAALKHGITPIFCLGEKVDVREKGEHVAFCTDQLVAGLKGLTAEQVRGVVIAYEPVWAIGTGKVASAADAQEVCSALRVKLAEAYGEDVASEVRVLYGGSVKSGSVGELIAQKDVDGALVGGASLDGDEFSKLCALAAGGPLP

SEQ ID NO: 4539 - protein, 265 aa, Beutenbergia cavernae DSM 12333
MASTRTPLMAGNWKMNLDHHQATHLVQKLAWTLGDAKHDYTGVEVVVAPSFTNLRSVQTLVDADRLGIRYASQDVSAHASGAYTGEVSASQLAKLGVTYAIIGHSERRQFHAEDDAVVNAKSKAALGEGIVPLVCVGEGLDVRQAGEQVPYTLAQVDGAFDGISADDAATIVVAYEPVWAIGTGEVATPEDAQEVCAAIRVRLSELYSPEVAGAVRVLYGGSVKSGNVAAIMAKPDVDGALVGGASLDADEFAAIVRYQQHAVGL

SEQ ID NO: 4540 - protein, 258 aa, Brachybacterium faecium DSM 4810
MTTPRTPLMAGNWKMNLDWKQGLALVEELGEHLKEVDTSLVETVVLPPFVDLRSVQVAVDAGKLPIAYGAQDISAHESGAYTGEVSGPMLKTLGCSYAAVGHSERRQYHGEDEEVTNAKVKAAFAADITPILCVGEPLEERQAGKHVEYTLAQLEGGIEGLDAAQAKRIVIAYEPVWAIGTGEVATPDDAQEVCAAIREALRAMHGDEVADAVRVLYGGSVKSANVAELMEKADVDGALVGGASLKAEEFAKIAGFQG

SEQ ID NO: 4541 - protein, 263 aa, Micrococcus luteus NCTC 2665
MAEQTTRVPLIAGNWKMNLDHLEAVTLVQRLTWLLSDADHDQEAVEVAVFPPFTGLRSVQTLVTGDRLDLVYGAQDLSPEDAGAYTGDVSGAFLAALGCRYAIVGHSERRTLHGEDDALVARKAAAALRHGLTPVICVGEGLEVRQAGRHVEHTLAQLEGSIAGLSAQDVAGVVVAYEPVWAIGTGEVAGPEDAQQMCAALRARVAALHGDDVAAGLRILYGGSVKSSSAPALLAQPDVDGALVGGASLDADEFAKIVRFDQA

SEQ ID NO: 4542 - protein, 263 aa, Kytococcus sedentarius DSM 20547
MTERLPLIAGNWKMNLDHLQATHLVQKLDWVLRDASHSFDAVEVAVFPPFTHLRSVETLIMADKLDIKLGAQDLSEHASGAHTGDISGGMLAKLGCEFVIVGHSERREHHAETDAVVHLKVKAALAAGLAPIVCVGESSETRAAGEHLAFVTRQVAAALEGLSAEELAHAVIAYEPVWAIGTGEVASSADAQEVCAAIREQVAHTHGAELAAGMRVLYGGSVKPTNIAEIMDEADVDGALVGGASLTAEEFASIVRFRSHHGR

SEQ ID NO: 4543 - protein, 263 aa, Catenulispora acidiphila DSM 44928
MTDRKPLMAGNWKMNLNHFEAMKHVQELAFSLTDKDFDAVDVAVLVPFTDLRSVQTLVQGDKLRIQYGAQDVSQHPSGAYTGDISAPMLAKLDCHYVIVGHSERRQYHGETDALVAAKAVAARKHGITPIVCVGEHLQVRKDGAHVAHCVEQTRGSLAGLSAEQVQASVIAYEPVWAIGTGEVATPEDAQEVCAAIRTELATLFDESVAANTRILYGGSVKGANAAELMAQPDVDGALVGGASLDAADFTRIVRFRDSAVAAG

SEQ ID NO: 4544 - protein, 261 aa, Saccharomonospora viridis DSM 43017
MARKPLIAGNWKMNLNHLEAIALVQKIAFSLPEKYYEKVDVTVLPPFTDIRSVQTLVDGDKLLLTYGAQDVSPHDSGAYTGDISAPMLAKLGCTYVVVGHSERREYHGETDELVNKKVRAALKHGLSPIVCVGEQLEVREAGGHIEHTTSQLIAALKGLKTEQVNNVVVAYEPVWAIGTGRVATPSDAEEVCAALRTALADKYGADLAQRVRVLYGGSVKSSNVADLVKCDNVDGALVGGASLDGEEFTKLCALAAGGPLP

SEQ ID NO: 4545 - protein, 260 aa, Jonesia denitrificans DSM 20603
MTNARTPLIAGNWKMNLDHNEAIHTVQKLAWALKDAQHDYNAVEATVLVPFTDIRSVQTLVDSDKLGITYGAQDLSAQVSGAYTGEISPVFLSRLGVKYVAVGHSERRQYHGEDDALVNAKTKNALAHDIAPIVCVGEPLEVRKAGDQVPFTLAQVDGAFADISAEDAVKVVVAYEPVWAIGTGEVATPADAQEVAQAIRARLAELYSQDVADAVRVLYGGSVKSSSIKELMNEADVDGALVGGASLDPEEFAKIVHYQD

SEQ ID NO: 4546 - protein, 255 aa, Atopobium parvulum DSM 20469
MRNRMIAGNWKMNETFAEGIELAQGIVDQLASGTGNVDVVVAPPLVDLKGVSEVLTQANSSVALSAQNVYWEESGAFTGETSPAMLTSVGATYCIIGHSERRGYFGETDEDINRKAKALMAHDIVPISCCGESLEVRNAGTHVQFVVDQIKADTKGLEITDPSKYVIAYEPIWAIGTGMTATADDAQEVCGAIRKTLVEIFGAEIAEGIRILYGGSAKPENVGGFLEKEDVDGALVGGASLKADSFVAMVKSAMN

SEQ ID NO: 4547 - protein, 261 aa, Nakamurella multipartita DSM 44233
MATRTPLIAGNWKMNLTHLEGIALVQKISFTLPEKYLKHVEVAVFPPFTALRSVQTLIEADKIDFKYGAQDVSAHDSGAYTGEISGIQLSKLGCTYVLVGHSERREYHHETDEQLAKKVNAAYKHGLIPMLCVGEGLEIREAGNQVAYSVNQLLAGIADVTPEQAESLVLAYEPVWAIGTGRVATPADAQEVCAALRVALAGKYGQETADKIRILYGGSVKSGNVAEICAQTDVDGALVGGASLDGTEFATLAANAVGVLP

SEQ ID NO: 4548 - protein, 783 aa, Brucella suis 1330
MARRFSKSDTGRSARTERRAATAQSKDSAAFLPTREEVLKYIEENPDRAGKRELAKAFNIEGDARVYLKDLLRELADEGLVEKRARKLSRPGSLPSVAVLDITGRDEDGGLLARPAEWVEASHGKPPVVLLRRTRLNKTSESGPVVGVGDRVLAKIFRNEDHAGPDFSARVMKRLEHHANAVLGVVRKLGNGEWRLEPVNRKQGEVQLDPAMLENAESGDLVEVELLSARRYGLPRGKVRQVVGSIDSEKALSMIAIHEHEIPHVFPDEVLREAETAGPATLEGREDWREIPLITIDPADAKDHDDAVYAEPDTDPENPGGQVVIVAITDVAAYVRPGSALDREAQKRGNSVYFPDRVVPMLPERISNDLCSLREMEDRPALTVRMIFSADGRKKSHKFHRIMMRSAAKVAYGQAQAAIDGAPDDKTGPILDTVLKPLWSAYAVLKRGRDAREPLELDLPEKKILLTPEGKVDKVIVPERLDAHKLIEEFMIQANVSAAETLEGRHQPLIFRIHGEPALAKQETLREFLRTLDLNLAKGAQLQPAQFNRILAAVDGTDHQELVNQVVLRTQSQAEYSPDNIGHFGLHLRRYAHFTSPIRRYADLIVHRALIKALGLGTDGLTSAEEAQLEEISALISATERRAMLAERETVDRLIAHFLASHLGDEYEGRVTGVTRAGLFVNLATYGADGLVPISTLGHEYYLYDEANHAIAGERSGRGFRLGDTVTVRLVEALPVAGALRFEMVSEPHPLPMSTRSHHKASRAMRGRKGKPAGIPRHKRRGH

SEQ ID NO: 4549 - protein, 782 aa, Nitrobacter winogradskyi Nb-255
MSKPRARNFPDREAIVAFIRAHPGRAGTREIAHEFGLKNADRAELKHILRALADDGTIVKRSRKLRKPETLPPTLVADITGRDRDGELIATPTEWDDEATPAPRILIHVPRRAKPGTVAGVGDRALLRIETIESDETASYRARVIRVIDRTRARMLGIYRASPQGGGRLVPVDKKQAGRELNIAKADSAGAEDGDLVSVELVRTRGFGLASGKVKERLGSLATEKAVSLIAIHAHDIPQEFTPAALREAAAAKPSALQGREDWRAVPLITIDPPDAKDHDDAVHAAPDDDPNNTGGAIVTVAIADVAYYVRPESALDREALERGNSVYFPDRVVPMLPERISNDLCSLVPGEARGALAVRMVIDADGRKRSHTFHRILMRSAAKLAYSQVQAAIDGNPDDATAPLLEPILKPLYAAFALVKRARDERDPLDLELPERKILLKKDGTVDRVIVPDRLDAHRLIEEFMILANVAAAEMLEKKGLPLIYRVHDEPTVEKVHNLREFLKTLDMSFARSGALRPELFNRVLDQVRGHDSESLVNEVVLRSQAQAEYSAENYGHFGLNLRRYAHFTSPIRRYADLVVHRALLRALGLGDGALPDSDNAETLAEIAARISVTERRAMKAERETADRLIAHFLADRIGNIFEARISGVTRAGLFVKLADTGADGLIPIRSLGTEYFKYDETRHALVGSRSGSMHKLGDVVEVRLVEAVPLAGALRFELLSGAEVRPRSPRARGGGKIKTPRGRNAGHPDVHSKAHPGRKPRGTSRKPGRSKAGKPKKGKS

SEQ ID NO: 4550 - protein, 783 aa, Rhodopseudomonas palustris HaA2
MSKTRDDKFPDKATLLAFIRAHPGKVGTREIAREFGLKNADRAELKRRLKELSDDGAIRKSGRRKVAEPATLPPTLLADITARDSDGELIATPSEWDEQDGEPPKIRIHTPRRPKPGTAAGLGDRALLHVEPAEAPEQGPAYVGRVIRVLDRGKPRILGIFRATPQGGGRLVPVDKKQAGRELNIAPHDAGGAQDGDLVSVDLIRSRGYGLSSGRVKERLGSLATEKAVSLIAIHSHDIPQEFSTTALRESEAAEPATLKGREDWRELPLVTIDPPDAKDHDDAVHAEPDPDPNNKGGVILHVAIADVAYYVRPDSALDRDALRRGNSVYFPDRVVPMLPERISNDLCSLKPGEPRGALAVRMVIGADGRKRSHSFHRVLMRSAAKLNYAQAQAAIDGRPDDTTGPLLDTILKPLYDAYAIVKRGRDERDPLDLDLPERKIILKPDGTVDRVIVPERLDAHKLIEEFMILANVAAAEMLEKKALPLIYRVHDEPSVEKVHNLVDFLKTLDLSFAKGGALKPAQFNRILAMVKGEDAEPLVNEVVLRSQAQAEYASENYGHFGLNLRRYAHFTSPIRRYADLVVHRALIRALNLGDGALPQTETVETLAEVAAQISLTERRAMKAERETVDRLIAHHLADRIGATFQGRVSGVTKAGLFVKLSDTGADGLIPIRTLGDEYYNYDETRHALIGSRSGAMHRLGDVVDVRLVEAAPVAGALRFELLSESRSVARGPRKGAYKGRAKAVEPAKGGAKIGRSARSKAGKPKAAKPSKRKANKPGKGTR

SEQ ID NO: 4551 - protein, 790 aa, Rhodopseudomonas palustris BisB18
MSTKKRDTSFPDRDALVAFIRAQPGKVGTREIARAFGLKNEDRVELKRVLRDLADAGTIKRRGKIVAEPEALPPTLMADITARDDDGELIATPTEWDEQSGEPPKIRIHVPRRAAPGTAAGIGDRALLRVEPGAEAYRARVIKVVDQTKTRILGIFRALPGGGGRLIPVDKKQVGREFNIAATDAGGAQDGDLVSVDPIRTRGYGLASGKVKERLGSLATEKAVSLIAIHSHEIPQEFSAEAIREADAAKPASLKGREDWRELPLVTIDPPDAKDHDDAVHAEPDPDPNNKGGYILHVAIADVAYYVRPQSALDRDALTRGNSVYFPDRVVPMLPERISNDLCSLKPGEARGALAVRIVIGPDGRKHSHSFHRILMRSAAKLSYAQAQAAIDGHPDDTTGPLLKPILQPLYDAYAVVKRGRDERDPLDLDLPERKILLKPDGTVDRVIVPERLDAHKLIEEFMILANVAAAEMLEKKALPLIYRVHDEPSVEKVHNLVEFLKTLDLSFAKQGALRPSLFNRVLAQVKGHDAEPLVNEVVLRSQAQAEYASQNYGHFGLNLRRYAHFTSPIRRYADLVVHRALIRALNLGDGALPDTETVETLAEVAAQISVTERRAMKAERETTDRLIAHFLADRIGASFQGRISGVTRAGLFVKLADTGADGLIPIRTIGSEYFNYDETRHALIGTRSGTIYRLGDVVDVRLVEATPVAGALRFELLGDGGVVAGGRPRPHIRSRGAASSEPRSKAHPGRNPSKAKKDKKSKPPKRDRKSKIKKANKAKGGTPGKPKKG

SEQ ID NO: 4552 - protein, 781 aa, Rhodopseudomonas palustris BisB5
MSKTRDATFPDKATLVAFIRAHPGKVGTREIAREFGLKNADRAELKRMIRELSDDGTIRKSGRRKIAEPAALPPTLLADITARDSDGELIATPAEWDEQDGDPPRIRIHVPRRAKPGTAAGLGDRALLHVEPAEASDNGPAYVGRVIRVLDRGKPRILGIFRVQPQGGGRLVPVDKKQAGRELNIAAHDAGGAQDGDLVSVELIRARGYGLSSGRVKERLGSLATEKAVSLIAIHSHDIPQEFAPAALRESEAAEPATLKGREDWRSLPLVTIDPPDAKDHDDAVHAEPDPDPANKGGVILHVAIADVAYYVRPESALDHDALRRGNSVYFPDRVVPMLPERISNDLCSLKPGEPRGALAVRMVMDADGRKRSHSFHRVLMRSAAKLNYAQAQAAIDGHPDDVTGPLLETILKPLYDAYAIVKRGRDERDPLDLDLPERKILLKPDGTVDRVIVPERLDAHRLIEEFMILANVAAAEMLEKKALPLIYRVHDEPTVEKVHNLVDFLKTLDLSFAKGGAMRPAQFNRILAMVKGHDAELLVNEVVLRSQAQAEYASENYGHFGLNLRRYAHFTSPIRRYADLVVHRALIRALDLGDGALPQTETVETLAEVAAQISVTERRAMKAERETVDRLIAHHLADRIGATFQGRISGVTKAGLFVKLSDTGADGLIPIRTLGDEYYNYDETRHALIGSRSGAMHRLGDVVDVRLVEAAPVAGALRFELLSESRSVVRGQRKGPHKTKGKEQATSKAAIGRSSRGKARKAKVAKPPKRKPNKPGKGKR

SEQ ID NO: 4553 - protein, 790 aa, Nitrobacter hamburgensis X14
MLARTADVSKLRDKRFPDRETIVAFIRAHPGQAGTREIAREFGLKNADRIALKQILRDLADDGTIVKRGRKLQQAETLPPTLMADITGRDSDGELLATPTEWDEEAGPPPKIRIHVPRRIKPGTAAGVGDRALLRIEAMEPDESARFRARVIKVIDHTRARILGIYRALPQGGGRLVPVDKKQAGRELNIAKADNAGAEDGDLVSVELVRTRSFGLASGKVKERLGSLSTEKAVSLIAIHAHDIPQAFAPAALREAEAAKPATLRHREDWRALPLVTIDPPDAKDHDDAVHAAPDDDPNNKDGAIVTVAIADVAYYVRPGSSLDHDALTRGNSVYFPDRVVPMLPERISNDLCSLVPGEARGALAVRMVIGPDGRKRSHTFHRILMRSAAKLNYAQAQAAIDGNPDDATGPLLEPILKPLYAAYTLVKRARDERDPLDLELPERKILLKTDGTVDRVVVPERLDAHRLIEEFMILANVAAAEMLEKKGLPLIYRVHDEPTVEKVHNLREFLKTLDMSFAKSGALRPELFNRVLDQVKGYDSESLVNEVVLRSQAQAEYSAENYGHFGLNLRRYAHFTSPIRRYADLIVHRALIRALGLGDGALPDAETPETLAEIAAQISVTERRAMKAERETADRLIAHFLADRIGNIFEGRISGVTRAGLFVKLTDTGADGLIPIRSLGTEYFNYDEARHALVGSRSGSMHKLGDVVEVRLVEALPLAGALRFELLSGGHAGPRDHRARGGRNTKGQRGPQDTRHPGVHSKAHPGRKPRKASRKPGKSKAGKPKKGKS

SEQ ID NO: 4554 - protein, 765 aa, Mesorhizobium BNC1
MARKNSKAAGGEGASANPHLPSREEILRFVSENPDQAGKREIAKAFSLKGGDRIWLKEMLRDMQNDGLLKQKRRRLSRPGSLPPMVVLDIFSRDAEGGLLARPAELEDEDGPIPLVSIRPQRGGRSPAAGVGDRVLARVFASKEEGGPAYTGRVVKLFEKRRRAVLGVFREMPDGTLRIEPVERRQPELVVDEASRKGAKSGDLVEVEPLSQGRYGLPRARVLEVVGSITTEKAVSMIAIHAHEIPHIFPESVVKEAESVKPATLEGREDWRKLPLVTIDPADAKDHDDAVYAEADTDEKNPGGVVVTVAIADVACYVRPDSALDREALNRGNSVYFPDRVVPMLPERISNDLCSLREGEARPALAVRMRFTSGGRKIGHSFHRVMMRSAARLSYEQAQAAIDGRPDDKTGPLLEPVLRPLWNAYSVLKRGREAREPLELDLPERKIILKPDGTVDRVVVPPRLDAHKLIEEFMIQANVAAAETLESVRQPLVYRVHDAPSLAKQESLREFLGSLEISLAHGAALRPAQFNRILAHVAGTEQEQLVNEVVLRSQSQAIYARENIGHFGLNLRRYAHFTSPIRRYADLIVHRALITAMNFGPDGLREADEERLEEVSALISATERRAMAAERETVDRLIAEHLAGRINEEFSARISGVTKAGLFVLLPQYGADGFVPVSSLGDDYYIFDEVRHALVGQRSGCGYQLGDSVDVRLLEVAPLAGAMRFEVLTSPTRLPGSSKSFHKARRGSARNQKRPSRSTVRGRRR

SEQ ID NO: 4555 - protein, 792 aa, Bradyrhizobium BTAi1
MIKKSDIGLPPREAIVAFIRANPGKVGTKDIARAFGLKNADRAALKQLLRELVADGTVKKSGRKKIVEPATLPATLVADITGRDSDGELIAKPAEWDEAEQSEPPRIRIHTPRHARPGATAGVGDRALVRVEPINDAEGIAYRGRVLKVLDQARNRVLGIFKSNPGGGGRLIPVDKKQAGRELSIAPDDTKDAKDGDLISVDLLRGRGYGLPAGRVKERFGSVATEKAISLIAIHAHEIPMDFSAAAIAEAEAAQPATLKGREDWRELPLITIDPRDAKDHDDAVHAEPDADPSNAGGVIVHVAIADVAYYVRPGSALDRDALIRGNSVYFPDRVVPMLPERISNNLCSLVPGEPRGALAVRMVIGADGRKRSHSFHRVLMRSAARLSYAQAQAAIDGKPDDITGPLLEPILKPLYAAYEVAKRGRDARDPLDLDIPERKILLKKDGTVDRVVVPERLDAHRLIEEFMISANVAAAELLEKKALPLIYRVHDEPTVEKIHALQEFLKTLDVPFAKSGALRPSLFNRVLTLVAGQDYEHLVNEVVLRSQAQAEYSTDNYGHFGLNLRRYAHFTSPIRRYADLVVHRGLLRALNLGDGALPDSETPDHLAEVAAQISVTERRAMKAERETADRLIAHHLADRVGATFQGRISGVTRAGLFIKLDDTGADGLVPIRTLGTEYFDYDETRHALIGQRSGAMHRLGDVVDVRLVEAQPVAGALRFELLTQADVLVSRHPRGAGPRRKSTAKRNTKTKAKATQADARPRHKEKSRKKNQKAGAKRKPGTSKKGRSWTP

SEQ ID NO: 4556 - protein, 783 aa, Brucella ovis
MARRFSKSDTGRSARTERRAATAQSKDSAAFLPTREEVLKYIEENPDRAGKRELAKTFNIKGDARVYLKDLLRELADERLVEKRARKLSRPGSLPSVAVLDITGRDEDGGLLARPAEWDEASHGKPPVVLLRRTRLNKTSESGPVVGVGDRVLAKIFRNEDHAGPDFSARVMKRLEHHANAVLGVVRKLGNGEWRLEPVNRKQGEVQLDPAMLENAESGDLVEVELLSARRYGLPRGKVRQVVGSIDSEKALSMIAIHEHEIPHVFPDEVLREAETAGPATLEGREDWREIPLITIDPADAKDHDDAVYAEPDTDPENPGGQVVIVAIADVAAYVRPGSALDREAQKRGNSVYFPDRVVPMLPERISNDLCSLREMEDRPALAVRMIFSADGRKKSHKFHRIMMRSAAKVAYGQAQAAIDGAPDDKTGPILDTVLKPLWNAYAVLKRGRDAREPLELDLPEKKILLTPEGKVDKVIVPERLDAHKLIEEFMIQANVSAAETLEGRHQPLIFRIHGEPALAKQETLREFLRTLDLNLAKGAQLQPAQFNRILAAVDGTDHQELVNQVVLRTQSQAEYSPDNIGHFGLHLRRYAHFTSPIRRYADLIVHRALIKALGLGTDGLTSAEEAQLEEISALISATERRAMLAERETVDRLIAHFLASHLGDEYEGRVTGVTRAGLFVNLATYGADGLVPISTLGHEYYLYDEANHAIAGERSGRGFRLGDTVTVRLVEALPVAGALRFEMVSEPHPLPMSTRSHHKASRAMRGRKGKPAGIPRHKRRGH

SEQ ID NO: 4557 - protein, 789 aa, Sinorhizobium medicae WSM419
MTRIPRDPTDTPAKGAGKKNGRAARTAPAGEKETIVQGAVPSREVLMRFIAENPQHASKRDIAKAFGLKGEARVELKTLLRSLEADGLVEKKRKSLIRPGGLPPVTVLDITIRDIDGDLIGRPAEWLDDDGVAPAVLIKQSSIARAKGKTPVGGLGDRVLAKIFPSKERGGPAYTARIIKVLDKRKDAVLGVFRATPGGGGRLMPIDKRGEELLIDPEFTGDAKEGDLVEAHLSRIGRYGLPRAQVQNVIGSVASEKAISMIAIHAHGIPHVFPERVLQEADAAQPATMSHREDWRSLPLITIDPADAKDHDDAVYAEPDPSPDNPGGVIVTVAIADVSWYVRARSALDLEALKRGNSVYFPDRVVPMLPERISNDLCSLKEDVDRPALAVRMRFSKEGRKAGHTFHRIMMRSAAKLSYQQAQTAIDGAPDEKTGPILETILKPLWEAYRILTRGRERRQPLELDVPERKIILKPDGTVDRVFVPDRLDAHKLIEEMMIQANVAAAETLEQKRQVLIYRVHDQPSLAKQESLREFLATLDISLAKGGNMRANHFNGILAKADGKPFETIVNQMVLRSQSQAIYSPENIGHFGLNLLRYAHFTSPIRRYADLIVHRALVSSLGLGEGGITPEEEGTLDDIAAEISTFERRAMAAERDTTDRLIAHHLNGRVGEEFEGRVSGVTKAGLFVTLPSYGADGFIPISTLGRDYFIYDEAHQALSGEKTGLGYRLGDPVQVKLVEAVPLAGALRFEMLSEGRKMPTAMRSFHKSGRRDRTGARKRPGTRAPRGRQ

SEQ ID NO: 4558 - protein, 787 aa, Ochrobactrum anthropi ATCC 49188
MARRFSKSDTGRSARTERRAAKAKSADGNSDPNAFLPTREEVLKYIEENPDRAGKRELAKAFNIKGDARVYLKDLLRELSDEGLVEKRARKLSRPGALPAVTVLDITGRDEDGSLLARPSEWDEAGYGKPPIVLIRRTRLNKASEGGPAVGVGDRVLAKIFRSEDRDGPDYTARVMKRLEHRTNAVLGIVRKLGNGEWRLDPVNRKQPEVQLDPAQLENAEAGDLVEVDLISSRRQGLPRGKVRQVVGSIDSEKALSMIAIHEHEIPHVFPAEALSEAEAAQPATMDGREDWRDIPLLTIDPADAKDHDDAVYAEPDKDPENPGGQIVIVAIADVAAYVRPDSALDREAQKRGNSVYFPDRVVPMLPERISNNLCSLRELEDRPALAVRMIFAADGRKKSHKFHRIMMKSAVKLAYSQAQAAIDGAPDDKTTPILDGILKPLWGAYAVLKRGRDAREPLELDLPEKKILLTPDGKVDKVIVPERLDAHKLIEEFMIQANVAAAETLEAHRQPLIFRIHDAPALAKQETLREFLRTLDLSLAKGAELQPAQFNRILEAVEGSDHQELVNQVVLRTQSQAEYNPDNIGHFGLHLSRYAHFTSPIRRYADLIVHRALIKALNLGSDGLTTEEEAHLEEISALISSTERRAMLAERETVDRLIAHFLAAHLGDEYEGRVTGVTRAGLFVNLATYGADGLVPISTLGHEYYLYDEANHAIAGERSGKGFRLGDTVTVRLVEALPVAGALRFEMVSEPHPLPMATRSHHKASRTMRGRRGKPAGIPRQKRRGR

SEQ ID NO: 4559 - protein, 782 aa, Parvibaculum lavamentivorans DS-1
MPSRKPPKKTGAAKKDTGSKKKARGLPSREEVLAFLADNPGKTGKREIGRAFGVKGDDRIGLKQMLKAMSDEGLIAKDETKSLRRVGEMPPVTVIEITHTDTDGELIARPVSWPGEDLPPLIVVTPDTRRGKRDVDEPPAGVGDRVLARVAKSEDETYPYEAQVIRRVGKGAERVLGLFRLTPKAKTARLIPVDKKMRVEFEIAIEDIGDAEDGSLVLAETIPGKRYGVPRARVREVFGDIADPRSISLIAIHTHGIPDSFPDAVIAEAEAARHQGLKGRTDLRDIPLITIDPADARDHDDAVWAAPDTDPKNEGGIVAIVAIADVAAYVRPNSAMDREALKRGNSTYFPDRVVPMLPERISNDLCSLIEKEDRACLAVRMVFDRNGNKRGHEFIRGLMKSAASLSYRQVQQAIDGNPDDATGPLLEPVLKPLWDAYRILAKAREARGPLDLDLPEYKIDIDEKGGVGGIRIGEKFESMKLIEEFMIQANVCAAETAEAQHRPVIYRIHDAPSREKLVALAEFLATLNLSFAKGENIRPANFNRILKAVDGTEHDQMVSDVVLRSQAQAVYAPDNIGHFGLNLRRYAHFTSPIRRYADLTVHRALIAGLGLGKDGQTEDETSSLTEIAEHISTTERRSMLAERDSKDRFIAAFLEARIGAEFRGRIAGVTRFGLFVKLNDTGADGFVPISTLGGDFYHHDEILHALTGERTGKTYRLGDGVLVRLEECVPVTGGMRFTLLEGGSEGKPAGPRPRSGRRPTGKGGSRQGEKNRKPKSSPRKRR

SEQ ID NO: 4560 - protein, 776 aa, Xanthobacter autotrophicus Py2
MPTKEQVLAFIATQSGEVGKREIARAFGLNAAQKIELKSLLRDLADTGTVERSRRRLHVPGALPGVVLADIVSRDGDGELIAVPVEWDTETQGDAPPILVQVPRRAVGPAPGLADRVLLRIVEGSIEHGVAHVGRVIKVLEKARRQTIGIFRAAPGGEGGGRIIPIDKKQLGRELQVPPGAEHEARDGDLVTVELMRQRVFGLPTARVKEKLGSLSSEKAVSLIALHAHAIPHVFPEAVLKEAEAAKPVTPRGREDWRDVPLVTIDPPDAKDHDDAVHAVADDDPANDGGFIVTVAIADVSAYVRPGSPLDREALIRGNSVYFPDRVVPMLPERISNDLCSLRPKEDRPALAVRMIIGADGRKRHHTFHRILMRSAGKLAYAQAQNAIEGRTDDTTDPLLNGVLKPLYAAYDCVKKARDARQPLDLDLPERKIVLKEDGTVDRVVVPERLDAHRLIEEFMILANVAAAETLEEKKTPLIYRVHDGPSLEKLSNLREFLKTLDIALAKIDQVRPSHFNRILAQVKDTDAAPLVNQVILRSQSQAEYASENYGHFGLNLRRYAHFTSPIRRYADLVVHRGLVRAMDFGSDGLPPDATTATLGEVAAAISVTERRAMAAERETVDRLIAHHLADQIGATFNARITGATKAGLFVALDITGADGFIPASTLGQDYYRYDETRQALVGERSGEMHRIGDRVEVKLVEAAPVAGALRFELLTEGSYVKGPRGRPGPLRRGGAKGGAPKGGFPKGGARQGPAGRHAGSGHPGKGPQGKGRSRP

SEQ ID NO: 4561 - protein, 788 aa, Methylobacterium extorquens PA1
MARRINPTAGTPVLPSREQILAFVAETPGKVGKREIAKAFGISGADKIGLKAILKEIEAEGALERDRGGLRKSGSLPPVVLADIVSRDRDGDLIARPAQWDGEGEAPKIAVETPRAGRKGNRPAPGIGDRALVRVAPDPEVPGRYTGRVIKVIGKNRSEVIGVYRAGRDGGRLLPVEKKSQGKEIAIPPGEEGEARDGDLVSVAVERETRFGLPRGRVTERLGALGSEKAVSLIALHIHNIPHVFPAAVLAEADAAKRATKRGREDWREAPLVTIDPPDAKDHDDAVMAEADPDPANAGGFIVTVAIADVAAYIRPDSALDREALLRGNSVYFPDRVVPMLPERISNDLCSLREGEDRPALAVRMIIGADGVKRSHSFHRILMRSHAKLAYAQAQAAIDGRPDEKSGPVLETALRPLYAAYEAMKRARDARGPLALDLPERKVLLDAEGGVDRVIVPERLEAHRLIEEFMIQANVAAAETLEKAGSPLIYRVHDEPALEKMRALGEVLASVGVKMTKAGALRPDLFNRILAQVAESEHAPFINEVVLRSQAQAIYAAQNLGHFGLNLRRYAHFTSPIRRYADLIVHRALVRACGLGKDGLPDDTTPGMLDAVSEQISAAERRAMAAERETIDRLIAGYLADRVGATFTGRISGVTRSGLFVKLAETGADGFVPVSTIGHEYYRHDEALHALVGDRSGETYRLGDTVEVRLVEAAAVAGALRFEILSEGRSRSGAKGGGIKRSGSKANPGKAKLGKAKFGAKPPKGKTRPGKAAASESDTARRHRGSRR

SEQ ID NO: 4562 - protein, 773 aa, Methylobacterium radiotolerans JCM 2831
MARRTTAPAAEPAAPQPFPTREQILAFVAESKERVGKREIAKAFGIKGAAKIDLKRVLKEIEEDGALDRGRGGLAPAGHLPPVVLADIRSRDRHGDFLAIPVEWTGTGKPPAIVLVQPRGPRKGNRPAPGIGDRALIRVERDAEGGYAGRVVKVIGKNKAEIIGVYRAGAQGGRIVPVEKRAQGREILIPPGEEGQARDGDLVSVSLERETRFGLPKGRVRERLGSLGSEKAVSLIALHLHNIPHVFADATLAEADAARPATLKGREDWRDRPLLTIDPPDAKDHDDAVMAEADPDPANPGGFILTVAIADVAAYVRPGSSLDREALERGNSVYFPDRVVPMLPERISNDLCSLREGEDRPALAVRMVIAADGEKRRHGFHRVMIRSRAKLAYAQAQAAIDGRPDDATGPLLETALRPLWAAYAALRAARDRRGPLALDLPERKVLLSPEGAVDRVIVPERLDAHRLIEEFMIQANVAAAETLEQARQPLIYRVHDEPALEKMRALGEVLASVGIKLPKEGALRPALFNRILATAAETEHGVFLNEVILRSQAQAVYAPENLGHFGLNLRRYAHFTSPIRRYADLIVHRALITACRLGSDGLASDVSLGELAQIGEQISAAERRAMAAERETIDRLIAHHLADQVGATFAGQIAGVTRAGLFIKLDETGADGFVPVSQLGADYFRHEEGRHALVGERTGETFRLGDRVEVRLVEAAPVAGALRFELLSEGRTRSGGRTAGPGKKAGGRAFKAAPPGRPPGIRNTGSRHRGSRH

SEQ ID NO: 4563 - protein, 795 aa, Methylobacterium populi BJ001
MARRINPKAVAPALPSREQILAFIAETPGKVGKREIAKAFGISGADKIGLKAILKAIEADGLLDRDRGGFRKSGSLPDVVLADIVSRDRDGDLIARPAQWDGEGEAPKIAVEVPRAGRKGNRPAPGLGDRALIRVAPDPEAPGRYTGRVIKVIGKNRTDVIGVYRAGRDGGRLLPVEKKSQGKEIAIPAGEEGEARDGDLVSVAVERETRFGLPRGRVTERLGTLGSEKAVSLIALHLHNIPHVFPPAVLAEADAAKPATKRGREDWRQAPLVTIDPPDAKDHDDAVMAQPDPDPANAGGFIVTVAIADVAAYVRPDSALDREALLRGNSVYFPDRVVPMLPERISNDLCSLREGEDRPALAVRMTIGADGVKRSHSFHRILMRSHAKLAYAQAQAAIDGRPDETSGPVLETALRPLYAAYEAMKRARDARGPLALDLPERKVLLNAEGGVDRVIVPERLEAHRLIEEFMIQANVAAAETLEKAGSPLIYRVHDEPALEKMRALGEVLASVGVKMTKAGALRPDLFNRILAQVAETEHAPFINEVVLRSQAQAIYAAQNLGHFGLNLRRYAHFTSPIRRYADLIVHRALVRACGLGKDGLAGDTTPGALDAVSEQISAAERRAMAAERETIDRLIAGYLADRVGATFSGRISGVTRSGLFVKLDETGADGFVPVSTIGHEYYRHDEALHALVGDRSGETYRLGDTVEVRLVEAAAVAGALRFEILSEGRSRSGAKGDGLKRTGFKAGVKAKAKARIGKGAGKGSGKGSGKGAGKGPGNGSASEGESARRHRGSRR

SEQ ID NO: 4564 - protein, 781 aa, Rhodopseudomonas palustris TIE 1
MSKPRDAKFPDKATLLAFIRAHPGKVGTREIAREYGLKNADRAELKRMLRELADGGSIRKSGRRKVSEPATLPPTLLADIVSRDADGELIATPSEWDEQDGDAPKILIHTPRRIKPGTAAGVGDRALLHVEAADSREAGPAYVGRVIRVLERGKARILGIFRALPQGGGRMVPVDKKQAGRELNIAAHDAGGAQDGDLVSVDLIRTRSFGLASGRVKERLGSLASEKAISLIAIHTHDIPQDFSSAAISESEAAQPATLSGREDWRELPLVTIDPPDAKDHDDAVHAAPDPDPNNKGGVILHVAIADVAYYVRPGSALDRDALRRGNSVYFPDRVVPMLPERISNDLCSLKPGQPRGALAVRMVIDAQGRKRSHSFHRVLMRSAAKLSYAQAQAAIDGKPDDVTGPLLETILKPLYDAYAVVKRGRDERDPLDLDLPERKIILKPDGTVDRVIVPERLDAHRLIEEFMILANVAAAEMLEKKALPLIYRVHDEPSVEKVHNLVDFLKTLDLSFAKGGALRPAQFNRILAMVKGEDSEPLVNEVVLRSQAQAEYSSENYGHFGLNLRRYAHFTSPIRRYADLVVHRALIRALDLGDGALPPSETTETLAEVAAQISLTERRAMKAERETVDRLIAHHLADRIGATFQGRVSGVTKAGLFVKLSDTGADGLIPIRSLGDEYYNYDETRHALIGSRSGAMHRLGDVVDVKLVEAAPVAGALRFELIGNANVEFTHRKTARKTKGTSKAKLKTESGKSARAKPGRAKARKAAKPKQKTKSGRGKR

SEQ ID NO: 4565 - protein, 762 aa, Methylobacterium sp. 4-46
MAKRSSPPSDHAALPSREAVLAFIAEATTKVGKREIAKAFGLKGADKVELKRMLAELKDEGAVEKDRAGLRKAGRLPPVLVAEIDARDRDGELLARPAQWDPEAGPAPKILVMAPRGRRTGSLPAPGIGDRALLRVEPDREAPGRYLGRVVKVIGRNKAEMLGIYRALEKGGGRVLPVEKRAQGREIEIPPGEEGEARDGDLVSVALTRDSRLGLPRGRVKERLGAVASEKAVSLIALHAHGIPHVFPPAVLDEAARARPAGMEDREDWRDAPLLTIDPPDAKDHDDAVMALPDPDPANAGGFVVTVAIADVAAYVRPGSALDREALLRGNSVYFPDRVVPMLPERISNDLCSLRPGEDRPALAIRLVIGADGRKRRHSVHRVMMRSAAKLAYAQAQAAIDGQPDAVTQPLLDPVLRPLWAAYRVLAAARDARGPLALDLPERKVVLDAEGRVDRVVVPERLEAHRLIEEFMIQANVAAAETLEEKAQALIYRVHDEPSLDKMRALGEVLASIGIKLPKEGVLRPSLFNRILGMVQGTEHQTFLHEVILRAQAQAVYAPENAGHFGLALRRYAHFTSPIRRYADLVVHRALIRALRLGPDGLPDMGAAELAEIGQQISNAERRAMAAERETIDRLIAQHLADRVGASFAGQISGVTKSGLFVKLTETGADGFVPVSTLGADYFRYEEGRHALVGERSGETFRLGDRVTVRLVEAAPVAGALRFDVVSEGTRSSPAPRRGGPRKGRPAAERREGLTKRRGKRA

SEQ ID NO: 4566 - protein, 790 aa, Rhizobium leguminosarum bv  trifolii WSM2304
MSRIPRDRTNPAGKRPGKIGRAGKDAPAVEPLNIVHGALPSREVILRFIADHPQKASKRELAKAFGLKGDSRVELKHLLQELEQEGMLQKNRKSLIRPGALPPVTVLDITTRDKDGDLIGRPAEWPEDQGVAPAVAIRQQSPAGRQGKGKAPVAGLGDRILAKIFPAVDRAGPAYTARIIKVIDKRRGASMGVFRTTPGGGGRLLPIERRGEEMVIDPDFTGGAKDGDLVEIEVARLGRFGLPRAKVLSVVGSVGSEKAISMIAIHAHGIPHVFPPAVIAEAEDAKPATMSHREDWRDVPLITIDPADAKDHDDAVYAELDPSPDNPGGVIVTVAIADVSWYVRPKSPLDREALKRGNSVYFPDRVVPMLPERISNDLCSLKEGVDRPALAVRMSFSGEGRKIGHTFHRVMMKSAAKLSYQQAQAAIDGAPDDRTGPMLEPILKPLWHAYAVMKRGRDRRQPLELDMPERKILLKPDGTVDRVHVPPRLDAHKLIEEMMIQANVSAAETLEKKRQPLIYRIHDGPTLAKQEILREFLATLGIPLAKGGNMRANNFNGILAKADGTPHQTMVNEMVLRSQSQAIYGPENIGHFGLNLMKYAHFTSPIRRYADLIVHRALVGSLGFGEGGITTEEEAGLDDIAAEISTFERRAMAAERETVDRLIAHHLSGRVGEEFAGRVSGVTKSGLFVALPEYGADGFVPISTLGSDYFIYDEAHQALSGERTGLGYRLGDNVTVKLAESIPLAGALRFEMVSEGREMPTAVRSFHKAGRRDRGQVRKKPGTRPPRGRH

SEQ ID NO: 4567 - protein, 788 aa, Methylobacterium chloromethanicum CM4
MARRINPTAGTPVLPSREQILAFVAETPGKVGKREIAKAFGISGADKIGLKAILKEIEAEGALERDRGGLRKGGSLPPVVLADIVSRDRDGDLIARPAQWDGEGEAPKIAVETPRAGRKGNRPAPGIGDRALVRVAPDPEAPGRYSGRVIKVIGKNRSEVIGVYRAGRDGGRLLPVEKKSQGKEIAIPPGEEGEARDGDLVSVAVERETRFGLPRGRVTERLGALGSEKAVSLIALHIHNIPHVFPAAVLAEADAAKRATKRGREDWREAPLVTIDPPDAKDHDDAVMAEADPDPANAGGFILTVAIADVAAYIRPDSALDREALLRGNSVYFPDRVVPMLPERISNDLCSLREGEDRPALAVRMIIGADGVKRSHSFHRILMRSHAKLAYAQAQAAIDGRPDEKSRPVLETALRPLYAAYEAMKRARDARGPLALDLPERKVLLDAEGGVDRVIVPERLEAHRLIEEFMIQANVAAAETLEKAGSPLIYRVHDEPALEKMRALGEVLASVGVKMTKAGALRPDLFNRILAQVAESEHAPFINEVVLRSQAQAIYAAQNLGHFGLNLRRYAHFTSPIRRYADLIVHRALVRACGLGKDGLPDDTTPGMLDAVSEQISAAERRAMAAERETIDRLIAGYLADRVGATFTGRISGVTRSGLFVKLAETGADGFVPVSTIGHEYYRHDEALHALVGDRSGETYRLGDTVEVRLVEAAAVAGALRFEILSEGRSRSGAKGGGFKRSGSKASPGKAKLGKAKFGAKSPKGKPRPGKTAASESDAARRHRGSRR

SEQ ID NO: 4568 - protein, 762 aa, Methylobacterium nodulans ORS 2060
MAKRTAPKADHGALPSREAVLAFIAEATTKVGKREIAKAFGLKGADRLELKRMLAELKEEGIVEKDRSGLRKAGRLPPVLVADIDARDRDGELLASPAQWDPEAGPAPKILVMMPRGRRSGALPAPGIGDRALLRVEPDREAPGRYIGRVVKVIGRNKAEVLGVYRALEKGGGRVLPVDKRAQGREIAIPAGQEGEARDGDLVSVALAREGRLGLPQGRVKERLGAISSEKAVSLIALHAHGIPHVFPREVLAEAERAASAGMENREDWRDEPLVTIDPPDAKDHDDAVRAVPDPDPANAGGFLVTVAIADVAAYVRPGSPLDREALARGNSVYFPDRVVPMLPERISNDLCSLRPGEDRPALAVRLVIGADGRKKRHSFHRVMMRSAAKLAYAQAQAAIEGQPDAVTLPLLEPSLRPLWAAYRLMARARDARGPLALDLPERKVILDAEGGVDRVVVPERLEAHRLIEEFMIQANVAAAETLEEKAQALIYRVHDEPSLEKMRALGEVLASIGIKLPKEGVLRPSLFNRILGLVDGTEHQVFINEVILRSQAQAVYAPENVGHFGLALRRYAHFTSPIRRYADLVVHRALIRALRLGPDGLPDMGTGELAEIGQQISMAERRAMAAERETIDRLIAQHLADRVGATFAGQISGATRAGLFVKLDETGADGFVPVSSLGADYFRLEEGRHALVGERTGETFRLGDRITVRLVEAAPVAGALRFEVVSEGARGAPAPRRGGLRKGRALPERREGLAKRRGKRA

SEQ ID NO: 4569 - protein, 792 aa, Agrobacterium vitis S4
MTLSKSPRPDTRSLTNRTRKAELAAKKAADKNETVIIHGAVPPREILMQFITDNPDRASKREIAKAFGLKGEARIELKEALRALEEDGLVNKNRKSLSRPGALPPVTVLDITTRDKDGDLIGRPAEWPDELGAAPAVSIRQSSADRAKGKTPVGGLGDRVLAKIFPSKDHIGPAYTARIIKVIDKRRGALLGVYREMAGDTGGRLMPIERRGEEMVIEAADVGDARDGDLVEVEVGRLSSRLGLARAKVLSVIGSVASEKAISMIAIHAHGIPHIFPQSVLDEADAAKPASMAHREDWRSLPLVTIDPHDAKDHDDAVHAEPDPSPDNPGGVIVTVAIADVSYYIRSKSALDREALKRGNSVYFPDRVVPMLPERISNDLCSLREGVDRPALAVRMVFSHEGRKASHTFHRIMMKSAAKLSYQQAQAAIDGNPDDKAGPLLEPILKPLWAAYAILKRGRDRRQPLELDMPERKIILKADGTVDRVFVPERLDAHKLIEEMMIQANVAAAETLEKKKQPLVYRIHDTPTLAKQEVLREFLATIGFSLAKGGNLRSNSFNGILAKAQDTPHQTIVNEMVLRSQSQAVYSPENIGHFGLNLLKYAHFTSPIRRYADLIVHRALVGTLGLGEGGITSDEEAALADVAAEISTFERRAMAAERDTINRLIAHHLATRIGDEFDGQVSGVTKSGLFISLPQYGADGFIPVSTLGRDYFIYDEAHQALTGEKTGLGYQLGDSVSVKLVEAVPLAGALRFEILSEGKKMPTGIRSFHKATRRGRPGPGKTPGTRPPRGRR

SEQ ID NO: 4570 - protein, 790 aa, Rhizobium leguminosarum bv  trifolii WSM1325
MSRIPRERTNPAGKRPGKTGHASKDAPAVEPLNIVHGALPSREVILRFIADHPQKASKRELAKAFGLKGDSRVELKQMLQELEQEGMLQKNRKSLIRPGALPPVTVLDITTRDKDGDLIGRPAEWPEDQGVAPAVAIRQQSPAGRQGKGKTPVAGLGDRILAKIFPAVDRGGPAYTARIIKVIDRRRGASMGVFRTAPDGGGRLLPIERRGEEMVIAPDFTGGATDGDLVEVEIARLGRFGLPRAKVLSVVGSVGSEKALSMIAIHAHGIPHVFPPAVIAEAEAARPATMSHREDWRDVPLITIDPADAKDHDDAVYAELDPSPDNPGGVIVTVAIADVSWYVRPNSPLDREALKRGNSVYFPDRVVPMLPERISNDLCSLKQGVDRPALAVRMSFSGEGRKIGHIFHRIMMKSAAKLSYQQAQAAIDGRPDDQTGPMLEPILKPLWHAYEVMKRGRDRRQPLELDMPERKILLKSDGTVDRVVVPPRLDAHKLIEEMMIQANVCAAETLEKKRQPLIYRIHDGPTLAKQEILREFLATLGISLAKGGNMRANNFNGILAKADGTPHQTMVSEMVLRSQSQAIYGPENIGHFGLNLMKYAHFTSPIRRYADLIVHRALVGSLGFGEGGITPEEEAALDDIAAEISTFERRAMAAERETVDRLIAHHLSGRVGEEFAGRVSGVTKSGVFIALPDYGADGFVPISTLGSDYFIYDEAHQALSGEKTGLGYRLGDSVTVKLAEAIPLAGALRFEMISEGREMPAAVRSFHKAGRRDRGQIRKKPGTRPPRGRH

SEQ ID NO: 4571 - protein, 362 aa, Trichodesmium erythraeum IMS101
MKKSIKLISNRALFYLAILPVSCGVFAWQGWSWWSWVSRPVVSPTSSTQSSQANAIRIKIPVGTYGQQIGEYLEDAGIIRSATAWNLWVKWLSLQNPNLEFKAGTYNLLPTEPLSAIADKILQGDVVKLSYVIREGWSIQQMAAYLDDEGFFPAADFIAATKNIPYDKFPWLPTNIPHLEGYLFPDTYKIVADNITPEAIINQMIGQFEQVALPVYQKNQNNTTKLSLHEWVSLASIVEKEAVVAQERGLISGVFNNRLEQGMRLAADPTVEYGLGIRQTKDKPLTYSQIETPSPYNTYMNTGLPPTPISSPGKASLEATLNPEDTEYLYFMARYDGTHIFSRTAREHEAAIAEVERLLSSQ

SEQ ID NO: 4572 - protein, 339 aa, Dictyoglomus turgidum DSM 6724
MNNFSLYFLLIFSLLVFIGFLVYLYLSSPKSKIEREIEVYIPEGSSAYKVADILLDNSLIKSKEVFIATLKLMGKDKGLKSGYYILSPSFSMFDIIDILTQGKGLRVKITIPEGSSLKDMAHLFSEKLALSKEKFITLCKDENFIDSVMKDYKNYFSSYKSLKTLEGYLYPSTYYFNKGIKEEDIIKFLIKEFFNQINVHIPEYKERLKSLNLSFNDWIILASIVEKEAKVDQERPLIAGVFLNRLKKGYKLQSCATVEYVYDFKKSVLLYKDLEIDSPYNTYIYYGLPPSPICSPSLNSLKAVLYPQGDYLFFVAKGDGTHIFTKTYEEHLKAQEFKK

SEQ ID NO: 4573 - protein, 351 aa, Cyanothece PCC 7425
MNWNLGWRSGAAIAAGLLLLGSWQWWSWATAPSQSKGNSLPSPLQVQIAPGTPADQVGEDLYQKGLIRSALAWKLWVRWQSWRSPQAGVQAGTYELSPTQSLPTIATRLWQGDVIQTRFTIPEGWSIRQMSRYLEQLGLFPAADFEQATRRIPRDEFAWLPANLTSLEGFLFPDTYQIPTGTITPEEVIRVMLQRFSEIALPLYRQAPSAQLTLAQWVTLSSIVEKEAVVPQERTLIAGVFLNRLRLNMPLGADPTVEYALGIQQTPDRPLTLTQVQTPSPYNTYLNAGLPPGAIASPGRASLEAVLTPARTDYLYFVARYDGTHIFSRTLAEHEIAQARIHDQRQSGSRL

SEQ ID NO: 4574 - protein, 385 aa, Eggerthella lenta DSM 2243
MPQHRKQVTYSQRPNHAARSAHARGERQFRTYDTSYIRPKKSKAPAIVAAVLAVLVVGGLAWGALTLFNSCSAQSVELLAEGQEATITVAEGAGAKVVGEQLAEARLVSNAGDFTKRVNEMGVDSQLKPGTYTFAGGMSLDAIINQLTAGPVANALTIPEGSTLEAVAQSVATFTENRITADAFTAAASDASSYAADYDFLADAGTNSLEGFLFPKTYEIGDDATAESVVRMMLDQFKTETSGLDWSYPQSQGLTIYDAVKLASIVERESSGDEQIRAQVASVFYNRLNNFGDPNYGFLQSDATTAYELGHDPTPEDIKNPTPFNTYTNTGLPPTPICSPGLDCLQAVCNPAQTNYFFFYFAPDESGTMQYYFSETYEEHQQTFS

SEQ ID NO: 4575 - protein, 403 aa, Cryptobacterium curtum DSM 15641
MALHRQVTYSSRPNRAARMAHAKGERQFRTYDTSLIQPRHSRGRLIVVALAALLLVALIGFGIHSCLKAPEVELIDESTSVTFTIPEGASTADIARILQENRLVARASDFSDAVKARGVASSLKPGTYTLTGGLDVSDIVDTLVSGPNSSTLTIPEGYTLARTAAAVETATDGRISAAEFTAAASDATAFSDQFPFVAEAYNGSLEGFLFPKTYEVLISDTADSLIRKMLSQYQSETATLDYSYASAAGLSSYDVLKLASMVEREADDTNRSRVAGVFYNRLAANMALQSDATIAYLVGGDPTHDDLSIASPYNTYLNKGLPAGPICSPGLDALSAACQPEQNDYLYFYFVKNSDGSMSYFFSRTYEEHQQAIAQTQGSDSDQTQEESDSSGEARDSSSSDES

SEQ ID NO: 4576 - protein, 389 aa, Slackia heliotrinireducens DSM 20476
MPRKQITYSSRPNHRARMVHAQGEKQFRTYDTSHIRPRRSKVPVIVAAVIGVLILVLAGLLLTNFVKGCSSDANENIGETVIVSEGTQVTIPEGATAKDVAAVLADAGLIDDQKAFVKRAAALGADAQFQAGTYTFSEGMTMDQVINAIATGDTGVLTLTVPEGWTNARIATAVEESSKGAITAEDFAAQALASNYVEDYPFVEGAYEDSLEGFLFPKTYNIEPGDTADTLIRKMLDQYAAEVEVLDYTYPESQGLTAYDVLILASIIEKEALPGEDFPTEREDVASVFYNRMAEEMPLQSDATMGYVTGGEVTAADLETESPYNTYLNDGLCPGPICNPSIASLQAACNPSTTDYLYFFIVDEDGYVDHTFSTTLEDHQAAIDRYTNR

SEQ ID NO: 4577 - protein, 451 aa, Atopobium parvulum DSM 20469
MPTPSNDSSPRRQGAHFSSSVSEGQAQEEQIQEKQTQQDSAHYNAGSQEALQQPPVEATGSLPALTGGKLSSRSAQVTHKAKNKQVKHRDRKASKCSRIFATLIAFVMVAALGIFVWKVALPELSRTNSDTQEITAGQQVTVTIPDGAGAQEVAKILFENKIIATKSEFLDQVKRQDAEQKIKSGSYVITTGTKPADIVHLLVSGPNAPGSGFVVPEGYTVSQVADLAQNYFGISRDDFLNQAKASNYVADYPFLAGAVDANDSLEGYLFPKTYTFTESNVTADTVIRAMLDQFKAETANLNLDAARITLNKRYNLNLTNEQIITMASIIEREALTDEDRPKVASVFYNRLYDDMYLQSDATLAYSLGREATAEELSSMTSDPYNTYAFKGLTPTPICSPGYASIKAAMDPAATNYYYFWITSDEHVFSETYDEHQQAIENAREREAASKQ

SEQ ID NO: 4578 - protein, 736 aa, Moorella thermoacetica ATCC 39073
MEVIVADYAGFCFGVKRAVEKAREAPKPVASLGMLIHNRQVVDQLAREGVRPVASLDEVNCGRILIRSHGTTPETLVRARDKGLEIIDATCPYVKRAQHLAQKMAAEGYQVIIVGDAAHPEVQGMLGWAGPGAVVVPDKKAAAALPFHPRRAVLAQTTQPESRLEEVAAALRSNTDTLVVHNTVCQATHQRQEAAVRLARQVDVMVVVGGKESANTRHLAELCRATGTPTYHVERAGELCRQWFINTRRVGVTGGASTPAWIIEEVVGMLTGEEKIMVPEEEKEPVTTQEPVASGQPVAPAEPEGNPAITGPEGGAEPPAAEAAKSGAFGGQEGPGVAPGETGTPEEQRNEMQQITARMPELRRGNVVAGTVVQITDNEVMVDVGGKSEGVIPLNELSHRNVTDPHEVVAVGDTINVMVLRPENEEGHPVLSKRRADRRVAWEKLEEHLASGEEIQGEVIEVVKGGLLVDVGVRGFLPASLVERGYVEDLNAYLGQTLRLRVIELDRSKNKVVLSRKAILEEEYEKQRQATWNSLEVGQVRKGIVRRLTNFGAFVDLGGVDGLLHVSEISWGRVEHPRDALSEGQEIEVKILGIDREEGKVSLGRKQLLPNPWDTAAERYPVGTIVEGKILRLAPFGAFVEVEPGIEGLVHISQLADRHVDKPEDVVSIGDIIPVKVLGVDQQAQRMSLSLRQAIREKNRKQAKPAEKPAENQNESGVKLGDLFGDLFEANQSTNQ

SEQ ID NO: 4579 - protein, 687 aa, Syntrophomonas wolfei Goettingen
MYVLLARNAGFCAGVRKAVKIAEEAAEEPDKWFSLGPLVHNDEVVNYFRQKGIEPVDMLERIGEQPAGIIIRSHGTSPEVIKQAQELGLEVRDATCVLVKKIHEIVTRLRGEDYDIVVFGDARHPEVEGILGWCGQRASVVASADEVGYLPVMPKVALISQTTRDEKEFQKVAGALSNKCRELKVFNTICSATRSRQEAARELCRKVDLMLVIGDLKSSNTRTLSKECQNTGVRTFQIQKASEIKPEWLDGVSKIGITAGASTPDWIIKEVLDRMTLYEEEKMLDENQETNQETSQETQETQEIQEPEVKEEVSANEESFAKLEAEMADFTTPNKGDVIKGKVIQVLDDEVMVDVGGKSEGIIPLREMSLQDIDSAKELVEVGDEIEVMVLKWDDDGTILLSKKKVDAKILLDELEESFKEGKVITGTVTGSVKGGLLVDVGIVAFLPASHVEDGYVKNLDEYINRELSFKIIEFNRNKRRGSQVVLSRKELVAEEKAKQKKQFWEEIEEGQVRKGRIKRLVDYGAFIDLGGYEGLLHVSEIAHTRIDQPSDVLQEGEEIDVYILALDREKERVSLSRKKLLKSPWEIVMEKFQEGDIIEGTVVRIAPFGAFVEIEAGVDGLVHISQLANHRVEKPEDVVQVNEKIKIKILSIDPEEKRIGLSLKEALNEMENQEVQDYMEKQEENE

SEQ ID NO: 4580 - protein, 694 aa, Clostridium thermocellum ATCC 27405
MEIIVAKSAGFCFGVSNAVKTVNNLLENQKEPIYTYGPIIHNAQVVDLFTSKGVKKIDDIDEAEPNGHIVIRAHGVTPDIYKKISDKGLILEDATCPYVKKIHNLVKEKSEEGYKIIIVGDRNHPEVIGINGWCNNQAYIVDSVDDVEKFPTSDEKVCVVAQTTITNEKWLEVNTALKKKFKNILKFDTICSATSRRQNEAEEIAKNVDMMIIIGGKNSSNTQKLYDICKKHCNLTYKIETSGDLPPVDIKKIKKVGISAGASTPDWVIEEVIKKMSELNKQGMVDILENDGEIDFANAFENSFVRIHAGDTVKGKIIGFNSNEVFVDLGYKADGIIPLEEYTDDPNFNIEKEVKIGEEVEVLVEMVNDGEGNVRLSKRKVDAIKSWDDIVKAYENKTPVNAYVVEVVKGGVIASYKGVRIFVPASQVSDRYVKDLNEFLKRSITVRILELNEKRRKVVGSARVIIEEEKEALANRTWNSMEVGKVFKGTVKSLTDFGAFVDIGGVDGLIHISELSWTRVKHPSEVLKVGDEVEVTVLEFDKEKKKVSLGYRKMEDNPWYKIEEKYKVGDVVKVTVLRFAPFGAFVELEKGVDGLVHISQISSKRLAKVEDALEIGMKVDAKIIEVDGENKKISLSIKEVMPIDPPSSKSESKAKDGSEAKETSANTEEEAEPTEHREDMNVTVEDLVSKTTQS

SEQ ID NO: 4581 - protein, 672 aa, Desulfotomaculum reducens MI-1
MRIKLASKAGFCYGVKRAIDLALSTAKEKAGNIYTLGPLIHNPQVVQNLAENGICEINDIGEVKEGTVIIRSHGVGPEIIQAAREKGLKVLDATCPFVARAQKYAHEMAAQGIPVYILGDPGHPEVQGILGWTEGKGSVIDNPSEITRVEHPKVGVVAQTTQPLSNFQALLEALQNQGVEVDARNTICHATGERQRAAMELAREVDVMVVVGGKNSANTKKLAKICQETGTPTYHVESARELRKEWFLGHEIVGLTAGASTPDAIIEEVKKRMNEMDQMTNGEEGMSEAMEVKSPQAGELVKGIVVQVGMDEVLVDIRAKSEGVIPRKEMAFYGVDNLQEIVKVGDEIECVVIKAEDNEGKIILSKERADAEKAWDGLEEAMEQGTIIKGVVREVVKGGMLVDVGVRAFLPASLVERGYVEDLSKYLNQEFEVRVIEMNKQRKKVVVSRKAVLEEQNARKREELLASLQEGQIVKGIVRRITNFGAFVDLGGLDGLLHISEMSWHRINHPQEVVKVGDELEVMVLKVDTQNEKISLGLKQVLPNPWDNVEEKYPVGNIFNAKVVRLAPFGAFVQLEPGVEGLVHISHLADRHVEKPEDVVKEGEEVQVKVLSMDPSEKRVRLSIREVNGERRSAREARPRKQEEVQEQNVMNETPEEKITLGDVFGDMFKEK

SEQ ID NO: 4582 - protein, 677 aa, Candidatus Desulforudis audaxviator MP104C
MEVRLATKAGFCFGVHRAIDLALKTVRETAPPIYSLGPLIHNPQVVAYLAEQGIEVVEEIERVPRGTLIIRSHGVEPKLLEKTRELGFTVVDATCPFVKRAQRLACDLNDSGHQVIVVGDRKHPEVRGIVGWTNGQAVVVEDRVEASALPFYPRVGVVAQTTQPHANLEAVVEELKSRMGEVLVCDTICNAVVERQNAALTLARQVDVMVVVGGIDSANTRKLTGLCRLSGTPTYHIETGDQLQSEWFRGCTVAGLTAGASTPDWIIEEVKRRMEELSEKEEVVGPEEEVNPEQEVANPEEEVVSPEEELQTTPVRSLRSGDIVRGVIVQVGQDEVLVDVGAKSEGVVPLRELSCYDVSSPDEVVQVGDEIDVWVVKAEDNEGRIILSKGRADAVKAWDTLDKAFHGGETVRGVVREVVKGGLLVDLGVRSFLPASQVERGYVEDLSQYVGREISARIIELNKARKKVILSRKVLLEEEYSRKRKETLETTQEGDVVKGVVRRLTQFGAFVDIGGLDGLLHISEISWHRINHPSEVLKVGDELEVQVLRIDRENEKVSLSLKQVLPNPWEQVVENYPVGSVVSARVVRLVPFGAFVELEPGVEGLVHISHLADWHVAKPEDVIAEGQQINVKVLSVDDENKRIRLSLREVVKDKDYHNDQGSEVTIGDVFGDLLHKN

SEQ ID NO: 4583 - protein, 705 aa, Natranaerobius thermophilus JW NM WN LF
MEILVAKGAGFCSGVNRALDKTIQAVQTDTSRDIQVFTLGPIVHNKEVIQNLTEKGIGIIENLTQLQSKKCLSEETNNYVVIRSHGVGPETFKMLNNLSNTDVIDATCPFVRKVQQKASKLYQDGYQIFIVGDPNHPEVKGIKEWTDNNAIVIEKPEQVNDIEISNKTAVVAQTTLREEKFNEIVEKILDRNPNTIVHNTICDATQKRQTATKELAGQVDVMIVVGGYNSSNTKKLKELAVKEGVPTYHIETAKELKTDWFLGCKKIGVTAGASTPDWTIKEVVGKMREFEEQNENLNTNSDESTQESQDELMKATEDSADKLDRGQVVKGKVVKVTEDEAMIDVGYKFEGSVPVNEMPIKEGESLEDLLSEGDEIDVKVVKVDDEEGQLILSKKWADKDKQWEQLEQLMENDEEIKAQVTEEVKGGLVVDLGQLQGFIPASHVDIHYVPDLSKYVGEELRLKPIELDRSRNKIVLSQKNILEQEQEEKKNKTMETITEGDIVDGTVKRLTDFGAFIDIGGIDGLCHISQISHSRIDHPESELETGENVKVKVLSLDPENERISLSIKEAQPDPFETFMKQYKSGDIVQGKVVRTVNFGAFIEITPGVEGLCHISQLSDDHVAKTQDVVNEGDQVTVKILSIDDQQKKVSLSIKEAQGKSKKEQEQEEFAKYQDSQEEEEGVKLGDMFGDVLEEIKEDDKDDKSK

SEQ ID NO: 4584 - protein, 399 aa, Elusimicrobium minutum Pei191
MTNAEENKIDSKQEAIQVEAAPEQEMTMDQLFAEQEELVNKLNKREIVQVTVVQVGKDSVLVDTGDKKEGYIPLSDFEGKAVPEAGEKVSAVLVKKGSDERHAVLSFKKAQEYLGWEIAKKAFDNKERVRGTIVSCVKGGYIVDVFGVSGFMPLSLSELHTAYKHYLPAGAKVKCVVVEFSKEKNKLIVSRKQVLEEDEAVRRDGVLAQVKEGEVLRVVVAKADKDKLYLRFHGIEGVVTLDNVAWQDTEKAITSFRRGQRLKAKLLKIDKETGKLEFGLKQLFLNPADALRRKFPYKSTTKGKIVAITEEGVEVSLGKNNTKGFISQFEMGRDFDGNVDDVINVMVIGINPDDCSVNLSVKKYDQVQNKKFVAQYMKQAPRPTLGQLLQDSLEESENK

SEQ ID NO: 4585 - protein, 661 aa, Desulfitobacterium hafniense DCB 2
MKIIRAEKAGFCFGVKRALDMAERTVQSSSTASLGPLIHNQQVVEKMEKQGVRVVGEVKETQAGDTLIIRSHGVPPDIYEEARRCQVKVVDATCPFVQKAQRLAAESSQSGQVVVVGDRQHPEVQGILGWAGGNAIAIETLEEARELPFYEQLSVLAQTTQPAANFHGIVDELKTHTHALKVHNTICNATEERQTVARELAGKVDVMIVVGGKNSANTRKLAGICSERTQTYLIETADELEDNWFTGVVTVGLTAGASTPDWIIEEVYRKMSTMENKETHEMMNMEDWAEGMQNLHRGALVTGTVVKINHDEVFVDLGWKSEGVIALKELTVASDLQTSDIVAIGDQISAVVLRVENEEGNPVLSKRRADEMAAVDKLKELAESKEEIQGKVADVVKGGLIVDVGMRGFVPASQIQPGYVEDLNQFKGQTLRLRVIEFDPAKRRVVLSQKEILQEEQAAKKEHLLATLQEGDVVSGVVKRLAQFGAFVDIGGVDGLLHVSDIAYTRIKHPSEYVNVGDEVEVQILKVDKEQGKISLGLKQLKPSPWESAPEKYALGSLVTGKVVRIAPFGAFVQLEDGIDALIHISQLSEKRVNKVEDVVKVGDMVQAKVIECKPEEKRISLSIREAAAEAQATEDAELLASQPEAPQVTIGDVVQSESES

SEQ ID NO: 4586 - protein, 387 aa, Geobacillus WCH70
MAEDMNLEVNVYKVGDIVRGKVVKLEDKQVLVDIEGSKQSGIIPISELSSLHIEKTSDAVSVGDEVTAKVKKVEEGENEEDGLLILSKKAVDADRAWEELERKFASGETFDVVVKDIVKGGLVADVGVRGFIPASLVEPHYVEDFSDYKGKTLAVKVVELNREKNRIILSHRAVVEEEQERKHKEALSRLEPGQVLEGTVRRVTDFGVFVDVGGFDGLVHISQLSHTRVAHPSEVVKEGETVKVKVLAVDEENGRVSLSIKEAMPGPWEGIAEKVAPGDIVTGKVKRLVPFGAFVEIFPGVEGLVHISQISNKRIGTPHEVLKEGEEVKAKVLDVNEAERRISLSMRELIEEETAPEEDYSQYTKPSNEVRGFQIGEVLGEQLKKLK

SEQ ID NO: 4587 - protein, 686 aa, Anaerococcus prevotii DSM 20548
MEIIIANYSGFCGGVRRSVELAEEAIKNEGERYCVGPLIHNPQLVEKLENEGLEVVDKKEALKIKDSTVLIRAHGESADFKERLLANGNEVVDATCPVLNNIYKKIIEKENDGYQVVIVGDKTHPEIIAMESFLNNGIIVSDETEAKNIKCNNKLYVVSQTTNRLDYFYDIANKLKENNDSVVIENTICKATENRQEAAKSLAKEVDCMIVAGGFNSSNTNKLYQVANLYCKNVFRIETVKDLPLQKLSKFKKVGIIAGASTPDEIIEEVVSSMDEFTKEEFMNSLEDSLKKIYPKEIVKGTVIDVKDDEVFVDIQFRADGIIKLDEMTEEEAKDPKNSFNVGDEIDVFVIKLDDGEGNVSLSTRRVEGMKVWKDLAEKAENDELVHGVVSGFNKGGLTVNVEGINGFVPASQIATYFVKNFKKFVGEEWDLKIISIDERKNRLVLSRKEVVEDELDGLWEELEEGQVVTGKVARLTDFGAFVEVNGLDGLLHVSDIAWSRVEHPSDVLNVGDEIEVKILKLNQEKNRISLGRKQLLEKPFEAFVNQHEVGDVVTGKVVNLLDFGAFVEVADGVEGLVHVSEISWEHVEKPSDELNVGDEIEVKIISIDTDEEKVGLSIKALKEAPERPERRAKRAPRNNDRPRRRPERDNSASFGDDDLNNNLGNLLEQALSEQGSEGLLEGEDE

SEQ ID NO: 4588 - protein, 676 aa, Desulfotomaculum acetoxidans DSM 771
MKIIVADKAGFCFGVKRAIDMANDVVRKRDGPIYSLGPLIHNPQVVDKLAQEGIIAIDDLKEIHAGTVIIRSHGVGPEILSEVYERGLNLINATCPFVSRAQQIARDLYTEGRQVIVVGDKDHPEVQGIVGWANGQALVVQNSLEAEALGAISNAGVLAQTTQPLVNFQQVVDVLKQKTEQLKECNTICHATGERQQAALELARNVDVMVVVGGANSANTGKLANLCRSTGTPAYQIETAGELRVGWFACVEKVGLTAGASTPDWIIEEVKKRMNELGEMNGIEESKEQLEEINSAEEGMQDSVEVKALHNGDIVKGVVVQIGQDEVLVDVGSKSEGFISAKELSSFNINSPDEVVKIGDEIDVFVISAEDNEGRIKLSKTRADAENAWAKLESLLESSEKIEGTVREVVKGGLLVDVGVRAFLPASLVDKGYVEDLSKYVGENITAQVIEINRIRRKVVLSRKAILEEEYANRKEELLNSLQEGQTVSGIVRRITNFGAFVDIGGVDGLLHISEMAWYRVTHPSEIVQVGDEVTVMVLKIDRNADKISLGLKQVLANPWENVDSKYPVGAIVAAKVVRLAPFGAFVQLEPGVEGLVHISHLADHHVEKPEDVVSEGEEVNVKVLSVDTQEKRIRLSIKEVTKKVKEEKPVQNYESNSQGSGEITIGEILGASLKK

SEQ ID NO: 4589 - protein, 385 aa, Alicyclobacillus acidocaldarius DSM 446
MSEDLREMLTDAAVREGDVVTGEVTAVDDHGVTVALPHGYEGHISPQELSAVPGTHPSDVVSVGSTVTAQVLKVDMESGHVTLSKRRAEQASAWERMQQLLESGEPIEVEIRDVVKGGLVADVGVRAFIPASLVDRHFVENLEQFKGQKLRAKVIEVDPQKNKLILSRRAVLEEESEARARKLFEELKPGDVIEGTVQRLTDFGAFVDVGGADGLVHISELSFSHVNHPSEVVREGDRVKVRVLRVDPEAGRISLSIKAALPEPWETYAHEFQPGDVVQGVVRRVVDFGAFVELRPGLEGLVHVSQISNEHVDKPSDVLQPGQEVTVRVLSVDPERKRISLSMRDSSQPRGGQGRGGRRDRRPTEPRNEGASGPTLGDLFGDLFK

SEQ ID NO: 4590 - protein, 383 aa, Desulfovibrio desulfuricans G20
MTEPAKREDSGLPEAVTAIRPEVAAFKPYAPGLSIDEIKERYGLSQVVKMASNENPLGTSPLVQQTLRTHADLAFRYVQSGNPRLVSAIARSFGVAAESVVTGNGSDEVIDLIIRVKARPGKHNIVAFNPCFSMYELQTRFCGVEFRQVPLRADFSFDYDAFVGAADADTAVAFITTPDNPSGYCPPVEEIIDLARRLPSSCLLVVDEAYMDFADDPAAHSVLPHLTEFPNVAVLRTFSKSYGLAGLRLGFGVMHPALADYVKRVRLPFSINILAEYAGIAALQDTTFHAQTLRVTREGRTYLTGALTEAGCTVYPSAANFIMFALPENCPHDARAVFEALLRRGIIIRPLSSYNLPQCLRVSIGNRHENELFIAQFKELLRG

SEQ ID NO: 4591 - protein, 388 aa, Syntrophobacter fumaroxidans MPOB
MKERGPWPPDGPATRQPNKMKPSVPEHIASLVPYPPGKPIEELEREYGITDSIKLASNENPLGPSPKAMQAVTGALSRLHRYPDGSGYYLRKRLSGKYALPFDGIVLGNGSNEIIELAIRAFLVPDDEVIMPAPSFLVYKLAVQTMGGKAIHIPLKRFAIDLEKTAGAVTPRTKMIFVNNPNNPTGTLISKRDFDVFLDRIPPEIVVVLDEAYIEFARDPDTPNGFDYIDRQGPFVIVLRTFSKAYGLAGLRIGFGAMNPFLADYLHRVRQPFNTGTLAQIAALAALDDEDFLHRTQRVVWDGLQYLYREVERLRLNYLPTEANFFLIEVPGPAKWFYEAMLRQGVIVRAMSSYGMDNHIRINAGLPEENERFIRTLSDTLVQFRASL

SEQ ID NO: 4592 - protein, 373 aa, Desulfovibrio vulgaris DP4
MTAPSMSRPDDVRPEVLDFKPYVPGLSIDEIRDRFGLADVVKLASNENPLGTSPVVQRTLKTKADLAFRYAQSGNPRLTRAIAAHHGVAPERVVAGNGSDEIIDLLIRVRATPGKHNIVAFRPCFSIYELQAKFCGLEFRQADLRPDFTFDWDAFLAATDENTAIAFVTTPDNPSGWCPPVSELEHVARTLPPSCLFVIDEAYMDFCGDEAAHSLLSRLDAFPNIAVLRTFSKSFGLAGLRLGYGILPERLADYLHRVRLPFSVNILAEEAGLAALEDTVFRSETLRVTAEGRAYIAEGLTALGCEVLPSWANFIMFRPPTDATDLFEALLRRGIIIRPLKSYGLPQHLRVSMGNADENRRFIAACKEILPHA

SEQ ID NO: 4593 - protein, 364 aa, Anaeromyxobacter sp. Fw109-5
MPLVPPHVASLTPYVPGKPIEEVEREYGVSNVAKLASNENALGPSPLALAAAREACAKVHLYPDGSAYLLRNAIAAKLGVPPEEVMVGNGSNELIELLVRTFVLDGEEVLTSAQSFVAYKLAAHEHGRTLVEAPMKGRFHYDLDALRKLLSRRTKLVFLANPDNPTGTWFTEAELTPFLDAVPKDTLVVLDEAYVEYVDAPGFQDGLALRRKYPNVVVLRTFSKIYGLAGMRLGYGLARPEVVEYVDRVRPPFNTNLVAQAAGAAALGDSAHVAKSRALVLEERPFLAKGLAALGAIVVPSQGNFVLADFPGRTGKDLFEALLREGVIARPVAGYGFPSALRITVGLRRENERCLAALGRILGA

SEQ ID NO: 4594 - protein, 362 aa, Candidatus Desulfococcus oleovorans Hxd3
MKISPPDYILSIKPYVPGKPIEELEREYGISGSIKLASNENPLGPSPLALAAIEKALSGLHRYPDGSGYYLVSKLAQKLGVAPESIVLGNGSDDIIGMLTRALLLPGDEVIMTDPSFAMYDITTCMVNARSVYVPLIDRALPLDTVAGAVTSKTKMVFLTNPNNPTGTVFSGKAFERFLEAVPSDVVIVVDEAYIEFVQDPECARAFDFLDNSRPLVALRTFSKAYGLAGIRVGYGVMPPYLAAILNRIRQPFNVNSLAQVAAIAALDDEAFLKQTLAVVHDGLAWLYAELEKMGLRCFPSQANFFLVDVKKDAAAVFEEMLKQGVIIRSMVSYGYPSYIRVTVGLPEENARFVAALKAVLK

SEQ ID NO: 4595 - protein, 387 aa, Desulfovibrio vulgaris  Miyazaki F
MCADKTASAGAPTGLPLASPSAVRPEVCGFKPYTPGLSIDEIRDRYGLAHVIKLASNENPLGTSPVVQHALRHKADLAFRYAQSGNPRLTAAIAAHHGVPAERVVAGNGSDEIIDLIVRVRAVPGVHNVVAFNPCFSIYELQTRLAGVEFRQAPLAADFSFDWDGLMALVDDATAVVFVTTPDNPSGFCPPVADLERLAHALPAGCLLVVDEAYMDFCGDESAHSLLARVDEFPNLAVLRTFSKSFGLAGLRLGYGILPVQLADYLRRVRLPFSVNILAEEAGLAALADDVFRTETLRVISEGRAALTEGLTALGCHVYPSKANFVMFRPAPTCKSAAHLFEELLRRGIIIRPLKSYGLPDLLRVSVGSPDENAAFLKAAGEIMAHA

SEQ ID NO: 4596 - protein, 386 aa, Desulfovibrio desulfuricans ATCC 27774
MFQISVRQEILALKAYVPGLSIAEIQQKYGLAQVIKMASNENPLGMPPLAIQAVQRHADMGFRYPQGGNPRLVEALARRHCLEPARVVVGNGSDEIIDLLIRIMAEPGIHNLVCFDPCFSIYPIQGRIGGVEVRRQPLNDDFSFDFDALLSHVDDNTRLVFVTTPDNPSGYCPPREAVAQLARRLAETAPRCLLVVDEAYMDFAENEQESSLLASGILPENTAFLRTFSKSFGLAGLRVGYGILPPGLADFWWRARLPFSVNILAEEAALAALADTAFLDATMHTVRRGRNVLTVGLTALGCMVWPSAANFVLFRLPENTLGAQDCFEALLRRGIIIRPLKSYNLPEHLRVSVGNKDENRAFLAAMDAILLEKHRAANGLENKELK

SEQ ID NO: 4597 - protein, 371 aa, Desulfomicrobium baculatum DSM 4028
MTKVLVRPEMAGFKPYSPGLSIDEIKKRYGLPRVIKMASNENPLGTSPVVQERLKNMSPMAFRYAQAGSPALTERLAAHLGVPASCVVAGNGSDEIIDLLLRVVARPGVDNVVAFSPCFSIYDVQSRLCGVEFRQAKLNADFSFPFDQLVSLTDENTALVFVTNPDNPSGHACPAADLVALASRLPARTLLVVDEAYIDFAEPLDVFSMLPHLDAIPNLVVLRTFSKMHGLAGLRLGYGVMPEWLADLLLRVKLPFSVNILAEQAGLAALEDDIFVSQTLRVVSEGRRLLERELSALGCKVWPSQANFLMFEPPMDARVLFEALLALGVIIRPLGSYGMPEKLRVSIGNEEENLEFLTKTAEVLRGHDRHS

SEQ ID NO: 4598 - protein, 366 aa, Desulfohalobium retbaense DSM 5692
MAKFSRVRPEIAGLKPYTPGLSIEEIKDRYALTTVCKMASNENPLGTSPLVQEALCRFAPYAFRYPRGGCPDLSAALAKVLGVPGECVVVGNGSDELIDLLIRTTLRPEKDNMVVFDPSFSIYRMQATLCGVECRQVPLEQDLTFDFDRLLEQVDSRTGLVFVTNPDNPSGHAVPAAQLMELARSLPQQCLLVVDEAYIEFAENGISPLADWDAHGNIVLLRTFSKLYGLAGLRLGYGIMPDWLAEAVLRIKLPFSVNLLAEKAGVAALEDTAFYTRTREVVGEGRRILSAGLRELGCEVSPSQANFLLFRPPMPAREVFERLLAKGIIIRPLTSYGLEDALRVSVGTAHENSRFLEAMQEIVHAR

SEQ ID NO: 4599 - protein, 340 aa, Ralstonia solanacearum
MRASAPSNLARRRCLTGVPLLAVGLFVRPALADPAVQHASRRLLGTQVDIVAQGAMPGAAAPAIDAAFAEMARLERLMSRYRPDSQVSALARAAGRNPVPVAPELMAILKLAARLSARSGGAFDITVGAFSGWNFDPAQARIPSRAELVHEQRLVNYRDVVLDQARGRVYLRRPGMKLDLGGVAKLPILQAGLRVLRRHGVRDAMINGGGDVLVSGQLQGHDWRVGLRNPLAPDRLLGVVALSDGIVASSGDYERGFVRNGQRYHHILDPKTGLPTHGPHGVTLVARSVDDVNGLGAAIMVAGAEAGRRLLVPPAGVDALIMGPGPRPWMSPGMALRLQT

SEQ ID NO: 4600 - protein, 344 aa, Rhodoferax ferrireducens T118
MASPASDRIQHGRRQLALALPLLACGLVVPSVHAKADVQQSSQILMGTRVDLTLQGNDSAALAAAATAAFTEMNRLADMMSRYRVTSALNAINLMAGLQPVPVPPELLRVLLMARQAGQASGGAFDATVGSLRDWDFSPEHPSIPSKQQIAAQLRLVDQKAGLVISEHAGTAYLTQRGMLLDLGGIAKLPILQAGLGQLQSRGVTNAMINGGGDVLVMGRLNGRPWRVGLRDPRQPSQLLGVVSLTQGFVAASGDYERFMMHDGKRLHHILDPKTGYPSTGPHGVTLISEQLELINGLGAALMVAGADAGRTRVGRTPGIDALIVDADSSLWLSPGMAQRFKRS

SEQ ID NO: 4601 - protein, 340 aa, Cupriavidus metallidurans CH34 uid250
MHALSPSGLARRRYLTAAPLLALGMFVLPALADSSVRHASRRLLGTRVDIVTDGVPADAAAQAIDAAFAEMGRLERIMSRYRPDSQVSALARAAGKHPVPIAPELMSALRLASEVSARSQGAFDITVGAFEGWNFDPGHEQVPGQAELTQERPLVNYRDVVLDSTRGSAYLRRPGMKLDLGGIAKLPILQAGMDVLRQQGISNAMLNGGGDVLVSGRLQGRDWRIGLRDPLAPERLLGVVAITDGVVASSGDYERCFARDGQRYHHILDPRTGLPTRGPHGVTLVARKTSDVNGLGAAIMVAGTAAGRSLLGPMANVDALIVGPGSHPWMSEGMATRMRS

SEQ ID NO: 4602 - protein, 362 aa, Acidovorax sp. JS42
MNSDRCMPAVGNRWTRRRFALALPLLGALAYLDPRQALAGMVEGAQPLVRASRTLMGTRVDIAAAVGNGRDADAVQQVMLHAFAEMERLEALMSRYREGGDVARLGAAAGRHAVHVAPEVMQVLRTARRLHQESAGAFDPTIGALRGWHFEPGHEAAPAPEEIAQALRLVNARHLVLDERAGTAYLARTGMGLDLGGVAKLPILQAGLQVLERAGVTDALVNGGGDVLVMGRQHDRPWRVGVRNPSAPAQLLGVLELQGRGVVASSGDYERGFLRAGRRLHHVLNPRTGWPTEGVSGVALMAERIEDVNGWGTALMVQGPAAAPAWHAGHAHVEALVASADGTRWSSPGMLAALRPVPARAA

SEQ ID NO: 4603 - protein, 346 aa, Ralstonia pickettii 12J
MHPLPPSNLGRRRCLAGVPLLAVGMFVRPALADPTVERASTQLLGTQIDIIAQDARPGAAGAAMRAAFVEMARLECLMSRYRPDSQVSALARAAGRNPVPVAPEVMSVFKLARQVSEQSRGAFDITVGAYSGWNFDPEHSRIPSSSELARERRFVNYRDVVLDERHGSVYLRRPGMRLDLGGIAKLPILEAGMRVLRQHGIRDAMINGGGDVVASGKLQGHEWRVGLRDPLAPERLLGVVTLSDGVVASSGDYERYFMHNGQRFHHVLDPETGLPAHGPHGVTLVSRDVDDVNGLGAAIMAAGTATGQRMLAPMLARVDALIVGSGVRPWMSAGMATRLRQFSASS

SEQ ID NO: 4604 - protein, 362 aa, Diaphorobacter TPSY uid29975
MNSDRCMPAVGNRWTRRRFALALPLLGALAYLHPRQALAGMVEGAQPLVRASRTLMGTRVDIAAAVGNGRDAGAVQQAMLHAFAEMERLEALMSRYREGSDVARLGAAAGRHAVHVAPEVMQVLRTARRLHQESAGAFDPTVGALRGWHFEPGHEAAPAPEEIAQALRLVNARHLVLDERAGTAYLARPGMGLDLGGVAKLPILQAGLQVLERAGVTDALANGGGDVLVMGRQHDRPWRVGVRNPSAPAQLLGVLELQGRGVVASSGDYERGFLRAGRRLHHVLNPRTGWPTEGVSGVALMAERVEDVNGWGTALMVQGAAAAPAWHADHAHVEALVASADGTPWSSPGMLAALRPVPARAG

SEQ ID NO: 4605 - protein, 346 aa, Ralstonia pickettii 12D; identical to SEQ ID NO: 4603

SEQ ID NO: 4606 - protein, 71 aa, Nitrobacter hamburgensis X14
MRRSDSVEARKKDTREKIELGGLIAKAGLRYEKRALLLGLLIDAADRLRGNEAEHERLTAIGAKAFGHEGT

SEQ ID NO: 4607 - protein, 71 aa, Sinorhizobium medicae WSM419
MARAMTSDARKKDTREKIELGGLIVKAGLRYEKRALLLGALVELSRRLKSDEGERARLIAIGAEAFGNDSE

SEQ ID NO: 4608 - protein, 65 aa, Methylobacterium radiotolerans JCM 2831
MNARRDERRTDAHLKIQLGGLIVKAGLAAMPRDQLLGLLLDGKERARDPDTAEHFVRLGEKAFRE

SEQ ID NO: 4609 - protein, 65 aa, Methylobacterium chloromethanicum CM4
MTKRHEERRADAYRKIKLGGLVIKAGLADLPSNVLLGLLMDGAERLRDPDAVEQFARRGDKEFKT

SEQ ID NO: 4610 - protein, 71 aa, Agrobacterium vitis S4
MARTITNDARKKDTREKIELGGLIVKAGLRYEKRALLLGLLIDAGRRLKGNDGEQSRLTAIGAEAFAHDGE

SEQ ID NO: 4611 - protein, 81 aa, Agrobacterium vitis S4
MKAGLARLDRMAKSKTSDARKKDTREKIELGGLIVKAGLRYEKRALLLGLLIDGGRRLKGDEDERSRLTAIGVEAFGHDGE

SEQ ID NO: 4612 - protein, 71 aa, Rhizobium leguminosarum bv  trifolii WSM1325
MARTKTFDARRKDTREKIELGGLIVKAGLRYEKRALLLGALIETARRIRSDEDERSRLTAIGSEAFGNDGE

SEQ ID NO: 4613 - protein, 259 aa, Polaromonas JS666
MAAIQITQAGPLLTLTLSRPEVRNAFNDEVIAELTAAFAQAGRREDVRAVVLAAEGPAFCAGADLNWMRRMADYTREENLADAAQLAEMLRAIYECPKPTVARIQGDVYAGGMGLVAACDIAVSGDTAQYCLSEVKLGLIPATISPYVIRAMGARAAHRYFLTAERFDAQEAHRIGFIHEVVSAVALDAKVAEIAQALVNASPQAVKACKRLVQDVAQHDITPALIAQTVQGIADIRSSEQGKEGVQSFLQKRKPSWII

SEQ ID NO: 4614 - protein, 267 aa, Acidovorax avenae citrulli AAC00-1
MTTTEYRHLHVGQAGSIARVTLARPEVRNAFSDEVIAELTRAFEALGRQEDVRAIVLAAEGPAFCAGADLNWMRRMADYSRAENVADAGRLATMLRTLNDCPKPTIARIQGDVYAGGVGLVAACDVAVAVDTAAFCLSEVRLGLIPATIGPYVVRAMGERAARRYVVTGERFSALEALRVGLVHEVVDFEQLDEKLDAVLQSIAAAGPQAVAAGKRLVRDIAGRPIDDALIASTVESIADIRASGEGREGVQAFLQKRKPAWLPARD

SEQ ID NO: 4615 - protein, 260 aa, Acidovorax sp. JS42
MSQNLSITQSGAVARITLTQPEIRNAFSDEVIAEITAAFTEVGGRADVRAVVLAAEGPAFCAGANLNWMRRMADYTRQENLADAAKLAEMLRVIYECPKPTVARVQGDVYAGGMGLVAACDMAVAVDTAGFCLSEVKIGLIPATISPYVIRAMGARAAHRYFLTAERFSAAEALRIGFVHQVVGAEQLDAQVDELLKALTAASPNAVRACKTLVRDVAGREIDAALIAATVEGIADIRASSEGREGVQSFLQKRKPSWLG

SEQ ID NO: 4616 - protein, 260 aa, Polaromonas naphthalenivorans CJ2
MSASLEISYDGAVARITLNRPDVRNAFNDEVIAELTAAFQEMAARAEVRAVVLAAIGPAFCAGADLNWMRRMADYTRDENLLDAAALAEMLRVMYECPKPTIARIQGDVYAGGMGLVAACDMAVSVDTANYCLSEVKLGLIPATISPYVIRAMGARAAHRYFLTAERFDAKEAHRIGFVHEVVGADALDAKVAELTNALSSASPNAVRSCKTLVQEVAGQGIEAPLIGRTVEGIADIRTSSEGREGVQAFLQKRKPSWLA

SEQ ID NO: 4617 - protein, 263 aa, Methylibium petroleiphilum PM1
MSADTTVRLSRPSAAVARVTLCRPDVRNAFNDEIITALTQAFRALDADDTVRVVVLAAEGPAFCAGADLHWMRRMADYTRAQNLDDAAGLAQMLRSIAGCRKPTIARVQGDAYAGGVGLVAACDLAVAVDTAQFCLSEVKLGLVPATIGPYVVRAMGPRAAQRYMLTAERFDATTAQRTGLLHEVAPAEALDAAVQALVDALLAASPQALATGKRLLHEITGAPLDAALIARTVEFIADARASDDGREGVQAFLGKRRPRWQA

SEQ ID NO: 4618 - protein, 261 aa, Delftia acidovorans SPH-1
MKTTALTLEFQGPLATITLTQPEVRNAFSDEVIADITQAFHSVGKRSDVRAVVLAAEGPAFCAGANLNWMRRMADYSRDENREDAGLLAEMLRVIYECPQPTIARVQGDVYAGGMGLVAACDMAVAAEGAGFCLSEVKIGLIPATISPYVIRAMGARAAHRYFLTGERFDAAEALRIGFVHRVVAADELDNAVDGLLKHLVSAGPAAARACKRLVIDVAEREINEQLIAATVEGIADIRASAEGKEGVQAFLQKRKPAWLA

SEQ ID NO: 4619 - protein, 260 aa, Diaphorobacter TPSY uid29975
MSQNLSITQLGAVARITLTQPEIRNAFSDEVIAEITEAFTEVGGRADVRAVVLAAEGPAFCAGANLNWMRRMADYTRQENLADAAKLAEMLRVIYECPKPTVARVQGDVYAGGMGLVAACDMAVAVDTAGFCLSEVKIGLIPATISPYVIRAMGARAAHRYFLTAERFSAAEALRIGFVHQVVGAEQLDAQVDELLKALTAASPNAVRACKTLVRDVAGREIDAALIAATVEGIADIRASSEGREGVQSFLQKRKPSWLG

SEQ ID NO: 4620 - protein, 262 aa, Variovorax paradoxus S110
MTFTKLKLEIQDTAARIWLDQPDARNAFDDVVIAELTQAFTDAGAAPKVKAIVLGANGPAFCAGANLNWMRRMADYTRSENIADASKLATMLRTIAECPKPTIARVQGDVYAGGLGLVAACDMAVSVDTAWYCLSEVKIGLVPATISPYVLRAMGTRASQRYFLTAERFTAAEAHRIGFVHEVVAADALDAKVDELLKALTSASPAAVRACKQLIADVDGREIEDALIAKTVEGIADIRASDEGREGVQAFLQKRKPSWLGH

SEQ ID NO: 4621 - protein, 103 aa, Nitrobacter winogradskyi Nb-255
MASPTVAANAYASLARMMDSGAVAGKAPGGDGPSFGAVLKDVLGGVVEAGRASDAQTVAMASGKANLMDVVTAVADTDVAVSTLVSVRDRVIQSYEDIMRMPI

SEQ ID NO: 4622 - protein, 101 aa, Rhodopseudomonas palustris HaA2
MASPISAANAYASLARLANPGGAGKPTDNGPSFGALVKDAMGSVLDAGRKSDAQTVAMANGKSNVMDVVTAVAETDVAVSTLVSVRDRVIQSYEEILRMQI

SEQ ID NO: 4623 - protein, 95 aa, Jannaschia CCS1
MDITQTLAARAYGDPRAAVPPTTAAQDPSLFAQAVGSFADTVANGEAQARAAMTTGADPHALVTALAQTELAVETVVTIRDRVVEAYQEILRMPV

SEQ ID NO: 4624 - protein, 101 aa, Rhodopseudomonas palustris BisB5
MASPISAANAYASLARLANPAGAGKQTDNGPSFGAMVKEAMGSVLDAGRKSDAQTVAMANGKSNIMDVVTAVAETDVAVSTLVSVRDRVIQSYEDILRMPI

SEQ ID NO: 4625 - protein, 103 aa, Nitrobacter hamburgensis X14
MASPTVAANAYASLAKMMDSGTAAGKASEGGGPSFSSVLKDALGSVMEAGRKSDAQTVAMASGKANVMDVVTAVADTDVAVSTLVSVRDRVIQSYEDIMRMPI

SEQ ID NO: 4626 - protein, 98 aa, Ruegeria sp. TM1040
MDIRSLTATSGYAAARPATKVDPDYNPTSLQEQAKTSFQDFTNTLAHSEQVSVQAMTGGADPHQLVQALAQTELAVETAVTVRNKVVEAYQEILRMPV

SEQ ID NO: 4627 - protein, 106 aa, Rhodospirillum rubrum ATCC 11170
MAVDFASAVSAYKSASRIGGAEMTGGLLPSGQPEGPSFASMVKGAIDDTITAGRQGEAQSRLAIEGKADLRDVVMAVNNAESTLQTVVAVRDKVVNAYETILRMPI

SEQ ID NO: 4628 - protein, 96 aa, Rhodobacter sphaeroides 2 4 1
MDIRTSTAAQSYAKARTAAAPDQPSVGLTAAFERAAESFTQTLAQGEETARAAMTGKADPHALVEALAASQMAVETAVTLRDKVVEAYQEILRMPV

SEQ ID NO: 4629 - protein, 92 aa, Paracoccus denitrificans PD1222
MISPTFAATAYDRARHAVAPAQGLPQGVTNAAADFARVMEQVDLDAAGAMTGQTDTHDLVHSIARAEIALETVVAIRDKVVEAYQEILRMPV

SEQ ID NO: 4630 - protein, 96 aa, Rhodobacter sphaeroides ATCC 17029
MDIRTSIAAQSYAKARTAAAPDQPSVGLTAAFERAAESFTQTLAQGEETARAAMTGKADPHALVEALAASQMAVETAVTLRDKVVEAYQEILRMPV

SEQ ID NO: 4631 - protein, 96 aa, Rhodobacter sphaeroides ATCC 17025
MDISTSVAAQTYARARLATAPEAPSIGVAAALNRAAESFTETLAHGEETARAAMTGKADPHALVEALAASQTAVETAVTLRDKVVEAYQEILRMPV

SEQ ID NO: 4632 - protein, 100 aa, Acidiphilium cryptum JF-5
MSGTISALVNPSNAISAYGRAAGTGAAGSPSFGDYMSNVITSAIHQSASTEQAASSGLMGKGDLTHVVASVAQAQVALQTTVAIRDRLIQAYQSIMSMPI

SEQ ID NO: 4633 - protein, 118 aa, Bradyrhizobium BTAi1
MASPISAANAYANSARVLDTGGSSNAFGSLARVRDVLGNGNGADKGGPSFSAVLKDAIGSVMETGRKSDSQAVAMAAGKANVMDVVTAVAETDVAVSTLVSVRDRVIQAYEDVMKMTI

SEQ ID NO: 4634 - protein, 107 aa, Parvibaculum lavamentivorans DS-1
MTTIPASTALNAYARAAGMGGGAQSPQTGGLKEAGGGFGDMLKQALDETVETSKSGEMKMAALTGTRDGNIVDVVTAVAEAETTLQTVVTVRDKVIAAYQEILRMPI

SEQ ID NO: 4635 - protein, 92 aa, Dinoroseobacter shibae DFL 12
MDIRSSTAAQLYTRSKELTAPKHEGPDIAGAARSFAETLQNGEAVTQAAMTGGADPHALVEALAQTELAVETAVTVRNKVVEAYQEILRMPV

SEQ ID NO: 4636 - protein, 101 aa, Rhodopseudomonas palustris TIE 1
MASPISAANAYASLARLAKPAGADKGGEDAPSFGNLVKQAMGSVLDAGRKSDAQSMAMASGKSNVMDVVTAVAETDVAVSTLVSVRDRVIQSYEEIMRMPI

SEQ ID NO: 4637 - protein, 113 aa, Gluconacetobacter diazotrophicus PAl 5 JGI
MISDIATRSLDAVNAYGLTQKTMQASADTQDADPNAQSSDVVTGFSDALNSAIKGAIKTGKTAEAQTAVGLSGKGNLTDIATSVEEAKLTLQTVTAVRDRVVQAYQNVMQMTI

SEQ ID NO: 4638 - protein, 100 aa, Methylobacterium nodulans ORS 2060
MPTNAFAAGAYAAIQNLGRLSPTRPAAPEGGFGQLLTAAVDGVAEAGRRSEQQMMAVGAGKANIVDVVTAVAESETALQTLVAVRDRVISAYEDIMRMQI

SEQ ID NO: 4639 - protein, 410 aa, Moorella thermoacetica ATCC 39073
MPKDNIVAGIDIGTTKVVAVVAEVMPEGRLNIIGLGETPSGGLRKGIIVDIENTSRAIAGAIEQAERMSGCQVHSAFVGLTGPHIDSLNNRGVVAVTGEDGEISLEDVERVLQAARVIPLAAERRIIHVLPRQYIVDGYDGVMDPVGMCGSRLEVETQIVTAAGAAVQNIMKSVQRAGLAVDELVLNPLASAGAVLQQAERELGSVVVDIGGGTTEIALISQGSLWFASVLPIGSEHITSDLAVGLRTPIVQAEVIKKEYGCVPADAVPDNEAVEVPPVGGREKRRVSRKALAAIIEPRVEEIFTLVRRELSSAHFQGLLPGGVVLTGGGALLEGITGMAAEILAMPVRLGWPEGGSGLADMVAAPPYATAVGLVNYGARRLAHPQAAATRETGWENFWSRLKSWWRELF

SEQ ID NO: 4640 - protein, 410 aa, Syntrophomonas wolfei Goettingen
MLGINRNIVVALDVGTSFIKAAMAELSQGQEINILGVSHVPSLGLRKGNIVDIESTARSIDSCLNDLERLTGVDIASTLLGFSGSSVYAVNNHAVVAVGNPSYEITQDDRQRVLQSACNIALPPDKTIVQAVERQYIVDGYDGVKDPIAMVGSRLELETTIIVAATAAIQNMHRSMQRINLQTEKIVYNPLLVAEAVLLPTEKEMGVVLLDIGGGTTEISFFEAGSLLYTSVLPVGGEYITRDLAIVLRTSLEEAGRIKERNGVASPDIARNDVIVNVKNVQGKEIRQVSQEVVAEIISARIMEIVEMIYAELKQFACLDRIPGGIVVTGGEAELTGLVKTIEEYTNIPTRLGIPENLRGIPVDFNRPQNAVILGGLIYSSRYLNINCDNKRGIAALFDQLSRWFKELFR

SEQ ID NO: 4641 - protein, 413 aa, Clostridium thermocellum ATCC 27405
MDDIISCIDIGTTKVCAIVAKLDENGNVEILGRATEPCSGVKKGVIVDIDSVSNALKSCAQKIRALLNIDIENVYVNVMGSHVDVFFNKAAVDILRPDRQITSEDVERTLKKVEDVKLPDNVQIIDVIPRQYIVDGCDEIVDPVGMAGVKLELEADVVVGKITTFNNIIKSLDNANIKVNGFIAEALAVGDLVLSPEEKDIGAILIDVGGGVTNISVFKNKCLALYDSIPVGGDHITNDISIGLKVSLNDAEKLKRDYGLALTSLIDNDHDITINEFSENTKRTIKVSEVVEIIEARVQEIFSLCKERLEQEGILNGFNGGIVLAGGGISYIDGSVQSAKEIFGLPVRIVSYKALEIKNAEHVTAMATVKYVANRIKSEAKGGGTKNNKPGKQKQKKEYGFLKKIASFFHGLF

SEQ ID NO: 4642 - protein, 325 aa, Desulfotomaculum reducens MI-1
MARRHFIGGLDIGTTKIVSVIAEISPSGYAMVKGLGECPTLGIRKGLVTDIVSFSKVIDQAVRLSEKMANVKVRSFFVTASAFRQLADQYHMIDEKLAESMQRVGLELVKMVPSVLASAEAVLTDTDKNIGTVLVDMGGTITEVAVFDQGLPIYISSLPVGCEHITSDLAVCLRTSISEGERIKRLLGMQTLEQKKDLEVSSVGGHEQRKVPVNAAMDIIHSRVQEIFELIHKELTQKYRLESLPGGLVLTGGGSLLKDIVNYANSQMNFFKVELGSPSKVGVSKEEWLNPSYASSLGLVMYGAKNNSRRLERLSGWRDVLNKFI

SEQ ID NO: 4643 - protein, 415 aa, Herpetosiphon aurantiacus ATCC 23779
MNRTIVGIDVGTTKICTLVAEVHDTGKVNILGVGLTPSKGLDRGVVVNIDEAVSAIATSVEKAERLSGYRIGTAFVGIAGRHISSVNSRGVVAISRPDHEISRTDVARAVEAAQAIAIPTQREVIHVIPRAYIVDGHEGIRDPVGMAGYRLEVETHIVTGEVMAIQNLIKSVERAGVGIDDLVLQPLASGEAVLSEEDKSRGVVLVDIGGGTTDIAIFIGGGIWHTVVLPIGGAHFTNDLVYVLHTPHNTAEYLKLRYGKVTDIDSHDPADDLIDTDGFSPGEHQQVSRVELNEILQARAEQLIDMIGNEIRRSGYEGLLPAGIVLTGGSAQLPGLDEMARQLLGMPVRIGIPTNLTGLAEAIDAPPYATAVGLVRWGLRHGMGSVGGHAASQPATTNWKQTYDRFKMWLREFLP

SEQ ID NO: 4644 - protein, 408 aa, Thermoanaerobacter sp. X514
MGDLIVGLDIGTSKVCTIIGEGDKNGELHIVGIGYYPCNGVKKGVIVDIDETAYSIKKSVEQAERMANQKISSVYLKIYGGLTTIYKNNGVVAVSREDREITKQDVDRVLQAAKIIAIPSDKEIIDVIPLEYIVDGYGEIKDPVGMAGIRLEVNAAIVTGSVTAIQNMEKCVKKAGLEVEGIIVGPLATGEAVLLKDEKELGVALIDVGAGVTDISVFKDGNIIYSSMIAVGGWHITNDLSVGLKISFEEAENIKKRYGTLEKLPPEKLEPIKIASLAGKNKSTTDVNEISDIIEARVSELLMLVYERLKEAKVLEDIVTNVVITGGGISFLKGNIELAQKIFNRNIRIGSPQNIGVATPIYSAGTGVVKYVYNNKRFMHNVQPTDKKEKKSSKLVDKLKEIFSDFWA

SEQ ID NO: 4645 - protein, 414 aa, Clostridium cellulolyticum H10
MSDNIVGIDIGTSKVSTVIGRINSVGEVEVLGKGTDLCTGVKKGIIVDIEAVSSSIRKSVKMAETQAEIKVVTAYVNISGLHVDIINHKNFVNIISDGKEITRNDVQKLLYSAGTMEIPEGSEIIDVVPRQYIVDGYDGITDPVGMKGATLEGDFDVVIGKIISVQNIVRSMEKAGLKVDGIIPEGFSAGECILAPDEKEMGVILIDVGGGSTEISVFKNEMLVMNKCIPVGGDHITNDLSIALKITYSEAEKVKRQLQLASTALIKHDQDITVNDISESFKKNIKVSDIIEVIEARVYEIFSICCDLVQKNCPGNYGAGVVLSGNGISTMDGSVQIANELFNLPVRIASPKIRNISGLQHCTAAGIINYIGKQDREASTTSSVSKKADPRPVKKAKQHSVFKKALNALKEFFY

SEQ ID NO: 4646 - protein, 424 aa, Geobacillus WCH70
MSSNEIVVSLDIGTSSVKVIIGEMLNESINIIGVGNVKSEGLKKGSIVDIDKTVQSIKRAVEQAERMVGLTIRRVIVGVTGNHVQLQDCHGIVAVSSENREITDEDVARVMDAAQVVSIPPDREIIGVIPRQFIVDGLDGINDPRGMLGVRLEMEGTIITGSKTILHNLLRCVERAGLEISDICLQPLAAGSLALSNDEKNLGVALVDIGGGSTTIAIFEQGFLQATSVLPVGGDHITKDLSIGLRTSTEDAERIKLKHGHAFYDYASEEEVFIVPVIGTDQHQQFSQLDIADIIEARLEEIFQMVQHEIRKLGFRDLPGGYVLTGGVANMPGILELAHVVLGSSVRIAMPDYIGVRDPQYTTGVGLIKFAYQQAMLQGKSVPVAASVAEPVEKHPQKQSQPKQKKKEATLGKKVKKFFGYFFE

SEQ ID NO: 4647 - protein, 405 aa, Desulfotomaculum acetoxidans DSM 771
MLKYNDQLIMALEIGSTKTVCGVGKLSHAGRLSILGYHEESSISWRKGRIGDNELAIRFFRNIVEAVQHSTGGRPYVVHVGMANHELYITRQNFKHVFSETAHRISEEDICFVFQMLKALAARENNRIIHVVPTGFYIDNQLVKEPLDLSGKCFSIEAIVISMNTEALDNLLMLLKLAGIKVKEVILGSLASADAVLNATEKEFGSVYVDIGGQTTAIVVYSHGFLQDVVVLPVGSNYITGDLVFGLGISYTAAEYLKLELGLTPVRNLAEEIEVKSGSELKRVSARLILDIIEARINEILDLIKKNIEIYNCEGLIKTGFVFGGGGAKLAGLVDYAEKHLDMPVRVTGPDAYLDAGTSTEAVSLGVIGLIRFRENQSLLPAKPDTSNILGTGWLEKIKLWAVKK

SEQ ID NO: 4648 - protein, 411 aa, Alicyclobacillus acidocaldarius DSM 446
MAKEDYIVSLDIGTSKVRVIIGESTGNNLNIIGVGSASSQGLRHGAIVDIDKTVDSIREAVDHAERMVGIRIPSAYVGISGEHIQLHSSHGVVAVSSADREITDEDIERVLQQARVVALPPEREVIDVVAKEFVVDGLRGIMDPRGMLGVRLEVDAYLITGSRTAIHNIVRCVERAGLEVANLVLAPMAASQIALTQDERKLGVALVDVGAGVTSVSVFANGVLMGTSIIPIGGDYVTQDIAIGLRTNTVAAEQVKLRHACAMVEQASEHETFRVPRMGSNKEAEFTQYDLATIIEPRMQEIFGLVRKEVEKMGYADELPAGYVFHGGVMSTPSAAELAGEELQAPVRIAVPEFLGVRDPSFVNGVGMIVYAARTGLRPSSADYNAGARQVRSSNHVGVFARIKDWLRDFV

SEQ ID NO: 4649 - protein, 288 aa, Thermoanaerobacter sp. X514
MKILIAEYAGFCFGVKRAIETAYQEIEKGDGKKIYTLGEIIHNPQVISDLSKKGVNVIEEEELDKLTEGDKLIIRSHGVSKKLYDFLAKKGVEVIDVTCPFVKKVQNIVYEYYHKGYSIIIVGDRNHPEVIGVNGWCDDTAYVVNSIEEAYELPQLEKACAVAQTTLIEKHWKDILEVIKLKVKDLIFFNTICDATQKRQDAADELSKKVDVMFVIGGKHSSNTQKLKKICEKNCKNTFHIEDAEELTLEMVKDHEIIGVTAGASTPDYVIEDVIKKIRFLKGEDGDE

SEQ ID NO: 4650 - protein, 288 aa, Sulfurihydrogenibium YO3AOP1
MANIIVAQTAGFCFGVRIAVDMAKQAGEKLGHAYTNGPIIHNKQVVNYLKSIGVEEMQDYSQLKPGDTVIIRSHGVPPKTERMLKELNINVLDATCPFVKKVHDKVKQLVEEGYFVVIIGEEGHPEVIGTLGHLEEVGGKGVVVENFEDLVKKVPKRNRIGVVAQTTQSEDFFREAVGYLAENTEELKVFNTICDATSVRQEEVKKIAPEVDVMIIIGGKHSGNTQRLYQISKALNPNTYHIETADELQNQWFENKENIGISAGASTPDWIIQEVVNKIKEIKGVSHE

SEQ ID NO: 4651 - protein, 283 aa, Dictyoglomus turgidum DSM 6724
MKVYIATPYGFCSGVKKSISLAEKILSLKGEVYTLGALVHNPKVIEELSKKGIKVLGKDEIVEGKALIVRAHGLPQRDIDFYKSLGNEIYDATCPLVKKVQVLAEYLKNNKYKVIIIGEKNHPEVIGILSYTDNQGIVIEYESDIEKVEYYPKIGIVFQTTQSFDNAIQKVNLIMNKGKEIRIFNTICPETIERQEKAKKLSKIVDVALVLGGKNSANTRRLYITLSLKVPTYHIENLEEIDKNWFKEDSKVGIITGTSTPNNFVEEVLALLKSLYPLEIHLV

SEQ ID NO: 4652 - protein, 663 aa, Anaerocellum thermophilum DSM 6725
MIIKVAQSAGFCFGVQRAVEGVLAWAKANKGKSIKVYGMLIHNSYVIDKLKDLGVKVVEDIEQIGKEDIIFIRSHGVSMEEYAEIEKRADKVYDFTCPYVKKIHEIVMEHSVNGYDIIVVGDMNHPEVKGIVGHVGNNRKCFVVDSIEKVKEAINQIEGKAAVVCQTTFDGKKWSEIREFLESHTNYKVFDTICKATINRQKEAQELAQHVDIMLVVGDKKSSNTNKLYKLLKEIKPTFFIEKVEDLDSIKLDSYIKSIGVTAGASTSPEQIEEVVKHLEEKFNEMNLKDFERLIDRSFLTVQRGEVVNGRIIKVEEDYLLVDIGYKAEGIIYKDEVIKNGNVNLKDLFKIGEVIEAVVIKESDEEGNVVLSKYRADILHGFEELLSKYENKETVRVIVKSIKEKSIVCDFRGTNVYVPISQWGEDVQTSDIGKIFEIEITDVSKEKKIAFGSRKSLLKQREEERFIKQINSLDFSREYEGTVVEIREKGIVVNFENLRGFVPASEIGYLKKGAGIKKLFELGEKVKVKILDIDKNKKQIYLSVKKTQDDEWIKKIKNLYLGMLVDCEVTKVLPFGLVVWITEHDVDGFVHVSNIPLGYNQRPHNLYKVGDSLRAKVIEIDEEKRRIALSLKDLHEEENIDTEHNEDFVITLADFVKNIKLEQ

SEQ ID NO: 4653 - protein, 344 aa, Acidimicrobium ferrooxidans DSM 10331
MAVDKVLLAAPRGFCAGVERAIGALGWMLRIFEPPVYCYHEIVHNRLVVEAFEAAGVVFVDDVESVPPGRPVMLSAHGTAPEVLEAARQRCPIVVDAVCPLVTKVHHEIRTRAQRGYQIVYVGHRGHEEAIGATAEAPEAVTFVETPEEARAITLGDGPVALLAQTTLAVPEWEAIAAIVASQTPNLWQPGRSDLCYATTNRQAAVRALAERVDAMVVVGSANSSNTRALERVATSAGVGHVERVNRPSELVGPFEGIVGVTAGASAAESVVKDVVAALAPRLGVEEISVLEEDEFFPLPPDLRDLIGALAGVVAVATGVSPEGALPERESAEAILAALDTRHR

SEQ ID NO: 4654 - protein, 278 aa, Eggerthella lenta DSM 2243
MRVVKASYAGACYGVQRALDMAVEASASGEGASTLGPLIHNPQVVAELAARGIRAVDGPENVERGSVIIRSHGVTPAVRRAVEERELPLIDATCPHVARAQKAAADLARRCGCVVVVGEEGHPEVEGLVAYAREAGGEVFVVAAPGDLSASIEAPVGIVVQTTQTREALDAVVEALAARGIRPEVKNTICFATRQRQESAAALADEVDAIVVIGGRNSSNTTRLADICAAACPRTHHVEAPEELDPSWFVGCESVGVTAGASTPEDQIAAIVERLEAL

SEQ ID NO: 4655 - protein, 284 aa, Cryptobacterium curtum DSM 15641
MEIIIASRAGACYGVQRALNLAQKAAQSGGDVQTLGSLIHNPQVVAELAASGVEAVSKPEELTASRAIIRSHGVTPQVREGIEQAGADIIDATCPHVLRAQQAARDLALEGRLVIVVGEESHPEVEGLRAWAEQAGGQVVVAATPDDVPSQIDGSVGIVVQTTQRREKLDAIIDVLKSRGIEAEIRDTICSATSTRQEAAAELASQVDVMVVIGGHNSSNTTRLFEICRARSPQAFHIESPDELQAIDFKGAQRVGVTAGASTPEDQIESVIERLRSFAESQEE

SEQ ID NO: 4656 - protein, 276 aa, Slackia heliotrinireducens DSM 20476
MEILRAKHAGVCYGVERALDMVSAASMDGDEDTFTLGPLIHNPQVVAKLESRGVRAVDGPEQVDHGIVILRTHGVEPHIAADLKSRDLTVIDATCPHVAKAQRSAANLADTCGTVLIIGRAEHPEIRSVREYAGEKAIVVADVDEVPEHLEEPVGVIVQTTESKEKLQAVVNELEARGVETQVKNTICFATRQRQDAAAALADEVDAMVVIGGKNSSNTTHLYEICRDHCDRSYFVETKEELDPSWFSATDRVGVTAGASTPDYQIEDVISYLESL

SEQ ID NO: 4657 - protein, 416 aa, Pelobacter carbinolicus
MSQTLIQQDPEIAEAIRLETERQEYNLEFIASENFVSEQVMEAQGSIMTNKYAEGYPAKRYYGGCEMVDIAERLAIERAKELFGAEHANVQAHSGSQANMAVYFAACKPGDTVLGMNLAHGGHLTHGSPVNFSGKLFNIVSYGVQKETGYIDYEEVERLALEHKPTLLVVGASAYPRTIDFPAFRKIADKVGAKIMVDMAHIAGLVAAGVHPSPVPYAEFVTTTTHKTLRGPRGGMILCREEFAKTIDSNIFPGIQGGPLMHVIAAKAVSFKEALAPEFKEYSTQVVKNAKVLADALVKRGLNLVSGGTDNHLILVDFTGTETTGKMAEKALEKAGITVNKNSVPFETRSPFVTSGIRLGTPATTTRGLKEAEMERVADWVVRALDNMENDTELAAIKGEVREMCKRFPLYAHLLK

SEQ ID NO: 4658 - protein, 412 aa, Desulfovibrio desulfuricans G20
MDELLIQDPEVGRAIVQEVERQTGKLELIASENFVSPAVRAAQGSVLTHKYAEGYPGKRYYGGCEFVDVAENLAIDRACEIFGAQYANVQPHSGSQANMAVYFSALTPGDTILAMDLSHGGHLTHGSPVNFSGRFYNVVFYGVSRETGCIDYDSVAELAREHRPAMIVAGASAYSRIIDFARFRAIADEVGSLLMVDMAHIAGLVAAGLHPSPVGTAHFTTTTTHKTLRGPRGGMILSDEEAAKKLNSQIFPGIQGGPLMHVIAAKAVAFGEALRPEFGAYQKQVVANAAKLAATLTDAGFELVSGGTDNHLMLVDLTNKDITGKDAQHALDLAGITANKNTVPFETRSPFVTSGIRLGTPALTTRGMKEAEMVKVAGWIIDALGNIGNETRLAEISRDVEKFARQFPLFHW

SEQ ID NO: 4659 - protein, 416 aa, Moorella thermoacetica ATCC 39073
MNLETVAKVDPEIVAAVRGELQRQRTHLELIASENFVSQAVMEAYSCVLTNKYAEGYPGKRYYGGCEWADVVENLARERAKALFGAEHANVQPHSGSQANTAVYLAVLNPGDKALGMNLAHGGHLTHGSPVSLSGKYYNFCFYGVDAKTGRIDYDAVARIAREERPRLIVAGASAYPRVIDFARFREIADEVGALLMVDMAHIAGLVAAGIHPNPVPYAHFVTTTTHKTMRGPRGGIILTTREYARDIDKAVFPGVQGGPLMHVIAAKAVALKEAMLPEFKRYQEQIVTNARTLADALMGYGFNLVSGGTDNHLMLVDLRNKNITGREAEDILASVQITVNKNAIPFDPQKPSVTSGIRLGTAALTSRGMDADAMVQVARAIDLALSYGPDEKKLEEARGIVAELCRAFPLYQELD

SEQ ID NO: 4660 - protein, 415 aa, Syntrophomonas wolfei Goettingen
MDYIQEYVKPVDPEVAEAIEKEEARQNNKLELIASENFVSRAVMAAQGSVMTNKYAEGLPGARYYGGCEYVDIVEELARDRVKEIFGAEHANVQPHSGAQANTAVYFAALQPGQTIMGMNLNHGGHLTHGSKVNISGKYFNIVDYGVNRDTERIDYEELREIALKARPQMIVAGASAYPRILDFKKFREIADEAGALLFVDMAHIAGLVAAGLHPSPVPYADFVSSTTHKTLRGPRGGFILCRQEWANKIDKAVFPGIQGGPLMHVIAAKAVCFKEALTPEFKAYQQDIVNNAAILAKALMEQGLRVVSGGTDNHLMLVDVRPKGLNGRDAEAILESINITVNKNAIPFDPEKPTVTSGIRVGTPAVTSRALKGDDMRELARAITLVLDKHDSEEVKEEARRIVKALCDKYPLYT

SEQ ID NO: 4661 - protein, 412 aa, Desulfovibrio vulgaris DP4
MDELLLQDPEVGKAIILEIERQTGKLELIASENFVSAAVRQAQGSVLTHKYAEGYPGKRYYGGCEFVDIAENIAIERARTIFGCEYANVQPHSGSQANMGVYFACLKPGDTILGMNLSHGGHLTHGSPVNFSGRLFNVVFYGVEKETGRIDYEQVAALAREHKPSLIVAGASAYPRTIDFARFRAIADEVGAKLMVDMAHIAGLVAAGYHPSPVQHAHYTTTTTHKTLRGPRGGMILSTEDNGKTLNSQIFPGIQGGPLMHVIAAKAVAFGEALRPAFKEYQKQVVDNAAALAGVLTAAGFDLVSGGTDNHLMLVDLTSKDVTGKDAEIALDKAGITVNKNTVPFETRSPFVTSGVRLGTPALTTRGMKAAEMEKVGGWIVDAIANTTNETRLAEISREVERFARQFPLFAW

SEQ ID NO: 4662 - protein, 413 aa, Desulfotomaculum reducens MI-1
MFNGKLAQTDPELAKAIELEHQRQQRNIELIASENFVSPAVLEAQGSILTNKYAEGYPGKRYYGGCEFVDIAESLAISRAKKLFGADHANVQPHSGAQANFAVYFALLQPGDKILGMNLAHGGHLTHGSPVNVSGKYFNVVAYGVEEDTGCINYEKLREIALQEKPKMIVAGASAYARAIDFKKIGEIAKEIDAYFFVDMAHIAGLVAAGLHQSPVPYADVVTTTTHKTLRGPRGGMILCKEEYAQLIDKAIFPGSQGGPLMHVIAAKAAAFGEALKPEFKAYQQQIINNAQALAKGLLERGFNLVSGGTDNHLILVDLRGTGITGKQAETLLDEVHITCNKNAIPFDPEKPFVTSGIRLGTPAVTTRGFKEKDMDKVAEIIALTLQEKDNPDTQEKARAMVKELCDKYPLYA

SEQ ID NO: 4663 - protein, 419 aa, Candidatus Desulfococcus oleovorans Hxd3
MIIDYLAQQDPEVAGAVAREVERQQHNLELIASENIASRAVMAAQGSVLTNKYAEGYPGKRYYGGCEYVDQAEQIAIDRAKTLFGAAYANVQPHSGSQANMAVYFALLSPGDTGLGMDLAHGGHLTHGSPVSFSGRLFDFKHYGVKKETGTIDYDQVADLAKTHRPKMIIAGASAYPRTLDFEKFAQIAASVEACLVVDMAHIAGLVAAGVHPSPVPHADVVTSTTHKTLRGPRGGLILSARADFGKALNKEIFPGIQGGPLMHVIAAKAVAFGEALTDGFVAYQQQVVKNARALAAHLMEQGIELVSGGTDNHMMLADLRNISVTGKAAETALERAGLTLNKNAVPFDTENPTVTSGVRIGTPVMTTRGMKEPEMAVVAGLIVNVLKNISNDTVIQATRKRVMELCEAFPIYRDNDNG

SEQ ID NO: 4664 - protein, 412 aa, Desulfovibrio vulgaris  Miyazaki F
MDELLIQDPEVGRAVTLEIERQTGKLELIASENFVSAAVRQAQGSVLTHKYAEGYPGKRYYGGCEFVDIAENLAIDRAKAIFGCGYANVQPHSGSQANMGVYFACLKPGDTILGMNLSHGGHLTHGSPVNFSGRLYNVVFYGVKKETGYIDYDEVAALAREHKPTLIVAGASAYPRTIDFARFRAIADEVGAKLMVDMAHIAGLVATGLHPTPIGQAHFTTTTTHKTLRGPRGGMILSDEDNAKTLNSQIFPGIQGGPLMHVIAAKAVAFGEALRPTFVDYQQQVVKNAARLAGCLTAAGYDLVSGGTDNHLMLMDLTAKDITGKDAEHALDKAGMTANKNTVPFETRSPFVTSGVRLGTPALTTRGMKEAEMEKVAAWIVDALANVNNETRLAAISREVEVFARQFPLFAW

SEQ ID NO: 4665 - protein, 414 aa, Desulfovibrio desulfuricans ATCC 27774
MDEILLQDPEIAKAIALESQRQMGKLELIASENIVSTAVREAQGSVLTNKYAEGYPGKRYYGGCEYVDMVETLAQERAKLLFDAQYVNVQPHSGSQANMAAYLAVLKPGDTILGMDLSHGGHLTHGSPVNFSGRLFKIISYGVQRETGRIDYDDVAAKAREHKPSVIVAGASAYPRAIDFARFRAIADEVGAKLVVDMAHIAGLVAAGLHQSPVPHAHITTTTTHKTLRGPRGGMILSTEDMGKTLNSQIFPGIQGGPLMHVIAAKAVALGEALHPAFKVYQQQVLDNAATLAACLTEAGYDLVSGGTDNHLMLVDLTSRDITGKDAEIALDTAGITVNKNTVPFETRSPFVTSGIRLGTAALTTRGMKQEHMRTVGQFIIAALEKRNDTAELEKIRKNVEEFAHQFPLFAHLA

SEQ ID NO: 4666 - protein, 412 aa, Desulfomicrobium baculatum DSM 4028
MDELTRQDPQIAKAIQLETNRQITKLELIASENFTSLAVRAAMGSVMTHKYAEGYPGKRYYGGCEFVDMAENLAMERARQLFNAEYANVQPHSGSQANMGAYFAAIQPGDTILGMNLSHGGHLTHGSPVNFSGRLFKTAFYGVEKETGQINYDEVEALALEHKPQMIIAGASAYPRTLDFARFRAIADKVGAKLLVDMAHIAGLVATGLHPSPIEHAHFTTTTTHKTLRGPRGGMILSTEEFGKTLNSQIFPGIQGGPLMHVIAAKAVAFAEALRPEFKDYQQQVVANAQTLAAELTAAGYHLVSGGTDNHLMLVDLTAQDITGKDAEIGLDKGGITVNKNTVPFETRSPFVTSGVRLGTPALTTRGMKSDDMRKVAKWIVAILENLDNESRLTEIRLEVEKFAGQFPLFAW

SEQ ID NO: 4667 - protein, 413 aa, Desulfotomaculum acetoxidans DSM 771
MTLLRSLADTDPEILRAIELETERQRNKIELIASENFVSRAVMEAQGSVMTNKYAEGYPAHRYYGGCEYVDVAENIARERALKLFGAEYVNVQPHSGSQANMAVYFALLKPGDTILGMDLAHGGHLTHGSKVNISGKYFNFISYGVEKDTGRIDYEKVQAIASEYKPKMIVAGASAYPREIDFEKLKKAADEIGAYLMVDMAHIAGLIAAGLHMSPVPYADVITTTTHKTLRGPRGGMIFCKECYGPDIDKAIFPGIQGGPLMHVIAAKAVAFGEALKPDFKEYQKQIIKNAAALAEALTGYGFSLVSGGTDTHLMLVDLQNKGITGMQAENMLDEVGVTVNKNAVPFDPQPPKITSGIRIGTPAVTTRGFDEEAMRQVAEVFHCVLDYFGDKHYQEKARALVRQICGRYPLY

SEQ ID NO: 4668 - protein, 420 aa, Desulfohalobium retbaense DSM 5692
MQHLLQTDPDMAKAIDLEHQRQLSKIELIASENFTSAAVREATGSIMTHKYAEGYPGKRYYGGCEFVDMAEELARERACQLFGAEYANVQPHSGSQANMAVYFGALKPGDTIMGMDLSHGGHLTHGAPVSFSGKLFKTVFYGVDQATGIIDYEQVAEQARTHRPQLIIAGASAYPREIDFARFRAIADEVGAQLMVDMAHIAGLVATGLHASPIGHAHFTTSTTHKTLRGPRGGLILSGSEFGKTLNSQIFPGIQGGPLMHVIAAKGVAFGEALQPSFRAYQEQVVANAQALGHALTETGFDLVSGGTDNHLLLVDLTRKNITGKDAEAALDKAGITANKNTVPFETRSPFVTSGIRLGTPAVTTRGMTAEHMHQIAAWIEAALDNMDNETRLLEINKEIAAFAGEFPLFISQPGADLSS

SEQ ID NO: 4669 - protein, 130 aa, Ralstonia solanacearum
MTQMHVPAFRFSVNPIPRVSSLAWLRSLARPAGQGLLLAALLLFIAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4670 - protein, 110 aa, Novosphingobium aromaticivorans DSM 12444
MTQTLARARNGASALVLAAVAALVTVMPAHAAGSSMPWEAPLQSILESIQGPVAKIVAVIIIIATGLALAFGDTSGGFRRLIQIVFGLSIAFAASSFFLSFFSFGGGALV

SEQ ID NO: 4671 - protein, 114 aa, Rhodopseudomonas palustris BisB18
MIHRPHPLRRAIATPAGFTTLTTVLASLTAAPAWAAGSSMPWEQPLNQILQSVEGPVAKIMAVIIIIVTGLTLAFGDTSGGFRRLIQIVFGLSIAFAASSFFLSFFSFGGGALV

SEQ ID NO: 4672 - protein, 109 aa, Rhodopseudomonas palustris BisB18
MNPSLQHIRRHAVTAVTTAPFALISGSVWAAGSNMPWEQPLSQILQSVEGPVAKILAVIIIIVTGLTLAFGDTSGGFRRLIQIVFGLSIAFAASSFFLSFFSFGGGVVV

SEQ ID NO: 4673 - protein, 127 aa, Cupriavidus metallidurans CH34 uid250
MTQMTISAFRVSVNPALRLARLRSLARPAGQGLLLAALLLFLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4674 - protein, 127 aa, Cupriavidus metallidurans CH34 uid250
MTQMTIPAFRFSANPALRLARLRCLARPAGQGLLLAALLLFLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4675 - protein, 114 aa, Sphingopyxis alaskensis RB2256
MKAKKTRLLAGTALDRLGVLAVTSAGLLITAPAHAGGSSMPWEAPLQSILESIEGPVAKIVAVIIIIVTGLSLAFGDTSGGFRRLIQIVFGLSIAFAASSFFLSFFSFGGGALV

SEQ ID NO: 4676 - protein, 110 aa, Rhodospirillum rubrum ATCC 11170
MTRFALRTRRHLATVGSITVMTLALAPAAYASGSSMPWETPLEQILDSVQGPVAKIISVIIITVTGLTLAFGETSGGFRRLIQIVFGLSIAFAASSFFLSFFSFSGGALV

SEQ ID NO: 4677 - protein, 110 aa, Mesorhizobium BNC1
MIQPIARGHQRLATAATALTLSFLLAPAAHASGSSMPWEAPLQSILQSIEGPVAKIIAVIIIIVTGLTLAFGDTSGGFRRLIQIVFGLSIAFAASSFFLSFFSFGGGALV

SEQ ID NO: 4678 - protein, 110 aa, Mesorhizobium BNC1
MIRFVSRGCRHMATAVAAVSVSLMLAPSAHASGSSMPWEQPLQQILESIEGPVAKIIAVIIIIITGLTLAFGDTSGGFRRLIQIVFGLSIAFAASSFFLSFFSFGGGALV

SEQ ID NO: 4679 - protein, 125 aa, Mesorhizobium BNC1
MIPERQPMRSARRLRSQPLCRCILGRLSSAGISVVTMLYALPAYAAGSSMPWEAPLESILESIEGPVAKIIAVIIIIITGLTLAFGDTSGGFRRLIQIVFGLSIAFAASSFFLSFFSFGGGALVG

SEQ ID NO: 4680 - protein, 127 aa, Burkholderia ambifaria AMMD
MTQMHIHAFRISVNPASAFARLRRLAAPAQHGLMLAAVMLMTAGTAQAAGSSMPWEGPLTSILESIQGPVARIVAVIIIISTGLALAFGDTSGGFRKLIQIVFGLSIAFAASSFFLSFFSFSGGAVV

SEQ ID NO: 4681 - protein, 128 aa, Shewanella sp. ANA-3
MTHAHAFRFSVNPLPHLSGLMRLRSLARPAGQGLLLAALLLFLADTAQAAGSSMPWEGPLQSILESIQGPVARIVAVIIIIATGLALAFGDTSGGFRKLIQIVFGLSIAFAASSFFLSFFSFSGGAVV

SEQ ID NO: 4682 - protein, 110 aa, Paracoccus denitrificans PD1222
MIRHALRIRQHIATAAAATYVSLFIAPAAHASGSSMPWEAPLQSILDSVEGPVAKIVAVIIIIVTGLTLAFGDTGGGFRRLIQIVFGISIAFAASSFFLSFFSFGGGALI

SEQ ID NO: 4683 - protein, 110 aa, Paracoccus denitrificans PD1222
MIRHALRIRHHVATAATTLYVSLFMAPAAHAAGSSMPWEAPLQSILDSVEGPVAKIVAVIIIIVTGLTLAFGDTGGGFRRLIQIVFGISIAFAASSFFLSFFSFGGGALV

SEQ ID NO: 4684 - protein, 128 aa, Acidovorax avenae citrulli AAC00-1
MTHVDAFRLSVNPLSWRPSLARLHRLARPAGQGLLLEALLLLLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4685 - protein, 125 aa, Acidovorax sp. JS42
MTHADAFRISANPLPRPARLDGLARPAMQGLMLAALMLLLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4686 - protein, 119 aa, Polaromonas naphthalenivorans CJ2
MTHIAFSTSRFSANPHLRLTLHVVVLAALMLCLTLPAHAAGSSMPWEGPLTSILESIQGPVARIVAVIIIISTGLALAFGDTSGGFRKLIQIVFGLSIAFAASSFFLSFFSFSGGAVVA

SEQ ID NO: 4687 - protein, 108 aa, Bradyrhizobium BTAi1
MKFNQSGMRGIVGAAAFAITYLTITSASAAGSNMPWEQPLNQILQSVEGPVAKIVGVIIIIVTGLSLALGDTSGGFRKLIQIVFGLSIAFAASSFFLSFFSFGGGVVI

SEQ ID NO: 4688 - protein, 107 aa, Bradyrhizobium BTAi1
MLIKDARRAFATATAFVFVALATAPAYAAGSNMPWEQPLNQILESIQGPVAKVVSVIIIIVTGLTLAFGETSGGFRRLIQIVFGLSIAFAASSFFLTFFQFGGGVTV

SEQ ID NO: 4689 - protein, 119 aa, Bradyrhizobium BTAi1
MTAARQPSTKHRLFVGSVLDRIGAIGLTATGLLYAAPAYASGSSMPWEQPLQQILQSIEGPVAKVIAVIIIIVTGLTLAFGDTSGGFRRLVQIVFGLSIAFAASSFFLSFFNFGGGAVV

SEQ ID NO: 4690 - protein, 111 aa, Sphingomonas wittichii RW1
MIHALRHGARRAMLAATASVIALTISAPAHAGGSSMPWEAPLQSILESIEGPVAKIIAVIIIIVTGLTLAFGDTSGGFRRLIQIVFGLSIAFAASSFFLSFFSFGGGLVVA

SEQ ID NO: 4691 - protein, 127 aa, Pseudomonas aeruginosa PA7; identical to SEQ ID NO: 4674

SEQ ID NO: 4692 - protein, 109 aa, Ochrobactrum anthropi ATCC 49188
MIRCAVRIRHHLATAAAFTWASLMTAPAQASGSSMPWEAPLQSILESVEGPVAKIVAVIIIIVTGLTLAFGDTGGGFRRLIQIVFGISIAFAASSFFLSFFSFGGGALV

SEQ ID NO: 4693 - protein, 110 aa, Parvibaculum lavamentivorans DS-1
MIRTTMRVRRYAATAAAFIYINLVLVPAAHASGSSMPWEAPLQKILESIEGPVAKIVAVIIIIATGLALAFGDTSGGFRKLIQIVFGLSIAFAASSFFLSFFSFGGGALI

SEQ ID NO: 4694 - protein, 110 aa, Xanthobacter autotrophicus Py2
MTPNRVSFDRRLLRTAAAIAAFACAVSAAHASGSSMPWETPLQSILESIQGPVAKIIAVIVIISTGLALAFGDTSGGFRRLIQIVFGLSIAFAASSFFLSFFSFSGGALV

SEQ ID NO: 4695 - protein, 110 aa, Xanthobacter autotrophicus Py2
MIRHALRVRHHIATAVSVTVLSMMLAPAAYASGSSMPWEAPLQSILESIEGPVAKIVAVIIIIITGLTLAFGDTSGGFRRLIQIVFGLSIAFAASSFFLSFFSFGGGALV

SEQ ID NO: 4696 - protein, 110 aa, Xanthobacter autotrophicus Py2
MIRHALRARRHIATAASVAVFSMMLAPAAHASGSSMPWEAPLQSILESIEGPVAKIIAVMIIIITGLTLAFGDTSGGARKLIQIVFGLSIAFAASSFFLSFFSFGGGALV

SEQ ID NO: 4697 - protein, 110 aa, Xanthobacter autotrophicus Py2
MIQRLHQTRHRLVSALSVATLSVVMAAPAHASGSSMPWEAPLQSILQSIEGPVAKIVAVIIIITTGLTLAFGDTSGGFRRLIQIVFGLSIAFAASSFFLSFFSFGGGALV

SEQ ID NO: 4698 - protein, 110 aa, Xanthobacter autotrophicus Py2
MTFTLPPFYRRLLQAVAGATACVCVVSAAHASGSSMPWETPLQSILDSIQGPVAKIIAVIVIISTGLALAFGDTSGGFRRLIQIVFGLSIAFAASSFFLSFFSFSGGALV

SEQ ID NO: 4699 - protein, 127 aa, Delftia acidovorans SPH-1
MTQMTIPAFRFSANPALRLARLRCLARPAGQGLLLAALLLFLAGAAQAAGSSMPWEGPLQSILESIQGPVARIVAVIIIIATGLALAFGDTSGGFRKLIQIVFGLSIAFAASSFFLSFFSFSGGAVV

SEQ ID NO: 4700 - protein, 125 aa, Delftia acidovorans SPH-1
MTHVDAFRISANPLPRPARLDGLARPAMQGLMLAAFMLLLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4701 - protein, 125 aa, Burkholderia multivorans ATCC 17616 JGI
MTHVDAFRLSVNPHPSLARLRLLARPAAQGLLLAALMLLLAGTAQAAGSSMPWEGPLTSILESIQGPVARIVAVIIIISTGLALAFGDTSGGFRKLIQIVFGLSIAFAASSFFLSFFSFSGGAVV

SEQ ID NO: 4702 - protein, 113 aa, Caulobacter K31
MMFHRAASRAQRDPRPLLLTTTLTLLVSAQAQAAGSGMPWEEPLQQVLESVQGPVAKIIAVLVIISTGLALAFGETSGGFRKLIQIVFGLSIAFAASSFFLSFFSFGGGALIA

SEQ ID NO: 4703 - protein, 110 aa, Caulobacter K31
MIRHALRVRRQIATVASVTFVSLALAPAAYAAGSSMPWEAPLQSILQSIEGPVAKILAVIVIIVTGLTLAFGDTSGGFRRLIQIVFGLSIAFAASSFFLSFFSFGGGALV

SEQ ID NO: 4704 - protein, 110 aa, Methylobacterium populi BJ001
MIQRLHQARHHLVTALSVAALSVVMAAPAHASGSSMPWEAPLQSILQSIEGPVAKIVAVIIIITTGLTLAFGDTSGGFRRLIQIVFGLSIAFAASSFFLSFFSFGGGALV

SEQ ID NO: 4705 - protein, 130 aa, Ralstonia pickettii 12J
MTQMIVPAFRISANPLALRCRPARLDGLARPALQGLMLAALMLLLAGTAQAAGSSMPWEGPLQSILESIQGPVARIIAVIIIIATGLALAFGDTSGGFRKLIQIVFGLSIAFAASSFFLSFFSFSGGAVV

SEQ ID NO: 4706 - protein, 100 aa, Prosthecochloris aestuarii DSM 271
MKKHVLLLPVLILLMSNAAYAASTGMPWEGPLDQLLNSLTGPVSRVIGAVSIISLGLGLAFSEGGGVMRKALWVVMGLAIAYNAVSWGIGFMGFGGGLLV

SEQ ID NO: 4707 - protein, 108 aa, Gluconacetobacter diazotrophicus PAl 5 JGI
MTRMIVLRRHLEVAGATLSLALLSAPAYAAGSNMPWEEPLNQILESVQGPVARIVSVIIITVTGLTLAFGETSGGFRRLVQIVFGLSIAFAASSFFLSFFSFAGGALT

SEQ ID NO: 4708 - protein, 113 aa, Gluconacetobacter diazotrophicus PAl 5 JGI
MIRVLATARRMHRRALDVITFAALSLAFAPAAYASGSSMPWETPLNSILESVQGPVAKIISVIIITVTGLTLAFGDTSGGFRRLIQIVFGLSIAFAASSFFLSFFSFSGGALI

SEQ ID NO: 4709 - protein, 130 aa, Thioalkalivibrio HL EbGR7
MTQMIVPAFRFSANPALRLPARSRLHSLARPAAQGLLLAALLLLLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4710 - protein, 121 aa, Agrobacterium vitis S4
MSRRMFTLVALAAISMMMAEPAFAAGGGGGLPWEGPLQQIQQSITGPVAMAIALIAVAVAGGMLIFGGEINDFARRLAYVVLVCGILLGATQVVGLFGGGGASIGVPLEATQDVTLDRAHG

SEQ ID NO: 4711 - protein, 128 aa, Diaphorobacter TPSY uid29975
MTHVDAFRISVYPLSRRSSPARLDGLARPAMQGLMLAAFMLLLAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4712 - protein, 94 aa, Azotobacter vinelandii DJ
MLAAIMLMTAGTAQAAGSSMPWEGPLQSILESIQGPVARIVAVIIIIATGLALAFGDTSGGFRKLIQIVFGLSIAFAASSFFLSFFSFSGGAVV

SEQ ID NO: 4713 - protein, 104 aa, Geobacter M21
MRTKEKVVGLWFALVVFLTTQPAFAGGSSMPWESPLNNILNSITGPVAKAGGVLAIVATGFGLAFSEGGGFMRKVVGVVFGLSITFSAGTFISDFLGYGGGAGF

SEQ ID NO: 4714 - protein, 798 aa, Bacillus cereus ATCC 10987
MDKQKHVTLGVTGMTCAACATRIEKVLNKMDGVDANVNLAMEKASIKYDPSQQEISNIKNKIENLGYNVAEEKITLDIEGMTCAACATRIEKVLNKMEGVSNATVNLATNSAVVEYNEGLISTENILEKIKKTGYKGQIRSEDVDRSERKEEVIKAKKRQLIISIILSLPLLYTMIGHMPFDTGIPMPHILMNPWFQLLLATPVQFYIGGHFYVGAYRALRNKSANMDVLVALGTSAAYFYSLYEALKTLGNANYSPDLYFETSAVLITLILVGKYFETLAKGRTTEAISKLLSLQAKDALVVRDGQEIRVPLEEVVIGDTIIVKPGEKIPVDGIVTSGVSSVDESMITGESIPVDKKEGDAVIGATINANGVLTIKAEKVGKDTALAGIIKIVEEAQGSKAPIQRLADIISGIFVPIVVAIAVVAFIVWYFFITPGDLPNALEVGIAILVIACPCALGLATPTSIMVGTGKGAEKGILFKGGEFLEGTHKINAVLLDKTGTVTKGKPEVTDVLEFEEGMLDYAISAESASEHPLAHAIVEYGKQQGINLKDLAQFSAIPGHGIEANIEDKKVLVGTRKLMNEQSIEISQHEEVMKDLEYQGKTAMLVAIDGKLAGIIAVADTVKESSKAAIQTLKEIGIEVYMVTGDNKRTADAIAKLVDLDHVYAEVLPEDKAKIVEDLQKQGKRVAMVGDGINDAPALAKADIGMAIGTGADVAIETADVTLVGGDLSHIPKAIELSRKTMKNIRQNLFWALFYNAIGIPVAAAGLLEPWVAGAAMAFSSVSVVTNALRLKRVKI

SEQ ID NO: 4715 - protein, 68 aa, Bacillus anthracis Ames 0581
MEQLTLQVEGMSCGHCVNAIESSVKELNGVEQVKVQLAEGTVEVTIDSSVVTLKDIVAVIEDQGYDVQ

SEQ ID NO: 4716 - protein, 68 aa, Bacillus anthracis str Sterne; identical to SEQ ID NO: 4715

SEQ ID NO: 4717 - protein, 68 aa, Bacillus thuringiensis konkukian; identical to SEQ ID NO: 4715

SEQ ID NO: 4718 - protein, 68 aa, Bacillus cereus ZK; identical to SEQ ID NO: 4715

SEQ ID NO: 4719 - protein, 68 aa, Thermobifida fusca YX
MASTTITVTGMTCGHCVSSVKEEISELPGVTDVRVDLESGRVEIDSTAPLSDEQIRAAVAEAGYEVVA

SEQ ID NO: 4720 - protein, 59 aa, Nitrosospira multiformis ATCC 25196
MTCMGCVNSVKNVLEKIPGVSNANVSLEQQQVTIEYDASRAHTDQFREAIKDAGFEVEN

SEQ ID NO: 4721 - protein, 805 aa, Anaeromyxobacter dehalogenans 2CP-C
MSDRVETTVRGREPAAARAAAVEASPEDRRARVTINVSGMTCAACQARVQKALSGAPGVLDASVNLMTAEAAISYDPAVAAPEALIERVRSTGYGAALSEPGADALEQQDAARAKEFRELRARALVALAAGVVAMIASMPLMAAHAHHGLGAPTDPFMSWSMRVLDPVLERALPWLYAIPEQVLSYGLLALTTAVMAWAGRHFYTRAWAAFRHHSADMNTLVAVGTGAAYLLSLAATVAPGFFVSRGVPPDVYYEAVVLIIALILVGNTMEARAKRQTSVALRKLMQLQPRTARVVRGGAEVDVPVEDVREGDVVVVRPGERLPVDGEIVSGTSAVDESMLTGEPLPVQKRAGDRVIGATVNGTGSFRYRATGVGADTVLAHVVKLMREAQGSRAPIQKLADRISGIFVPVVLSLSIATFVVWFVAADAAPAVRALVAAVAVLVIACPCAMGLAVPTAVMVATGKGAELGVLLKGGEALERAHAVDTVVLDKTGTLTLGKPAVTEVRLAPGAPVDEDALVGLVAAVERASEHPLAAAIAAHATARGAAVPQVEAFESITGRGARGLAGGRRVVVGNAALLESEGVSTAPLEAEAGALAAKARTAVFAAVDGKLAGLLAVADELRPTSRDAVARLRRMGLEVVMLTGDVRRSAEAVAKAAGVERVVAGVLPEGKVAEVERLQAEGRVVAMVGDGINDAPALARAEIGIAMGSGTDVALEAADVTLMRPDLRAVADAIALSRRTMRTMRQNLFWAFAYNVVGIPVAAGVLFPAFGLMLSPVLASAAMAFSSVSVVTNSLRLRRFRGA

SEQ ID NO: 4722 - protein, 70 aa, Rubrobacter xylanophilus DSM 9941
MEKRITLRVPDMSCGHCKAAIEGELGRLPVAEASADPQTKAVEVVYDEERVDERQIRAAIEEAGYTVEAG

SEQ ID NO: 4723 - protein, 66 aa, Alkalilimnicola ehrlichei MLHE-1
MKLKVEGMSCGHCEKAVREALAAVPGVEGVVRVSAAEGEAEISGQAEPRALVAALDEQGFDACVEE

SEQ ID NO: 4724 - protein, 821 aa, Alkalilimnicola ehrlichei MLHE-1
MSTETGNARGFDLGVQGMTCASCVARVERVLGRVPGVRSVSVNLATERARVEASEGLELGALLDAVGKAGFEPVVQDLDLTVEGMTCASCVGRVERVLARQPGVISASVNLATGKARLRTLPGVAEPQALIRAVEKAGFGAVLETDETEPGGPSPAERELQQLRIAKRVALLLTVPLVMIAMGPMMIPPLAEVMHRLLPPAGWRWVEAVLATPVLFWAGARFFRHGWPALRRLNPDMNSLVMLGASSAWLYSMLVLLAPGLFPEAARGVYFEAVGVIVTLILVGRYFELRVRGRASDAIRQLLALQVREARVRREGGLVSVPLEALQPGDVVVVRPGERIPVDGEVLDGGSYVDESMVTGEPVPVEKGVGASVVGGTVNGSGSFSFRATGIGEDSVLGRIVHMVEEAQASKPPIQALVDRIAGVVVWGAIAIALVAALIWFAVGPGPHYALVTAASVLLIACPCAMGLATPMAIMVGSGRGARQGILFRRGAAFQAIAGVDTVVVDKTGTLTEGRPALTEFERHGGWSQDALAPLVAALESRSEHPVAEAIVRGLDDPGERVVEGFTAHAGLGVEGRVEGRHLQVGADRYMSRSGLDLSPFADRARALADRGRTPLYVAVDGELVALLAVADPVKSGSPEAVRALKALGLRVVMITGDNRRTAEAVARETGIEEVIAEVMPEDKAREVGALQAAGHSVVFVGDGINDAPALARADVGMAIGTGTDIAIEAGEVVLMSGDLRGVAAGIRLARRTFRTIRQNLFWAFFYNITLMPVAAGLLYPAFGLLLSPMMAAAAMSLSSILVVSNSLRLRRARLGGPLEV

SEQ ID NO: 4725 - protein, 76 aa, Arthrobacter FB24
MSPVSTTVNVSGMTCGHCVSSVSEELEALEGVETVDVDLNAGGISTVTITSDKALSRSEIGEAVAEAGYLVVANEA

SEQ ID NO: 4726 - protein, 67 aa, Acidothermus cellulolyticus 11B
MTTKTYTVEGMSCQHCVSAITAEVGKVPGVAGVTVDLAGKTVTVTGDAFEDAAIAAAVEEAGYTLVG

SEQ ID NO: 4727 - protein, 80 aa, Mycobacterium vanbaalenii PYR-1
MSTTTTTKSYAVTGMTCSHCIAAVSAELGALTGVTDVHVDLVAGGISTVTVSSDTPLTVAQVATALDEAGDYRLSTDQPR

SEQ ID NO: 4728 - protein, 803 aa, Desulfotomaculum reducens MI-1
MENQTQVTEKNNLATCTIPVTGMTCAACSARVERGLKKLQGVAGANVNLAIEKATISFDSNQTKVEDIITKIQTLGYDVPVETLELVISGMTCAACSARVEKRLNALPGVQEAAVNLATNKATVKYISGLIHATEIRKTVEKLGYKAQRANDLSQDQEGKARQKEIRYQILKFVLATVLSLPLAWMMVTEVLGWHQFMIDPWIQLALATPVQFYAGWTFYRGAYYALKSGGANMDVLVVLGTSVAYFYSLIAVLQGWKTLYFESAAIVITLILLGKILEAIAKGKTSEAIKKLMGLQPKTARVVRDGEEVDTPIDEVEVGDTILVRPGERIPVDGVVLNGLSNVDESMLTGESIPVEKGPGDEVVGASVNKQGSFTFRATKVGKDTALAQIIRMVEVAQGSKAPIQRLADRVSGIFVPVVIVIAALTFLGWYSTGATITEALIHMTTVLVIACPCALGLATPTAIMVGTGVGAEKGILIKGGEYLERAGRLDTIVLDKTGTITKGEPSLTNLFVLAPFQENEVLQAVASGEKKSEHPLGQAIIQEADERKLPLMETAEFEALPGKGIRFKLDNNLWYIGNEALAHSLHIDLSPVRAEKDKWEEDGKTVMIAVAGDDLAGLVAVADAVKENAREAIAELKEMGLEVYMLTGDQRRTALAIAKQVGIDHVIAEVLPAHKAKEVENLKGIGKVVAMVGDGINDAPALATADVGMAIGTGTDVAIESAAITLMRGDLRAIAAGIRLSRQTLRKIRQNLFWAFIYNVIGIPLAVFGLLTPVMGGAAMAFSSVSVVTNSLLLKRYNPSI

SEQ ID NO: 4729 - protein, 78 aa, Salinispora tropica CNB-440
MVTTTYQVRGMTCGHCVNAVSAEVGGLTGVEKVQVDLEAGRLTVTSQHPMEIEAVRAAVDEAGYDLVDAAPTSRPRPA

SEQ ID NO: 4730 - protein, 73 aa, Kineococcus radiotolerans SRS30216
MRSSYAVIGMTCGHCVSAVRSELSTVPGVRAVDIDLVVGGATTVTVTSDAALEHDTVAGAIDEAGYELAGQRS

SEQ ID NO: 4731 - protein, 796 aa, Bacillus cereus cytotoxis NVH 391-98
MGKTKQITIGIDGMTCSACSARIEKVLNKLDGVEANVNVAMEQATVQYDEEEQNIEAITNRIKKLGYEVRTKKVNFDIEGMTCAACSNRIEKVIGKMEGIETVTVNLAMNTATIVYKDGLLTIEAILDKIKKLGYKGKLQEDVGSTKKEEQLKKKRKQLFLSILLSLPLLYTMVAHLPFETGIPMPHFLMNPWVQLLFATPVQFYIGAHFYSGAYRALRNKSANMDVLVVLGTSAAYFYSLYEGIKTIQEPSYLPQLYFETSAVLITLILVGKYFEALAKGRTTEAISKLLSLQAKDALVIRDGNEILIPIENVVIGDSIIVKPGEKIPVDGIVLSGISSVDEAMITGESIPVEKQVGDAVIGATINKNGILTMRAEKIGKDTALASIIKIVEEAQGSKAPIQRMADIISGIFVPIVVAIAIVAFLVWYFAIAPNDLPQSLEVAIAVLVIACPCALGLATPTSIMVGTGKGAEAGILFKGGEYLEATHKINAVLLDKTGTVTKGKPEVTDVLSLQDNMLAFAASAENVSEHPLAAAIVEYGKQQGITLLPVEDFRAAPGHGIEARIEAQSIVIGTRKLMNEHGVNIGQFEEHMAAQEADGKTVMLVAIENQFAGMISVADTIKESSKEAIHEMKSAGIDVYMVTGDNQRTAEAIAKQVGIEHVYAEVLPEKKARIVEELQHNGKQVAMVGDGMNDAPALAKADIGMAIGTGTDVAIEAADVTLVGGNLKHIPQAIELSTKTMKNIRQNLFWALFYNAIGIPIAASGLLEPWVAGAAMAFSSVSVVTNALRLKRVKI

SEQ ID NO: 4732 - protein, 69 aa, Salinispora arenicola CNS-205
MITVTYQVQGMTCGHCVNSVSTEVGALPGVENVQVDLDAGRVTVTSQRPLDITSVRNAVDEAGYDLVSA

SEQ ID NO: 4733 - protein, 68 aa, Bacillus weihenstephanensis KBAB4
MEQLTLKVEGMSCGHCVNSIESNVKELNGVEQVKVQLAEGTVEVTIDSSVVTLKDIVAVIEDQGYEIQ

SEQ ID NO: 4734 - protein, 805 aa, Anaeromyxobacter sp. K
MSTPADSTVRGREPATSPGVAVEATPADRRARVTINVSGMTCAACQARVQKALSGAPGVLDASVNLMTAEAAISYDPAVAAPEALIERVRSTGYGAALSEPGADALEQQDAARAKEFRELRARALVALAAGAVAMVASMPLMAAHAHHGLGAPTDPFMSWSMRVLDPVLERALPWLYAIPEQVLSYGLLALTTAVMAWAGRHFYTRAWAAFRHHSADMNTLVAVGTGAAYLLSLAATVAPGFFVSRGVPPDVYYEAVVLIIALILVGNTMEARAKRQTSVALRKLMQLQPRTARVVRGGAEVDVPVEDVREGDVVVVRPGERLPVDGELVAGSSAVDESMLTGEPLPVEKRVGDRVIGATVNGTGAFRYRATGVGADTVLAHVVKLMREAQGSRAPIQKLADRISGIFVPVVLSISIATFVVWFVAADAAPAVRALVAAVAVLVIACPCAMGLAVPTAVMVATGKGAELGVLLKGGEALERAHAVDTVVLDKTGTLTQGKPAVTEVRVAPGAPVDEDALVGLVAAVERASEHPLAAAIAAHATARGAAVPPVEAFESVTGRGARGLAGGRRVVVGNAALLEAEGVSTAPLEADAGALAAEGRTAVFAAVDGRLAGLLAVADELRPTSREAVARLRRMGLEVVMLTGDVRRSAEAVARAAGVERVVAGVLPEGKVAEVERLQAEGRVVAMVGDGINDAPALARAEIGIAMGSGTDVALEAADVTLMRPDLRAVADAIALSRRTMRTMRQNLFWAFAYNVVGIPVAAGVLFPAFGLMLSPVLASAAMAFSSVSVVTNSLRLRRFGGA

SEQ ID NO: 4735 - protein, 68 aa, Bacillus cereus AH187
MEQLTLQVEGMSCGHCVNAIESSVKELNGVEQVKVQLAEGTVEVTIDSSAVTLKDIVAVIEDQGYDVQ

SEQ ID NO: 4736 - protein, 68 aa, Bacillus cereus B4264; identical to SEQ ID NO: 4735

SEQ ID NO: 4737 - protein, 68 aa, Bacillus cereus G9842; identical to SEQ ID NO: 4735

SEQ ID NO: 4738 - protein, 68 aa, Bacillus cereus AH820; identical to SEQ ID NO: 4715

SEQ ID NO: 4739 - protein, 798 aa, Bacillus cereus AH820; identical to SEQ ID NO: 4714

SEQ ID NO: 4740 - protein, 79 aa, Arthrobacter chlorophenolicus A6
MSTTSPTTTKVSVSGMTCGHCVSAVSEELEALTGVEAVDVDLNAGGISTVTITSAGKLSPSEIGEAVAEAGYLVVANEA

SEQ ID NO: 4741 - protein, 805 aa, Anaeromyxobacter dehalogenans 2CP 1
MSTSADSTVRGREPATSPGVAVEASPADRRARVTINVSGMTCAACQARVQKALSGAPGVLDASVNLMTAEAAISYDPAVAAPEALIERVRSTGYGAALSEPGADALEQQDAARAKEFRELRARALVALAAGAVAMVASMPLMAAHAHHGLGAPTDPFMRWSMRVLDPVLERALPWLYAIPEQVLSYGLLALTTAVMAWAGRHFYTRAWAAFRHHSADMNTLVAVGTGAAYLLSLAATVAPGFFTSRGVPPDVYYEAVVLIIALILVGNTMEARAKRQTSVALRKLMQLQPRAARVVRGGAEVDVPVEDVREGDVVVVRPGERLPVDGELVSGTSAVDESMLTGEPLPVEKRAGDRVIGATVNGTGSFRYRATGVGADTVLAHVVKLMREAQGSRAPIQKLADRISGIFVPVVLSISIATFVVWFVAADAAPAVRALVAAVAVLVIACPCAMGLAVPTAVMVATGKGAELGVLLKGGEALERAHAVDTVVLDKTGTLTLGKPAVTEVRLAPGAPVDEDALVGLVAAVERASEHPLAAAIAAHATARGTAVPQVDAFESVTGRGARGLVGGRRVVVGNAALLEAEGVSTAPLEAEAGELAAKARTAVFAAVDGRLAGLLAVADELRPTSRDAVARLRRMGLEVVMLTGDVRRSAEAVARAAGVERVVAGVLPEGKVAEVERLQAEGRVVAMVGDGINDAPALARAEIGIAMGSGTDVALEAADVTLMRPDLRAVADAIALSRRTMRTMRQNLFWAFAYNVVGIPVAAGVLFPAFGLMLSPVLASAAMAFSSVSVVTNSLRLRRFRGA

SEQ ID NO: 4742 - protein, 76 aa, Beutenbergia cavernae DSM 12333
MGRGSDMSTQTYQVTGMTCGHCESAVHGEVATLPGVTRVEVSAVTGRLVVVAEAILADDAVLAAVDEAGYSAERAE

SEQ ID NO: 4743 - protein, 132 aa, Beutenbergia cavernae DSM 12333
MPTTLTTLDVTGMTCGHCVSAVTNELETVDGVQSVTVELHAGGTSEVTVLSHAPLAEDALRAAIDEAGYDVTGVRAHGEAEEWAEEGHAQQTADDAAAGSAGVPASGGGCGCGCGTASDAGPNVVEIGKRPS

SEQ ID NO: 4744 - protein, 797 aa, Geobacillus WCH70
MGEKKHVTLHITGMTCAACSSRIEKVLNKMDGVEANVNLAMEKATIEYDPTKQSIHDIQEKIEKLGYGVATEKVMLDIEGMTCAACAARIEKGLRRMEGVESATVNLATNSAVVEYKEGITSVEAILEKIKKLGYKGQVRKEEESAGFKEEQLKQKQRQLMISIILSLPLLYTMIAHLPFDLGLPMPAWLMNPWVQLLLATPVQFYIGGPFYVGAYRALRNKSANMDVLVALGTSAAYFYSLVEAAKTIGSPHYMPNLYFETSAVLITLVLVGKYFEARAKGRTTEAISKLLSLQAKEALVLRDGKEVKVPLEQVAVGDTIIVKPGEKIPVDGIVIAGASAVDESMITGESIPVDKKEGDRVIGATINTTGTLTIRAEKVGKDTALANIVKIVEEAQGSKAPIQRMADVISGIFVPIVVGIAVLAFIVWYFFVAPGDLPKALEVAISVLVIACPCALGLATPTSIMVGTGKGAEHGILFKGGEYLEETHKINAVLLDKTGTVTKGKPQVTDVLEFQEGMLNFAVSAESASEHPLAQAIFEYGKQQQIAVKPLEHFAALAGHGIEAKIDGKRVLVGTRKLMKENNIDISRHEEKMIQLEIEGKTAMFVAIDGQLAGIIAVADTIKENAKEAIRALKQMGIDVYMVTGDNERTAKAIAKQAGIDHVYAEVLPEDKANIVETLQREGKRVAMVGDGINDAPALAKADIGMAIGTGTDVAIETADVTLVGGDLSHIPKAIELSRKTMTNIRQNLFWALFYNTIGIPVAAAGLLEPWIAGAAMAFSSVSVVTNALRLKRVKL

SEQ ID NO: 4745 - protein, 72 aa, Micrococcus luteus NCTC 2665
MTTTDLKITGMTCGHCVASVREELGEIAGVSAVDVDLNAGGVSTATVTSEGPLDPAAARAAVEEAGYTLVEA

SEQ ID NO: 4746 - protein, 755 aa, Kytococcus sedentarius DSM 20547
MSTPPVLDNSPIELDLQGMTCASCANRIERKLNKLDGVEATVNYATEKARVQAPAGYDPQLLVDEVAKAGYTASLPAPPRDETGTAGETDAAGNADPELHSLRQRVIISAALTVPVIAMAMVPALQFTYWQWASLTLAAPVIVWGAWPFHKAAWTNLRHGAATMDTLVSMGTLAAFGWSLYALFLGTAGTPGMTHPFEFTVAPSDGAANIYLEAAAGVTLFILLGRYFEKRSKRQAGAALRALLELGAKEVTVLRDGREVTVPAGELQVGDEFVTRPGEKIATDGEVVSGSSAVDASMLTGESLPVEVGPGDTVTGATVNAGGRLVVRATRVGSDTQLAQMARLVEDAQTGKAEVQRLADRISGVFVPIVIGIAVATLGAWLGAGFPATAAFTAAVAVLVIACPCALGLATPTALLVGTGRGAQMGVLIKGPEVLESTRTVDTVVLDKTGTVTTGEMTLADAVSAEGSDREDVLRAAGALESSSEHPIARAIVAGARAELGDLPTPTDFSNLEGRGVRGTVDGHRVLVGRPALLADEGMPLGAHLQEALEAAQQQGRTAVAVGWDGAARGVLVVSDTVKTTSAEAIDRLRGLGLTPVLLTGDNEAAARHIAAEVGIEEVIAEVLPQDKVDVVRRLQEQGKVVAMVGDGVNDAPALAQADLGLAMGTGTDVAIEASDITLVRGDLRSAVDAIRLSRRTLSTIKTNLFWAFAYNVAAIPVAALGMLNPMLAGFAMAFSSVFVVGNSLRLRGFRSVSA

SEQ ID NO: 4747 - protein, 859 aa, Eggerthella lenta DSM 2243
MKQTFDVTGMTCAACSARVEKATRAVPGVADVAVNLLKNSMDVAFDDGAEPSAVTVAVEAAVDKAGYGAAARVPAGASGGRQGAGSRAAQARPVADAAAEAKHVRMRLIVSAVFTIPLFYLSMGHMFGWPLPGFFLGDENVLTFAFTQFLLLLPVVFVNFKFFRVGFKTLFHGAPNMDSLIALGSTAATVYGIYAIYKIGIALGAGDLHAAHLAAMDLYFESAAMILTLITLGKYFEARAKGKTTGAIAKLVDLAPKEATRLVDGREERVAVEAVRAGDVLAVRAGEGVPVDGTLLEGSGTVDESVITGESVPVDKRPGDAVTGATVNRTGWFTMRADRVGDDTTLAGIIRLVDEATSTKAPIEKIADKISGVFVPVVIVVAVVTFAVWMLGGSTLETAMSHAISVLVISCPCALGLATPTAIMVGTGRGATNGILIKSAEALETAHDVKTVVFDKTGTVTEGAPSVTDVVPAPGVGEERLLELAVSIEGRSEHPLARAVCDYARSRHAYPLLVEDFKQVPGEGVAALVDDRPSCAGNLRMMEARNVAVGAFAEEAQRQADMGKTPLFFAQDGELLGVIAVADTVKPSSAAALATLSAMGIRTVMLTGDNERTAAAIQREVGADEVIAGVLPDGKEREIRRLSEQGRVAMVGDGINDAPALARADVGIAIGAGTDVAIESADIVLMKSDLLDVPASIQLSRATLRNIKQNLFWALVYNAVCIPVAAGALSFMGLNLNPMIAAAAMSLSSVCVVSNALRLRGWKPNLPSAAMDAPASAPIDSTVPSEPNEKETVMEKTLNVEGMMCQHCVAHVKKALEGVEGVEEAVVDLDAGTATAKLARDVPEETLAAAVVEAGYEVK

SEQ ID NO: 4748 - protein, 74 aa, Chloroflexus aggregans DSM 9485
MVTEQFRVPGVSCQHCVHAVRKEVGALNGVVQVDVDLDNKIVTVVHSDDVEITDIVMAIKEAGYDDVTPLGIAC

SEQ ID NO: 4749 - protein, 925 aa, Cryptobacterium curtum DSM 15641
MKKTFDVTGMTCAACSARVTKATQAVPGVDEAVVNLLKNSMEVTYDGNDATLAAVSAAVEKAGYGATVRGQASSEAAPSRGSASDAAQKEARHVRMRLIVSILFTVPLFYLSMGHMFSWPIPAALAGHEGMMSLALTELLLTIPVVFVNFKFFRVGFKTLIHRAPNMDSLIALGSTASIIYGIAAMYRMSAALGVGDVQAAHTAGMDLYFESAVMILTLITLGKFFEARAKGRTTDAINGLLDLAPATALRVRDGQEEEILIEQVVVGDILAVRAGAAVPCDGVVVEGTAAVDESVITGESLPVEKEAGDTVTGATVNRSGWFTMRATAVGADTALAHIVKLVDEATSTKAPIERKADQIAGIFVPAVIGVAIVVFAIWLVIGDFSAAVSHAISVLVISCPCALGLATPTAIMVGTGRGAQQGVLIKSAEALENAHDTRIVVLDKTGTITEGAPRVTDALVYEHDGWTAVETNQLTADQTRVVQAALSLEERSEHPLARAFVDYATERGVEAQPVEDFTTVAGRGVKGIVDGSFCVAGNERLLRETGVTVDAFATETKRLAEEGKTPLIVARDGKAELIVACADVVKPTSKHAIERLRAMGVKTVMLTGDDARTAAVIQREVGTDEAIASVLPEGKEERVRAFCAEGKTAMVGDGINDAPALARADVGIAIGAGTDVAIDAADIVLMRSDLEDVATSLELSRATMRNIKQNLFWALIYNAICIPIAAGALSAWGIALNPMIAAACMSFSSICVVTNALRLRGWKPSLEAASVSVDAGQLSAGQRNSDQLGDDIKVNSNIKLEGDNRSKNNSQPDDDKSKSTGQSGDSTSDSVSQSNGEGQTTQNNPENEVDRKEPTMKKTLAVDGMMCEHCVAHVTKALEGIEGVSSVKVSLADKNAVVDLAQEVPDAALVDAVVDAGYEASVVA

SEQ ID NO: 4750 - protein, 68 aa, Saccharomonospora viridis DSM 43017
MVQQTYTVTGMTCEHCARSVREEVGEITGVTDVAVDVPTGKVTITSDTEIAVDDVRNAVEEAGYTLHA

SEQ ID NO: 4751 - protein, 839 aa, Anaerococcus prevotii DSM 20548
MKERFDISGMTCASCQANVQKAVQKLGVNDVNVNLISESMIVDYDSDKINNDDIIKAVEKIGYGASLKDKDRSNDVTLKESEEMSTISRLKISFLFLIPLMYISMGPMINLPIPGFLEGRTGAVNNAFVQFLLALPVIFVNRKFFVSGFKGLVNKAPNMDTLVALGASAATIFGIFAIMRMSYALGINDNQVLDHYRHNIYFESSATILTLITLGKYFEARSKGETKSSLKHLMELAPKTARVIKDGKEFEVSIEDIKIGDTIIVRPGEAIPVDGVVTKGSSLVDQSAITGESIPVNKNPGDEVISASINKQGSFQFRAKRVGENTTISQIISLVNEANETKAPIARLADKIAAIFVPVVIVIAILTFAIWAYITKDFEFALNLMIAVLVISCPCALGLATPMAIMVATGKSAELGLLFKNAESLENLHKIDSILLDKTGTITEGKPVVTDVYTKMDEAEFISIARSIEEASEHPLSNSIVEYANDENISPREITDFHSITGMGLEAKIDGKIYYAGNIRLMNEKNISVEGFEDKSIAYSEEGKTSMYFANENKVLGLIAVQDLAKDSSIKAIEKLKAMGYHIIMLTGDNEKTAEAIRKKLDIDEKYAEVLPQDKDKVVRKLQESGKKVAMVGDGINDAPALARSDIGIAIGSGTDIAIDSADVVLIKNSLLDIVNSIRLSSKTIKIIKENLFWAFFYNIILIPVAAGILYPRYGVTLNPMFAALAMSISSVFVCLNSLRLRNFKPEEESEESKEENKLIKENKMSELNKMIVKVDGMSCQNCAKHVTEALEAVAGIKQVNVDLENKEANVEFFGSVDENEISKAISEAGYEYKGIEYK

SEQ ID NO: 4752 - protein, 117 aa, Jonesia denitrificans DSM 20603
MSTVTTLMVPGMTCAHCVSSVTRELDAVSGVENVSIELRKDAESEVTVFSDNPLDEAALREAVDEAGYEVASIAVDTQALATESGEQGDKANANEDLGLTAKGASGGGCGCGNCNCQ

SEQ ID NO: 4753 - protein, 905 aa, Slackia heliotrinireducens DSM 20476
MKQTFDVTGMSCAACSSRVDKCTRGVEGVADVAVNLLKNSMEVEYDPEATPEQIARINEEISATVDKAGYGATPRAVQAAAGGTANGKSTAQLAHEAATKNAVANEKHMRMRLILSIVFCVPLFYLAMGHMMGWPLPSVFLGHEHMMVTALAELVLVAPIIFIDFKFFSNGFKSLFHGAPNMDSLIALGATASTAYSIANMFIMANAMGQGDLESAHEAFMGLYFDSAGMILTLITLGKYFEARAKGRTTDAISKLMDLAPKTANVLRDGVETEVPVEQVRVGDVLVVRAGEGVPLDGVVLEGSASVDESAITGESVPVDKHVGDPVTGATINKSGYFTMEVQRVGDDTVLAGIIALVDEATSSKAPIQNMADKIAGIFVPAVIGFAILVFVLWMLLAAPFETALTHAICVLVISCPCALGLATPTAIMVGTGRGASNGILIKSADSLETAGRIKTVVFDKTGTITQGKPGVVDVAPANGVAASDLVALASAVESKSEHPVAQAIVEYAESQGIQPVQDTVSDFTQVPGEGVRALVGGRTCLAGNARMMASNQVALDNAEDAAERYADEGATPLFFALDGKLQGIIAAADAIKPTSARAIRELHAMGIDTVMLTGDNERTAHAIQKQAGLGKVIAGVLPQDKEREVARLSQEGGVGMVGDGINDAPALARADVGIAIGAGTDIAIESADLVLMRSDLMDVPAAIQLSRRTLRTIKQNLFWALIYNVICIPIAAGLFSWAGLTLDPMIGAAAMSFSSVCVVTNALRLRTWKPKFVTPEEPSAQVTSVQAPKASPALESAAPAPAPQPAAAPAPAAKPELPTEPEDLSAPDGTVAVKTLAVKEMMCGHCVRWVTQALQDVEGVLRADVSLSRENAVVYLNRDVPDDVLTAATDEQGYPAQVIETQAN

SEQ ID NO: 4754 - protein, 867 aa, Atopobium parvulum DSM 20469
MNQKVFDVQGMTCASCSAHVEKAANSVSGVSEARVNLLKNSMEVDYDGNPDTLKQISDAVSKAGYEATPRSDKKDSAAAIKADATDASERAVKQKRVELISSMAFAIPLFYLAMGEMMGAPVPPAVSGMNGMMNLALTELLLCIPILFICRHYFIGGFRSLLHGAPNMDSLIALGSAASFAYSVVSLYQMANAFVAGDVTAAHHAMHGMYFESAGLILALITLGKFFEARAKGHTTGAINALMNLAPKTAILVKDGVEQEVPAETVVVGDMLVVRAGQSIPVDGQVIEGEGSVDESAITGEPVPVSKTVGDFVTGATVSTGGWFKMRATAVGDDTTLAGIIRLVDEATSSKAPIERLADSIAGVFVPVVIGIALVTFVAWFGFVAPGDFAVALSHAVSVLVISCPCALGLATPTAIMVGTGLGASNGILVKSAEALEGAVRATVVVLDKTGTLTEGKPSVTDVLCAGSVSKDQLLEYAYALEQKSEHPLAQAIVTYAQEKLGKSEAGSLDVQEFSQVAGGGLTAKVGEKHLVAGNARLMEQEDINTQELISQAQQLAEQAKTPLYFALEGKLLGVIAVADKVKQTSASTIDRLRAMGVKSVMLTGDQATTANVIGKELGVDQVISDVLPSQKESYIRQFQDAGENVVMVGDGINDAPALARANVGIAIGAGTDVAIESADIVLMKSDPADVATSIELSRATMTNIKENLFWALFYNTICIPVAMGLLYPFGISLNPMIGAAAMGFSSVFVVCNALRLRTWKPKNASSVTHQDAHDTKAVIDVQSKSTNDTSVSQKEESYMKKKLNVEGMSCQHCVAHVTHALEAVEGVSKATVSLDEKSAVVELSSDVPDSALVDAVVQAGYEATIA

SEQ ID NO: 4755 - protein, 817 aa, Desulfotomaculum acetoxidans DSM 771
MIGENSMRAQSLPAENLVFKISGMSCAACARRIEKALSGIEGIAEAGVNLAAETASVKYDPNSVTVEQMMDRIKKLGFEVVTEKIDINISGMSCAACAGRIEGKLNKTGGVIKATVNLATEKAFIEYNAAQVNLADIKQVINNLGFKVVHEDSGLPVDTEKNRRQSEINRQKKLFAFSAVLSFPLFLFMLAMVTKSHHFFPAIIMNPYFQFALATPVQFGPGYFFYRDAYLTLKSKGANMSVLVALGTSAAYFYSVAVTFFGSRLGLNEVYYEAGALVITLVLLGKMLESIAKGKTSEAIKKLMGLQPKTARIIKNGQEVEIQVDEVRVGDLVVVRPGEKIPVDGIVREGISSIDESMLTGESMPVDKKTGDQVVAATINKLGTFKFEAIKVGRDTALAQIIKIVESAQGSKAPIQRMADIISGYFVPAVVAMALLTFASWYLIGTPGDFTRALVNFTAVLVIACPCALGLATPTSIMVGTGKGAENGILIRGGEHLERVHKLNTLVLDKTGTITKGKPELTDIISLYEYQGQENTLLTMAAGAEKGSEHPLARAVINAALERNLAIKEPEIFQAVPGHGVEAHIEGQKVLLGTKKLMLEHGVNVNKITSDIERLESQGKTVVILSIDEQPAGLLAIADTVKEESQAAIAALQAMGLEVWMITGDNQRTAHTIGQQVGISNILAEVLPEEKASEIKKLQSQGRIVGMVGDGINDAPALVVADVGFAIGTGTDVAMEAADITLMRGDLWGLVNSIKLSRATIINIKQNLFWALIYNTIGIPVAALGFLNPVLAGAAMAFSSVSVVSNALRLKNFKFNH

SEQ ID NO: 4756 - protein, 794 aa, Alicyclobacillus acidocaldarius DSM 446
MSEAKEIMLPIEGMTCAACAARIEKNVAKLPGVKEVNVNLASERARVVLDSDTPWSEVVSKIEKTGYSVPVREVDLHITGMTCAACAARIEKVVGRLEAVKSVHVNLASEKARVSYVPGVIDEADIIQAVEKAGYGAILASEAAETEEKERKLRAYHRDLAKFGFSVLMTVPLVVQMFVMLVGGRPFLPNWLSWLLATPVQFYVGWRFYKGAYHALRGGAANMDVLVALGTSVAYVYSTVLTLLGRSDVYFDSSATVVTLIFMGKLLEARAKAKSSAAIESLAKLGAKVAHVLREGVETDVAVEELRVGDLVRVRPGEKVPTDGVVVEGTTSVDESFLTGESMPVSKHLGDEVVGASINQTSAFVMRVTKVGRDTALAQVIRLVDQAQGSKAPVQRLADKISGIFVPVVLGAALVTLLVWGMLGHWSHGLLAAIAVLVIACPCSLGLATPTAIMVGTGLGAESGILVKGGEHLELAHRVNTVVFDKTGTLTTGKPVVTDVWSADGVEQDDVLKVAAALEAQSEHPLGRAVVAYAKEHGVEIPSASEVQSVPGYGIRGMVKGARTRVGNRTWFVDANVTIPDDVLAAFESAGKTAVLVAQDERLLGAIAIADTLKSDVQGTVKELQTMGIEVWMITGDGARTAEAIAKLAGITNVMAGVLPAEKAAKVESLRHAGRVVAMVGDGINDAPALAAADIGIAMGTGTDVALEVADIVLMHGQTHGVVDALRLSKATMRKIRQNLFWAFFYNVLGIPLAALGVLSPIIAGAAMAFSSVSVVSNSLLLRRLQIGKEVHAA

SEQ ID NO: 4757 - protein, 67 aa, Alicyclobacillus acidocaldarius DSM 446
MATTTLRVKGMTCDGCVRSVTRALTAVEGVSKVDVSLEKGEAVVTHADSTPVSAIRAAVEEAGYDVE

SEQ ID NO: 4758 - protein, 251 aa, Moorella thermoacetica ATCC 39073
MDRQSLAHFRQKLLEEKAGLEEQLDSLNSGGLGESLLESTQELSRYDNHPGDLGTEEFERGKDLALRDNVQVQLRKIEDALQSIAEGTYGYCRRCGREIPRERLEAIPETTLCLECRRKMEGKADKHSRPVEEAVILPPFGGQTTDPHQKHADEEEAVEYDGEDVWQELGRTIEHASEARSGSYFGPLDLDEDQGFVEAVENIPYFRGADGMFYEDTGAYLEDEGAPEEKVIGDAGWDRVLKGEGDREHQS

SEQ ID NO: 4759 - protein, 147 aa, Syntrophomonas wolfei Goettingen
MDYQDNLMQRKAEIEQVIKQKRDELIIPLGEWSDELSLYDQHPADIASEVTQRETNLGILEMLEYELEKVNDALSRLQNGQYGVCEACGQKIEPARLERLVNTTLCTNCARSQQKGFKRPAEEGVIAAGQMSDLGEGIQIAGYEFYE

SEQ ID NO: 4760 - protein, 206 aa, Thermoanaerobacter sp. X514
MDSEKLEHFRQLLLKEKEKVLSTINQMNLNDGIGGIAQREYYQELSLLDNHPADFASEVYEVEKNYALKDNEKYILRQIEDAFKRMEIGTYGICAHCHKPIEEERLEALPYTVLCAECAKNNDLELKDLKNSRPNEERMIKYPFGWGYKDLKGEIQFDAEDSYQEVARFNKTKSGLDNYDDVYDDENAGYVEETDKISNEDYKKTL

SEQ ID NO: 4761 - protein, 212 aa, Candidatus Desulforudis audaxviator MP104C
MGSDKVDSAKLEQLRVRLLRERAAVQREINAIQQTMDVALEDTIGELSTYDNHPADIASETFERSKDFALRENARFRLLAVEDALARMDRGTYGRCDECGVDIDLERLEAVPFTTKCRECKARAEGKDERARPVEEEVFNRPWLPPGNESVMYDREDAWQDASQDSLSTETENSEEEDRGHTEDVDAIPYVKEDGMFFQDTRVRGDTGEFGR

SEQ ID NO: 4762 - protein, 216 aa, Natranaerobius thermophilus JW NM WN LF
MTDQEIEKYRQKLLSIKADLEKHEAEGQHDNRTSIRDNVSELSSYDNHPGDLGSEQYELEKDTTLSNLREQKLREIEIALEKIANGDYGKCESCGKEINNERLDAVPYTRYCISCLGDLASNQDEHPYFEGHTHLETMSSKDENSIHFDKEDMWQKLENYGQAGGTNEDYENSDENWGAADKMDEYSIGGKDLSINPKTDPERFKRRKRRGRNDQS

SEQ ID NO: 4763 - protein, 222 aa, Desulfitobacterium hafniense DCB 2
MDTSKYARLIEQLKKDKEEAWATAQGLITGDMRESIAELSLIDNHPADIATEVYERSRDVAIHDRLHHRIQAIDSALQRYEEGKYGLCEHCQKEIPLGRLEALPFTTVCTECSRLEEMEEQHSLHRDSVEEEILDMPFARTFNDGKDQVGFDGEDSWQAVARFGTSDTLQDLGTNHDLSDPNSFYEHGDEVIGAVQAVETIEVELEPGHANTVYYGKKHGRT

SEQ ID NO: 4764 - protein, 228 aa, Halothermothrix orenii H 168
MDRTKEKKYRQLLINEKNSLLHELKHFSDDEFASVKDSTGELSSYDNHPADQGSNTYDREKDRGLRDNAQVLLNKVENALNRLEEGNYGLCEKCGQEIREERLETIPYATLCERCQAKEEGKDYNRDRPLEEENLTPPFGRGFYDETNYNAYDAEDTWQDVAQYGTSNTPQDVPEETSGTGAEAYIDSEETVGSVGFEDSIIDDEADNLEEASEKESTFTGEKGKDKK

SEQ ID NO: 4765 - protein, 210 aa, Clostridium cellulolyticum H10
MDKNQLLHYKDKLLKEAKKADTALEQMRDLDEGEMSNYTPSELSNYDNHPAELGSELYTLEMNLALKVHEQTKINDIKLALKKIDNGTYGICENCKKKINPARLEVMPTARFCMECQEDKEAEEINTPDQQYNEIFDSPFGRKYLNKQEDDEFEGLDQLNDLLKYGSADTPQDMSGYADYEEFYTNEIDNQGYVEETDKISNQQYKNQLP

SEQ ID NO: 4766 - protein, 205 aa, Anaerocellum thermophilum DSM 6725
MQPAEIEMLKKLLLEKKSEVEEYLKNTKENQVANFSSLYSNEVSNYDNHPADIASDLFEAEKNMSFKADMKRKLELIEKALSKIEKGNFGYCMSCKKEIPIERLLAIPYTEFCIECQKDIENQENYQTDQRPIEEKVLGKPFNDMFPSQGEEEHDGTDMWSILEMHSTSNGPQDEVVSDGKNYYKNINDIDDSVEEIDKISKDNF

SEQ ID NO: 4767 - protein, 231 aa, Desulfotomaculum acetoxidans DSM 771
MDRQKMQAFKETLLKEKKELEDSVHSFDERGLGISLSQATSELSTYDNHPADVGSEVFERSKDFALRDDAMLKIRAVEDALKNIEMGKYGICDICGKEIGYARLTALPRTTLCKECKEAQERIPSRNIRPAEEDILQPPFERSFNDRVSDDAGIGYDGEDAWQDVARASDHAPNAQSGSYYGGDQLLDEDRGYVQSVEDIPCVKGTDGVIYQDFVGTDDEDSPVALRTKDI

SEQ ID NO: 4768 - protein, 213 aa, Alicyclobacillus acidocaldarius DSM 446
MDTDSIRSRLEAARERLIDRLNGAETSADIRSAMPDEFSELAMYDNHPADVASELALRNQAVGERLRDERALADVEDALSRIRQGTYGQCESCGRPIPPDRLEAIPTTRRCVDCEREVEARQASARRPVEEDVLAPAFGQFDRDGADETGYDGEDALQDVMRYDRPVTGLARYDEPDLDDDAGYVESVDRISEDDYRRTLPSPAQLLTDYDEP

SEQ ID NO: 4769 - protein, 277 aa, Frankia CcI3
MSREKALVDASWVEANRNDPKVVLVEVDEDVSAYDKGHIPGAVRLDWKSELQDPVIRDFINREQFEKLLSEKGISNDDIVVLYGGNNNWFAAYAYWYFSLYGHADVRLLDGGRKKWELDSRELTTEATPRQPTSYTAPEPRTDIRAFREEVISAIGEKALVDVRSPDEFSGRLLAPAHLPQEQSQRAGHIPTAKNIPWAKTANEDGTFKSNDELTGLYTEAGVDLSRDIIAYCRIGERSAHTWFALHELLDLPNVKNYDGSWTEYGSLVGVPIEKGA

SEQ ID NO: 4770 - protein, 277 aa, Mycobacterium MCS
MARSDVLVTTDWAESNLDAPNTVFVEVDEDTSAYDTGHIPGAVRLDWKTELQDQVKRDFVDQQQFSKLLSEKGIANDDTVILYGGNNNWFAAYAYWYFKLYGHENVKLLDGGRKKWELDGRPLSSEPANRPATSYTAKQPDTSIRAFRDEVIAAIGQKNLVDVRSPDEFSGKILAPAHLPQEQSQRAGHIPTAINVPWSKAANEDGTFKSDEDLTKIYADAGLDGEKETIAYCRIGERSSHTWFVLQELLGHKNVKNYDGSWTEYGSLVGAPIELGS

SEQ ID NO: 4771 - protein, 282 aa, Nocardioides JS614
MSRETSLVTAQWVEEHLDDPKVVLIEVDEDTTAYDKGHIKGAVKLDWTTDLQDQVRRDFVNKQQFEALLSERGVANDHTVVLYGGNNNWFAAYAYWYFKLYGHQDLKLLDGGRKKWELDSRELTEERPTRAKTSYTAQEQDLSIRAFRDDTVAAIGVKNLVDVRSPDEYAGRLLAPAHLPQEQAQRAGHVPTSINVPWSKAANDDGTFKSDEELKALYADAGLDDAKETIALCRIGERSSHTWFVLKELLGHQSVKNYDGSWTEYGSLVGVPVAIGDEPGEA

SEQ ID NO: 4772 - protein, 277 aa, Mycobacterium KMS; identical to SEQ ID NO: 4770

SEQ ID NO: 4773 - protein, 277 aa, Mycobacterium vanbaalenii PYR-1
MARSDVLVTADWAESNLEAPKTVFVEVDEDTSAYDTGHIPGAVRLDWKTDLQDPVKRDFVDAAQFSKLLSERGIANDDTVVLYGGNNNWFAAYAYWYFKLYGHQDVKLLDGGRKKWELDARPLSKDAVERPQTSYTAKEPDNSIRAFRDEVIAAIGTKNLVDVRSPDEFSGKILAPAHLPQEQSQRAGHIPTAINVPWSKAANEDGTFKSDEDLAKLYAEAGLDGEKETIAYCRIGERSSHTWFVLQELLGHKNVKNYDGSWTEYGSLVGAPIELGS

SEQ ID NO: 4774 - protein, 277 aa, Mycobacterium JLS; identical to SEQ ID NO: 4770

SEQ ID NO: 4775 - protein, 277 aa, Mycobacterium gilvum PYR-GCK
MARSDVLVSTDWAESNLDAPNTVFVEVDEDTSAYDTGHIPGAIKLDWKTDLQDQVKRDFVDAAQFSKLLSERGIANDDTVILYGGNNNWFAAYAYWYFKLYGHQNVKLLDGGRKKWELDARPLSKDAVERPQTSYTAKEPDTSIRAFRDEVIAAIGTKNLVDVRSPDEFSGKILAPAHLPQEQSQRAGHIPSAINVPWSKAANEDGTFKSDEDLAKLYADAGLDGEKETIAYCRIGERSSHTWFVLQELLGHKNVKNYDGSWTEYGSLVGAPIELGN

SEQ ID NO: 4776 - protein, 277 aa, Frankia EAN1pec
MSRENALVDATWVDAHSGDPKVVLVEVDEDVSAYDKGHIPGAVRLDWKSELQDPVIRDFVNKEQFEKLLSEKGIADDDTVVLYGGNNNWFAAYAYWYFVLYGHAEVRLLDGGRKKWELDGRELTIEVTPRAATKYSASEARTDIRAFRDEVITAIGDKNLVDVRSPDEFSGRLLAPAHLPQEQSQRAGHVPTAKNIPWARTANEDGTFKSNADLEKLYSEAGVDLSKDTIAYCRIGERSAHTWFALHELLGLANVKNYDGSWTEYGSLVGVPIEKGA

SEQ ID NO: 4777 - protein, 281 aa, Actinosynnema mirum DSM 43827
MSRADVLVSAAWAEENLAAPGVVFVEVDEDTTAYEGGHLPGAVRIDWRTELQDPVRRDFVDRAGFEKLLSAKGIANSDTVILYGGNNNWFAAYAYWYFKLYGHEAVKLVDGGRKKWELDGRPLDKEVVEREATTYQAQEQDLSIRAFRDEVVEAIGAKNLVDVRSPDEFSGKLLAPAHLPQEQAQRGGHIPTAINVPWSKTANEDGTFKSDEELTALYADAGLDGSRSTIAYCRIGERSSHSWFALHELLGHSDVKNYDGSWTEYGSLIGVPVELGPGKEA

SEQ ID NO: 4778 - protein, 279 aa, Saccharomonospora viridis DSM 43017
MSREDVLVTVEWAEQNLDTPGVVFAEVDEDTTAYDSGHIPGAVKFDWKNELQDPKRRDIVDRQGFEELLSAKGIANDDLVILYGGNNNWFAAYAYWYFKLYGHEKVKLLDGGRKKWELDGRPLTTEVVERERTNYTAKEQDHSLRAFRDEVVEAINVKNLVDVRSPDEFSGKLLAPAHLPQEGALRAGHVPSAINVPWSKAANEDGTFKSNEELEQLYKEAGLDPSKPTIAYCRIGERSSHTWFALHELLGLKDVKNYDGSWSEYGSLVGVPVETGEQS

SEQ ID NO: 4779 - protein, 117 aa, Clostridium thermocellum ATCC 27405
MKAREILEILNAELLTGEENLDMEFNAACGSDLMSDVMAYVKENVVLLTGLVNPQVIRTAEMMDIKLVVFIRGKRPEEKIIQMAKEKGIAIMTTNDPMFIACGKLYSAGITERGVWD

SEQ ID NO: 4780 - protein, 116 aa, Thermotoga petrophila RKU-1
MTIEEIARIVEGEILCGNKDLNIERAVATDLMSDVLAFAEPNVLLITGLHSPQAVRTAMVVGIPAVLFVRKKDIPETIVNFAKECNITVLATNLSMFETCGRLYMKGLKPVRRAIE

SEQ ID NO: 4781 - protein, 116 aa, Clostridium phytofermentans ISDg
MTVRDVKEILGAQVISGEEFLNREAQTGCGSDMMSDVLAFVEEQCVLLTGLCNLQVIRTAEMMDVVCIVFVRGKRPDEAMIELANEREIPLLCTGHRMFTACGLLYQNGLRGGTSN

SEQ ID NO: 4782 - protein, 117 aa, Thermoanaerobacter sp. X514
MKLKEVKEILNAEVMVGEEKLEEEVFTACGADLMSDVLASRDEKAVLLTGLTNAQVIRTAEVVGDIKCIVFVRGKTPGEEILELAKKAGLVIMKTKYPLYIACGLLYSNGLTCRSGE

SEQ ID NO: 4783 - protein, 116 aa, Thermotoga RQ2
MTIEEIARIVEGEILCGNKDLNIERAVATDLMSDVLAFAEPNVLLITGLHSPQAVRTAMVVGIPAVLFVRKRDIPETIVNFAKECNITVLATNLSMFETCGRLYMKGLKPVRRAIE

SEQ ID NO: 4784 - protein, 130 aa, Natranaerobius thermophilus JW NM WN LF
MKISQIKKILQADILTGKEENSVEVAFGTDLMSDVLAFFGESDNTLLLTGLTNLQVIRTAELLDINAIIFVRGKEPKDELIKEAEECGITLLSTDYTLYEASGLLFTHGLRGINTDDNLPESPERGLDHG

SEQ ID NO: 4785 - protein, 119 aa, Dictyoglomus turgidum DSM 6724
MTLGKVREILKAQVLCGEENLNREISIVGATDLMSDALCLLEEGALLLTGLITIQVVRTAEMLDLVGVVFVRGKIPPKDVIDLARKSNLPLLSTKYPMYEACGLLYTAGFKGKKVDVDS

SEQ ID NO: 4786 - protein, 117 aa, Anaerocellum thermophilum DSM 6725
MKLTKIKELLNCRVYFEPEDLCNEEFLNACGSDLMSDVLAFVKEKVILLTGLVNPQVVRTAEMMDIKAVIIVRGKQPSEEMLKLAKEKCIALLGTDYPMFQACGILYENGLGKERCC

SEQ ID NO: 4787 - protein, 116 aa, Desulfotomaculum acetoxidans DSM 771
MISIKLHQVNELLEAEVITGEELLDLTVNYGFGCDLISDSLSFSRPDCLLLTGLTNIQIIRVAEMVEAKAIVFVRGKKPGTEIIEMSRQKKIPLMSTKRFLFESCGILYQHGLRSY

SEQ ID NO: 4788 - protein, 238 aa, Brucella suis 1330
MNKAILAVAMVLLLAGCATKPEEIGRAPDLSPVAAHLGMQNNPQFNGYPARPGKASYSLWDQRSTNFFKDPRAATPGDVLTVIISINDRANLDNKTDRERVSKGIYGGGGSFATSSITGAAAGGDMDASINTHSDSKSKGKGTIERSEDIRLQIAAIVTDTLPNGNLIIRGSQEVRVNNELRVLNVAGVVRPRDISGNNTISYDKIAEARISYGGRGRLSEIQQPPYGQQILDQFSPF

SEQ ID NO: 4789 - protein, 234 aa, Rhodopseudomonas palustris BisB18
MTLMRLPVAVTACLALAGCANNLAELGQAPAMSPIGQGLYADARAIPVEPRSRYAQNRYSLWNERRDLYRDPRASRVGDLLTVTISMNDKATLDNKTDRSRDSETKFKTNYLAEFLPWSSKGKLEANVDSQTSTKGTGKIDRTEEVKFSVAAAVVDVLPNGNLLIAGSQEVRVNYEMRVLHVGGIVRPLDITRNNTIAYEKVAEARISYGGRGRLMEVQQPAWGHQVYDQVVPF

SEQ ID NO: 4790 - protein, 235 aa, Mesorhizobium BNC1
MNKIAGTLFLLAGLAMAGCTTTEELGKPPALSPVGSGAEPTAMQAYHYPDRRQAHVSRYSLWSDRQSRLFTDPRALEVGDILTVVISINDKAKFENESERSRQATRNLGLAGTFAIGSATGSAEADADIGSGTSTVGSGATKRSEDMRLVIAAIVTERLPNGNLRISGTQEVRVNAELRVLTIAGLVRPADIGPNNTISYERIAEARISYGGRGRLTEVQQPPYGQQFLDTVLPF

SEQ ID NO: 4791 - protein, 230 aa, Bartonella bacilliformis KC583
MYLVFGIIFTSVIVTSCSYNTKDFNSVPDFSPVRADLGYAPSRTAQTYPLPPRESNYSLYRASGNSFFRDPRAMQPGDVLTVQISINDRASLNNKSDLKSDSSSKYTIGTGYSFMDRIAGSLEGESSNQSKGDGKIERQENIRLSVAAIVTDVLPNGNLIIRGSQEVRVNHELRILNIAGVVRPRDISGNNMIEYDKIAEARISYGGRGRISEIQQPPYGQQLLNQISPF

SEQ ID NO: 4792 - protein, 242 aa, Brucella ovis
MKNSMNKAILAVAMVLLLAGCATKPEEIGRAPDLSPVAAHLGMQNNPQFNGYPARPGKASYSLWDQRSTNFFKDPRAATPGDVLTVIISINDRANLDNKTDRERVSKGIYGGGGSFAASSITGAAAGGDMDASVNTHSDSKSKGKGTIERSEDIRLQIAAIVTDTLPNGNLIIRGSQEVRVNNELRVLNVAGVVRPRDISGNNTISYDKIAEARISYGGRGRLSEIQQPPYGQQILDQFSPF

SEQ ID NO: 4793 - protein, 236 aa, Sinorhizobium medicae WSM419
MRMRITAILAAGLLAGCQNQAFNEIGRAPAMSPIGSGLQYTQTPQLAMYPKQPRHVTNGYSLWNDQQAALFKDARAINIGDILTVDIRIDDKASFENETDRSRKNSSGFNLGASGESQTSDFAWSGDLEYGSNTKTEGDGKTERSEKLRLLVAAVVTGVLENGNLLISGSQEVRVNHELRILNVAGIVRPRDVDADNVISYDRIAEARISYGGRGRLTEVQQPPWGQQLVDLVSPL

SEQ ID NO: 4794 - protein, 242 aa, Ochrobactrum anthropi ATCC 49188
MKNSMNKATLTAAVLVLLAGCATKPEEIGRAPDLSPVAAHLGMQNNPQSNGYPARPSKATYSLWDQRSTNFFKDPRAATPGDVLTVIISINDRANLDNKTDRERVSKGIYGAGGSFATSSSTGAGAGGDMDASLNTHSDSKSKGKGTIERSEDIRLQVAAIVTDTLPNGNMIIRGSQEVRVNNELRVLNVAGVVRPRDISGNNTISYDKIAEARISYGGRGRLSEIQQPPYGQQILDQVSPF

SEQ ID NO: 4795 - protein, 235 aa, Methylobacterium extorquens PA1
MRPSSAAVAVLALSLGACQSDLDRLGRPPLLTPIGTGLNAPREPLPTSFGALGPRHSYHSTWSPASAALYQDPRARDVGDVITVSIAINDKAQFDNASERGRSQKSSLGFDFGYGISGLKDTATADTGIRSGTETKGQGSIDRKESLSLSVAAVVTEVLPNGNVLISGSQEVRVNNEVRVLEVAGIVRPRDISRKNTIDYDKIAEARISYGGRGRITDVQGPSLGQRVFETVAPF

SEQ ID NO: 4796 - protein, 232 aa, Methylobacterium radiotolerans JCM 2831
MKRLAAIAALTTLGACATPVQEIGRAPALSPVGLGIDPNHDAVPPLAVASQAQGYHSTWAQQSADLFQDPRAKNVGDVLTVLIAMNDKAQFDNATDRSRDSRAKTSLDLQFDLFGLTPESKNHYEVNGNSSTKGQGTIDRKEQLRLSVAAVVTHVFPNGNMLISGSQEVRVNFEVRVLNIAGIVRPRDISRRNTIDYDKIAEARVSYGGRGRLMEVQQPAVAQQVYDLVSPF

SEQ ID NO: 4797 - protein, 344 aa, Beijerinckia indica ATCC 9039
MPSFLIKNAQENPQDNLQMASIPMEAIPIEAVRAEVSPATIQKNIFWRIGLNGLLRTDSLSTNHESVPECHAYGKHKQFQSIMTNGRNAISAGARSCFSLERLIDQKISLRFSFAFVALGSVALAGCAGDIRELGREPAMSALGTGLAARVQPSATAVFQNASMTRPQSIWNGSRTDIFSDPRAARIGDVVTVMIFINDHATFGNNTDRSLEAKINTGFDYKLGLSNQTIQFKPTITSDILSSTQGQGAIDRSEKMQLSVAAVVTDVLPNGNLIISGSQEVRVNFELRLLNVAGIVRPQDIAKDNTVSYDKIAEARISYGGRGRIMEVQQPAIGQQIYDRFKPI

SEQ ID NO: 4798 - protein, 236 aa, Methylobacterium populi BJ001
MRPAPSVAAALLALSLGACQSDIAQISRPPVLTPIGSGLNAPREPLPTTFGALGARHSYHSTWSPASAALYQDPRARDVGDVITVSIAINDKAQFDNASERARSQKSSLGFDFGYGVSALKDTATADTGIRSGTETKGQGSIDRKESLSLSVAAVVTEVLPNGNVVISGSQEVRVNNEVRVLEVAGIVRPRDISRKNTIDYDKIAEARISYGGRGRITDVQGPTLGQRVFETVAPF

SEQ ID NO: 4799 - protein, 238 aa, Rhizobium leguminosarum bv  trifolii WSM2304
MNMRFPAAIAVLALLAGCQSPTAVSEIGRAPSMSPIGSGLAYGQTPQMALYPKQPRAVAQGYSLWSDSQAALFKDARALNVGDILTVDIQINDKGSFDNETNRSRKNSSGMNWDVNAQIFGWTPESKTDLTYGSDTSTDGKGKIERTDKLTLLVAAVVTGILENGNLVISGSQEVRLNQELRILNVAGIVRPQDVNAENQISYDKIAEARISYGGRGRLMEVQQPPRGQQAVDLFSPL

SEQ ID NO: 4800 - protein, 233 aa, Methylocella silvestris BL2
MERAILILTMLCLCGCAGDLRELGREPSMSPVGTGLMAEVQPTASALFLPAPKPDSRSIWSGGRADIFSDPRAAKIGDVVTINIGINDRASFGNTTDRSLDSAVGASLDWKLGLNNTRNEFKPEYLATAISKTKGEGNTDRAEKIQLSVAAIVTDVLPNGNLIISGSQEVRVNFELRLLNVAGIVRPRDISKENTISYDKVAEARISYGGRGRIMEVQQPAWGQQVYDWFKPL

SEQ ID NO: 4801 - protein, 235 aa, Methylobacterium chloromethanicum CM4
MRPSAAAVAVLALSLGACQSDLDRLGRPPLLTPIGTGLNAPREPLPTSFGALGPRHSYHSTWSPASAALYQDPRARDVGDVITVSIAINDKAQFDNASERGRSQKSSLGFDFGYGISGLKDTATADTGIRSGTETKGQGSIDRKESLSLSVAAVVTEVLPNGNVLISGSQEVRVNNEVRVLEVAGIVRPRDISRKNTIDYDKIAEARISYGGRGRITDVQGPSLGQRVFETVAPF

SEQ ID NO: 4802 - protein, 237 aa, Agrobacterium vitis S4
MIKRSAVVLMAVILTGCGNKTLEEVGNAPAMSPVGSGLRYNQAPQLASYPKQTKAVSNGYSLWNDSQAALFKDSRAINVGDLLTVNISIADKAKFKNDTSRSRKNSTSLTWSTVINLFGITPPDSSGDMSTDSNSSSDGKGSVDRSETLTLMVAAVVTSILENGNLLISGSQEVRVNHEVRILNVAGIVRPQDVDAKNTISYEKIAEARISYGGKGRLTEVQQPPVGQQVVDMFSPF

SEQ ID NO: 4803 - protein, 238 aa, Rhizobium leguminosarum bv  trifolii WSM1325
MNMRFPAAIAALALLAGCQSPTAVSEIGRAPAMSPIGSGLAYGQTPQMALYPKQPRAVAQGYSLWSDSQAALFKDARALNVGDILTVDIQINDKGSFDNETNRSRKNSSGMNWDVNAQIFGWTPESKTDLTYGSDTSTDGKGKIERTDKLTLLVAAVVTGILENGNLVISGSQEVRLNQELRILNVAGIVRPQDVNAENQISYDKIAEARISYGGRGRLMEVQQPPRGQQAVDLFSPL

SEQ ID NO: 4804 - protein, 158 aa, Rhodoferax ferrireducens T118
MRCLVKRLDTRMQANQTSYSVPAVQLPVMLVAEVQDSLLVVVHDLNRLDGLLVHTMENLMERFTCASANLADPMLVDSAALDAVRSALRAAVTELQFQDIASQLIVHTSKILQGCAYRLASESMGLEDGEAVPFVEEVPERPNPVTQDAMDAGSIELF

SEQ ID NO: 4805 - protein, 148 aa, Acidovorax avenae citrulli AAC00-1
MQSTLTGPDEPGVQLPVMVAAELQDSLLVVMRDLHRLEGLLSHATDNLLARFGEANQALSDELIKGSPELLALRTALRSAVTELQFQDMASQLIWHTTKVLQGCAFRLASEAMGSEEGEEAAPFAEMAPDRPNPVTQSEMDAGSIDLF

SEQ ID NO: 4806 - protein, 148 aa, Acidovorax sp. JS42
MQSTLNTPDGPAVQVPVMVAAELQDSLLMAMHDLHRLEGLLNHATENLLARFGEANASLTDELIGASAELADLRTALRSAVTELQFHDMATQLIIHTTKVLQGCAFRLAAETMGQEEGEDAAPLDGVVPDRPNPVTQSEMEAGSIELF

SEQ ID NO: 4807 - protein, 148 aa, Verminephrobacter eiseniae EF01-2
MPSTPTTSTGPAVQVPVMVAAELQDSLLVVMHDLQRLEGLLNHATDNLLECFGAANASLTDGVVGTWPELRAARSALRNAVTELQFQDMASQLIWHTTKVLQGCAFRLASDAMGHEEGEDAAPFAEMAPDRPNPVTQSEMDAGSVDLF

SEQ ID NO: 4808 - protein, 143 aa, Methylibium petroleiphilum PM1
MPQAQISAEPALPLLLAADLQDHLMMASNDLDRLQRLLADTCDALMQRFHGAVGQLDGGDAIDAGTVRDVRRLLGEAVTALQFQDMASQLIAHTHQRLRNCADQLARDAFGADGDGEAVIAPPPLRPNPVTQDEMDAGTVELF

SEQ ID NO: 4809 - protein, 148 aa, Delftia acidovorans SPH-1
MQSMHKPSGEPAVPMPVMVAADLQDALLVAMRDLQRLEGLLNHATQNLLDRFDETHGQLAGEALGALPELDAARSTLRLAVTELQFHDMSSQLIAHITKILQGCAFQLAAATMGVDEGEDDSLGLPAIPDRPNPVTQSEMDAGSVELF

SEQ ID NO: 4810 - protein, 153 aa, Leptothrix cholodnii SP 6
MQMSDEIDPDAPAAFPLLMAAELQDHLLTATNDLDRLQRLLTDASEELMGHFYGANSRLSGLLRDAAVLPHVDTTALHSAMQSLSGAVTALQFQDMASQLIEHTHRRLRSCVDQLAREAMGFDPEGDAVIEDAPLRPNPVTQDEMDAGSVELF

SEQ ID NO: 4811 - protein, 148 aa, Diaphorobacter TPSY uid29975
MQSTLNTPDGPAVQVPVMVAAELQDSLLMAMHDLHRLEGLLNHATENLLARFGEANASLTDELIGASAELADLRTALRSAVTELQFHDMATQLIIHTTKVLQGCAFRLAAETMGQEEGEDAAPLEGVVPDRPNPVTQSEMEAGSIELF

SEQ ID NO: 4812 - protein, 1209 aa, Burkholderia mallei ATCC 23344
MSHAVARIVRPLPSRDIWTFAGLVVLACFVWLAGPLFAFAEFRPFESGAVRAATIVALFVAWGARIAWRGWRAGQLNAQLLNQLREAAPRPAATGDPAQAQLDELRSRFDEAATLLKKVRFGEADGARKGLPRWLEQMSRQYLYQLPWYVFIGAPGSGKTTALVNSGLSFPLAEQFGRAAIRGVGGTRHCDWWFTNDAVLIDTAGRYTTHESNRALDEAEWKGFVDLLKKYRARQPLNGAMLTISVADLLGASEAERTQHAMVLRKRLLELRAQLGIRFPVYLLVTKADLLAGFAEYFGGFGRAECAQVWGFTFPLAESEAPGFELRAAFDREYRLLHQRLNDGLPELLASQTDARQREMTYLLPQQIADLQDMLGQFVAEVFSVSSFEPMPMLRGVYLTSGTQEGTAFDRVMSGIKRFLKIEGVPPAAQTGSSGRSFFLKSLLQDHIFREAALAGSNLRWHQRQRVLQIVGYAAIALLCVAVLFAWLRSYSRNRDYLDEVAARVPAVDAQIGRAKFTGAADIVQLLPVLDELSGLPNAGGVDLRHPPLAYRWGLFQGEKIEEASDAVYRRALDDVLLPIAASRMEQALRDARPDEVEYAYAALKAYLMLYDSAHYDPAFVQAVVDLEMERALPADFSSAQRSALRAHLGALFGNRVAVSPFPMNERLVADVRERLRQVPFSQRLYRQLARTLHASTASYDFSVARAVGPDASLVFRRQSGKSLADGVPGLYTRSGYRNVFAPRLPGAIDSYGREEVWVLNLGASEIPNPADAAAWARDIRQLYLNDYIKTWDDYLADIRLQRTSTLAQSIQVARTLSSADSPLTRLMVALARDTPLGDAPGGARNLASRAQDKVDEARNSLAQIFAGQPGGEAGAAAAPPASPEQIVDSHFAGLRAFAPGGGDQAASFDAVLKAIDALYTYLTATDDALRSGAAPPPSDAPARLRAQAGRLPTPVREVLDDLSNVANGSIASVEQRNVAQRAGANVGDFCRQAIAGRYPFARGAARDVAPSDFAQLFAAGGLMDDFFQKNLQTLVDTTAHPWRFNNRNAEADPSAAAMLGSFEKAAVIRDVYFGGGARTAQIKVEIVPLEMDPSISEMLLDVDGQIVRYAHGPQVPTAVQWPGTRGSNQVRLQVTEQSGATGGFTTEGPWALHRLFDRAGVSGGRGPEQMVARFAVDGKPIVLQVTASSVRNPFRLPQMESFTCPPKQ

SEQ ID NO: 4813 - protein, 1209 aa, Burkholderia pseudomallei 1710b
MSHAVARIVRPLPSRDIWTFAGLVVLACFVWLAGPLFAFAEFRPFESGAVRAATIVALFVAWGARIAWRGWRAGQLNAQLLNQLREAAPRPAATGDPAQAQLDELRSRFDEAATLLKKVRFGEADGARKGLPRWLEQMSRQYLYQLPWYVFIGAPGSGKTTALVNSGLSFPLAEQFGRAAIRGVGGTRHCDWWFTNDAVLIDTAGRYTTHESNRALDEAEWKGFVDLLKKYRARQPLNGAMLTISVADLLGASEAERTQHAMVLRKRLLELRAQLGIRFPVYLLVTKADLLAGFAEYFGGFGRAECAQVWGFTFPLAESEAPGFELRAAFDREYRLLHQRLNDGLPELLASQTDARQREMTYLLPQQIADLQDMLGQFVAEVFSVSSFEPMPMLRGVYLTSGTQEGTAFDRVMSGIKRFLKIEGVPPAAQTGSSGRSFFLKSLLQDHIFREAALAGSNLRWHQRQRALQIVGYAAIALLCVAVLFAWLRSYSRNRDYLDEVAARVPAVDAQIGRAKFTGAADIVQLLPVLDELSGLPNAGGVDLRHPPLAYRWGLFQGEKIEEASDAVYRRALDDVLLPIAASRMEQALRDARPDEVEYAYAALKAYLMLYDSAHYDPAFVQAVVDLEMERALPADFSSAQRSALRAHLGALFGNRVAVSPFPMNERLVADVRERLRQVPFSQRLYRQLARTLHASTASYDFSVARAVGPDASLVFRRQSGKSLADGVPGLYTRSGYRSVFAPRLLGAIDSYGREEVWVLNLGASEIPNPADAAAWARDIRQLYLNDYIKTWDDYLADIRLQRTSTLAQSIQVARTLSSADSPLTRLMVALARDTPLGDAPGGARNLASRAQDKVDEARNSLAQIFAGQPGGEAGAAAAPPASPEQIVDSHFAGLRAFAPGGGDQAASFDAVLKAIDALYTYLTATDDALRSGAAPPPSDAPARLRAQAGRLPTPVREVLDDLSNVANGSIASVEQRNVAQRAGANVGDFCRQAIAGRYPFARGAARDVAPSDFAQLFAAGGLMDDFFQKNLQTLVDTTAHPWRFNNRNAEADPSAAAMLGSFEKAAVIRDVYFGGGARTAQIKVEIVPLEMDPSISEMLLDVDGQIVRYAHGPQVPTAVQWPGTRGSNQVRLQVTEQSGATGGFTTEGPWALHRLFDRAGVSGGRGPEQMVARFAVDGKPIVLQVTASSVRNPFRLPQMESFTCPPKQ

SEQ ID NO: 4814 - protein, 1208 aa, Burkholderia 383
MNQAVARFVRPLPSREIWTFAGLVVLACFVWLAGPLFAFAEVRPLESGWARGLTIAVLFIAWGARVAWRSWRAGRLNAQLLNQLREAAPGPATADDPAKAQLDELRSRFDEAASLLKKVRFGQADTVRKGLPRWFDRMSRQYLYQLPWYVFIGAPGSGKTTALVNSGLSFPLAEQFGRAAIRGVGGTRHCDWWFTNDAVLIDTAGRYTTHEGNRALDEAEWKGFVDLLKKYRTRQPLNGAMLTISVADLLGASEAERTQHAMVLRKRLLELRAQLGIRFPVYLLVTKADLLAGFAEYFSSYGRTECAQVWGFTFPLAQSEAPGFDLRAAFDREYRLLHQRLNDGLPELLAAQTDARQREMTYLLPQQIADLQDMLGQFVAEVFSVSSYEPMPMLRGVYLTSGTQEGTAFDRVMSGIKRFLKIEGVPPVAQVGSTGRSFFLKSLLQEHIFREAALAGSDLRWHQKRRVLQIVGYVLLALVCVAVLVAWLRSYSNNRAYLDQIAARVPAVDAQIAGAKFSDAADVARLLPVLDALGNLANAGGVDLQHPPLAYRWGLFQGEKIDEAVDAVYRRALEDVLLPIAARRMEAALRDARPDETEYAYAALKAYLMLYDSAHYDPAFVQAVVDLEMERALPPDFSPAERTALRAHLAALFGNRVAVSPYPMNERLVADVRDRLRQVPFSQRLYRQLTLTLRPATSAFDFSVARAVGPDASLVFRRQSGKPLSEGVPGLYTRNGYRNVFAPRLAGEVDTYGREEVWVLNLGLSEIPGPNDAAAWARDIRQLYLNDYLKIWDDYLADIKLQRTATLAQSIQVARALSSADSPLTRLMVALARDTALGDAPGGARNLAARAQDKVDEARSSLSQIFAGQGSDSSASAAAPASAEQIVDSHFAGLRAFAPGSGDQAQAFSEVLKSIDALYTYLTATDDALRSGAQPPPSDAPARLRAQAGRLPTPFREVLDDLSNVANGSVATVEQRSVATRAGANVGDFCRQAIAGRYPFARGSSRDVAPADFAQMFAPGGLMDDFFQKNLQSIVDTTSHPWRFANRNADADPSAAAMLASFEKAAVIRDAYFGGGARTAQLKVQIQPLEMDPSITEMVLDVDGQIVRYAHGPLVQSAVDWPGPRGSNQVRLQVSGQAGATDGFSTDGPWALHRLFDRAAVSAGRGSDQMIARFTVDGKPIVLQVNAGSVRNPFRLPQMESFTCPPKP

SEQ ID NO: 4815 - protein, 1209 aa, Burkholderia thailandensis E264
MSHAVARIVRPLPSREIWTFAGLVGLACFVWLAGPLFAFAEFHPFESGWARALTIAALFVAWGARIAWRNWRAGQLNAQLLNQLREASPRPAAPGDPARAQLDELRSRFDEASTLLKKVRFGAADGARKGLPQWLERMSRQYLYQLPWYVFIGAPGSGKTTALVNSGLSFPLAEQFGRAAIRGVGGTRHCDWWFTNDAVLIDTAGRYTTHESNRALDEAEWNGFVDLLKKYRARQPLNGAMLTISVADLLGASEAERTQHAMVLRKRLLELRSQLGIRFPVYLLVTKADLLAGFAEYFGGFGRAECAQVWGFTFPLAESEAPGFDLRAAFDREYRLLHKRLNDGLPELLASQTDAHQREMSYLLPQQIADLQDMLGQFVAEVFSVSSFEPMPMLRGVYLTSGTQEGTAFDRVMSGIKRFLKIEGVPPAAQTGSTGRSFFLKSLLQDHIFREAALAGSNLRWHRRQRVLQIVGYAAIVLLCVAVLFAWLRSYSRNRGYLDQVAARVPAVDAQISRAKFTGAADVVQLLPVLDELSGLPSAGGVDLRHPPLAYRWGLFQGEKIEEASDAVYRRALDDVLLPIAASRMEQALREARPDEVEYAYAALKAYLMLYDGAHYDPAFVQAVVDLEMERSLPADFSSAQRSALRSHLGALFGNRVAVSPFPMNERLVADVRERLRQVPFSQRLYRQLARTLRPSTATYDFSVARAVGPDASLVFRRQSGKSLADGVPGLYTRDGYRNVFAPRLPGAIDAYGREEVWVLNLGASETPNPADAAAWARDIRQLYLNDYIKNWDDYLADIRLQHTSTLAQSIQVARTLSSADSPLTRLMVALARVTPLGDAPGGARNLASRAQDKVDEARNSLAQIFAGQPGADAGAAAASPASPEQIVDSHFAGLRAFAPGGGDQAASFDAVLKAIDALYTYLTATDDALRGGATPPPSDAPARLRAQAGRLPTPFREVLDDLSNVANGSVASVEQRNVAQRAGANVGDFCRQAIAGRYPFARGASRDVAPSDFAQMFAAGGLMDDFFQKNLQTLVDTTTHPWRFNNRNAEADPAAAAMLGSFEKAAVIRDVYFGGGARTAQIKVEIVPLEMDPSISEMVLDVDGQIVRYAHGPQVPTAVQWPGPRGSDQVRLQVTEQSGATGGFTTEGPWALHRLFDRAGVSGGRGPEQMVARFAVDGKPIVLQVTASSVRNPFRLPQMESFTCPPKQ

SEQ ID NO: 4816 - protein, 1157 aa, Jannaschia CCS1
MNPLGMWTTIRSNVQSYASVLGPRFAALIWVGAICAVIWIFGPRLPWGDTRPLEPARIRLILIAVILGLWLIYALISWLRGRKRAASEDAAITESPEAVAAGEAREEIAELRSRLRDALKMMRKHARRRFGYAYDFPWYLMMGAPGAGKTTLLQRSGLKFPLGDALRAEPVQGVGGTRNCNWWFTDRAILIDTAGRYTTQETGQARDREGFLGFLSMLRRTRRQQPINGIVLTLSLTDLLAQDPEDRLRDIRAIRQRLTETEEALGARIPVYMVLTKADRLTGFSRFFDSLGQQARKQVWGITFPYEEAQTKGTLPDIFSREYQGLLARLNAMLIERFQQETDIDQRGRIFRFPAQVSALHDALREIVEELSSGAANVSEPLLRGIYFASATQENAGPVAAIPGVPQTAAAMNRTYFVERLFREVILGEAALVGRDARVSRRRRIATGLAYGAAASLALFLLGSWTLGFSTNRQALAAIDTGLVNYEDLADTIPVRDVADADFLRVLPALDRLARTPDAFHVAEGPGLTMRRASFGMDRSARIESGHAEAYSEALGAFLLPRYMVALQNVLQDGETDEATAFETLKHYLSLAGLGPIDRDGLLAQSERLFDQLYPGSGRGPTRDALQAHMVAMLDRGTLPVLEIDEMLVEDTRARIAERSPAQRVLDLLADRPAARAIPDWTLTSAAGPRARQVFVGDGTVIDGLYTRAGYREVLLPRIGALSEVAVHEDWVRGPGTPTRATPSDIAADAVTLYYAAFESHWRAALSGLSIVPTEALSGAADLALTLASEADPLSRLARDIAARTDLITPSPIDDFDASALPFDPATAPDPYGPLRRSLEPEEDAEGNTTDALTPLVPLYDEIYQQLTRLDSPDPAAAAALASETALRDAAQSLVAEGRQLDAPIDAFVVTIAARVSEAAVGQARAAADALWQAEGYPMCDRAISDRYPFSPAASADVTLTDFTAVFGPNGLFATFFAEHLADLVNTTADPWVWSGGLAPDGDIQTALHQFQRAAQIRAAFFPNGVAEPRVELRVDLIALEQGARVALFEIGDRRSAHREDLSDEERLIWPPEDSDIARVMLLPGDRETAPTERGPWAPFRLIDRAEVTPGTDNEFQARFTVDGRAVTFNLTSGSVNNPFNLPALTAFRCPQSLAAQ

SEQ ID NO: 4817 - protein, 1181 aa, Saccharophagus degradans 2-40
MKRFFQQFTQPWFLSLLGVLLLCLIIWYIGPLIAIAEYKPLSAEWVRLSMVFVALILWGLNNLRKRTRTNQATDKLANAIAEDAKPAASKTKKVPSADEQILESNLQKSLGLLQGSGFGKDNKLYKLPWYMVIGAPGSGKTTALKNSGLNFPLQNKLGDAPIQGEGGTRYCDWWFTEEAILIDTAGRYTTQDNPQTKDSEAWLGFLARLKKARPKQPLNGIIVTVSIQDILQKTPTQKALQATAIKQRVQELNNHLNMKIPVYLVLSKLDMVAGFNSFFSDLEAQDREQAWGFTYSQFKAGDISATEEVFNNEFDLLLQRLEDRVLSRLNNEHSPQKRALIYEFPRQMRALKTEILKFVAPIFTPNQFETPIMWRGLYLLSSTQSNMASRWVTGILPPEQCAPPIDIIGIQPKTYFVNNLLKKVIFAEANLATLNDKMRARYRWIYTGLTGCAIAAFSCLAIAWSHSKTLNKDYIHEIEDQLEKYSKIDKKQNTAVRDWHNLALKLNLLRDLPTGYMLKDSQYTFKQGFGLYQGNKLGEQAETTYKKALESFFMQHLEEMLGEQLELAKNDDERLYEALKFYLMPYHSSKMDTDSFTLWVNILWERQLPNQNKQVLLSELNSHLKTALSEKVSPFPIDDTKVEMARNILIKTPLDLRVYRRLKNDYMDLHPEEFSIKSVLGKKADAMFYRKSGKALENGIPELFTYSGFHRGFNLENIKLSQRLADEQWIYGDKQEEALTEERIKEISSRVNQYYFNEYIARWDEYLNDVAIQSFGTVNRGQSVVQMLASSDQPLVKLLVQIRKHTALSEAPVISDNMKDSANQLAEEFSSSQKGRLERLVPKSAGLSNIKLPGFDVTEHFEDLNSYINTEEGLPLLQLQQALINLDDYFQNLAYSENTKQAAFDASKEWKGGSSPVVFVQRAISDAPPQIETWFSSIARDTAQVTAAATQSHMNNIWQTEVVSFYNRAIKDKYPLNPKSKRDVKLADFTKFFGPAGILDSYFVEYIEPFVDTSKHPWRWKKNIGLSTNSLELFYQAQNIKNAYFSDKSGEPEVAFSMKPHTLDHIASGFLLETAGTTIAYNHGPVRNVNVLWPGAKTDLSKIVFSLSSKGTPISARTEGEWSWFRLLDEHSKIERKKESDGLLVTFELDGIASAYIIQPASTDNPYHNKDVQKFSLPTQL

SEQ ID NO: 4818 - protein, 1173 aa, Rhodobacter sphaeroides 2 4 1
MRALRLLLAALTSRTLWTFLGLALLCGLVWQFGALVSVGETVPLASDLARGLVVGCIAVGWLLSLLAAQLRAARRNQLFVTELAAPAPAAPDPGAAAVAEVGARFRQVMAEMKRSRVGGRRFLRDMPWYLLIGPPGTGKTTALRQSGLHFPIDPGDDLQGVGGTRNCDWFFTEQAVLVDTAGRYVQQQSDPEADAAEWSGFLDLLKRHRGRRALNGVIVALSMTELLGPEPALRAHGREIRKRLSELGQRLQIRLPVYLMVTKADLVPGFETFFAPLPARGREQVWGATLAPDERPEGGAVDREARALWQELEARVGPRLAEEATLADRAEIFRFPARMAEVEAPLRVLIATLFGESRYEDSPWLRGFYFTSATQEGSPIDRMLGDLAGAFGLSAPAPPRRARGETRSYFLHDLLAKVIFPEAGLGRLDRAAEERRRWLWRGSVAGAALATAVAGLGFLLSFLGWSGAIEDQARLTADLSARLANVAARQAPTEPLDLPLALEAATAADAARTEPPSGPFALIGPSAAAEIERAGTIAYERTLANVLAPRMVALLEASMWRQVRDPDDMLGALKAYFMLTGLAPYDRDFLTGWRQEQLPQQAVLDPFPTEAARWHQLAALSLFGTQGDPIPPDEELVAAALASICTIPLAARAYGALMQDPAVTGLPDWIPGDRAGPNGARIFTRLSGKTLRVGLPGAFTFAGFHETILPLVPEVAAQATLDRTLFAGGCGGSAGASAATLEADILKLYSDDFIARWDGLLRDIRLAPLTDFATATAAMKDLASPDSALKRLLAAVVAETDLTRVPAPDAAPPEGLLKAAGKKLGKVGKLVKGAAALSAGSAPPTEPPGQAVARHFEPLKGMIAEVEGVPPRIGDAELALGALANALQTAAANPDPQAALTAQGGLATLTGGLTEVAARLPPPIGAWLEGLATDTASVTREAAIARLNARYRADILPFCRAATAGRYPFEPGSAIDVNTADFQRLFGPGGLFDGFTGDALGPWIDTTRHPWAWRADLGLDARSLAPFEAARRMRDGLFAGGIGPVMGFLLQATDLSPNAARVTLSLDGQQLVYMNAATPPVGMTWPGQNGTNLIVLSFTPLDGSAEAVTSESGAWAWLRLIGKGSLAPTAQPDLFRLRLAAGAYAARFDLRANSVENPLDLRLFGGFRCPDGF

SEQ ID NO: 4819 - protein, 1182 aa, Shewanella frigidimarina NCIMB 400
MSLKSIGKGIVDTLKSKWAITIIGFLCLALLIWFGGPLVAIAGYEPLASAATRVILLLVIVIIFGAIHFTRQLKNKKQSEKMVDSLINGEEGNSVTGDDLAKSEITVLQNKMTQALDILKNTKLTKNKSIYELPWYIMIGPPGSGKTTAIQHSGLEYPLKEKMGVDMIEGVGGTRHCDWWFTNKAVLIDTAGRYTTQDSHVKQDSRAWQGFLGLLKKYRPVRPINGVIISMGMSDLLNQTKTERNLHARAIKQRLQELQNQLGMTFPVYVLFSKSDLVAGFNEFFDDLTKEDCEQIWGITFPLNADTEDTDIVSSFNKEFHDLLLNLNARLNSRLKNERDLERRAAIYEFPKQLRLLQSSADDFLKEIFAPNAYEEAPLLRGVYLTSATQEGTPIDHLSSHLSSGIKSKAKTFAANKQRSYFIKRLLEDVIFPEKNLASTNRKHTNHNKLLRKVSVGIAAGVTLLASYVWWQSYDWNRQLIDDTYQGVTTYKTITSGGLNAKSDVITLTKGLTLIRDLPVGFGTDKPEDAYTFGLYQGDKLKQPATAAYHRALETHLMPYLQSVLSAEMDANGEHLNYLYETLKTYLMLYFPEHFDKSDVQVWFSAYIDRNIVGDVNGEVRKELNKHIDTLLSLGVRGHQYDSMTVDSARINLTMLPLVERAYQRLKSDFSNSSIPDFKLVDILSLDSLDGLVFTSGRQFNQGIPGLYTFNGFHGIFSIEKNKIIKNLTADSWVYGDELVDLDEQAKAQITQELENRYIRDYIFYWEDFLSDLAIKPYSTREEAESVTAALASPDQPIKTIITAVQKNVNLTKLPADSNNLKAAAEVAGNISDVAFRSKKARLNRLLPDTAIELDIDLPGKDVEFAFAELLKINPADIDKIQTTLRALNRNYNKLSMQSEGQGNVVNQATEESFAQLGSSLSEQLMDLPYPVKNWLSEVAYRTRSFAKSNQSQRFNGIWRSQVLAEFNRAIAGRYPFDRKSSEDVRLKDFSKFFGYGGTLDKFWDQYLASHVDTSKKPWRFKRNIGIRNDILEMYQRAEIIKEAFFEPGSKQPIVNFSLEPELLDRSVSMFLFEIDSQQLKYRHGPTRKELFTWPGPGANNETRIAFSPPNGGRSINKKYEGEWSFFKLLDELSKKRPQTKKDGKLLINLKGYNAVLKLTANSVNNPFWMANMEKFRCPANL

SEQ ID NO: 4820 - protein, 1102 aa, Pseudomonas aeruginosa UCBPP-PA14
MQSLAEVSAPDAASVATAEELATLKQRMDEALALLKRAKLGGSERRNLYELPWYVIIGPPGSGKTTALMNSGLDFPLAAQMGAGAIRGVGGTRNCDWWFTDEAVLLDTAGRYTTQDSHAQVDKAAWLGFLDLLKTQRKRRPIDGAFIAISLSDLLLGSDAERAAHAQAIRARIQELYQQLGVRFPIYVMLTKFDLVPGFMEFFDSLNREERAQVWGMTFALDDGKSAEGPLAVFDSEFALLEQRLTARLVERLQQERDPARRDLVYGFPQQFAALRECLGEFLNGVFKPNPYEERPLLRGLYFTSGTQEGSPIDRLIGSMAQSMNLDRQHLARQTGTGRSYFIERLFREVAFGERGLVGTNPKVERRRKWLTIGALSATALVVLAVTAVWIASYRANQSYIAAVDQRVDPLARGIESLSPAQRDVLAVLPQLNAVQNLAGDAPSWAEGYGLYQGDMLGEESASVYRKLLIAVFAPRLVTRIEEQLRSGGSSDFLYEGLKAYLMLGSPDHYDADFIKAWISLDWERNLPRDLSPEQRQALHAHLDALLERRPPSARLDQDLVEDLRRQLQQLPVAQRVYDRVKRQRLPKDVPDFRISDAAGRDAPLVFARKSGKPLTDPLSGFFTYRGYREVFLTASLSQAGTIAEEQWVLGRDLNDAGDAANLALDVRRLYFQDYLRQWDDLLADLTVVPITNVTQAADVLRILSGPTSPFRKLLEAVARETDLQKGDRLVAAQVKKAADGTVDKLKQRLGSLVGQEEEEGAREQPQQADSDPISAHFAELNSLVSKGEGGNEPAPIDSLLEDMNALYVQVSAMAGASGDSLLGDAKNQVAAAASRVALSAERQPPVVQGLVKNVVNSTTSSMMGSVRNQLNAAWISDVVSVYRQSLAGRYPIAAGSSRDATLEDFGHFFGAGGVMDSYFRQYLQPYVDTSASTWRWQPGAAQKLGINPGVLHTFQRAAAIRDAFFRSGGMQPAVRFELKPVTMDAAISQFILDLDGQQLTYDHGPARPVAMQWPSANGLGVVRLTVTPPPSSGRSGLTLEGPWAWFRLLDQSDLERGNSPDRFTLRLRIDGSSIACELRASSAFNPFKSRVVSGFSLPERL

SEQ ID NO: 4821 - protein, 1176 aa, Paracoccus denitrificans PD1222
MRILKAIFRFFLSRGFWTFVGLALLAAAIWFYGPLVSVGEAAPLESAEVRALCLGAILVLWLLILLVGQIRAARRNRMFVTELAAPPPLPDTPDAAAEIGGKFQEILATLARSRLGKRRFLREMPWYVIIGPPGTGKTTALRQSGLNFPIALNDDLKGVGGTRNCDWFFTENAVLVDTAGRYTDQSSEPERDAAEWAGFLDLLKRHRGRRALNGVIVALSLDELLGPEDALRRHAREIRKRLTEIAERLEMQLPVYLMLTKADRLPGFETFFGALTSAERAQVWGATLPVDALPEPEAITREFRSLAAVLEGRLDARLAEDADLPQRAAIFRFPAEFERLEAPLRLLIDTAFGESRYEQTPWLRGFYLSSATQEGSPLDRMLAGMAAGFGLAPAPVPHRAMGERRSFFLHDLLAGVIFGEAGLGLFDPRAEERRTWIWRGSAVAAALLVLLAGLGFLFNTMRQSGAVADQQRLLADLAGRLANAASRQAPTEPLDLPVALDAMTEIEAARTPVPGGPLALIGPSAAAEIEGAARLARERGLRNLLEPRMVAFLEATMWRQIRDPDFLLGALKAYQMLTGLGPYDRAWLAEWWQEVLPAFAAETPFPTEAARLWQLAALDRLGGDESRIEANPQLVEAALQAICTVPLSLRTYRALMSEPEIATLPDWIPAEKAGPLAGQVLTRLSGQTLRQGIPGAFTWQGFHGTVLPMLPGMAEAALNDRKVFAGGCAESADASAASLQADMMKLYQDDFINAWEGFLRDVRLAPIPDLATATANLKDLASPDSTLKRLLNAVVAETDLARPPEQGDSPEINPGVLKKVAGKLGLGAAARIGTKVAAAARRPGEPEPPPPGAEIARHFAPLKAIVAEVDGKPPLIADAETALGALSKELLTVQASPDPQAALLSRGGLPQLTGDLRNVAATLPDPVNAWLGAIAGDTISVTREAILAQLNARWRADVLPFCRAATGGRYPFVADSAIDVTVSDFQQLFGPGGRFDGFTNETLAPYVDTSARPWRWRADLGLDARTLAPFEQARAIRDALFPGGAGPVMAFTLEPKDLTPNAARVTLNVDGQSLVYFNAAARPMPMTWPGKDGTNLISLSFTPVDGTGEAISTETGAWAWLRLVRKAGLSPTALPEVFGLRLGIGPYAARFELRAASVENPFDLSMFGAFRCPEAF

SEQ ID NO: 4822 - protein, 1209 aa, Acidovorax avenae citrulli AAC00-1
MLRKIFSFFFNRFTLVLCGLVLLSLLVWFVGPLVYIKPYQPLESEAVRGWIIAALFGIWFLRLFIRWWRAKEMNARLLGQLARIGASDASAPEAGPGKEEVAELEKRFKEAVDVLGKTRFGQTEQGWFGRLSRRYLYQLPWYLIIGSPGSGKTTALVNSGLDFPLAAQFGKASIRGVGGTRNCDWWFTDQAVLLDTAGRYTTQESDEAQDSAAWSGFLGLLRRFRGRQPINGVLVTLSVQELLSGGDAERERLARLIGLRLAELCEGLSIKFPVYVLVTKTDLLAGFNEFFGNMTREERAQVWGFTNPYVEGQAQEDPGLQFRKEFDGLADQINRLLPQRLLAEPDLARRGQIYGLPQQFVGLRDVVQQTLSTIFASSRFKEKPLFRGVYFTSGTQEGMPFDRVLSALSRRFSVAPPAHPAGEGRAGKSYFIETLLKGVIFNEAGLTGRNAKKERQLRLLQAAGFFALAAGLAGATIAWTISHGNNQKYLDEVAAKVPTLKQAVEESRDADPENMVALLPLLNHAEALAVSQRYTGDSPPLSWRYGLLQVPKVQTAADATYMRLLEDAWLPRLARHLRNSLQQASTANPEASYEALKVYLMLYDPERFNPRVVKAWMLNEWEATLPPALVQSGMLDQLAHHLDRLMEDRALVSPIPIDQPLVDEVRQRLAQLSPAQRAYSRLKQLLTTGTALPPDFTLVRAAGPEAPQVFTRRSGKPLTQGISGLFTYDGYYGVFSHELPKVTSLLAQEETWVLGKAQGQRSVANEVMTGQLALEVKRLYLMEYAKVWEDFLADVRPVQVASLDQAGEQARLYSSANSSLEQFIRAVAKETTLGQKPGAGGSSTSSWLGEKINRIKEEQEQLSRLTGKRVNIGGLAASTNLEADLVDFRFREYRRLATSNGSGPAPIAASLQVLNEAAAVISSARQQISAGGTVPPSLSPALERVRMEAKRVPPPLNTMYEDLASSTSAMVGRDVRATVGSNLNATIGTFCRRAIGGRYPFTKGSASDVTSDDFASLFSPGGMMDEFFRNTLQPMVDISTTPWRFRQGVDGTPVGGSAALASFQRAATIRDVYFRAGGKVPSIRMDIKPLEMDASISQMVLDIDGEVLRYQHGPQIPKSMAWPGTRGTGQVRLQITGGGAENTGLVTEGPWAVHRFFDKAQILPGSTPERFVAAFDIGGRKLRFEVTTGSVLNPFRLKAMEEFACPGNL

SEQ ID NO: 4823 - protein, 1209 aa, Burkholderia mallei SAVP1; identical to SEQ ID NO: 4812

SEQ ID NO: 4824 - protein, 1173 aa, Rhodobacter sphaeroides ATCC 17029
MRALRSLLAALTSRTLWTFLGLALLCGLIWQFGALVSVGETVPLASDLARGLVVGCIVVGWLLSLLAAQLRAARRNQLFVTELAAPAPAAPDPGAAAVAEVGARFRQVMAEMKRSRVGGRRFLRDMPWYLLIGPPGTGKTTALRQSGLHFPIDPGDDLQGVGGTRNCDWFFTEGAVLVDTAGRYVQQQSDPEADAAEWSGFLDLLKRHRGRRALNGVIVALSMTEILGPEPALRAHGREIRKRLSELGQRLQIRLPVYLMVTKADLVPGFETFFAPLPARGREQVWGATLAPDERPEGGAVDREARALWQELEARVGPRLAEEATLADRAEIFRFPARMAEVEAPLRVLIATLFGESRYEDSPWLRGFYFTSATQEGSPIDRMLGDLAGAFGLSPPAPPRRARSETRSYFLHDLLAKVIFPEAGLGRLDRAAEERRRWLWRGSVAGAALATAVAGVGFLLSFLGWSGAIEDQARLTADLSARLANVAARQAPTEPLDLPLALEAATAADAARTEPPSGPLAFIGPSAAAEIERAGTIAYERTLANVLALRMVALLEASMWRQVRDPDDMLGALKAYFMLTGLAPYDRDFLTGWWQEELPQQAVLDPFPTEAARRHQLAALSLFGTQGDPVPADEELVAAALASICTIPLAARAYGALMQDPAVTGLPDWIPGDEAGPNGARIFTRLSGKTLRVGLPGAFTFAGFHETILPLVPEVAAQATLDRTLFAGGCGGSAGASAATLEADILKLYSDDFIARWDGLLRDIRLAPLTDFATATAAMKDLASPDSALKRLLAAVVAETDLTRVPVPDAAPPEGLLKAASKKLGKVGKLVKGAAALSAGSAPPTEPPGQAVARHFEPLKGMIAEVEGVPPRIGDAELALGALANALQTAAANPDPQAALTAQGGLATLTGGLTEVAARLPPPIGAWLEGLATDTASVTREAAIARLNARYRADILPFCRAATAGRYPFEPGSAIDVNTADFQRLFGPGGLFDGFTGDALGPWIDTTRHPWAWRADLGLAARSLAPFEAARRMRDGLFAGGIGPVMGFLLQATDLSPNAARVTLSLDGQQLVYMNAATPPVGMTWPGQNGTNLIVLSFTPLDGSAEAVTSESGAWAWLRLIGKGSLSPTAQPDLFRLRLAAGAYGARFDLRANSVENPLDLRLFGGFRCPDGF

SEQ ID NO: 4825 - protein, 1209 aa, Burkholderia mallei NCTC 10247; identical to SEQ ID NO: 4812

SEQ ID NO: 4826 - protein, 1209 aa, Burkholderia pseudomallei 668
MSHAVARIVRPLPSRDIWTFAGLVVLACFVWLAGPLFAFAEFRPFESGAVRAATIVALFVAWGARIAWRGWRAGQLNAQLLNQLREAAPRPAATGDPAQAQLDELRSRFDEAATLLKKVRFGEADGARKGLPRWLEQMSRQYLYQLPWYVFIGAPGSGKTTALVNSGLSFPLAEQFGRAAIRGVGGTRHCDWWFTNDAVLIDTAGRYTTHESNRALDEAEWKGFVDLLKKYRARQPLNGAMLTISVADLLGASEAERTQHAMVLRKRLLELRAQLGIRFPVYLLVTKADLLAGFAEYFGGFGRAECAQVWGFTFPLAESEAPGFELRAAFDREYRLLHQRLNDGLPELLASQTDARQREMTYLLPQQIADLQDMLGQFVAEVFSVSSFEPMPMLRGVYLTSGTQEGTAFDRVMSGIKRFLKIEGVPPAAQTGSSGRSFFLKSLLQDHIFREAALAGSNLRWHQRQRALQIVGYAAIALLCVAVLFAWLRSYSRNRDYLDEVAARVPAVDAQIGRAKFTGAADIVQLLPVLDELSGLPNAGGVDLRHPPLAYRWGLFQGEKIEEASDAVYRRALDDVLLPIAASRMEQALRDARPDEVEYAYAALKAYLMLYDSAHYDPAFVQAVVDLEMERALPADFSSAQRSALRAHLGALFGNRVAVSPFPMNERLVADVRERLRQVPFSQRLYRQLARTLHASTASYDFSVARAVGPDASLVFRRQSGKSLADGVPGLYTRSGYRNVFAPRLPGAIDSYGREEVWVLNLGASEIPNPADAAAWARDIRQLYLNDYIKTWDDYLADIRLQRTSTLAQSIQVARTLSSADSPLTRLMVALARDTPLGDAPGGARNLASRAQDKVDEARNSLAQIFAGQPGGEAGAAAAPPASPEQIVDSHFAGLRAFAPGGGDQAASFDAVLKAIDALYTYLTATDDALRSGAAPPPSDAPARLRAQAGRLPTPVREVLDDLSNVANGSIASVEQRNVAQRAGANVGDFCRQAIAGRYPFARGAARDVAPSDFAQLFAAGGLMDDFFQKNLQTLVDTTAHPWRFNNRNAEADPSAAAMLGSFEKAAVIRDVYFGGGARTAQIKVEIVPLEMDPSISEMLLDVDGQIVRYAHGPQVPTAVQWPGTRGSNQVRLQVTEQSGATGGFTTEGPWALHRLFDRAGVSGGRGPEQMVARFAVDGKPIVLQVTASSVRNPFRLPQMESFTCPPKQ

SEQ ID NO: 4827 - protein, 1209 aa, Burkholderia pseudomallei 1106a; identical to SEQ ID NO: 4826

SEQ ID NO: 4828 - protein, 1171 aa, Pseudomonas mendocina ymp
MKAFFNFCVRWLVPILGLIALSLVIWFVGPLIAIGGFEPLASASVRWILIALLFLIWIGFRVLRLIQTRRNAAKVMQGLVAVAPDAASVATAEELATLKQRMDEALQLLKKAKLGGQERRNLYELPWYVIIGPPGSGKTTALVNSGLNFPLAEHMGGGAIRGVGGTRNCDWWFTDEAVLLDTAGRYTTQDSHAEVDKAAWLGFLDLLKNQRKRRPIDGAFIAISLSDLLLGSESERAAHARSIRARVQELYAQLGVRFPIYVMLTKFDLVPGFMEFFDDLGKEERGQVWGITFPLDDGKSGEGPLAGFKQEFAALEERLTQRLVERLQQERDPNRRDLIYGFPQQFAALRDNLASFLDGVFKPNPYEERVLLRGVYFTSGTQEGSPIDRLIGAMAQSMNLDRQHLARQTGTGRSYFIERLFREVAFGERGLVGANPKVERRRKWITRGALAASVLLFVAVASVWLVSYNANQAYIAEVDARVAPLKGQLEALSPAQREVLAVLPLLNAIRHVADNPPSWAAGFGLYQGDMLGAEAGSVYRKLLIAVMAPRLLTRIEEQLRSGGNSDFLYEGLKAYLMLASADQYDADFIKAWINLDWDQSLPRDLAPDQRLALGEHLDALFARKPPPARLDENLIEDLRRQLQQMSVAQRVYNRVKRQKLPDGLPDFRISEAAGRDAALVFTRKSGKPLNDPLSGFYTYRGYRQVFMVASLSQSGALAEEQWVLGRPLADNQDAATLALEVRNLYFQDFLGQWESLLGDIDFVAIISVAQAADVMRVLSGPNSPLKQLLEAVARETDLQQEDRLLADKLKAADGTVDKLKQQLGSLVGQGAQNQPQAAPQVDPITARFNELNSLVRKPEGSNSAPIDDLLAQFNELYVQLSAMSGASGDALLGEAKNQAVASAQRVKLAGERQPPLVQNLVNSVVSATTNSMMGGIRSQLNAAWVAEVVNVYRQSLAGRYPLDSGSTRDATLEDFGNFFGVGGVMDNYFRKYLQPYVDTSATTWRWQPGAAERLGIGSGVLQTFQRAAAIRDAFFRSGGTQPTVRFELKPVAMDAAISQFILDLDGQQMTYDHGPSRPVAMQWPSPNSLGVVRLSITPPTSAGRSGLTLDGPWAWFRLLEQSDLTPGASPDRFTLRLRVDNASVACELRASSAFNPFRGRVLSGFSLPERL

SEQ ID NO: 4829 - protein, 1175 aa, Acidiphilium cryptum JF-5
MSARLVRWLLSGVGAAIIAALVWFFGPFLAVLAGILPRAAIAVLVFVIWLAANLWLDRRARKKAAAVEEAITETQADPEAGMRAEEVAALADKMKKALGILARARGRRGFLYEQPWYVIIGPPGAGKTTALLNAGLNFPLAAELGQGAVAGVGGTRYCDWWFTDQAVMIDTAGRYTTQDSSASVDQAGWHGFLDLLRRTRPRQPLNGVIVAIALSDIAQADAAARAAHARAIRARIKEINTRLGVTVPVYALFTKADLIAGFTEFHDDLDTAGRAQVWGMTFPPDRTPAGMAGRFAAEFRELVGRVEERMLDRLAAERSPDRRSLIAGFPMQVASLQAPLEAFLNEAFAGSQLDPAPWLRGVYLCSGTQEGTPIDRLTGALARSFGIDQRRAPSLRPQSGRSYFLGRLIGEVIFGEAMLGSADRSGARRRLALRGAGFGAVGLVFVVLLAALFRSHADNAAAIARARAGLAAEQKVAAQIRLDPVASADLSRIAPLLREARDLAGAPPERGYHGIGLDQGASIRAATAAVYRNVLDHALLPRLVLQLEAEMRGGLDRPDFLYQATRVYLMLGNQGPLDASLVEAWMKLDWRRLYPGFGQTALRHSLMRDLTALLARPLPDVPLDGQLIATARATFSRVPIAERVYSRIRDSEAASRVPAWTPAAALGAAGTPYFVNATGKPLTDGVPGFFTKRGFYTVLLPALTHATQDVARESWVLGAQDRIKPDSPQMQSLEQDVIRLYDTAYARHWQSMIDDLNIAPLGSAGQAVQALYVLGSPQSPMVRLLSSMADELTLTKPPKDLAKAAKGATGAEAKLRAPAKLNEAATRLKQLLGPQASGAPAPKPGAAINAEFAPLRNYVGNGAAGSPLSLTLQLIDQVQKQLATLAATAPGAAGPASPAAGGDAAQLLAGEAQHDPQPVSRWLGAIVATSNSLRGGSAAAAAAAAFKAPGGAAALCEKAVTGHYPFDASAASGIPLADFARLFAPGGVMDNFFNTQVRPFVNMTGQVWTVQPVNGVAPPVSQGAVAEFQRAQEIQQMFFLGGTQPSVQFTVTPAGLSAGAAQVVLQLGGVDVSYAHGPTVPTSVNWPGATGMQTARLIITPAAGGTPVTLQASGPWAVFRLFGMGRLTRDGSSARYTLTFDQGGMQARFTLEAGSIFNPFAPGVLNDFRCPSLKG

SEQ ID NO: 4830 - protein, 1176 aa, Pseudomonas aeruginosa PA7
MKGFLNFFTRWVVPVLGLLALSLVIWFLGPLLRLGNYEPLASATSRWVLIALLFLVWIGFRVLRIVQARRNAAKVMQSLAEVSAPDAASVATAEELATLKQRMDEALALLKRAKLGGSERRNLYELPWYVIIGPPGSGKTTALMNSGLDFPLAAQMGAGAIRGVGGTRNCDWWFTDEAVLLDTAGRYTTQDSHAQVDKAAWLGFLDLLKTQRKRRPIDGAFIAISLSDLLLGSDAERAAHAQAIRARIQELYQQLGVRFPIYVMLTKFDLVPGFMEFFDSLNREERAQVWGMTFALDDGKSAEGPLAGFASEFALLEQRLTARLVERLQQERDPARRDLVYGFPQQFAALRECLGEFLNGVFKPNPYEERPLLRGLYFTSGTQEGSPIDRLIGSMAQSMNLDRQHLARQTGTGRSYFIERLFREVAFGERGLVGTNPKVERRRKWLTIGALSATALVVLAVTAVWIASYRANQSYIAAVDQRVDPLARGIESLSPAQRDVLAVLPQLNAVQNLANDAPGWAEGYGLYQGDMLGEESASVYRKLLIAVFAPRLVTRIEEQLRSGGSSDFLYEGLKAYLMLGSPDHYDADFIKAWISLDWERNLPRDLSPEQRQALHAHLDALLERRPPSARLDQDLVEDLRRQLQQLPVAQRVYDRVKRQRLPKDVPDFRISDAAGRDAPLVFARKSGKPLTDPLSGFFTYRGYREVFLTASLSQAGTIAEEQWVLGRDLNDAGDAANLALDVRRLYFQDYLRQWDDLLADLTVVPITNVTQAADVLRILSGPTSPFRKLLEAVARETDLQKGDRLVAAQVKKAADGTVDKLKQRLGSLVGQEEEGVREQPQQADSDPISAHFAELNSLVSKGEGGNEPAPIDSLLEDMNTLYVQVSAMAGASGDSLLGDAKNQVAAAASRVALSAERQPPVVQGLVKKVVNSTTSSMMGSVRNQLNAAWISDVVSVYRQSLAGRYPIAAGSSRDATLEDFGHFFGAGGVMDSYFRQYLQPYVDTSASTWRWQPGAAQKLGINPGVLHTFQRAAAIRDAFFRSGGMQPTVRFELKPVTMDAAISQFILDLDGQQLTYDHGPSRPVAMQWPSANGLGVVRLTVTPAPSSGRSGLTLEGPWAWFRLLDQSDLERGNSPDRFTLRLRIDGSSIACELRASSAFNPFKSRVVSGFSLPERL

SEQ ID NO: 4831 - protein, 1212 aa, Serratia proteamaculans 568
MLSTLFSIITSRLLWGFAGITALAFIIWMIGPLVAIGDYRPLEPALNRQLTIGAIYLIWFLCRIIPRIYSAWFNRRLLSNLRAAEEVPAENGKPVAKQDEQLAQRFDEAAQLLKKARFAPGQGDSKHRWMTHFSSQYLYQLPWYVIIGAPGAGKTTALVNSGLHFPLADRFGKSALRGVGGTRNCDWWFTNDAVLLDTAGRYTTQESQREEDADEWKSFVGLLKKYRTRQPINGVMVTISIADLLSESSEARAAQASSLRKRLIELHEQLGIHFPVYVLVTKTDLLNGFMAYFNGFDKAQREQIWGFTFPYEASRQPDFNLNATFEQQYALLQQRLDAALPETLLVEHDGRQRAESYLFPQEFAALRPLLGQYLEQVFATSSFETRFTPRGIYFTSGTQEGLPFDRVMGELNRYLQLPTANSQPHANPAWNHVDPAAPIPAGKGQSFFLKDTLESVIFQESGLAGSNRWWEYRNRAVHWAGYILLAACLAILAIFWFTSYSNNKAYLAEVAAKVPGVERQGLGLTQLGNGDMLSLLPFLNSVLHLPDSQNFSLEDPPFTYRMGLYRGDQVSDASDSLYQKALKELLLPQVAQQIATTLRNDNHGDADFSYEALKAYQMLYLPKQYDGKFLRAWVMLNLQRNLPQGSTQKQLQQIEWHLSQLLDEQIQASPYAKDEPMVEQAQAALNRAPLSQRVYGRLKRLLLKQTEIKPVSLVDLAGPQTELAFSRKSGKPVTDGVPGLYTSRGYWKTFNDNIDPVTDTLRQEDVWVLNSKTPDQKNADLIKTIRQLYMQDFINAWDELLGDIQLANIGNLSQRISSARLLSGNPSPMRNLLVNVSKNVTLRDEKSTADSRSLLDKTEDRLSQSANHQLEALFTHRPANADGDVSAQPEQLVMAHFAALLELAQSQGEGNKAIPFDSVLKQVDELYSYLTAVQGAANSGMSAPPSDIIPRLQAESGRLPVPFKQMLLSLAIGASSDTQRKEMENVKKRISVEVGSFCRQAIAGRYPLVARARQEVTPDDLARMFAPNSGLMDSFFRDNLQGKVDTTRANWRFTPGVDGKTLPGGEGILRSFQQAQRIRDAFFANGTATPSYRVTVRPVRMDNDILNLTLDIDGQLFKYSHGPQVPLVISWPGTRNTNQVHLQLALANGSTASLVTSGPWALNRLVDMAQTSAGSSSLGRQATFNLDGHRVTLEFTPNSIRNPFQLPAFSCP

SEQ ID NO: 4832 - protein, 1218 aa, Delftia acidovorans SPH-1
MIRRIASWLFNRYMLELLGLVALSLLIWFVGPLVFIQPYQPLGSPTVRWWIIAGLFILWFLRLLLRWWRAQRMNEHLMTGLARLTSPREADGTPAAGSEEVAELESRFKEALDTLSKTRFGQTEGGLFGRWNKRYIYQLPWYLIIGSPGSGKTTALINSGLDFPLAAQFGKRAIPGIGGTRNCDWWFTDQAVLLDTAGRYTTQESDAEQDKAAWKGFMQLLKRFRGRQPVNGVIVTLSVQELLSASDAERAQLAQLIGLRLSELCEELTIRFPVYVLVTKSDLLAGFNEFFGAMSREERAQVWGFTYPYDEKTQRSPASDPQAASALYMEEFDALVAQINRLLPQRLMTEPDLARRSLLYALPQQFAGLKDVVRDTLDAAFSASRFKEKPLLRGVYFTSGTQEGMPFDRVMSALSRRFALRGRLPADAVPQQGRSYFLESLFKDVMFNESGLTGRNAKKERQLRLMQAAGLCALLLALGGAALAWTLSYENNQRYLNEVADNAGTLRQAVEESKATDPDNVVALVPMLNHAARVAQSSRFEESAPLGWRWGLLQVPKVQTAAHATYLRLLEDAWLPRLSSHVARSLRQVSTGSPEASYETLKAYLMLYEPDHFDATFVKAWLRSDWENTLPQHLVQAGLVDQLSEHLDRLIDGRVVVSAQPIDANLVAEVRQRLAQMSPAQRAYSRLKQLLNTGDKLPPDFSVVRASGPEAPQVFARASGKPLTQGISGLFTYDGYHGLFLHELPKVTTLLAKEETWVLGQAEGRRSVAQEVLTGQLANEVKRLYLMEYARLWETFLADIRPIRTASLEQAGEQARLYSSANSSLEQFIRAVARETTLARRPDQQEGGGSGSTSSWLGEKLQRIREEQHQLSRLTGKPLNVGGMLATGTLEADIVDFRFREYRRLATSNGSGPAPITASLQVLNEAAAVIASARQQVIQGGGVPPSLSGTLEKVRSEAKRVPPPLNSMYEALATSTSSFVGSSVRSTLGGNLNATIGDFCRRAILGRYPFTRSATRDVTTDDFARLFATGGTMDEFFRTQLQTMVDISTVPWTFKQGVDGTPVGGSASLAAFQRAASIRDVFFRAGGNTPGIRLEIKPLDMDASISQMVLDVDGEIVRYQHGPQIPKAVSWPGTRGTGQARLQITAAGAQNTGIVTEGPWALHRLFDRAQILPGNSPERFTAIFTIDGRKLRMEVTTSSVLNPFRLKAMEEFECPDRL

SEQ ID NO: 4833 - protein, 1220 aa, Leptothrix cholodnii SP 6
MKTLLGWIFNRWTLAVVALLALSLLIWIVGPLIAVAEVRPLDSTRSRLMLIGCLVLALLLMAAWSAWQARRANRSVVEQLMKPAAGGAPAGSESPDVAAMRQRFERALQVLREARFPSASTAAGGAPVGAIDARGKPAAPKPGLLARLGLQNLGGRYLYQLPWYLIIGAPGSGKTTALRNAGLQFPLAELTGEHRVRGVGGTRDCDWWFTDRAVLIDTAGRFTTQDSDAGRDQGAWSGFLGLLRQSRPRQPINGVLVTVSVPDLLGRSAAERDDYAARVRLRLQELHKQLGVRFPVYLLVTKVDLLNGFGDYFATLDKDSRATPWGTTFTLAQSRSGDHTALAPELKALTQRLQDGLVERLQAETDPQRRARIYGFPLQFGSLHEPLDAFVRDAFAPSPFEPPSLLRGVYFVSGTQEGTPIDRLMGSIARSWQLERAILPPQGASARSYFLERLLGEVVFAEAGLAGTDPRGERRRRLMLVGAYAALGLLTAGALAAWATSAVNNRNYVDAVLARVDEVRRLVQATPNRASPDLQPLLPALAATRQLAQAGWGDAAVPWSLGFGLFQGDKLDAASRSAYQRMLVDAVLPRLALRIEEQLRQRADAPELQYESLKAYLMLHDPQRFDADALAALVRADWAQNLPREVGTAEREQLDQHLDALLALGPAVSPLPQDQALVTQTRALLAAVPLPQRIYNRLRHQGLGEQVAEFTAARAGGPAAALVFARASGAPLTRGVPGLYTRDGYQQGFQRKVDAVTRELADEETWVLGNAANGGGGAAGQATRPSAATLADDVRRLYLTDYANTWEAFIADVRLRPTQSLAELVQVTRVLSGPDNPLATLLKAVVRETTLLGGEEPGAVKAAADRARGAVAAVREGIRALGGDAAAAALPARGVPLESIVDDRFAMLRRYVQAAPGARAPIDDTLVLLNEVQLHLASVELAVRSANPPPPSDLPVRLGAEGARSAEPVRSLLGTLGRSSAGFTGLMQREVLSREVRSMVGDFCTQAVAGRYPLRSGSATDVTLADFGQLFGPGGRFDRLFQEKLAAHVDTSARPTWRFRANGLGEDAGTLAQFQRAQVIRDTFFPAGGNTPQLRLEFKPVEMDASISQFVLDIDGQVVRYAHGPQIPTSVQWPGPRGTNQVRLQLSPAGASGNGLLNEGPWALLHLFDRVQLEPGRSAERFRATFELDGRKAVFEITASSVRNPLRLRELAEFSCPNGL

SEQ ID NO: 4834 - protein, 1152 aa, Xanthomonas oryzae PXO99A
MRFVLDFLRVRYLASAAILSLLALLVWVGGPYLSLGRWQPFASVSGRLLAMAVLVLAWAGWRYLRWRRDSAKQQRLAAELVGQGARAEDASGNDSRARAAHEQVRLRARFTEAMAVLRRRRRNGPGLHVLPWYLLIGAPGSGKSTLLQSSGLEFPLKAHGTHAALEGVGGTRNCDWWFADQAVFLDSAGRYTTQDSDAIADAGAWHGFLDLLRRHRRQPLNGVIVTVSVAELLELDGDAGLSHARAVRHRLNELVEKLRARVPVYLIVTKCDLVSGFAEFFADLDAAGRAQVWGVSFPQAQAAGDTDPLTRFPTELERLLERIDQRVLERLHRARDARERAAVLSFPQQLRLLQPALMDVVQTAFGRHGYAGQPWLRGVYLSSGTQQGHPIDHVISAVAQHFGVAAAGLPPVSSAPRSYFLSRLLKDVVFAEAGLAGSQPGSAQRRRLLQLACWAVLTATTLGVLSGMAGSYARNVRLIGQVRDALDAYPAGPLPADAGEAAFYAKALQRFDALAQARDAALPPGASIPWSRRFGLHQGTALARDVQEAYLRDLNGALLPALAQSLRRKLEQSSNDPQRLYPLLKGYLMLGDPTRRDAMHLATLAGTVWRQIFPDDASVRAGLNLHLRALLGPVDGARALALDRQQIEQTRASLRTAELPALVYGGLKLTQPGVDAGQAPRLDRRLGLLSDVFERRSGLPLSAPLPPLFTRQAFQAQIGGGIAHGVQQFLADDWVLGTAPLDPLARSQLEREVLALYQRDYIAAWDSLLADLVLRPVVQTGQASAVAAKLGGPASPLKALLVLLREHTHALGRTPAAKAGAGAAAAADTAAAAEPDVAAEPIERHFEPLTRLLDGGPGASALDETLAALTQMSRTLLGAAAGVAADQNAPALLIAAQQAEQLPPPLGNWMATLSGRGRALTASSAGEALRNAQRQAAGRECALLVSGRFPFVPGSNNEIPLRDFAELFAPGGRMDRFAQQALLGKVDTSGPGWKWNAGMAAAGADDVLARAQLADEIKQAFFAGGGAQPQVAFTVSIPPQAGIRRLQLEVDGQALDVRDGARATQSMTWPGPTPGLVRLAAWDASGQALPVVEYRGPWAWFRVMQAGRLHRSGDLDYTASLALGGTSVRVDIQPASLRHPFAASAVQRFSCP

SEQ ID NO: 4835 - protein, 1181 aa, Methylocella silvestris BL2
MNKEIIRIIAYGVGLSSIAAVVYLAGPMIEIGGVRPLENSIVRDIIIVVLVAAAAGLAGFTFWRRKKNAAEIEKGIAEGGAPDSDAEVLGERMKDALATLKNASKGATKGAYLYELPWYLLIGPPGAGKTTALANSGLKFPLSRGATPAAVAGVGGTRYCDWWFTEDAVMIDTAGRYTTQDSDARADQKSWLAFLDLLKKNRPRQPINGVIVAIALSDIMTETQAQIEAHAQAIRSRLIEVNKQLKVDFPVYVLFTKADLISGFREFFGSLNENARAQVWGATFQTADKKLNLVGEVPAEYDSLIARLNEWTTDRLQEEPVPSTRASLFGFPAQVAALKKPVFNFLNLIFEPTRYHANATLRGFYFTSGTQEGTPIDQLIGALSRSFGAREVAANAYSGRGQSYFLKNLVGKLIIGEAAWVSTDRAAVFRARLIKGVALGLLALVCAGLSLAWFGSYQRNSDLIVRTQAGAADFRTVAGPLATEPEISDRDLAKILPPLNKLRFLPAGFETKGETPPLAATFGLSQFDRLQSASTGAYDMALERLLRPRLIYRLEEQMEANRGDPSFLYEALKVYLMLGGLHAVDRDLVMNYLRRDWTENLYPGSANADGRRLLEAHVAAMLDMKGDIIVSLNGPLVSEAQNLLARLSVSQQAYELLRSQAASSEISDWNAARQGGPDSALVFEATQGAALDSIKVPAFYTYAGFRRLFIDRLSGIGEKLKSDRWVLGAAGEQAAVEDQYKSLSDDLLAIYGKDFIAAWQSALGRLKLKRLLADKPKYVTLAAASAPTSPIKQLIVSVRDETALTRERPGFAKKEGVDPNAALFQNRAVPGADIEQAFKAYHVLVEGEAGRAPVDLIISNLAEIYQSLLLMGNPAQAPLATSQLQTQVAALRANANRLPQPFAGMLQTAGTDIDGDLTNSFRSQLNRALRDTVTGVCQQVVSNRYPFARTDREVSLVDFGRLFGPQGIIDKFFSTQIQQYVDMSKPVWTFRQDNNVARALASSGATLKEFQRAAQIRDVFFATGGLMPSMTLTITPPPAPLPALPAPPPPAAGAAQAAPAATPAPAAPTVSIKMDMNGTPIISPAGASAPVVAQWPGASTNRSAITVTSDAPGAQPSTIERRGPWSLFRLIEAGAPVPHGDSIVVSYIVGGRELQYTFSAGSTQNPFTLPALREFHCPSDL

SEQ ID NO: 4836 - protein, 1204 aa, Methylobacterium nodulans ORS 2060
MITLPRSRPLWLGLLATLAGSAALAALVWWAGPLVAFGTARPLEGDLPRAALAAAILLAGLATCGLRLRRHRRSVAALEAEISRDEGDGAVLGATMRDALATLRKVGSPKGDPLYELPWYVIIGPPGAGKTTALVNSGLKFPLAREGAAAAVAGAGGTRYCDWWFAEEAVLIDTAGRYTTQDSDPRGDRESWLAFLDLLKRHRPRQPINGVLVAISLEDLIAGPPEAVAAHASAVRKRLLELHERLGVDFPVYALFTKADLIAGFAEFFGHLPEAGRRMVWGHTFQTGERTRNMVGSVAAEFDALVERTNAWLPDRLQEEPNPTSRVVLFGFPSQVASLKDLVVDFLTAVFEPTRYHAAAALRGFYFVSGTQQGTPIDRLIGALSRSFGSQDAAPDAAPGLGRSFFLADLLRKVVIAEAGWVSTNRAALRRLLALRAGAYAGLALAAALAVGLWWTSFLRNEALSGQAAAGAAKYRAEAVDVLRDSVVADRNFSKVLPYLNTLRYLPAGYASRGEAGPVLATFGLSQRARLGSAAETAYHAGLERLLRPRLIYRLEELIEANRGNPGVLYEALKVYLMIGRRPEAPLDRDLVLAWMRRDWAEFLYSGAGFAKGRQLLEDHLVAMLDLEDAGEPVVSINQGLVEETQRTLARLSVAERAYELLKSEARASGRRDWTLAAAAGPDAALVFEATGRGDLDGVRVPYFLTYDGFFDAFIDRFGDIAEAVGRDRWVLGGAGEEEAYTAQYGSLFADLLKLYARDFAAAWRSTLGRLKLRPLAADRPRYVALTALAAPTSPLKRLLESVGAETRLTRERPAARPGTEADPRATKAAAVVAGALSAEAERQAAGVLPSRVASTASALGRLALERTPPQAAGPARIDASEAPGAAIEAGFRAFHAVLDGEGGKRAVDALLANLSDLRAAALEAAAPGGATAPLSAQARNLRSLASRFPAPFEAMIQGAAAEFEGSVTGAAVAGLAQGLAETVTRECQAAVAGRYPFARSEREIPLADFARLFAPGGILDRFFTQNLVSHVDRSRPQWTWRADDQVARAFSLATLREFQRAAEIRDAFFAAGGTTPGFTLAVTPLALTGDATRAKFELNGSTVEAGTGVNAPASLAWPGASGLGRAAVSVEGIFGTNAASVERAGAWALYRLLEAGSLLRQGDAVVATFSLGGRDVSYRLAVSAIANPLTLPALREFRCPSSL

SEQ ID NO: 4837 - protein, 1164 aa, Agrobacterium vitis S4
MINPLSWFYTIRSYVDSYAGVVGRRFISLIWVIALCVLIWFYGYLAAFGSFKPLASVSARIWTMVVIFAIWTAYMIVTMVRAKRQDKELVDSIEAQALANQQAEVSEISNRLKEALALLRRITKKRFGYIYELPWYVIFGAPGSGKTTALTNSGLQFPLGDALGSDAVKGIGGTRNCNWWFADQAIMIDTAGRYTTQDDLDGSSKAGWEGFLGLLRRYRRSQPVNGALLTLSIGDLLTRDPEAQREELRAIRKRLAELDDHLGARVPVYILLTKADLLTGFVEFYDSFNKSDREQVWGTTFGLEESYGAKTLPERFAEEFALLQQRVDAMLIERLQQEQSADVRGRIFRFPAELASLQEKLGEAISELCTGSSLVEAPLIRGIYFVSATQPDETLARTTTNRTRRSYFLPKLFSEVIFNEAALVARDKRLSSRQVLLRQAVWGLAVAAVVIVFAGWTMTFFQNRAALAQAEEHLNAYDKLIQDVPVRNVSDADFLRVLPALDNLRAVPTGFDTRYVWAASFGLSQRDKIAGRQRDAYQRALNSLLLPRMLVQLQKDLTGESDVTRTFNALKLYEMLGGLGRLDREFVSAQATQMFNALYPGEGRTAARKALIQHASAMAAGVLPPVEIDRRLIEKARDTIRNQTVAERAFDILAGSKQAQALMPWQPSLAFGALGEKAFIRKSGALLTEGVEGLFTATGYRSVVLPHIADAAREALQEEWVRGSNAQLRGQTLESVAQAALQIYYDRLEQRWASVLGDLAVRPSQNLGDAVETTRILSNDRNIVAQAARSIADATDLRPKGDTAGMTTLVSSASGDTVAAMLASSMAAPDPYSRLREALDTPAADDSRKATTDKQDKPASQVEAILPVITALHDQLARSVTSSAEVAKVFDVDSQLTRANQDLLQDARRLPGPLDGWMAGLAADTGSLAVKSARSRIGDLWSSEGAGLCSSIVTGRYPFDRASSRDVAMNDFIRLFGPKGLFQTFFKQRMEPFVDQSISPWGWKGTFGAAGIPSEGIAEFERADQIFRAFFPNGSETPAIAINVKPVSLGETSTAVMLEIQGERVVYFHGPVQAKTITWPSKDAASMSRIAFQPGGWQQAKTENGDWSPFRLFDDANIQNQGDDLFRAKFTNDNQVAEFDVQFGSVLNAFRLKALSEFTCPTQF

SEQ ID NO: 4838 - protein, 1205 aa, Azotobacter vinelandii DJ
MNRLLDFLARALGLILGRQLWVLLGLAALVALIWLVGPLIAIDGYRPLQSDRLRLGLIAAMLMAWLMRVLYRTWRSANLNAQLLNRVREPAEGAATTADPHLEELRSRFGEAAERLKGARFAAQGGSGWGRWLERISRQYLYQLPWYLFIGAPGSGKTTALVNSGLDFPLADQFGKAAIRGVGGTRNCDWWFTNEAVLIDTAGRYTLQESHREQDQKEWLGFVELLKKYRARQPINGVMLTVSTADLLSSDEQERTQHAVRLRQRLQELRAQLGIQFPVYVLVTKIDLLSGFTEYFARFGREERSQVWGMTFPLEAVRAPDFDLRRAFADEYRLLLERLYAGLPERLQGEQDPLQRELAYLLPQEFAGLQAVLERFLEQVFVESRFEANALPRGVYFTSGTQEGTVFDRVMGGIKRLLQLGGGAHLPQVGEPGRSFFLRRLMQEVIFQEAALAGRNERWQRRQAWLRRAGHALVGVGVLALGLAWFNSYRHNLRHVEEVLARVPAVAERIAGIKVDDRAPVGALMPVLDQLASLHASSRFDVDDPPLDHRFGLFQGDKLRAAADGAYARALEDVLLPHLARRLEDGLRQARPDDVEYAYGALKAYLMLYEAQHYDADYLQAWLSFDIERGLDGRLANDRREALRQHLARLLGGRAVSSPYARDDALVAQVRGRLLGHGFGERSYGSLKRALRHDERLTDFNVAEVVGPQATLVFLRVSGASLGNGGVPGLFTYRGYWEVFAPRIEDDLVARSREESWVLGLPELERIDPQTLAKWVREVKRLYFDDYIREWEGYLADLRLRSGADLAQNIQIARALSAADSPLVKLMSAAAQETTLLRAGEDDRRPAAEQARDRVGAAREALESLFGRPESSADPRPSATERPERVVDERFAALRHFTRPGEKGEPAPIQSVRDTLNELYIHLIATDTALRDGQTPPGDGVLNKVRADAGRLPLPFRNMLNELARVSDGNVSRVVHRQLGQNVAANVGDFCRQAVDGRYPLAHGSARDISPNDFAQLFAPAGLMDEFFQKNLAGLVDTSVRPWRFKGEAGGRAAYLQSFERAAVIRDVYFAGGGRTPSIRIELKPLRMDAGIAQILFDIDGQTLRYAHGPQVPVQVQWPGPGGGNRVRLEASGPDGTSKVLLSEGPWALHRLFDRAALAPGGAPEQMIATFDIGGAKAVFQVTAGGVRNPFRLAQLESFSCPRRS

SEQ ID NO: 4839 - protein, 1211 aa, Variovorax paradoxus S110
MLRAIFRFLVSRDLWVFLGLLAVAFLIWIIGPVIAVGRYRPFESEFVRIVVIALMFAIWIARVLYRKWRERRLNAQLLNQLRTPSPKEKAAKPEDAPEIKELQSGFTDATSILKNMRFGADAGGKPAGRFALFDRQYLYQLPWYIFIGAPGSGKTTALVNSDLDFPLADQLGKAAVRGIGGTRNCDWWFTNEAVLIDTAGRYTTHESNRETDEGEWKGFLDLLKKFRPRQPINGAILTISIADLPLADDAQRARHAMALRKRLLELRNGLGINFPVYVLVTKTDLLAGFNEYFGALGRAERSQVWGFTFPIDANPADPAKADLRERFHQEYKLLHQRLDERLPELLAAEPDQLRRAQAYLLPQQFASFEDILGTFLADVFNPSKFEVAPMLRGVYFTSGTQEGTAFDRVMGAIKRYLQVNAPPAPPPGPGKSYFLKELLQQVIFRDAGVAGTNLRWYRRKRAIDLAGYGLIGVLLVVVLGACVNSWRNNRDYVAEVDTNAKAFNKAAARGELPTVVDSNSDIASSLPVLDRLRDLPKSSHFDIGDPPMGYRFGLYQGEKLQAATDGVYQRALEGVLLPQAAQRVEQALREASKTDAEYSYEALKAYLMLYDAERYDADFLQAWLLTDVDRKIGAGLTREQRTNLESHLKALFAERVVTSPFAKDDRLVTETRNRLAGVPLAQRAYARLRRILLQTSPPNAFSIAEAAGAESALVIKRTSGKPLTDGIPTLFTYRGYWDIFDKRMAETTLALEQEDRWVLQIRAPGMADITSRELLLREVRRLYLTDYIRVWDDYLLDVRLADSRSLLQSIQMTRVLSTSESPMSRLIRGAARETDLLRNHDEATRSLLDQAQNRVASTRERIEQLIGQPDGSQRRNTVPDRPESLVDNHFAPLRRMVTAPKAGGQAPIDATAALINELYTFLTATDTALRSGNIPPSSDAVTKVQAEAGRLPVPFQGMLNDLSATASSKAAAVTRQNIGQNAAATIGQFCSQAIAGRYPFSRGSNRDVAAGDFAQLFAPGGMMDDFFQKNLASQVDTSVNPWAFKKGVDGSSPGRSAYLDSFQKAQAIRDVFFSGMAGGRTPSFTIDIRPEDMDAAISQFTLDIDGQTVRYAHGPQAPSTVKWPGPRNSNQVRLQVTTASGTPAGGIVTEGPWALHRLFDKASISSGSAPESFNATFDLQGKKVVLAVTANSVYNPLRLHQMNGFSCPGKS

SEQ ID NO: 4840 - protein, 1199 aa, Variovorax paradoxus S110
MIKKIFGFLFSPLLLTLLALVIVALLIWWIGPLVKIGAWVPLESELARALLIGAIVLVVVLRAIYRRWRARRASQHLTDGLMKAPAAKADAPVNGEQKILDTRFSEAVATLKQMRLHAAGKKPGWRDWLSISGGSYLYDLPWYVFIGAPGAGKTTALVNSGLSFPLAEKFGPGAIRGVGGTRNCDWWFTDEAVLIDTAGRYTTQDSHQSEDKSAWEGFLGLLKKARPRRPLNGVFLTVSVADLLSQGPEQRTQLAASIRARLLELDAKLTTRLPVYVLVTKSDLLYGFTDYFDDLGKEQRAQVFGFTLAADENVQADEKGLSTAFHREFALLHNRVNDGLIARMQRETDGTRRAAIFGFPAQFGSIGSMLSDLLDQVFTGSRFAQPPWVRGVYFTSGTQEGSPIDRVMGSLARSFGIERAMLAPQKSSGRSYFLTALLREVVFPEQRLAGANVKLERRRHALRMAGVAAMTLVTLALLAGWGYSTLQNLNYLKSVEARVEPARQTLAALPSRVQNLVEVAPVLQGLRDIWKTPDNRQGDEPLSMTLGLYQGDKLDAAAMLTHQRALNDAFLPQIAKRIEDQLRTAQKDNLEYTYEALKSYLMLYQPEHFDAEALKAWITLDWARSLDRGIPEDQRQALEDQLDVLIAQGPPRSPLKMDENLVRSVRAVLASYPLEQRVFSRLKRQRATKDIPAFSIATAAGPSAPLVFERISGKPLTEGVPGMFTYDGYHKRFQNEVTVLTGLLAQEDPWVLGQDRSAADRMRDVAALGALTDRVRRLYLAEYVKVWEALLADVRLIRASGLEKNIEAARILSGVGSPLANFLRAVVKETTLIPADQPKDVVSKATATVASTRKGLEDLFGGDPNKAVASGKRIESIVDDRFEPLRRLVTAAGPNQPAPIDDALKLFNEVYVYLTAVDTAVKGRTSPPPGDVAGKLKSDAGRLPEPVRTMVENLSQSGAAQAQVAERGNLSQDLRPVTDFCNRAIAGRYPFVGSSKRDVLPEDFGQMFGAGGLMDEFFQKRLAALVDTSTKPWRYKPVAERGAVTTQALAQFERAARIKDIFFRGGGRGPSMRLDFKPVEMDAGITQFILDVDGQLVKYAHGPVVPMAVQWPGPKGSYQVRIQVSPPSATGSSGAAVDGPWALFRALDDGQLEAGDAPEKFFITFQIGARKTRFEVTTNSVQHPIRLKELREFSCPEGL

SEQ ID NO: 4841 - protein, 410 aa, Colwellia psychrerythraea 34H
MFRISQLLKTLHDDMAELKPVKASRKMKGPVVIWNLIRRCNLQCKHCYSTSLDIDFKDELSTEQVKTTIDDLKVAHVPVLILSGGEPLLRPDIYEITEYAKQKGFYLALSTNGTLINEDNIEAIKAAEYQYVGISIDGLEEFHDEFRRQKGSFKTSMHAIKLCKDAGIKVGMRLCLTRENFKDLPAMLNLMEENSVDKFYLSHLNYSGRGKRTAENDAMFKMTKDAMELLYERAWTHINQGIETDFVTGNNDADGPFLLQWASKQFAEEYPEAIANLKQRLINWGGNSSGINVANIDNTGTIHPDTYWWNHPIGNVTTEKFSDVWRDTQDPLMLGFRQTPRPVKGRCASCEHLAICGGNTRTRAFAQSGDAWAEDPGCYLDDDEIGFIPSPSKFADELTNTENPIQFVEV

SEQ ID NO: 4842 - protein, 387 aa, Ralstonia eutropha JMP134
MFRLSRFMEALRDGGPVPAPRKPAGPVVIWNLIRRCNLNCKHCYSTSADTNFKGELTTAEALDVLGQLKAAHAPALILSGGEPLLREDLYTIAARAREMGFHLSLSSNGTLLDAAHAARLAESGFDYVGVSLDGMQDTHDRFRRSGDAFRHALAGLRAARSAGLRVGVRMTLTEENANELPAVVAFTEAEGIDKFYLSHFNYAGRGRSHRGDDARHAATRAALDWLFDHVWERARQGHAGDFVTGNNDADGVYLLHWIARHQPHRLADMRRRLVNWGGNATGVGVANIDNLGNVHPDTMWWHVTLGNVRERAFGDIWADRSDPLMAGLAASPRPLQGRCANCAQVDICNGNTRVRAAAVTGNPWAQDPGCYLTDEELAMQLGAEVAA

SEQ ID NO: 4843 - protein, 399 aa, Thiobacillus denitrificans ATCC 25259
MFRISRYLQELAQPTPLGPERTPPGPVVIWNLVRRCNLTCKHCYSISADKDFPGELGTDEVFAVMDDLKRFRVPVLILSGGEPLLRPDIYAIAQRAKDMGFYVGLSSNGTLIDEHNIERIAAIGFDYVGVSLDGIAATHDRFRRMDGAFDASLRGIRLCRDRGIKVGIRFTLTQDNAQDLPALLQLMEDERLDKFYLSHLNYAGRGNTNRKHDVVHQATRQAMDLLFDTCWRYQQAGLHKEFVTGNNDADGVYLLFWIRRHFPAMEGHMRAKLAQWGGNSSGVNIANIDNLGNVHPDTFWWNYSLGNVKERPFSEIWPDTSDPLMAGLKASPRAVKGRCGECAYFDICGGNTRVRAYQLTGDPWQEDPACYLDDEEIGVTTPHERLTVTPYVPLRRVAR

SEQ ID NO: 4844 - protein, 387 aa, Pseudomonas aeruginosa UCBPP-PA14
MLRISHYLRSLAEDAPAPRRAGGRRAPVVIWNLLRRCNLTCKHCYSTSADSDFRGELETAEILRGIDDLRAAGVRVLILSGGEPLMHPDLFEIAAHARQAGMFVALSSNGTLIDEGNIQRVAEARFDYVGISLDGLRETHDRFRQKQGSFDAALAAMRLCREADIRVGMRTTLTEENAAQLPALLDLMRELDVQKFYLSHLNYSGRGRRSRALDAHHRRTREALALLFERADEDIRQGRDSDFVTGNNDADAILLLDWLKRRRPQQLARLCELLLDWGGNASGEGIANIDNTGEVHPDSYWWHHSVGNIRHQRFADFWFERPDPLLLQLRQRPRPVVGRCSQCRWLDICNGNTRTRAWAGGELWGEDPGCYLSDQEIGLERIALHAV

SEQ ID NO: 4845 - protein, 407 aa, Paracoccus denitrificans PD1222
MFRLTQYMQQLLDPSPPRRRTRPGTVRPVVIWNLTRSCNLKCRHCYTVSADRPFPGELTHEQAMAVLRDLSDFRIPALILSGGEPMSRFDFWELAEEARRLDFRHLSLSTNGTRINAQNVDRLAGLGFDYVGISLDGIDAVNDWFRGVEGAFDQALAGVRACKAQGVKVGLRFTITEGNAHHLPAMLDLCRDEGVDKFYLSHLVYAGRGDKHRGEDTEHARTRRAMELLIARAWEAVERAEPLEVVTGNNDADAVYFLRWAETRFPPAAVAHLRAHLEAWGGNSSGLGVGNIDPQGKVHPDTYWSDYTLGSVKERPFSAIWTGDDPILATLRTRPRPLKGRCGACAYQAVCGGNTRIRALQLTGDPWAEDPACYLSGSEIGAEGADLDRLAVTPFRGKSHDPAHRFL

SEQ ID NO: 4846 - protein, 406 aa, Acidovorax sp. JS42
MFRISQYLRELAQAQATGTYPTSRERHARGPVVIWNLIRRCNLTCKHCYALSADHDYAGELSLQEVYTVMDDLKAFGVPALILSGGEPLLRPDLFEIAARARDLGFYTGLSTNGTLIDAPMAARIAGAGFDYVGISLDGLKPTHDKFRRLDGAFDRSLAAIRHLATHNVKVGLRFTMTALNAHDLPALLQLMKDEGANKFYFSHLNYAGRGNIHRDKDAHHQATRQAMDLLFNHAWADAQAGSLDDYVSGNNDADGPYLLQWAREHLPQWEDALRQRLVAWGGNASGQMVANIDNLGHVHPDTMWWHHDLGSVRERPFSQIWNDTSDPLMAGLKQHPRPVQGRCAGCQYLTICNGNTRVRAQQLTGNPWFEDPGCYLTDAEVGASSTPFESPAKHERRRTIEIAHA

SEQ ID NO: 4847 - protein, 404 aa, Marinobacter aquaeolei VT8
MREKTMFRMTRYIKSLMNPAPVRPVPKPSGPVVIWNLIRRCNLTCKHCYSISADIDFKGELTTQEVYKVMDDLKAFGVPVLILSGGEPLMRPDIFDISHRAKAMGFYVGLSTNGTLITEDNISKIAEVGYDYVGISIDGLEATHDEFRQKKGAFKESMHAVALCKQAGIKVGLRFTLTQDNYPELPAMLEMLDEHQIDKFYLSHLNYSGRGGRNKKRDAWYDMTRDAMNLLFNHCHDELRRGIEREYVTGNNDADGPFLIEWAKEHYPDQVDALTQRLTNWGGNSSGVNISNIDNLGVVHPDTFWWDHNLGNVRETPFSKIWSETTDPLMQGFRQHPRPVKGRCADCKYLNICNGNTRVRAYNVSGDFWEEDPGCYLTNEEIGVVDTTPRRVAAPVIEIPVHNL

SEQ ID NO: 4848 - protein, 398 aa, Methanoculleus marisnigri JR1
MNRITRYIHATGTVSEVIRHRAAEKRPSGMLAFSELRRPVVFWNITNRCNLLCSHCYIRAGPGRGREDELTTEEGLALIDDLAEMRVPLLLFSGGEPLVREDFWELAGHAKESGLTTALSTNGTLITPAVARRLRDAGVEYAGVSLDGATAETHDGMRNVPGSFDKAVSALDNCRSAGLKCGVRVTATRENYAEICALIDLSLDTGAERFCVYWLVPSGRGGEGYDARQLRFQEIAGLLDLLIEKAREVDPAAMEFLTVDAPQDTVYLLKRLEKDDPSAYESMCTLLAHAGVGCSAGDRIANIDPSGAVYPCQFAQMDRLKVGSIREKPFSTIWNDPENRILADFRRKKDLVGGSCGRCSYRDRCGGGCRIRAFADTGDLWAEEPLCPVRREEPRDGA

SEQ ID NO: 4849 - protein, 387 aa, Pseudomonas aeruginosa PA7
MLRISHYLRSLAGDAPAPRRAGGRRAPVVIWNLLRRCNLTCKHCYSTSADSDFRGELETAEILRGIDDLRTAGVRVLILSGGEPLMHPDLFEIAAHARQAGMFVALSSNGTLIDEGNIQRVAEARFDYVGISLDGLRETHDRFRQKQGSFDAALAAMRLCREADIRVGMRTTLTEENATQLPALLDLMRELDVQKFYLSHLNYSGRGRRSRALDAHHRRTREALALLFERADEDIRQGRDSDFVTGNNDADAILLLDWVRRRRPQRLARLCELLLDWGGNASGEGIANIDNTGEVHPDSYWWHHSVGNIRRQRFADFWFEHPDPLLLQLRQHPRPVGGRCTQCRWLDICNGNTRTRAWASGDLWGEDPGCYLSDQEIGLERIALHAV

SEQ ID NO: 4850 - protein, 391 aa, Candidatus Methanoregula boonei 6A8
MNRITQCLHGKGTVSAVMKHRHGDVPARYLAFSGMRRPVVFWNLTDRCNLSCTHCYSRSAPDSPTQGELSTNEALAFIDDLAAAGIPLVIFTGGEPLVRPDIWQLAGHCRDKGIKTALSTNGTLITDEVAAKIKASGIEYAGISLDGATAATHDRFRNTPGAFARATAAFARCKKAGVRCGVRVTLTKENLAELGSLVQLSQDLGASRFCLYWLVPCGRGSDAYYRLQLGAEEVTQALTLLYHTAQEIPPDQMEFLTVDAPQDCIHLIHSMERDNSPDLAEAKELLSSLNGGCSAGDRVANVDPRGNVYPCQFARSPEFLVGNIRDRPFSLLWNDEKNPVLARFRTRPAVVGGKCGSCTYLSLCGGGCRVRARALMGDVTAEDPFCSVNGP

SEQ ID NO: 4851 - protein, 404 aa, Dinoroseobacter shibae DFL 12
MFRLSHYLDQLYHPTPPRIARGTPKPVVIWNLTRRCNLKCKHCYTVSADVDFPGELTAAQARETLEDIGRFKVPALILSGGEPLLRDDLFALAKRARALTRVLALSTNGTGVIGSKADRVAEIGFDYVGISIDGIGATNDAFRGVIGAYEQALAGVRSCKRRGIKVGLRFTITEQNESQLPELLKLCDDEGVDKFYLSHLVYAGRGNKNRGEDADHARTRRAMDLLIARALESAEGRGHPLEIVTGNNDADAVYFLNWAKANFPAAQVAHLRKHLEAWGGNASGVGVANIDTQGDVHPDTYWSEYTVGSVKQTPFSELWTGPDPMLAELRRRPRPLKGRCGACAHQAVCGGNTRIRALQLTGDPWAEDPACYLTAAETGTATDIDRLTVRPFIGDRHDPKPAFV

SEQ ID NO: 4852 - protein, 418 aa, Leptothrix cholodnii SP 6
MFRISQYMRELAQAHRGGVYPAPRRAAAGGSMTGPVVIWNLIRRCNLTCQHCYALSADHEYSGELSGAEVGTVMDDLKAFHVPVLILSGGEPLMRPDIFEIAARAKAMRFYIGLSTNGTLIDEPMADRVAAAGFDYVGISLDGLRETHDKFRRLDGAFDRSLAAVRLLHARGVKVGLRFTMTAMNAHDLPALLQLMRDEQVDKFYFSHLNYAGRGNIHRGRDAQFAATREAMDLLFETAWQAALEGRDEEYVTGNNDADGPYLLQWVAEHLPHLSPLVHESLRQRLVAWGGNSSGVNVANIDNLGNVHPDTMWWHHTLGNVRERPFSAIWADTSDPLMAGLKARRRPVGGRCGGCAHFAICGGNTRVRAQQLTGNAWAEDPGCYLSDAEIGVSGNGERVKVTAFSGGRKRVGVPVVAG

SEQ ID NO: 4853 - protein, 402 aa, Thauera sp. MZ1T
MFRISQFIRELDHPTPAGPRRNPPGPVVIWNLIRRCNLTCEHCYSISADKDFPGELNTQEVFKVMDDLKDARVPVLILSGGEPLLRPDIFDIARRAKGMGFYVGLSSNGTLIDESNIDAIDEIGFDYVGVSLDGIGATHDHFRRKQGAFEASMHGIRLCRERGIKVGVRYTMTEGNAHDLPALLKLVEDEAIDKFYFSHLNYAGRGNKNRAGDARHRTTREAMELLFETCLDLHRRGIDKDFVTGNNDADGPFLLHWVQRRFPDKAAHIEARLRQWGGNASGVNVANIDNLGIVHPDTMWWHVPLGNVRQRAFGEIWNDLSNPLLAGLKQHPRKLEGRCGACKYLEICNGSSRVRAEQVTGNPWAEDPACYLYDEEIGVNPADYGAERVVTTPWTRIDKVSA

SEQ ID NO: 4854 - protein, 406 aa, Diaphorobacter TPSY uid29975
MFRISQYLRELAQAQATGTYPTSRERHARGPVVIWNLIRRCNLTCKHCYALSADHDYAGELSLQEVYTVMDDLKAFGVPALILSGGEPLLRPDLFEIAARARDLGFYTGLSTNGTLIDAPMAARIAGAGFDYVGISLDGLKPTHDKFRRLDGAFDRSLAAIRHLATHNVKVGLRFTMTALNAHDLPALLQLMKDEGANKFYFSHLNYAGRGNIHRDKDAHHQATRQAMDLLFNHAWADAQAGSLDDYVSGNNDADGPYLLQWAREHLPQWEDALRQRLVAWGGNASGQMVANIDNLGHVHPDTMWWHHDLGSVRERPFSQIWNDISDPLMAGLKQHPRPVQGRCAGCQYLTICNGNTRVRAQQLTGNPWFEDPGCYLTDAEVGASSTPFESPAKHERRRTIEIAHA

SEQ ID NO: 4855 - protein, 399 aa, Candidatus Methanosphaerula palustris E1 9c
MNRITQCMHGRGTVSDVMRHRHKPQTTVPSTYLAFSGMYRPVIFWNLTDRCNLSCNHCYNQSGPERTTEGELTTAEALKVIDDLADMGVPLILFTGGEPLMRADIWDLAQHARNRGLKMALSTNGTLITPDIARRIKESGIEYAGISLDGARAETHDRFRNSPGAFEQTLAAFAACKEAGLRCGVRVTLTKENCRELEALVDLAISLGASRFCLYWLVPTGRGIDSYTQLQLDRDEVIEALSLLYLKAKETDPATMEFLTVDAPQDCIHLLASMEKDQSEDLVDARELLESLKGGCSAGTRVANIDAQGNVYPCQFARSPEFLVGSVRNLPFSRIWADPANPVLARFREKQARFGGRCETCNYRDLCGGGCRVRAYAVNENFLAEDPFCFVEKVFPKRQ

SEQ ID NO: 4856 - protein, 283 aa, Jannaschia CCS1
MGDLADFEKLSALEKRLSQALDRISTGIKARDEAKGAEAEAEARATEATERVTALEARLSETQDALSEAQSDVASAREEADAARAEADTARAQAAATPAEDTQELADLKTRLEAAEAQVTETTASLDAARAELDKAKAAPVSDAEPEDMEKALAVMGRRVERARAERNQARTACDAATDALDELKEATGASVDDRILALRRQLRLMRTRAEDLAAQVSLLQSGASVDASLLDQGLLAEVETLRQLRDTDAAELDRIVQDMQAGLEMTGPGAAGPDLTEGGQNA

SEQ ID NO: 4857 - protein, 306 aa, Ruegeria sp. TM1040
MEQLEELQGRIQTALHRIYGGVAALEQKHANRPVPTLEELDMQKHAELLADLEDEKMANAQLIERLRLLHGRLEDMEKKVAAVDGAQDLIALHAELELLRNEAGNSVETEALKAEVARLKQDLEAARNQAASEREKLEDDLSEATAQNEQLQAQLSALPESPADTEMTSDVKGDAHADSAELEALRAEVAELRARAEAAESAAVSQDVEPADEGVSAELDLRLSALDGELQGLRASNDQLRQSNAALRAANAEGVADPALINSGLEAELEGLKAARATDQAEVNAVLARLEPLLATAPNLPEGEEA

SEQ ID NO: 4858 - protein, 152 aa, Rhodobacter sphaeroides 2 4 1
MVELERRLTAALERIGAGIDAIPVMPAENPLQAELDEERMVNAQLSERLKSVKEREGVKIAQLEEQVEALTRQLDAQGMELQRMKKTTGQLREALRSLREATAEGVADSELVNRSMVVELEALRAARATEAAEVEEVLSALEPLISEGRTDA

SEQ ID NO: 4859 - protein, 211 aa, Paracoccus denitrificans PD1222
MREDLNLSEKRLIAALDRIDQFLDRVAQARHAPPPASSAEAEAVQVRLHEAEAENRRLSQELAALHQRQATTLSDCEARLAEAHQRLVAVGQEAAQLSAANEALAEANRAFVAAQGEGASQDDIRRALEAEIESLRAARAAEVAQMGEIVDALDRMIDGPAPPAPADAPPAMVETPAPPEAATLAGEAREDGPPEAAELAGDGATLDGERG

SEQ ID NO: 4860 - protein, 155 aa, Rhodobacter sphaeroides ATCC 17029
MQEMVELERRLTAALERIGAGIDAIPVMPAENPLQAELDEERMVNAQLSERLKAVKEREGVKIAQLEEQVEALTRQLDAQGMELQRMKKTTGQLREALRSLREATAEGVADSELVNRSMVVELEALRAARATEAAEVEEVLSALEPLISEGRTDA

SEQ ID NO: 4861 - protein, 155 aa, Rhodobacter sphaeroides ATCC 17025
MQEMVELERRLTAALERIGAGIDAIPVMPAENPLQAELDEERMVNAQLTERLKAVKEREGARIGQLEEQVEALTRQLDVQGLELQRMKKTTGQLREALRSLREATAEGVADPHLLNRSMVVELESLRAARATEAAEVDEVLSALQPLIAEGRSDA

SEQ ID NO: 4862 - protein, 142 aa, Dinoroseobacter shibae DFL 12
MSEIPQLEQRIAAALERIRAGLDTLPGAEIAETAARADTLAARVSALEAEVSEKGALEAEVSALRDGLARAEQERTEMLDTMQKLQTVNADLRLAAAEGVTDPEAINAALVADLEALQKVRAADLRDIDAILSELAPLAKEA

SEQ ID NO: 4863 - protein, 303 aa, Thermobifida fusca YX
MTDSPTTADTARILAEFDRHLRVERGCSPHTVRAYLTDVRSLLDYLADTGAGGLEDLDLATLRGWLGTLHDAGASRATMARRTAAARVFTAYLHRSGRLATDPGLRLATPRRHRRLPAVLDEDQAARVCAAARDGEESPLVLRRSAVVEVLYSTAIRVAELCGLDLDDVDWERHTLRVLGKGGRERVVPIGVPALDAVDRWLRDGRPQWATAHSGRALFLGARGGRLGERTARRDVYAATAAVARTGPHGLRHSAATHLLNGGADLRSVQEILGHASLASTQIYTHVSIGRLASVYQQAHPRA

SEQ ID NO: 4864 - protein, 385 aa, Frankia CcI3
MSPGAVSRTPRRLDENHRCCHGRLMVLRGESAEEPADGRLLPRQRSRATCGSDARPVEIVETPESDWDTAVAGFLRHLIAELARSPETVRAYAADLANLRAHAERMGCSVLADLDLALLRSWLASMRAAGAAPASLARRASMARVFSSYAARHGFLDTDVAARLVGNRTVRRVPEVLTAAAARQLLENPSPDVSPPGTSQPSGLPDSTADSERVVRRAVELRDALVLELLYGSGIRVSELCGLDLGHIDDDRRLLRVLGKGGKERSVPFGVPAVAALRSWRSTGRPRLMTARSGRALLLGLRGGRLDPRTVRRILTTRVAAGVAPAGLTPHGLRHSAATHMLEGGADLRSVQEFLGHASLATTQIYTHVTPERLRAAFEQAHPRA

SEQ ID NO: 4865 - protein, 312 aa, Nocardioides JS614
MSEEEQSARLPEAMARALGDYERHLAAERDLSEHTVRAYIGDVAGLLEHASRLGQTEPGDLDLRTLRSWLAKQQTMGRSRTTLARRATAARVFTAWLARTGRTPLDAGASLGAPKAHRTLPPVLRTDEAADLVRAAVEHADDGSPVGLRDVAMLELLYATGIRVGELVGLDIDDLDRERNVVRVLGKGRKERTVPFGRPAARAVDFWLKHGRPLLAVEGSGAALFLGARGRRIDQRAVRTVVHRRIAEVPGAPDIGPHGLRHTAATHLLEGGADLRSVQELLGHASLATTQIYTHVSTERLRRAYQQAHPRA

SEQ ID NO: 4866 - protein, 319 aa, Mycobacterium vanbaalenii PYR-1
MVCHGRGVQTGGQERSDPGIGSCLEEFDEYLALERGRSEHTRRAYLGDVRALFDFLAERRPGTGLRGLTLPVLRSWLAAQATAGAARSTLARRTSAVKTFTAWAVRRGLMTEDPAARLQVPKARRTLPSVLRQDQAREAMDAAKSGAQQGDPLALRDRLIVEMLYATGIRVSELCGLDIDDVDTARRLLRVLGKGNKQRTVPYGDPAHAALTAWLSDGRPALVTAGSGAALLLGARGGRLDPRQARTVVHQTMAAVSGAPDIGPHGLRHSAATHLLEGGADLRVVQELLGHSSLATTQLYTHVTVARLRAVHDQAHPRA

SEQ ID NO: 4867 - protein, 300 aa, Mycobacterium gilvum PYR-GCK
MDTVLEEFDRYLELERGRSEHTRRAYLGDLRSLFAFLDERSPGTGLGGLTLPMLRSWLAAHAAAGTARSTLARRTSSVKTFTAWAVRRGLIGDDPASRLQVPKARRTLPSVLRQDQARDALEAAESGAQQGDPLAVRDRLVVEMLYATGIRVSELCGLDVDDVDTSRRLLRVLGKGNKQRTVPYGEPAHAALTAWLHEGRPALATADSGPALLLGARGKRLDPRQARTVVHQTVSAVGGAPDIGPHGLRHSAATHLLEGGADLRVVQELLGHSSLATTQLYTHVTVARLRAVHDQAHPRA

SEQ ID NO: 4868 - protein, 344 aa, Frankia EAN1pec
MGTGGDPAATARGGRGDSAGGGNGGRAGAGPGDGDRGSGGDGWAGAVEAFVRHLVAERDRSPETVRAYRADLAGLRAHAAAAGRTDLLDLDLAVLRGWLAGMRSAGAAPATIARRASLARVFSAFAARRGFLPDDVGARLATTRAPRRIPQVLTAAQADRLLETRPRGDRAQDPRDVALNLRDDLVLEILYGSAVRVSELCRLDIGDVDHERRLLRVHGKGGRQRSVPFSVPAAGALDVWLTRGRPYLATRVEAALLLGARGGRLDPRSVRRLVQARGAAAGVPTGLTPHGLRHGAATHMVEGGADLRSVQELLGHASLSTTQIYTHVTPERLRAAFDQAHPRA

SEQ ID NO: 4869 - protein, 380 aa, Beutenbergia cavernae DSM 12333
MLSELCANVAHNSYIPVRLKEGAWHRHVGFASEWRRGTRAAAGHGGSVAADHPRDSAAPRASHHPPSRPGDAALVERYALHLEAQRGLSAHTVRAYTSDVADLLAELPPTGDEPNGADLTRLDLVALRRWLARQARAGLARSTLARRSASARTFTAWAHRAGLLAEDVGARLRSPRADVVVPVVLTEADAATVLDGVRADDGGVGADDDEGERSALALRDSAMLELLYGAALRVSELAGLDTGDVDLRERLVRVLGKGAKERVVPFGLPAARAIEAWISVRPELAGPRSGRALFLGARGGRIDPRVVRDVVHRATARAGVRDLAPHGLRHSAATHLLAGGSDLRSVQEILGHASLATTQRYTHVTPERLRAAFRQAHPRA

SEQ ID NO: 4870 - protein, 332 aa, Brachybacterium faecium DSM 4810
MSTEREHADDAVLDAFADHLHLERGRSEHTVRAYRREAAGLLAHLRTVERITLPELDVTALRSWLSARAETGASASTLARSAASVRTFTTWLASTGRIPHDVGGRLRAPRRGRHLPTVLTGDQAGELLDGLDGSARDDSAAPPREIAAAPRAEQDPRDRAVLLRDAAVLELLYSSGLRVSELVALDRSRIDRQHGTVRVRGKGDRERIVPVGLPALEALQRWESEGRPVLLAAATPGTPPGDALFLGVRGGRLGDRAVRTLVDRHVAEAGISRHVTPHTLRHSAATHLVEGGADLRSVQDFLGHSSLATTQIYTHVSAERLRRTVDQAHPRA

SEQ ID NO: 4871 - protein, 336 aa, Kytococcus sedentarius DSM 20547
MSATGLLREVEGFADHLLLERGRSPHTVRAYTADLTALAEHLEAAGATEWRQVTLSDLRSFAARRAAAGLARSTLARGTASQRTFFGWMVATERLVVDPSARLVSPRVEKRLPAVLRAEQAAQLVEGGGTRPEPRATGGAGDPGGDTQTDTDTDTDAAPGTEADPVSLATDLRDRAVLELLYATGIRVGELVSLDTGAVSLQDHTVRVWGKGSKERVVPFGVPALRALEEWVHQGRPELLGARSGEALFLGVRGGRIDPREVRRVVHRAAQRVEGAADIGPHGLRHSAATHMVDAGADIRSVQELLGHASLATTQVYTHVSVERLREAFDRSHPRA

SEQ ID NO: 4872 - protein, 336 aa, Nakamurella multipartita DSM 44233
MVRTSTAELRDGLPAPLVRDLERYRTFLSAERNRSPATVTAYLADLVSLLDHLGRMTGDRPAELTDLTLPVLRSWLARQRTTGAARATLARRAAAARSFCAWAHRTGRLPQDVGARLAAPRADKTLPAVLRADQAHQMLDAPAVSAPDQSPDTGTGTGTGTGTSAVEQAMARRDQAILELLYASGIRVSELTGLNLDAIDRHRRVIRVLGKGNKQRTVPFGLPADRALGDWLDRGRPVLADDESGAAVFLGRRGRRIDPRAVRTLVHRRTAAVDGAPEIAPHGLRHTAATHLLEGGADLRTVQELLGHASLATTQIYTHVSTERLAAIYRQAHPRA

SEQ ID NO: 4873 - protein, 192 aa, Streptococcus agalactiae 2603
MEVKTAIEWMHTFNQKIQSNKDYLSELDTPIGDGDHGGNMARGMTAVIENLDNNEFSSAADVFKTVSMQLLSKVGGASGPLYGSAFMGITKAEQSKSTISEALGAGLEMIQKRGKAELNEKTMVDVWHGVIEAIEKNELTEDRIDSLVDATKGMKATKGRASYVGERSVGHIDPGSFSSGLLFKALLEVGGV

SEQ ID NO: 4874 - protein, 198 aa, Listeria monocytogenes 4b F2365
MTYDKDWALRWLNDFGERVQENKQLLSDLDQAIGDGDHGINMARGLGELKKAFTEKEPADLKDVFKTAGMTMVSKVGGASGPLYGTAFLNMSKAVDSETIDAEGLTKVLEAGLEGIEKRGKSHAGEKTMIDVWEPVVNALHQEDLTDDVVDAALQKTKDLKATKGRASYLGERSIGHLDPGAYSSALLFHAMLQTEVS

SEQ ID NO: 4875 - protein, 194 aa, Staphylococcus aureus COL
MKVNDMKARLLNLEETFKKHESELTELDRAIGDGDHGVNMVRGFSSLKDKLDDSSMQSLFKSTGMALMSNVGGASGPLYGFSFVKMSAVTKDDMDNQDFITLIQAFAEAVESRGKVTLNEKTMYDVVARAAEKLKNGETLTFNDLQQLADNTKDMVATKGRAAYFGEESKGYIDPGAQSMVYILNALIGDEDNA

SEQ ID NO: 4876 - protein, 191 aa, Staphylococcus epidermidis RP62A
MNVADIKARLLDLENTFKEKESELTDLDRAIGDGDHGVNMVRGFEHLKEKIDDQSMQALFKSTGMTLMSNVGGASGPLYGFGFIKMASAVNDEIDHDNLKEVLKAFADGIQQRGKVELNEKTMYDVIERAREAVEKNETVDLDKLQSFANETKDMVATKGRASYFNEASKGYIDPGAQSSVYILNAIIGGE

SEQ ID NO: 4877 - protein, 208 aa, Mycoplasma capricolum ATCC 27343
MSLNVDNVKEVLVKIAEVVNENKEELSQLDAAIGDGDHGHNMSRGFLKVVEELKNNSYDDIGSIFKKVGMVLVSNVGGASGPLYGTAFLKAATFVNNKKEIDINDFSVCLQQAVDGIKIRGKANVGDKTMLDVLQPVSDLIKDLINQKYLAKEILNKAVELAFQKVEFTKEIVAKKGRASYLGQRSIGYKDPGAYSSYLILKCISENI

SEQ ID NO: 4878 - protein, 208 aa, Rubrobacter xylanophilus DSM 9941
MDATEKTLEAVRAMAAAMEERRVELTQLDAAIGDGDHGTNMHRGFRAALERLQASPPGTPSEVLKAVSMALVSRVGGAAGPLYGTAFLRASSALSGREEPSAADVAAALEAALAGVKQRGRAEVGDKTMVDALEPAVRAARQAEGKGVAAMLRAAAEAAGEGAEATVPLTARKGRASYLGARAAGHKDPGAASTAYLLAAAARAVEGS

SEQ ID NO: 4879 - protein, 194 aa, Staphylococcus aureus JH9
MKVNDMKARLLNLEETFKKHESELTELDRAIGDGDHGVNMVRGFSSLKDKLDDSSMQSLFKSTGMALMSNVGGASGPLYGFSFVKMSAVTKDDMDNQDFITLIQAFAEAVESRGKVTLNEKTMYDVVARAAEKLENGETLTFNDLQQLADNTKDMVATKGRAAYFGEESKGYIDPGAQSMVYILNALIGDEDNA

SEQ ID NO: 4880 - protein, 194 aa, Staphylococcus aureus JH1; identical to SEQ ID NO: 4879

SEQ ID NO: 4881 - protein, 212 aa, Thermoanaerobacter sp. X514
MVITKNDVLKIVDKIVEVIKENKEYLTELDAAIGDADHGINLDRGFDAVKQKLTTLPETTDIGTILRTIGMTLVSTVGGASGPLYGTAFMRAGQVVQGKNELSEEDIVKIFEAALDGIKQRGKAEAGDKTMIDSIEPAYKALKESLENNIALPEALNRAANAAKEGMEYTKNISARKGRASYLGERSIGHLDPGATSAYLMIKSFSDVVNLS

SEQ ID NO: 4882 - protein, 252 aa, Halorubrum lacusprofundi ATCC 49239
MSGNESDGDGGVSDDHGVAVVAAVEAIAERIEAERDYLTELDSAIGDADHGGNMARGWAAATEAARDLDDPDPETVCKTVGKTLMAEVGGASGPLFGGSLVFASAELDDGLTAESAVAFAETYLTKVEERGDARVGDQTIVDALTPTVHTFKKSIETDDLPPLEALAKAVDAAERGVAFTVPIRARKGRASYLGWRSVGHQDPGATSVLYILEELLATAADALDAEIPDVDATSPTIPDEATEDDSATTEDD

SEQ ID NO: 4883 - protein, 209 aa, Acidimicrobium ferrooxidans DSM 10331
MSEPGSLAWWHDVWRCFAASVRDQRTWLDDLDAAIGDGDHGTNLNRGLERALGALETSQTPRAGLRSVGMALLGTVGGASGALWGFGWTKASAAAGDGTGAPTPDEVVATLSLFRDAVLERGHAELGDKTMVDVLVPALASLAAELGTQRSFAEAAATAASVASERAESTIPLVARKGRASYLGERSAGHEDPGAASMALFFACLGEVS

SEQ ID NO: 4884 - protein, 208 aa, Actinosynnema mirum DSM 43827
MGCGAREVAGAVRALADVVVAHRNELVRLDREIGDGDHGENLSRGFLAAAEKVALAEPTTPGAVLKLVATTLISTVGGAAGPLYGTALLRAATALGEVAELSGDDVALALRAALDGVVARGKAQVGDKTMVDALSPAAAAAAGLGGAGVGEVLAAAAAAAEGGARATVPLVARKGRASYLGERSAGHMDPGARSTALLLGALARVAAG

SEQ ID NO: 4885 - protein, 204 aa, Geobacillus WCH70
MAFGVEQAKRWMNIANDHIQQQKQYLTELDQAIGDGDHGLNMARGFQEVVEKISSTNYEDLGSLFKDVSMTLIAKVGGASGPLYGTAFLKMSLALAGKKEADDKELIAALEAALDGIKARGKASVGEKTMVDVWEPVIELLREKGSMRAKEAALLAKEKMEHTKELEAKKGRAAYLGSRSVGHIDPGSASSYFLFAALAEVLEG

SEQ ID NO: 4886 - protein, 204 aa, Rhizobium leguminosarum bv  trifolii WSM1325
MQAEPVLVAGLIEVCRATIAANSDHLCALDRAIGDGDHGTNMRRGCEAVSAEGESLSSLPFPDAMEKIGLTLVMNVGGAAGPLYGTLLMEIGRELRKSNEKADFSLVLKQAIDAVARRGRAHAGDKTLLDVLYPVHAALEKRSPLGDVARKAERSASRTADMKAMRGRAAYLGDRSIGHVDPGASSCALLTTAICRYLGEHRPQ

SEQ ID NO: 4887 - protein, 215 aa, Chloroflexus aggregans DSM 9485
MPITVEHVTHFLTAAAALIHERRDELTALDAAIGDADHGANLDRGFTAVMARLPSVADKDIGTVLKTTGMTIVSTVGGASGPLYGTAFVRAGMALADRHELSTEEVLLALEAALDGIVARGKAQRGEKTMVDALAPAIEALRAALAAGEPLGRALQAAADAAEGGAKATIPMLALKGRASYLGERSIGHQDPGATSTAYLLRALAMTCSRVEEGA

SEQ ID NO: 4888 - protein, 199 aa, Anaerococcus prevotii DSM 20548
MNIDKLKVLFTEISDEIIANEEYLTDLDRSIGDADHGYNMAKGFKAIKADLDKEYSSLKDFFNKIAMNLLSKVGGASGPLYGSFFMSFAKALDGKEDLTRDELNQAFDEGVAAVKKRGKAQVGDKTMVDVLEPVSNALKEGKDLDDVVKIAEEKMTYTKEIKALKGRASYVGERSIGHIDPGAYSSYLIIKKAFGGCHD

SEQ ID NO: 4889 - protein, 218 aa, Nakamurella multipartita DSM 44233
MSEADRTSCDAAGVVAGIRAVAATIAEHKVELTRLDRDIGDGDHGENMARGFTAVLAKLDAGEPDTPSAVLKLVASTLISTVGGAAGPLYGTAFLRASTAVKEATTLDPQAIVTALTAGRDGVVARGKAELEDKTMVDALTPAVNAARAAADAGGDVAAVLRAAANDAAMGAAATIPLQARKGRASYLGARSIGHQDPGATSTAYLLEALAAVAEKAP

SEQ ID NO: 4890 - protein, 224 aa, Ralstonia solanacearum
MAIADWPAHERPREKLLTQGPAALSDAELLAIFLRVGMPGKSAVDLARELLAHFGSLGRLCHASRREFSAIHGMGPAKYAQLHALLEVARRALKEEIAYGQTLESPQSVKDFLRLTLGHRPQEVFACLFLDVRHRLIAWEELFQGTLTEARVYPREIAKRALHHNASALILSHNHPTGHVEPSESDLVLTRELCRALALLDVRVLDHMIVGRAEVYSFLEHGKM

SEQ ID NO: 4891 - protein, 238 aa, Acidovorax sp. JS42
MPLKDLPLDAQPREKLLARGPAALSDAELLAILLRTGLAGKGVLQLAQELLDDPVRDSATGRSAGGGFGGIAGLLHASSQDLQRIKGLGPAKRAELMAVLELARRALAQQLREREVFDSPQAVQHYLQLHLAGRTHEVFAVLFLDSGNRLIAMEELFRGTLTQTSVYPREVVLRALHHHAAAVVLAHNHPSGSVQPSRADEALTQTLKAALALVDVRVLDHVIVAPGAALSMAEQGLV

SEQ ID NO: 4892 - protein, 224 aa, Polaromonas naphthalenivorans CJ2
MLIKDLPADARPREKLLARGPAALSDAELLALLLRTGLPGKNALQMGQELLDNFGGVAGLLHTGAEALKSIKGLGPAKRAEIVAVLELARRALAEELKEKALFTTPQAVRDYLQLQLGSRPHEIFAVLFLDSQHRLIALEELFRGTLTQTSVYPREVVIRALALNAASVVLAHNHPSGAAQPSRADEMLTQTLKTALALVDVRVLDHFVVTASLAVSMAEMGLV

SEQ ID NO: 4893 - protein, 237 aa, Verminephrobacter eiseniae EF01-2
MALKDLPADAQPREKLLARGPATLADAELLAILLRTGIMGKGVLQMAQELLDPPGVDAATGQPTGGFGGIAGLLHASAADLERIKGLGPAKRAELVAVLELARRALAQQLRECAVFDTPDAVKHYLQLQLAAKGHEVFAVLFLDNQNRLLAMEELFRGTLTQTSVYPREVVLHALHHRAAAVVLAHNHPSGSVQPSRADEALTQTLKSTLALVDVRVLDHVIVAPGQALSMAEMGLL

SEQ ID NO: 4894 - protein, 222 aa, Methylibium petroleiphilum PM1
MKDLPADLRPREKLLARGPAALADAELLALLLRTGLKGQGVLQLAQALLDRFGGLSGLLATDTAELGSVKGLGPAKRAELAAVLEIARRSLASRLAQTPVFDSPQAVKDYLQLQLASKPHEVFAVLFLDTQHRLLAFEELFRGTLNQASVYPREVVKRALALNAAAAILAHNHPSGVAEPSRADEALTQALKAALALVDVRVLDHFVVARGSVVSFAERGLL

SEQ ID NO: 4895 - protein, 239 aa, Polynucleobacter necessarius asymbioticus QLW P1DMWA 1
MIVSRPTPNLHSSIPNWPKSEQPREKLRIHGARALTDAELLAIFLRVGVKGKSAVTLAKDLLHYFGSLPRLLASTPEEFIRIHGMGLSKWSQIQAAYELVKRSLEEGLAQNSIFSSPGHVKEYLQSKIGRLPHEVFLCLYLDPRLHLIECQELFRGSITQTAVYPREILKEALSRNASALIVAHNHPSGNPLPSQADQDLTQTLLKALQWVDISLLDHCIVSSSGFFSFSESGLMNHDD

SEQ ID NO: 4896 - protein, 226 aa, Delftia acidovorans SPH-1
MALKDLPAQAQPREKLAARGPSALSDIELLAIVLRTGMAGKGVLQLAQELLQLPGRAGLSGLLQAGHADLKAIKGLGPSKCAQLLAVLELARRAMAEQLRERPALASPEAVARYLQLHLAARQHEVFAVLFLDGQHRLIALEEMFRGTLTRTSVYPREVVLRALHHHAGAVILAHNHPSGQVQASAADKAVTQNLQAALRLVDIQVLDHVIVAPGASLSMAGQGML

SEQ ID NO: 4897 - protein, 222 aa, Leptothrix cholodnii SP 6
MKDLPAAMRPREKLLALGPAALADAELLALLLRTGLKGTGVLQLAGQLLAQFGGIGGLLQADPAGLKTVKGLGPAKRSELQAVLELARRAIVSQLAQRPVFDSPQAVRDYLRLQLGRLDHEVFAVLFLDAQHRLIAYEPLFRGTLTQTSVYPREVLKRALALNAAALILAHNHPSGVAEPSRADEFLTQSLKTALALIDVRVLDHFVVGRESVVSFAERGLL

SEQ ID NO: 4898 - protein, 238 aa, Diaphorobacter TPSY uid29975
MPLKDLPLDAQPREKLLARGPAALSDAELLAILLRTGLAGKGVLQLAQELLDDPVRDPATGRSAGGGFGGIAGLLHASSQDLQRIKGLGPAKRAELMAVLELARRAMAQQLREREVFDSPQAVQHYLQLHLAGRTHEVFAVLFLDSGNRLIAMEELFRGTLTQTSVYPREVVLRALHHHAAAVVLAHNHPSGSVQPSRADEALTQTLKAALALVDVRVLDHVIVAPGAALSMAEQGLV

SEQ ID NO: 4899 - protein, 225 aa, Variovorax paradoxus S110
MAFKDLPAHARPREKLIARGAAALADAELLALLLRTGVAGKNVLQLAQELLDHFGGLSGLLQTSAEDLKVIKGMGGDAKRAELIAVLELARRAMAERLKERTVFDSPGTVKQYLQLHIGSRPYEVFAVLFLDAQHRLIVLEELFRGTLTQTSVYPREVVTRALHHQAAAVVLSHNHPSGSIEPSRADESLTQTLRAALSLIDVRVLDHVIVSAGQSYSMAEKGLL

SEQ ID NO: 4900 - protein, 174 aa, Chlorobium luteolum DSM 273
MGMVDTPGERRGTKAKGHQRKRIGFRLDMTPMVDVAFLLLTFFMLTTTFSKSNTMEINIPPEQGEVKVAGSNILTLRIPGDGMAYCSLGDLAPRRIPLYEPGDKGRKALSGDMRSLLRQQSLSNSKLVIVVKIGQKAKYKQLVDIIDELNMMKIDRFSLDDYTPQDDLEIKKSV

SEQ ID NO: 4901 - protein, 179 aa, Chlorobium chlorochromatii CaD3
MALHGEEQRPTSPTRLPKRHPARRGYHLDMTPMVDVAFLLLTFFMLATTFTPFYSMELSQPQKQRRLAVQAEEVLTMQVANNGIVHYRLGSNALSSMPLYQETATTQEPSATPMLNPALHHFLRSLKAEQPNITVVLSMNNQARYRDLVAVVDLLNSLQITRFSLGEIDGEEKQKAGVK

SEQ ID NO: 4902 - protein, 175 aa, Cytophaga hutchinsonii ATCC 33406
MAEINTGGGGGKDGKKRSKKMSTKVDMTPMVDLAFLLITFFMLATTLTKQQKFDFGVPPDVTNPEDQPELKASNAITLILGKDDAIYWYTMNQDGSTDFHETDFSDDGIRATLIERKKAVGADLNVVIKPMKDSKYKNLIDIIDELAILGIGKKALVEATPDDIKLVQAENASVN

SEQ ID NO: 4903 - protein, 174 aa, Chlorobium phaeobacteroides DSM 266
MGMVDSPNERRAKKGRKRIRKRIGFHLDMTPMVDVAFLLLTFFMLTTTFAKSNTMEISMPPEMEEVKIAEANVMTLRISGEGMAYCSLGNEAPRRLSLYESGDASRFALSAELRQILKQQTTANKKLVIVLKISEKAKYKYLVDVIDELNLMKIDRFSLDDFTDQDELEIKRAV

SEQ ID NO: 4904 - protein, 184 aa, Flavobacterium johnsoniae UW101
MAELNTGDGGGGKGGKVRSKKQSSKVDLTAMVDLAFLLITFFMLTTSLSKPQSMDLSLPDKDPKNDEKPVKVDENRTMTVMLGENNKLTYYMGLLESPIAGPKDISYGKDGIRRELLKRKKSVLEYSAGLGKPKNGIIVIIKPTKKSTYRNLVDMLDEMAITGVDTYAIVPEFTPEETKLIDKK

SEQ ID NO: 4905 - protein, 174 aa, Chlorobium limicola DSM 245
MGMVDSPNGNRSAKKGKKRQKRIGFHLDMTPMVDVAFLLLTFFMLTTTFAKSNTMEINLPPDTGEVKVSETNVMIVRLAGDGMAYCSLGEQIPRRIALYDSGDANRLALSGELRSLLRKESSSNKKMVIVVKISEKAKYRNLVDLIDELNLMKIDRFSLDDYTDQDEAEIKRAV

SEQ ID NO: 4906 - protein, 182 aa, Chlorobium phaeobacteroides BS1
MGMVDSPNGRDSGRKAKRRRKRLGFHIDMTPMVDVAFLLLTFFMLTTTFSRANTMEINIPPENSEVKIAETNVMTFRIARDGYAFWSIGEGTPRKMRLYDESDAMTLSSEVRQVLVQQTKANSKLVIVVKISDQAKYKYLVDLIDEFNMMNIDRFSLDDFTDADAKAIGILASGITEVPDLN

SEQ ID NO: 4907 - protein, 174 aa, Pelodictyon phaeoclathratiforme BU 1
MGIVDSPNGRRSNKKGRKHSKRIGFHLDMTPMVDVAFLLLTFFMLTTTFSKANTMEINIPPDKAEVKVVESNVMTLRIADNVMAYCSLGDEAPRRIPLYDPLDTHQLALSGELRQLLRQQTAANTKLVIVVKISEKAKYKHLVDIIDELNLMKIDRFSLDDYTEQDAVEIQRAI

SEQ ID NO: 4908 - protein, 188 aa, Prosthecochloris aestuarii DSM 271
MGLVDSPNDRRSSRKGNRQSKRLGFHIDMTPMVDVAFLLLTFFMLTTTFGKPNTMEINIPPESGEVKIAENNVMTFRIVEDGYAYWSIGDQTPTRISLYDEGRERGAMSLGKELRLMLRQQTALNAKLVIIVKISDRAKYKYLVDLIDEFNLLQIDRFSLDDFTDDDASAVGMVASTGSNVGRDAAMN

SEQ ID NO: 4909 - protein, 179 aa, Pedobacter heparinus DSM 2366
MAELDTSGGGGKKGKKVRSKKANTKVDLTAMVDLAFLLITFFMLTTSLSKPIAMDIAKPDKDDNSQERNELRASETMTILLGKNNKVAWYMGEAGKSVPNIESFADIRKSILDNKKKVADATGGRQIIMVIKPTSGATYKNFVDIMDELAITKIKTAPAIDDENITDAEKDFMKKAGIL

SEQ ID NO: 4910 - protein, 193 aa, Dyadobacter fermentans DSM 18053
MAAIEESGGGGHGKGDGKVRGKKMSTRVDMTPMVDLGFLLITFFMLATTMSKPTSMSLAVPDKTEDQEKPTEPLKASKVLTLFMGDNDDVYYLDGIAADDDKAKTELKTTRYGHDLRTVIFASQKRINAANPKDKDGNEAFVVVIKPTEVSTYKNMVDVLDEMAITKTKRYALVDNLTDSEKEVLGDKIKPKN

SEQ ID NO: 4911 - protein, 197 aa, Chitinophaga pinensis DSM 2588
MAEMDTSSSGGKGKHQGTKSKKQSTRVDMTPMVDLGFLLITFFMLTTTMSKPKTMDLIMPKDTKDEKEQNKVKESTALTILLGKKDRVYYYEGLAQDPNASANPEFFKATTFANTGGIRDVIIKKRDEVAQLRNSKGEPEDVVIIIKADNDATYKDFVDILDEMAINRIQRYATVDISDQDKTWIQQTETANGGGSK

SEQ ID NO: 4912 - protein, 865 aa, Ruegeria sp. TM1040
MTDNQSATAQEDRSLEDFVADSDTGGRLPQDALGRNALWYLPLVWSLYQLWIASPLPFILGVGVWNDTQTRAIHLGFAVLLAFIAFPGLKSSPRHHIPIPTWIIGAVGALCASYLFYAYSGVAARSGAPNQTDVIVSIVGLVLLLEAARRSLGFPLMGVALFFLAYVFFGSSPWLPEVVQWKGASINKAMSHMWLTTEGVFGVALGVSSGFVFLFVLFGALLNQAGAGNYFLKLAFAALGHLRGGPAKAAVIGSAATGLISGSSIANVVTTGTFTIPLMKRVGFPATKAGAIEVSSSINGVLTPPVMGAVAFLMTEYVGIPYVEVVKTAIIPAAISYIALIYIVHLEALKMGMKGSSRMHPVKFFLGAIFTISISILIGGGTLWLCGVLVNALESIAGGATTWLIVVIMAVLYVLALKVAAAQEDLEISIESMQNLPPTREIFKTGIHYIMPILLLMYLLMIERKSPGLSAFWSSVAMLVILATQNPIKAMFRGQDTAIADFKQGIADIFEGLIIGARNMIGLACAMGVAGIIVGAVTLTGIGQVMAEFVEFLSGGSVMLMLIFVALISIVLGMGLPTTANYIVVSSLMAGVVVELGAQNGLIVPLVAVHMFVFYFGIMADVTPPVGLASFAAAAISKGDPLRTGFQAFFYSIRTALLPFLFIFNTDLLLIDVGPIQAIFVFIVAMIAMLLFAASTMNYFIVKSKIWESVLLLLVAFTLFRPGFFLDQLQPAFETRPGSAVYEMAEAVEDGGTLRVRLVGESLEGDMVDARFLLPLGEKGADGQTRLYDGAGIEFRDEDGKIYVDNLNFGGPAEQLGIDFDWELVEMEVEADRLPKEVFYLPAFLILGFVVFLQMGRKRKEEGVA

SEQ ID NO: 4913 - protein, 891 aa, Mesorhizobium BNC1
MAEKTKNVTGEQAPLSADDLQDLVASTDTGAREPSGIAGYIIAGVALCWSLFQLYIASPVPFSLSSLTGLPLVFNDTQIRSVHLAFGLLLAFLAYPAFSSSPRDRIPVIDWILAIAAAFCALYIFIFYRELSGRPGASITRDLVAAGIGMVLLLEATRRALGPPLMVVAIIFLAYVFFGSSTVVPDVLRWGGASFSRAMDQMWLTTGGVFGVAIGVSASFVFLFVLFGSMLDKAGAGNFFIKLAFAFLGHLRGGPAKASVLSSLMTGMISGSSIANVVTTGTFTIPLMRRIGYSAEKAGAIEVASSVNGQIMPPVMGAAAFLMVEYVGIPYSEVVRHAILPALITYISLLYIVHLEAVKKDMPVLQRRQSGPFFMSLVRSLIVFLSFVLVLIGTYWLVKLVRMALPGLSTEILIFLLLGAYVAALWFAAKVPDLELDDPNAPVVKIPSALEVAKTGFHFLLPLFVLVWMLLVEHRSPGLSAFYAVLLLIVIMLTQKPLKAWFRRLQTPEIRAAALEGWYDLGNGMILGARNMIGIACATAAAGIVVGTVTLTGVGQVMAQFVELLSGGNIYLILIFTAIISLILGMGLPTTANYIVVSTLMAPVIVNLGAANGYLIPLIAAHMFVFYFGLMADVTPPVGLASFAASAISRADPLRTGVQAFFYEMRTALLPFVFVFNQELLLMDVTLLGAIFVFMKSTIAMLLFAAATQGFFMTKSRLWESAALLLVTAALLRPGFFLDFVQPPYEQIEPQRLFEVVEQLPSDSEVRVLIRGPSFEDPDQTLERTMAFNLGEAGQDGQMRFEEATDLPARIESGSVILDEPLDLNSLSGRTLSNMDFYADEPVQVVAFEVPAERMPREVFYIPAVFILGLVMFLQRRRGGTLAGNPVPQPA

SEQ ID NO: 4914 - protein, 877 aa, Rhodobacter sphaeroides 2 4 1
MTDETQPKSRSFTDEELQDLVASTDSGGRNPSNRTVAILIAATAFLWSLFQLWIAQPQLWFGQYLPVLNSSQTRPIHLTFAILLAFLAYPALKSSPRDRVPILDWVLALAGAGCAFYVFLYSRELAATARAGLPTQTQIVVGAVGIVLLLEASRRALGPALTVVGAIFLLYAWVGQGWLIPDIIAHSGLSFTSIVNAQWLDTNGVFGIPLGVSTAFVFLFVLFGALLDKAGAGNYFIQLAFAGLGALRGGPAKAAVVGSAMTGLISGSSIANVVTTGTFTIPLMKRVGFSSEKAGAVEVASSVNGQIMPPVMGAAAFLMVEFVGISYVEVIKHAFIPAVISYIALVYIVHLEALKQDMPALGPAANLGRMFAKIAVGFVVTGAAFTGLVWAIQALRGAAPGISDWIVMAVLGLAYVLMVRVSARRPDLALDDPNARQIRLPAVAEVFPTGLHYLLPILVLVWFLMIEMQSPGKSAFYAVAVMIFIIVTQRPLKALFRGEDVGQAFGAGFGDLIEGMIAGARNMIGIGVATAAAGIIVATVTKTPIGTELAGLVEMLSGGNLFIMLLLVGLFSLILGMGLPTTANYIVVSSLMASVVVSLGAQEGLIVPLIAAHLFVFYFGIMADVTPPVGLASFAAAAVSGGDPIRTGITAFFYSLRTAALPFLFIYNPTLILYGVDLGTWAGILQAVGVFAVATVAMLLFAAATQGYFLAPSRLWERAALLLVAFTLFVPGFWLDRILPRFEERPPTELAQAFDAAEPGETVRFVVQGPDFATGRPTRLTMVHTVEAEAPATGRAEAAGLLLLPEEGRLYMDEPMFGTDYQQKLQGFDFYGTERVEVSSLQSPAHRPPKQLFYIPALLLLGLVIALQRRRQTKPAF

SEQ ID NO: 4915 - protein, 870 aa, Rhodobacter sphaeroides ATCC 17029
MTDETQPKSRSFTDEELQDLVASTDSGGRNPSNRTVAILIAATAFLWSLFQLWIAQPQLWFGQYLPVLNSSQTRPIHLTFAILLAFLAYPALKSSPRDRVPILDWVLALAGAGCAFYVFLYSRELAATARAGLPTQTQIVVGAVGIVLLLEASRRALGPALTVVGAIFLLYAWVGQGWLIPDIIAHSGLSFTSIINAQWLDTNGVFGIPLGVSTAFVFLFVLFGALLDKAGAGNYFIQLAFAGLGALRGGPAKAAVVGSAMTGLISGSSIANVVTTGTFTIPLMKRVGFSSEKAGAVEVASSVNGQIMPPVMGAAAFLMVEFVGISYVEVIKHAFIPAVISYIALVYIVHLEALKQDMPALGPAANLGRMFAKIAVGFVVTGAAFTGLVWAIQALRGAAPGISDWIVMAVLGLAYVLMVRVSARRPDLALDDPNARQIRLPAVAEVFPTGLHYLLPILVLVWFLMIEMQSPGKSAFYAVAVMIFIIVTQRPLKALFRGEDVGQAFGAGFGDLIEGMIAGARNMIGIGVATAAAGIIVATVTKTPIGTELAGLVEMLSGGNLFIMLLLVGLFSLILGMGLPTTANYIVVSSLMASVVVSLGAQEGLIVPLIAAHLFVFYFGIMADVTPPVGLASFAAAAVSGGDPIRTGITAFFYSLRTAALPFLFIYNPTLILYGVDLGTWAGILQAVGVFAVATVAMLLFAAATQGYFLAPSRLWESAALLLVAFTLFVPGFWLDRILPRFEERPPTELAQAFDAAEPGETVRFVVQGPDFATGRPTRLTMVHTVEAEAPATGRAEAAGLRLLRHRTGRGLVAAKPRAPAAEAALLHSGAAASGARHRASATTADQARLLSAHQGGDHGQNHPAAHRSG

SEQ ID NO: 4916 - protein, 877 aa, Rhodobacter sphaeroides ATCC 17025
MTDESQKKSGRSFTDEELQDLVASTDSGGRNPSNRIVAILIATTAFLWSLFQLWIAQPQLWFGQYLPVLNSSQTRPVHLAFAMLLAFLAYPALKSSPRDRVPILDWVLAIAGAGCAFYVFLFSRELAATARAGLPTQTQIFVGAVGIVLLLEASRRALGPALTIVGAVFLLYAWMGQGWLIPDIIAHSGLSFTSIVNAQWLDTNGVFGIPLGVSTAFVFLFVLFGALLDKAGAGNYFIQLAFAGLGALRGGPAKAAVVGSAMTGLISGSSIANVVTTGTFTIPLMKRVGFSSEKAGAVEVASSVNGQIMPPVMGAAAFLMVEFVGISYVEVIKHAFIPAVISYIALVYIVHLEALKLDMPALGPAVNLGRMFAKIAAGFVVTGLAFTGLVWAIQALRGAAPGISDWLVLAVLGLAYVLMVRTSARRPDLALDDPNARQIRLPSVAEVFPTGLHYLLRSSSSSGSMIEMQSPGKSAFYAVAVMLFIIVTQRPLKALFRGEDAGQALRAGFGDLIEGMIAGARNMIGIGVATAAAGIIVATVTKTPIGTELAGLVEMLSGGHLFIMLLLVGLFSLVLGMGLPTTANYIVVSSLMASVVVTLGAQEGLIVPLIAAHLFVFYFGIMADVTPPVGLASFAAAAVSGGDPIKTGFTAFFYSMRTAALPFLFIYNPTLILYGVDLGTWAGLLQAAGIFVVATIAMLLFAAATQGYFLAPSRLWESAALLLVAFTLFVPGFWLDRIMPRFEERPPTELAQAFDAAEPGETVRFVVSGPDFTTGRPTRLTVVHTIAEEAPETGRAEAAGLFLLPEDGRLFMDEPMFGTDYQQRLQGFDFYGAERVEVTTLQSPADRPPKQLFYIPALLLLGLVVALQRRRQTKPAF

SEQ ID NO: 4917 - protein, 854 aa, Vibrio cholerae O395
MTQTTTPSQDVQEMVAQADTGARAPKGLPGRVLWFVPLCWSLFQLWYASPLPFIFDFGVLNDTQARSIHLTFAVFLAFTAYPAMKGSPRDRIPLTDWLLALAGSFSAAYIYLFYAELAGRSGAPTQFDVIASVVGMVLLLEATRRALGPPLMMVAALFLLYTFAGPYMPDVIAHKGASLNKAMSHLWLTTEGVFGVALGVSTSFVFLFVLFGAMLERAGAGAYFIKVAFSMLGHMRGGPAKAAVVASGLSGLVSGSSIANVVTTGTFTIPLMKRVGFPGTKAGAVEVAASTNGQLTPPIMGAAAFLMVEYVGISYVEVIKAAILPALISYIALIYIVHLEACKAGMSGLPRRHQSTVAQKLLSFTATILGLCVISAVVYYGIGWTKEAFGDAATPILTVVLLAAYVGLVKISAPYAKEGLGIDENLQYVPDVAPTLKSGLHYLLPIVVLVWCLTVERFSPGLSAFWASVFMIFILLTQRPLMALFNRTGSLGDAAKEGVTDLLESLVSGARNMIGIGVATAAAGTVVGVVTLTGIGLVMTDFVEFISGGNLMLMLIFTAVISLILGMGLPTTANYIVVSTLMAPVIVTLGAEHGLIIPLIAVHLFVFYFGILADDTPPVGLAAFAAAAIAKSDPIRTGIQGFAYDIRTAILPFMFVFNTQLLLMGIDSWWHLMLTILSSITAMLLFSAATQGWWLTKTKWWEVVALLVLTFTFFRPGFWWDMVYPAQVMYAGTKLEQIVEQAPVGQPIQMIVAGENLKGEYTSKTVQLPFEDRAVSAQERIASMGLTLLNDKNRMLVEMVEFGSPAEAAGIDFDWEIRSVVVDSDRPMKEWVFLPAILLTLLLAWNQKRRIKKA

SEQ ID NO: 4918 - protein, 927 aa, Vibrio harveyi ATCC BAA-1116
MQSADFFQKSRSHLKKETAHFLCPQINGLQICSDSLESKLRSIHYTVIAKRGSRYTIQTGPSIIRKKYMATNNTPSQDVQEMVAQADTGARSPMGLQGRILWFVPLCWSLFQLWYASPLPFIFNFGVLNDTEARAIHLTFATFLAFTAYPAMKNSPRDHIPLIDWALALAGSFAAAYIYIFYTELAGRSGAPTTVDIVVSVTGMALLLEATRRALGPPLMVVAAVFLTYTFAGPYMPDVIAHKGASLNKAMSHLWLTTEGVFGVALGVSTSFVFLFVLFGAMLERAGAGAYFIKVAFSLLGHMKGGPAKAAVVASGLSGLVSGSSIANVVTTGTFTIPLMKRVGFPGTKAGAVEVAASTNGQLTPPIMGAAAFLMVEYVGISYVEVIKAALLPALISYIALIYIVHLEACKAGMTGLPRRHNPTMLQSLLSFTGTILGLCVISALVYYGVGWTKDVFGDAATTIVTIALLIAYVGLVKISANHVKDGAIEIDAELTEVPDPGPTIKSGLHYLLPIVVLVWCLTVERFSPGLSAFWATVFMIFILLTQRPLIALLSKQGDLVEQTKDGFVDLAESLVSGARNMIGIGVATAAAGTVVGVVTLTGIGLVMTDFVEFISGGSIILMLLFTAVISLILGMGLPTTANYIVVSTLMAPVIVTLGAAHGLIIPLIAVHLFVFYFGILADDTPPVGLAAFAAAAIAKSDPIRTGIQGFTYDIRTAILPFMFVFNTQLLLMGIDSWWHLALTVISSIIAMLIFSAATQGWWFTRNKWWETILLLVLTFSFFRPGFWWDMLYPAKVLSPGVEIAQITEGLNVGESIELRVAGENLEGDYVEKTVRLPFEDKAVTAEERLSSMGLMLTENDGKMIVDMVEFGSPAESSGIDFDWEIKWVVQDAERPMKEWVFVPCLMILLVLALNQKRRARKEQLSA

SEQ ID NO: 4919 - protein, 859 aa, Aliivibrio salmonicida LFI1238
MTQSSNTSQDVQEMVAQSDTGARSPEGLSGRILWFVPLCWSLFQLWYASPLPFIFNFGILNDTEARSVHLAFAIFLAFTAYPALKNSPRDRIPVIDWILAFAGSFSAAYIYIFYTQLAERSGAPTTPDIIASVVGMVLLLEATRRALGPPLMVVAAVFLLYTFAGPHMPDVIAHKGASLNKAMSHLWLTTEGVFGVALGVSTSFVFLFVLFGAMLEKAGAGAYFIKVAFSLLGHMKGGPAKAAVVASGLSGLVSGSSIANVVTTGTFTIPLMKRVGFSGEKAGAVEVAASTNGQLTPPIMGAAAFLMVEYVGISYVEVIKAALLPALISYIALLYIVHLEACKAGMKGLPRRHTPTLVHSLLSFTGTILGLCVLSAAVYYGIGWTKDVFGDAATPIVTVALLLSYVGLTSISAKYQEHAMMAIDEELTEVPDPGPTIKSGLHFLLPIVVLVWCLTVERFSPGLSAFWASVFMIFILLTQRPLIGFFTKEGTLVNQVKQGVDDLLESLVSGARNMIGIGVATAAAGIVVGVVTLTGIGLVMTDFVEFISGGSIILMLLFTAVISLILGMGLPTTANYIVVSTLMAPVIVTLGAAHGLIIPLIAVHLFVFYFGILADDTPPVGLAAFAAAAIAKSDPIRTGIQGFTYDIRTAILPFMFVFNTQLLLMGIDSWWHLALTIISSIIAMLTFSAATQGWWFTKTKWWEVVLLLLITFSLFRPGFWWDQIYPAKDYYQGIEIAQLAEELNVGQSLTLEVSGENLEGNIVSKTVRLPFDDRAVTGEERVSSMGLMLSKVDNKMIVDMVEFGSPAEASGIDFDWEITNVVLDAERPLKEWVFIPTLLLLFALGFNQRRRAKKENLAA

SEQ ID NO: 4920 - protein, 737 aa, Desulfomicrobium baculatum DSM 4028
MAEHETPKQDNAAPGQESSASMKQAAEDLVAMVEAGAREPSNFFASGVITFLCLCWSCFQLYLAYQPLDSHIARAWHLGFAVCLAFLAYPAYKQHTPPMWVKWTRKVIPNFARRSIRTYIPYYDMILAALATAGALYIWWDYDQLINRQGLPNTMDIWMGIILIALLLEAARRSLGPALTILGGIFMGYTVFGPYLPEVLRHRGVPLDFIISDMYLTTTGIFGVPLGVSTDFVFLFVLFGALLDRAGGGKYFIDVAFSALGTFRGGPAKAAVLASGLTGLVSGSSIANTVTTGTFTIPLMKKVGFPAYKAAAVEVAASTNGQLMPPVMGAAAFIMAEIIGIPYLDVVRAAFLPAIISYLALFWVVHVESMKMGIKAIPRSQLPPFFKTLVRGCHFIIPLAVLIFFLVIVRRSPVTSALLAIESLTVIMLVQRPIIAFLTMGAHRRAGTLDPAVDTKRFIAAAAWQGLVDIWNGLIMGARNMISVGVATATAGIIVGVVTITGLVGRFITLIDTISMGNVVLMLIFTAITSLILGMGMPTTANYIIMATLTAPVIVQLGADAGLVFPLVAAHLFVFYFGILADDTPPVGLAAYAGAAIARSDPIKTGVQGFAYDLRTAILPFIFLFNTDLLMISGVTSTGDIIWLDDYLHIAWIFFSGTIAMFAFASAIQGWLVKSCSWVERLALLAICATTFRPGAFAPYLPFDRLGMQILGVCVFFLLVAWQMSQKKTKKKKKVTT

SEQ ID NO: 4921 - protein, 211 aa, Brucella suis 1330
MAHIPDGLLSLPVVVGGGVAAAAAVAVALGRLEEERIPQTAILAAMFFVASLFAVPVGPSSVHLLLSGLMGLTIGLATFPAVMVGLLLQALLFGFGGLTTLGVNTINIALPGVVFGWLFLPFVRRLPPFSAGVVGFICAALSVAGTGCGVMLALVLSSSDFVPSVKIIGITYLPLMVGEGLITGFAIAFLKRVRPEIFASQPPLAQRNHTQ

SEQ ID NO: 4922 - protein, 204 aa, Desulfovibrio desulfuricans G20
MHISEGVLSAPVLLCGAAVAAAGIAAGLRRMDYDRLMTVALLSAAFFVGSLIHIPVGPASAHLILNGLLGAVLGWAAFPAIFTALLLQAVLFQYGGLTILGVNTATMASAAVLCFYLFSPLMRRQGRWRLLGGFCCGACGVLFAGLFTAASLAFSDEGFRHAAGMILVAHIPVMVVEGIITALTVSFLARARPEVLHMNAGKQR

SEQ ID NO: 4923 - protein, 211 aa, Rhodopseudomonas palustris BisB18
MAHIPDGVLSLPVLAVGAAVAAAGCAYGLKRLDAERIPQVAVLSAVFFVASLVHFPVGPSSVHLILNGLVGVALGWAAFPAILIALLLQAVMFGFGGLVVLGVNVMNMAVPAVLCGLLFDAVRAHAGERWAVPAAGAAGVLGVLLTALSVALVLALSGREFVPAAKLVLVAHVPVMIIEGFFTAAAIGLLLRVKPEFLDRTPACLAEEIAS

SEQ ID NO: 4924 - protein, 208 aa, Rhodopseudomonas palustris BisB18
MHIVDGALSMPVLVAGSALAVAGIGIGVRQMPIDKIPAAGVLSATFFVASLVHVPIGPSSVHLIVNGLAGLVLGWAAFPALFVALLLQAVFFGFGGLTVLGVNTVDIALPAVIVYYVCRPGIVHAQPAVAAIWGAIGGALAIALTTVCVGIALAFSGDEFVPAAKLVFIAHIPVMAIEAVLTAAAVYLVRRVKPELFNAFAAPVLKGA

SEQ ID NO: 4925 - protein, 211 aa, Rhodospirillum rubrum ATCC 11170
MHIAEGIVPLSVAAPLTVVAVAGVAKGLRAIDAERLPTCGLFSAVFFVASLIHVPLGPTSTHLVLSGLIGLMLGWAAFPAILVGLALQAVFFGFGGLLVLGVNTLTMAAPAVLAWALFRGLADRLAPSRAPVLAAICGGLAVLVSALLVAGVLALSDQAFLPAAGLVVLGNLPVIGLESLITGAAVALLHRVRPEMLPRQGGRPWSGSFVS

SEQ ID NO: 4926 - protein, 205 aa, Rhodobacter sphaeroides 2 4 1
MHIPDGILTLPVLAAGGALAVVGVGLGLRGLDDRGIPRVALLSAVFFAASLVSVPVGPSSVHLLLSGLMGLVLGLGIFPAVLVALALQAVLFGFGGLTTLGVNTVNIALPGAAAGLLLGPLVRRQTSPLVAGVLAGVGSALCIFASGGGVALTLWLSSSDFVPVARVLLVTCLPLALVEAAVAGMVVAFLMRVEPRMLQPSAGGA

SEQ ID NO: 4927 - protein, 205 aa, Rhodobacter sphaeroides ATCC 17029
MHIPDGILTLPVLAAGGALAAAGVGLGLRGLDDRGIPRVALLSAVFFAASLVSVPVGPSSVHLLLSGLMGLVLGLGIFPAVLVALALQAVLFGFGGLTTLGVNTVNIALPGAVAGLLLGPLVRRQTSPLVAALFAGAGSALCIFASGGGVALTLWLSSSDFVPVARVLLVTCLPLALVEAAVAGMVVAFLLRVEPRMLQPSAGGA

SEQ ID NO: 4928 - protein, 203 aa, Rhodobacter sphaeroides ATCC 17025
MHIVDGALSGPVVIGGAVLAAAGIAQGLRHLPVEKIPTAGVLSATFFVASLVHVPIGPSSVHLILNGLAGLVLGWAAFPALFVGLLLQAVFFGFGGVTVLGVNTFDIAAPAVLVGILCRRGLAGPPAVAAIWGAVGGALAVALTTLCVGVALALSGEEFIPAAKLVFLAHIPVMAVEAVITAAAVSLVRQVKPELFSVMEAAR

SEQ ID NO: 4929 - protein, 211 aa, Brucella ovis; identical to SEQ ID NO: 4921

SEQ ID NO: 4930 - protein, 201 aa, Shewanella sediminis HAW-EB3
MHIADGVLATPVLVAGIAMTLAGTTLGLKKLDDDKIPFAAVLSACFFVASLIHLPLGPSSVHLIFNGLIGLLLGWLAFPVMLIALILQAMFFGFGGIVVLGVNCLNIALPAVMVGALLRPMRHHIPAQLLGFLAGSGAVLLTGIMVSSSLYLSGEAFSKTANVVFWGNLPLSLLEGVISGFIIVLINQVKPEILKGVHSNV

SEQ ID NO: 4931 - protein, 197 aa, Candidatus Desulfococcus oleovorans Hxd3
MHISEGILSWPVLAGCGAVALAGTAVGIRKLDPEKIPRTGMLSAAFFVASLIHVPLGPSSVHLILNGMVGLILGWSAFPAIFVAILLQAVLFQYGGITTLGVNTMIMAVPALLSYYLFRPFAGRGDSLVFAGAFLCGMVAVLTGGFLAAVVLIWSEERFLEVALLIVTAHLPVMVAEGLITGFAVLFLKKVKPDLLE

SEQ ID NO: 4932 - protein, 207 aa, Desulfovibrio desulfuricans ATCC 27774
MHIAEGVLSPPVLVTGYALAAAGTAMGLRRLDYDRLMTVAILAAVFFVGSLIHVPIGPSSAHLILNGLLGVLLGWAVFPAILSALALQALLFQYGGLVVLGVNSFTMAFSGLVAWYIFRGLTHLWPGTRGLRAAAFCGGAVGVLGAGLLTALALAFSDEGFLTAARLIFLAHLPIMLIEGLITMFTVGFIARVRPEMLQLTTQKSAT

SEQ ID NO: 4933 - protein, 208 aa, Desulfomicrobium baculatum DSM 4028
MHISEGVLSPAILGLGAVLTVGGTALGLHRLDYDRLMTVAILAAAFFVGSLIHIPIGPSSAHLILNGLLGVILGWAAFPAILVALMLQAVLFQYGGFTVLGVNAFNMAFPAVLCFLLLRPLLSRPGPMRTMGAFCCGALSVAGAGLLTALSLAYTNEGFLQAARLLFLAHVPVMIVEGIVTTLTVSFLSRVRPELLRFASRSKGGIRA

SEQ ID NO: 4934 - protein, 204 aa, Desulfohalobium retbaense DSM 5692
MHIAEGVLSAPVLLVGAVAAAGLTGVGVKKTDQDRIPVVAVMAAAFFIASLVHIPLGPASVHLILNGLMGALLGWACVPALLVGLGLQAVLFQFGGLTVLGVNTVIMAAPALGLGLVLRPVIQGRGVVAVAASFCVGMGGVIGAGCVAALALYASGEEFLSAAQLLVAAHLPVALLEGGVTAIVVGSLKRIRPEIFAATSESGV

SEQ ID NO: 4935 - protein, 112 aa, Methanosarcina barkeri fusaro
MSDKPSKKPSEDESPLARQVGTKAERKLRAQRHVNRTIWLGLGMMGLIGWSVAVPTLIGTAIGLWLDKHYPESFSWTLTMLIIGLFIGCLNAWHWLAKERKEMQEEQEDYNE

SEQ ID NO: 4936 - protein, 122 aa, Pelobacter carbinolicus
MTEDKDKPRRSGQQSREDLRRLLAAKQERKLRAIGQRDRNAWFGLGMFGLVGWSVAIPAVALTALGVWIDARHAGPYSWTLMLLVIGVGLGCVNAWFWISRERKEIETQRHEPPKEDLHDTD

SEQ ID NO: 4937 - protein, 106 aa, Chlorobium luteolum DSM 273
MTERPEEKGPLSKRVGSSEQRKLKARKRTIRNIWFGFSLFGLIGWSIVIPTLAGVAIGLWIDSRYPSGRSWALMLLVAGLAVGCWNAVRWMLEEKKEMEREERDDE

SEQ ID NO: 4938 - protein, 163 aa, Nitrosospira multiformis ATCC 25196
MKVPAGLRGKREEREGKEKREAEFSRRIKVKAARKLRARRAGNRNTEMVWAGLGMIGLVGWGISVPTVLGVALGIWLDRRFPGGYSWTLTLLFAGLLVGCLNAWRWIVREEQLTRRKESQEVAAQERGSKSKNETSDATREMGKQDGVNKANRKITENEQGEG

SEQ ID NO: 4939 - protein, 111 aa, Rhodoferax ferrireducens T118
MNNEPKKPPKKVSDYVGQVGVKAARKLKAQRNTTPGVWFGLGMMGLIGWSVVIPTLLGAALGLWLDERYPGGRSWTLALLVAGLAIGCFNAWHWVAKEDKAMREEQENDDE

SEQ ID NO: 4940 - protein, 130 aa, Pseudoalteromonas atlantica T6c
MKSHSAKPQPNENKHSANNDAPHLAKQVDAKVALKLKAKRQKNAGVWFGLGMMGTIGWSIAIPTLIGVGIGIWLDKQYADPRSWTLALLLAGLALGCFTAWAWISKEYAAMHEDATMQKHDNKENDQHDV

SEQ ID NO: 4941 - protein, 125 aa, Shewanella frigidimarina NCIMB 400
MNHKPEENITPEKSHSEPPKPEKDKSNNDKFSQQVEDMATRKLKAQRHINKTVWTGFGMMGLIGWSVVIPTVLGAVLGMWLDKHYPGEHSRTLMLLIIGLCLGCFNAWHWVDKEDKEIHRGDELD

SEQ ID NO: 4942 - protein, 127 aa, Psychromonas ingrahamii 37
MKLKSGKKSARKVENKGLNNEEKKSDFVGMIGLKTARKLHARRNSSPGMWFGLGMIGIIGWSVVIPTLLGAALGIWLDNHYADQRSWTLALLIAGLTLGCFNAWYWVDKEQQTMSNEQEQEKKDEGE

SEQ ID NO: 4943 - protein, 111 aa, Polaromonas naphthalenivorans CJ2
MTDKPRKTSKTEPGLAEQVGVKAARKLKARRNPAPGVWSGLGLMGMIGWSVAVPTLLGAALGIWLDRRYPGGRSWTLALLMAGLMLGCLNAWHWVAREDAAMREKPEHDDE

SEQ ID NO: 4944 - protein, 126 aa, Marinomonas MWYL1
MKDDDEDKNGTKTDRNLDRSLDQKPKNNYSKQVGSVAARKLKAQRHVTKTVWSGLGMMGLVGWSIAIPTVLGAALGIWLDSAYPSDRSWTLALLVVGLCLGCFNAWHWVQKEDKDIHQPEDNDDVN

SEQ ID NO: 4945 - protein, 111 aa, Prosthecochloris aestuarii DSM 271
MSDDQKKHILEQGSSFGKEVGAKESRKVRARKEGPANVWSGFAISGLVGWSVVIPTLFGVMLGVWIDSRFPGSYSWTLMLLMAGLLVGCFNVWHWVSRENREMQREDSDDE

SEQ ID NO: 4946 - protein, 110 aa, Desulfomicrobium baculatum DSM 4028
MSEKPEIKSKDDRTTFSREVGAKAARKLKARRNPTPGVWFGLGMMGLVGWSVVIPTLLGAALGIWLDHRHPGSHSWTLALIVAGLTVGCFNAWHWVAKENREMGKEDNDE

SEQ ID NO: 4947 - protein, 260 aa, Ralstonia eutropha JMP134
MNLRWICVLTATCLTLYAQASPLALPDPPDMAFAPTLGKQVPLDLVFRDDDGTPVRLRELSAHRPVILVPGYYHCPNLCSTVMDGVLESLAQAHLPRGAWRVVAFSIDSGETVAVAAAKKQSYGALVAASGGNLHMLTGDTAAVGTLMQAIGMRVSRPPGASEIAHAAGFAVLTPDGRIAQAFNGVRFDASALRTAIERASAGKVGSPAQQLLMRCVHFDPLTGRYTVTILDGIRALFLGAFAALAGWWLWQHRQRRRSS

SEQ ID NO: 4948 - protein, 262 aa, Nitrobacter hamburgensis X14
MKPLFAALFIMAPLVLATGAQAALTRNELDGVFLSPAADAAAPLALKFRDIDDRRLTLREAIGGRPSLLLFVDYNCRTICGPALAIASGALAQTGLDPAKYRLVVIGLDPKDSAKDARLMARQIGDSAVERVTILLRGDAGNVHRLTDALGYRYRYDVAADQFAHPAGALVMTADGRVSRALSSLALNPRDLRLALVEAGAGHIGTFADRLTLLCYGFDAAHGVYAPAIARMLKLFAALTVISVLGAIAVLERRRRMSKDIR

SEQ ID NO: 4949 - protein, 280 aa, Candidatus Koribacter versatilis Ellin345
MALPLLAVSAAIAQPPAAFMEKQNSGPASQVDPASLKDIGIDQHLDTQIPLDLQFKDENGNIVKLGDYFKKGRPVILTMVYYQCPMLCSEVLQGLNSALQTMTFSAGNQFEVITVSIDPRDTPELAKEKKASFLKEYNRPGAEDGWHFLTVNDPKDVAKLANVVGWKYRWDPKMQQFIHAAGIMIVTPQGKLAQYYYGIEYAPKDLRLGLVEASQDKIGNLVDKVVLYCYHYDPHTGKYGAVVANLLRIFGAATVLLLGGFIVLMVRRDSHAGRHETGQA

SEQ ID NO: 4950 - protein, 261 aa, Methylobacterium sp. 4-46
MTRLLLALLIALAPCAARAGLAASELAAAGLAPPAGARLPLGARVTDESGRSLALGEALGGRPALLVPVDFTCRTLCGPALAVVAGALGETGLRPGADYRLIVLGLDPKDGLAEGRALLGAQVADPALRAATVLLRADPAALADLTRSLGYRTAYDAEHDQYAHPSAALALTLDGHLARALSTLALDGPSLRLALLEAGRGAIGGVAGRLAVLCYGFDAARGIYTPAISRLLTLAGALTVAGLGLALWRLGRGGGPARRVP

SEQ ID NO: 4951 - protein, 260 aa, Gluconacetobacter diazotrophicus PAl 5 JGI
MTPGPTIGRAMVAALALAVSTAAWAGPMQDLAFTQRQGAIVPLDARFTDTAGRTLPLGAFMDGHPAILSIGYYTCPNLCALEREDLLHALDAGGLKTPDDYTLIVVSIDPAETAAMARQARQDDLASHATPGADRGWHFLVGQAASIARLSQAVGFHARYDPALKQYLHPMGLVFMTPAGMVSGYVLGVGYRPGDVRQALAWAAAGQRAEASPVLLLCFHYDAATGRYTLAVRKLLRLGALMTVLTLATLLGMAHWRRAR

SEQ ID NO: 4952 - protein, 342 aa, Methylobacterium nodulans ORS 2060
MRRILLALLIALLPVAAPVTAQAGLSEADLAGAGLSPPAGARLPLALRFTDQTGRVLALGDALGERPALVLPVDFTCRTLCGPALAVVASVLAQTGLRPGADYRLIVLGLDPKDSLQEGRALLDAQVADPALRDATTLLRGEAAAVAGLTRAVGYHTAYDAEHDQFAHPAAVLAVTPDGHLSRALSTLALDGRDLRLALLEAGRGTIGGVAGRLAVLCYGFDAAHGIYTLAISRLMMIAAVLTVLGVALALWFLGRNGAATASGDHPPPHAEVLWAIFDRPKAASKHPKPLVRDKGDREERSWVLRGCGGAAAPQHEEPSLYHDPAAPRRDGGGGRAAREAS

SEQ ID NO: 4953 - protein, 279 aa, Chloroflexus aggregans DSM 9485
MKRWISLTLLGWLSMLLLAPVTVLAQGSKSNPADGVAFEQRMGEQVPLDSVFIDEQGNEVRLGQFFRSGLPVVLVMSYYECPMLCSFVREGVLSALQQVPLTAGQDFQVVNISIDPLETPMMASGVKTLTLQRYARAGAEDGWHFLTGSEEQIRRVADAIGFKYVYDETIDQYAHAAGFVVLTPEGKTSRYFFGIEFNVSDVRLGIVEASSGKVGTPIDQFLLLCYQYNPITGQYTPAIMTILRIVGMLTVIGIITLIVTLSRSTPGGNLPPPRESVPA

SEQ ID NO: 4954 - protein, 259 aa, Pelobacter carbinolicus
MIAMLPNTTESVRAAALAAAAIIISLAILACVPLLLDQTSPAQRHNLPRTNRNIPLVPEKTPEDRLFEQQELPDPPAPEPILNAPPVELPEVAPPDTQAPATSCPDMTAAALASLPAVDLPVRVAVPLQGLALRPDPQRLAMNINPGKLHLPATAPTTGHRFNLDEVDRRPQGISTMQPLYPYQARRMAIEGYVTVRFLVTHNGSVDELTILKAEPEGVFEQAVKSTLRHWRFKPGQKNGRPVATWVKTSIEFKLQDAS

SEQ ID NO: 4955 - protein, 219 aa, Desulfovibrio desulfuricans G20
MIVRPIRHTGRLIAGAAGAVFMVGLLHVGILQLNRGGETTHPEEIHGAIRLAQQTDEPPVPEERAKTIKETPPPEKLPRTFSSKQTSRPQRPAMTQAPSFSAELHPSVKGGMVMPALSVAGATFTLAEVDTPPRVVRTVPLKYPLVAKRSNIEGYVIVNMLVTAEGNPEQLSIQAASPAGIFEESALEAARQSRFTPGKLNGQAVDTWVQQPFEFKVTQ

SEQ ID NO: 4956 - protein, 260 aa, Chromohalobacter salexigens DSM 3043
MRAIAGAAGGVLMALGLFYLLALLVAPPDDAREPIEQPMSVSRVEAPKAQAPAPQAAAPDAPTPPADTPPPPPPSPVPAAQSDSALALPEPERSAPPTPEVPQETLPELEEIELQPEPMPEPQPEPEPAPEPEPTPQPTESSSANEASQGESEAASADQAADSGESSQAPSQEVGSPQPTERVPPEYPSRAQRRGIEGYVEVRFTIQPDGRVDTDSLRVTEAQPRNVFERAALKAISGWRFPRADAPREARQRLEFRLKR

SEQ ID NO: 4957 - protein, 249 aa, Campylobacter fetus 82-40
MNSFIGFFISLLLHAGLIFGFILLNAKDSADQIQNEQLLKLTFSNLNSLEDIPKPYEEVSEPIIEEKKEVDQAPQKKIIEKKIEQIYTKKIIKHTKPDKKQEQTPKKQIVQNIETKQMPGIDPNLKSITQNSIEQKIFDQNTNQNKIEQQPKNTVNENMIIGTKIRNIIANYARKNYPNSARRKRQTGIVKVSFMYKASGEVTNVKIDHSSTYMVLDEAVLTAIQKTKSKFPSIKNDTNFQIEVEFSLS

SEQ ID NO: 4958 - protein, 283 aa, Psychromonas ingrahamii 37
MKIISSYFPFLIISLVFYGFIFLYLDQPKRITTLPLNSGEQSVQVQFISQPNKGQNPAEDKLAAPTEQKIVEAKSYVTEEEVVERAKVKSKKVIKYSAKSLILSESEIKLRKQALLESFATAGTDNVAKLKAEIFLEQLATEKILTNETEQLSKTKDQASSPQTSNGPAKKAVIKKSPSENSSSLASSTKNQGVLQEAIVVSGRKPVYPQRAILRNQQGRVVIKLTITKKGLPKNPKILTSSGFPLLDDAVLAFVDQELFMPALQGEDQVMSEQLFAFRFELN

SEQ ID NO: 4959 - protein, 246 aa, Anaeromyxobacter sp. Fw109-5
MTSPPSDGSPRARTLAAMAVASLAIHAGGFAWAARLEARPAARPAPVVVEFEAAPPPPAPVVPRPPAAPPAPRRVAISRLPPPPADPPPPPPPNEPPPPAAPAARAVPRVGVSLSSTTTGGAFAVGVGNTLHGRASEIAADPEAVRPYSAPRTSPARLSAQPRLLERPEIPYPADARRDGLEGQVVLLLRIDAEGRVAAARLLSAPGPALGEAARAAALRFRFSPPLLEGEAVETEIRFTYTFVLE

SEQ ID NO: 4960 - protein, 228 aa, Candidatus Desulfococcus oleovorans Hxd3
MKATPVIHAGNFQKGRDWAAAAGLALLINLLLFAALPAVKLPPAPAAEPYRQPGPVTVTRLRPSRPLPAPAPLVKPSVPEKKPEATAPARSVPAVKKVPAVSPEPVETTRPDSGAETTPEAPPVPAGPQVFDAMDLDSPLVPVFRKPPVYPAHAKRRNIQGWVTVSFLVDAKGRVTDVTVTESDPESIFDDSVIQCVSGWRFKPGTIAGRPVVTKVTTTIRFELKADE

SEQ ID NO: 4961 - protein, 244 aa, Anaeromyxobacter sp. K
MTAGQAPGLRGPLAGAAAASLLLHAAILAAALRLPPRPRERPAPVVVDLEAAPPPAPPPAPEPPPAAPPPPRRVAAAALPPPRPIPAPPAPAPPPPPDAPAPSPAPARAPRVGISLSSTATAGGFAVGTGDTLAGRPREVADAPEPARPLPAAPRPSAQPRLVARPEVPYPPDARRAGLEGRVVLLLRVDREGRVAAARVLSEPGGGLGAAARAAALGFRFQPALLEGEPVETEIRFTYTFVLE

SEQ ID NO: 4962 - protein, 243 aa, Anaeromyxobacter dehalogenans 2CP 1
MTAGQAPRVRGPLAGAAAASLLLHAAILAAALRLPQRPRERPAPVVVDLEAAPPPAPPPAPEPPAPPPPPRRVAAAALPPPRPIPAPPAPAPPPPPDAPAPSPAPARAPRVGISLSSTTTAGGFAVGTGETLAGRPREVADAPEPARPLPAAPRPSAQPRLVARPEMPYPPDARRAGLEGRVVLLLRVDREGRVAAARVLSEPGGGLGAAARAAALGFRFQPALLEGEPVETEIRFTYTFVLE

SEQ ID NO: 4963 - protein, 237 aa, Desulfohalobium retbaense DSM 5692
MSGWARRTGLVLLALAVNALLFGTIPYLTQVQDQRLRSRQHHDPPQVHHQVTLEPEPADPAPDASSKPQETPSPAAAPSPAPQMPEAAPSPRPQTQSSPRIQRPALDLPAPQWEPSAITLPKPSPSERGPKSPGSGSPLEAPALDRQPRLVSHLRPVYPYKARRQGLNGTVVVEVLVSAKGRVAKARVVRATPENVFEDSALKAVRQWRFAPATANGKPVRARVRIPIRFSLENQNP

SEQ ID NO: 4964 - protein, 1106 aa, Nitrosococcus oceani ATCC 19707
MDEYRVLKTVNFDWTMQLQSVWRNSPLHVPGLHENLRTELMETLKERMGSQDQNPLGQIITGPAGAGKTHLLSAIRQEVAALPAWFVLVDMTDIKDFWETVLLGYLNSLQQATSGNRPQFQSLLKHLLNPDVKPQNPFSSFYRTPSRSRKSPLQWLTALLAGKKAQRQEAAPATPRQIAEYGDKELAQVIRQTINRLSTQYPEEIRAHQDALRALMLLNSNDLERANVGYSWLQGMAIDETDRHLFGFLWPQRQPSEIVKSLSWLMSRYAPTLLAFDQLDAIMSQHHITTASSGEGERMTGEQRASQAIIEGIADGFMAVRDTVYRTATILACLEGSWEILRKGSLKSATDRFASPQPLPPINNATLAEEIIALRLAHAYHAHGFTPPYPSWPFQPQVFASAATLLPRELLKRCEEHRLQCLSKGEVIELACFESPPEATETLATIRPDPGLDHAYQELCRQAPIQELLSEEAEDEVLGMLIPALCRCLLRETPLPKSRRGVVDTEFPGDKNYRALHARLRIIDSSQENREQHYCFRALQKTHATAYQNRLNGALTASGIDSKLPFRRLIIVRTTPLPLGKVTREITDKFLQAKGKFAAPNEQDLRTMWALHKLEQQNLPGFEAWLRERHPATQLQWLQETKITECLAADAFPLENNLPLNAKENTDIWAKLPAPKRHNYKATTPSYPSALPVGKILSNPAEKITIPLPLLTQYTGILAGSGSGKTVLLKRWVEEAALLGIPSIVIDRTNTLVSLGEQWPAPPTSWTPEDQEKAEHYHANNEVIIWTPGQADGNPLQLEPLPDLASLLEQPEKFQQALEMAQSTLKEIVAPGKSAHSDYKMDVLTAALKLFAIQKGKTLPDLIAILSHLPAEISTSISSAARLGSEMAQRLQAEIQNNRLFYPESPFLDPGCLFKGTSANRSRISIINLAGLPDLKTQQQFLNQLAITLLGWIKQHSASPSMPVQGFLILDEAEDFIPAEQSTPCKDNLLKLAEYAPTGGLGLVFSTQNPKNIAPPIISDCFTQFAGKASAPAIIEAIREQFKIRGGEEDDIPVLEAGHFYLHTEGMPAPVKVAIPWCLSYHPPHPPEKAEVLKRAAASRLQAQNP

SEQ ID NO: 4965 - protein, 1071 aa, Rhodopseudomonas palustris BisB18
MSSQEAVSDLEAFRAVDFNWTRQLKGIWRDQPYHAPLHQDVLDELMGYLLSNTRDAEPDNEPLGRVVIGSAGLGKTHLIGELRRRVWEEDAVFILLDFVGIKDFWSSVALGFLNSLQVRIDERRTQYDRLIHKLATLLELQSQLADIAVRLRGRPRELMAELVKTFLGALARRDRAMTQQHGDVVRAFVLLISEDLECGSIAHAWLQGMDLDAEQLRDLGFVVVKKSPIDIVRGISWLLSLVGPTLIAVDQIDAIISEANAERHRGNGAAASEQTQETQSIIEALAHGLMDLHDVKRRAITVVSCLEASWEVLRSQATVAVTDRYYRPNVLYALTQPQLARALVSARLAQGYAASGYTPPDETYPFAPETFETAVGFTPRQLLKACDEHRQRCLAEGRVILCKSFDAAQPPPPRPTRNGYDEAFGHELRAASTAGLLDLSNEDPLRDLLADVLQIYTAHLQLPDDVDVVSQPDPDQRRPSLHGRLSFVFRSEGDREQHYCFRVLAHTNAIAFQGRLRAAMTASGVDRALKFRHLFILRAGAAPGGAKTAQLVEKFLQAGGQFIAPTEQDLRAFVALRAMAQRNADGFEAWLRARKPLFDTALFKAAGLAPPPFLAGPQPDPAKPSGSSPVPPPAPPAPSLVSTAPRSAPSPVAPAASKPVDRDIPVGHRYERGTAGAAAMLPADLLPRHTAILAGAGSGKTVLLRRIVEEAALLGIPAIVLDTNNDLARLGDQWPAPPEGRSADDAAKAANYQRDVEVVIWTPGFNAGRPMSLALLPDFAALKDDEGERDLAIEMARATLSPYIGGGKGASAKLKEGVLADALRSFAHAGGGDLERLIELLAELPDDTSRIDDAAKLAAAIANQLRAAIATNPLLQSRGTPLDPQVLFGTDAGKTRISVINFSGLASDEARQAFVNQLQMSLFSWIKRNPSPTGRLYVLDEAQNFAPSQRTTPCKESTLSLAAQARKYGLGMILATQTPTGIDHKIISNCTTHFYGRMSSPTTIEATKGLMAAKGGSGEDIGKLSRGEFYFSTEGLPRPVRIRTPICLTWHPANPLTAEQVVTKARAAVPN

SEQ ID NO: 4966 - protein, 1043 aa, Mycobacterium vanbaalenii PYR-1
MDTVQREALASLRLTWAPTSDDLWRPQGATHVTGLNEHAVDDVMDAFGDALADPASTPLGVVIRGPAGSGKTHLLGQIRERVQDGGGFFFVVELLDAASFWESVRSGMLESLGRPGANRETQLKDLLWELASLAHVSRADRRAIIGDDDLDPETLYRFIKALSSAAKETVRQCHQVLRALVLLGSNDFVAHDIGEGFLEGTEEFTVEERGPWGLRSAPASAQECVRDLSRLVALAGPSVLAVDQIDTLIAQSVAATGQSTGDGGIVLEQVAHGLMALRQTMRRTVTAVACLPAVWEHIRDQAGAAVADRFRVTGVLTPLPSADIGRAILERRFAASYAATGFTPLYPSWPLAPEAFEEAPSYTPRQLLIRADTHVRECLKHGTVVELTHLRADAQPTWETQSPNGNAPVSGALDRRFAEYRRRAVPEAALAHDGEDTTMPELLSAALTAWIAERDGEQTFVCDPPPGAHVVLHARLRESLDSATDDERHWAFRAVAATNATAALSRIRKAVTAAGFGAGSDRRSLFLLRNSPWPSGPKTAAVIDEFLAAGGRVLPLSDDDVRTMTALRDLIRDDDPDLPGWLRARRPAHGLTLLAEALGDGPAEPVAVVPEDGPEAALPVDEPESVVDHDYEVPDTELPLGLDVHTEEPVTVGLSALRKHVAIFAGSGSGKTVLIRRLVEECALRGVSSIVLDPNNDLSRLGTGWPQPPDGWRRSDGARADDYLRHTEVTIWTPRRTNGRPLAFQPLPDFASVVADYDEFTDAVESACAALEPQALITGKTQKATRSRAVLREALQHYGRTPSPTLDGFVRLLADLPEDVSNMAGAHAIAGDLSQNLRAAMVNDPLFGGAGTPVDPGVLLTPSDGYRARVSVISMIGLPSDEQRQSFVNQLQMALFAWIKRNPAGERPLGGLLVMDEAQNFAPARGFTACTRSTLALSSQARKYGLGLVFATQAPKSLNNNIPGNAATQFYGLLNAPAQIEAAREMARAKGGLVDDISRLRAGNFYVAAEGEAFHRIVAPWCLSYHPSSPPSAEDVLELAISV

SEQ ID NO: 4967 - protein, 1031 aa, Mycobacterium gilvum PYR-GCK
MDTLQREALASLRLTWAPTSDDLWRPQAATHVTGLNEHAVDDVMDAFGDALRDEASSPMGVVIRGSAGSGKTHLLGQVRERVQAGGGYFFVVELLDAASFWQSVRSGVLESLGRPGTQRETQLKDLLWELSSLAHVSRADRRAIIGDDDLDAETLYRFIKALSGVAKETVRQCHQVLRALVLLASNDFIAHDIGEGFLQGSDEFSIAERGPWGLRSAPESAQMCVRDIVRLVALAGPAVLAVDQIDTLLAQSLAGTDGDGVLEQVAHGLMALRQTTRRTVPVVACLPAVWEHIQDRAAASVADRFRVTGMLTPLPSADIGRAILERRFAASYRAVGFDPPYPSWPLAPSAFEEAPSYTPRQLLIRADTHVRECLKRGEVVELAHLRADAQPDWDTVSTNGSGAVSTALDRRFAEYRRRAVPAAAVAHDGEDVTVPELLSAALTAWIAERDGEATFVCDPPPGTHVMLHARLRETLDSATDDERHWAFRAVAGTNASAVLSRVRKALTASGFGSGGDRRRLFLLRNSPWPSGKKTTEEIELFHSAGGRTLPLSDDDIRTMTALRDLFADDDPELAAWLRARRPAHGLTLLREALGGDSESAEPAAPEPEPDPEDEVVADYDVPADEIPLGLDLQDEKPVTVQLSALRKHVAIFAGSGSGKTVLIRRLVEECALRGVSSIVLDPNNDLSRLGTAWPQTPAGWRRGDDARADDYLTNTEVTVWTPRRTNGRPLAFAPLPDFAGVLDDPDEFTEAVEAACSALEPQALITGKTQKATRSRAVLREALQHYGKTESPTLGGFIRLLADLPEDVSDIAGAHAIAGDLSQNLRAAMVNDPMFGGAGTPVDPGVLLTPSDGYRARVSVISMIGLPSDDQRQSFVNQLQMALFAWIKRNPAGDRPLGGLLVMDEAQNFAPARGFTACTRSTLALSSQARKYGLGLVFATQAPKGLNLNIPGNAATQFYGLLNAPAQIETAREMARAKGGLVDDISRLRAGNFYVATEGESFHRIVAPWCLSHHPASPPSAEEVLNLATSV

SEQ ID NO: 4968 - protein, 1144 aa, Frankia EAN1pec
MSAELEALAAIKLDWVHGLEDVWRDSPVHVDGVHVEPRRRILAALDRLGERKPPGIVVQGQAGAGKTHLLGWVRQQVERRGGYFFLIGPVSGDAFAESVVSAMLTGLFRTVDGEAEIRRFLLALCAQFRVPAELTSAVVGDQPLEPTHLKDLVVAFFDHDRALARECQHTLRALVLYSSDDYDAQAVGETYLRSMDEQEPGERARRGMQARTRPPMDIARDLSRLLALTGPSVIAVDQVDGVVAELTARDEAADSGLGGFGGSGAVRLNMLADGLLVLHERMERTLCLLACLPVSWIQFRERAVASMRDRFSAIMPLNRLDDPEITARIIERRFQEDFDRIGFAPHYPTWPVARSAFDRAPQYTPRELLQRIDRHIQECLSTGVVRELFDFAAADENDIVDVQDNGDHDITDITVSTNFTDGTDLDGERLDRLDRLGREDRSGGGRGRAADEVGATSPEVLSALDAQFAELRAGAPRVAAVNEDILVPVLLTAGLSAWIIENGGAHDYSLEPMPSTRPALHARLTRTVDADTGEQLHWCFRAITASHGNAILPRITAACTAAAMVAGNPRRRLFLLRNDPWSPGKKVQQALAAFSAAGGRTLRLHAGDLDTFMALRTLLDQRPAGLRAWLASRRPASGTWLLREALGDAAGTDPTGSAALAPRAPTMTPGPGRLGSAGDPDPDPDFDFGPEAEPGPESPPQVAPGPRSAAPAGVVRSSFASADDLGGGVAAPSALTLGTAVRGDAPARIDLAVLRRHVTIFAGSGSGKTVLIRRLVEECALRGVSSIVLDPNNDLARLGDAWPSPPAGWRDGDAQFAAEYLAATDVVIWTPRRDGGRSLTFQPLPDFAGLRDDPDEFEAAIDAAVATLAVRANVTGNANRASLGRAVLTAALRHFARGNRTGLTAFIELLAELPDGVADDLDPAGKRSVELAQTLRAAMVNDPLFGGKGEPVDPGTLLVPAPGQRARVSVISLVGLQHDEQRQSFVNQLQLALFSWVKRNPAGNRPLGGLFVMDEAQTFAPSGPSTACTTSTLALASQARKYGLGLVFATQAPKNLHNGIPGNATTQMFGRLNAPVQIEAARMMARACGGDAPDIGRLAVGEFYATSETLPFMKIRTPMCLSHHPPSPLTAEEVITRARPDLTA

SEQ ID NO: 4969 - protein, 1076 aa, Methylobacterium sp. 4-46
MTDALDALRRVDFDWVNTLDSVWIDAGAAPGPNSAQAAGIVREFVRRARAPEDKLKGAILVGQSGIGKTHLVGEMRREIWRAGGWFVLLDVLGLADFWRSTALSYLTALLHRMPDGRRQCEAVLAGVARRFNVEQQVEQAFATPDIDARRVVDLLVRALTQIDMARALRHQDVFRALCLLRASDVGVVGLAHAWLQGHDADEEARRALGFRSAPPPPAELVAGMSWVMSLAGPTLVAVDQIDGVVSPASAALGEDFEPGPNLAAVLTAGLLELHDVRHRGQTVVTCLVDSWERIRENGLRSGTERFEPPVALLGMNDRRAASALVVDRLGRAYAEAGFTPPFPTWPFGEVAIAEAAASGMMPRTLLMRCDAHRRACLERGTVTVCESLIAEAPPRDPGAPRAPFDLAAAARAADIAGLLDGEDDAIGPLLRDAFDLYALQAPPHERVEIVNRGDPDQRIPPLHGRLTFIFRDDNDRERHICYRGLTQRHAIAFQARLRAALTASGIRTRLHHRELVLVRRGPPPGGAKTQQLFDVFTRAGGRLIDPADADLRLLVALQTLRARAVAEGRLAEFEAWMRAARPLDGLGFFRAAGLGEAAALAPPPAEGATRIPPRRHAAGRPAPDAPPFDPGPTSRISAEGIAPEAKVAPEPRRETPPGPRAEAIPDRIPLGRRTTPEAEPVDLATALLRRHTAIIAGSGSGKTVLLRRIVEEAALAGLPAIVVDPNNDLSRLGDPWPEPPVGFTAQDEARAGRYRAQVEVVVWTPGLRAGNPLFVPAMPDFSGLGGDADERDQAVEMAVETLAPLAVAGGRRELQRGVLADALRFFAGRGGGDLPDFTALLSDLPDGISLIGDAGRLAAGMANQLHAAVATNPLLRAEGPVIDPALLFFGRDPARTRISVVNLSGLASEAAREDFVNRLQMTLFGWIKRHPSPRGLLYVMDEAQTFLPAQRQPPSLGSGIKLAAQGRKYGLGMILATQAPRGIHNQIVSNCTTQFLGRQASPATIAAAHDILSAKGGGAGDIGKLKAGEFYFSTEGSGRPAKLRTPYCLSHHPANPPTPEEVTVRAHRAAQVLAGG

SEQ ID NO: 4970 - protein, 1100 aa, Actinosynnema mirum DSM 43827
MTLVGPGLDDERRNALQAVHFNSAVAPDDIWSPLAHHVPELHGPVAAELARAVASAARKPRSTPIGVVLRGERGVGKTHLLGWLRQEARARGGWFFLLKLLDDRSFWAGAVHGAISGLNREGDQLGAMLDALAKATGHTDESRLRLRGTIPISREYLDELVERVRELDPQVALECQDTLRALVLYRARGRPSEVGHRFLALEDGGIDEADRAEWGFHLRSRSAQLVLGDLSRIFALTGPVVMAVDQIDSVITQQPGSSGLVDRLADGLMRLREETRRTVLVVACLPRSWELLSEHAVNSAASRFAVLDLRTAMPSAGVAEAIVQRHLGALYAEEGFAPPHPTWPVARVAFGGAEVAHSTPRRLLQRVEEHVRWCLARDVEAELRDFADGPAEVAAPEVDAGGLAELDERFARACEAADVTSPLDPAREDELVPGLLSAALRCYAVEHGGDLVLDPPPGRKPALHARLRLTLDEASEDEVWWSFRAIAHGHSTAVLARLRSACLEAGVFGGTGKRRLVVLRGTPFSGGPQTARAVGELVAAGGEVLPLTPEDLRVFSALRELVGQAPAGLLAWLAARTPASRTPLLRRVLPPVGDAGSQAPQRPSAHDEPVWPEREYEEQVCALPAPPPQHAPEPSWPERGWPAAEPSRLAGSLFDPESRWPATPAPVPTPTLIPAPAPAPAPAPVVAPTSPPSADATITLGADATTGRPFTLPLVLLRKHVAVFAGTGSGKTVLLRRLVEEAALHGVSSVLLDTNNDLARLGDAWPSPPEGWAPGDADRARRYLDGTDVVVWTPGRESGRPLVLDPLPDFGAVRGDPDEFRGAVDAAVAGLLPKLALSGRRLVHGRAVLTEALTAFAGRGGRDVADFVAFLHDLPEGASTMRDATRLAPELADGLHAAIITDPLFGGSGRRLDPGELLRPAPGTRARVSVISCVGLPTDGQRQAFAHQLQQALFAWVRRNPAGDRPLGGLLVLDEAQTFAPSRGEVVSSASTRLLAAQARKYGLGVVFATQAPKGLHNSVTGNTATQFFGRLNASAQVQTAVELAAARGGRVDDVSRLGAGRFYGATEGTGFTKLRLPMCLSHHPQGALTEGEVLARARA

SEQ ID NO: 4971 - protein, 306 aa, Nitrobacter winogradskyi Nb-255
MNWGWVTSLDQFWRSPAFPMWLTLAGAVFFAFIVFLTLIRAEKSVANGVLTIITLLAIGVAAAVALRTFEADGSRSLDSKNQSVRTNIAIPALSCIDGLAGEVVESACEKALFGTPDAVAAAVSYVASEINRLRSFGAAAADGSIVAPELEVLRRTIERDRYGLVAHVLVARDHCQPSDCAAFQSLTDHGRIAANMKEQLYENLVVRYASSWNAPAVAQAAAPGTPPVPALASEPTGNPTTMDFPTAESIPPVSIMTPEPAAAPPASSSAAAQAVPKPRPAARKPHAPKPHAPPPVRLAPPPTPQN

SEQ ID NO: 4972 - protein, 345 aa, Rhodopseudomonas palustris HaA2
MEWASWSAAADRILHSPNLPIWAAMAAAAVFVLILVIALVRADRSVANAVLGVITLLAVGVAGLASWRLFVDSAGPVVRNADAGRAINTMPALACVDDLAGDAVQAACERALFSSPETVAAAVSYASARMAQLTAQGDVASASKRMTPELDRLRRSIERDRYGLIAYVLTAQDRCVPDQCAAFQSLTDHSRIAANMNEHVYETTVTRAAPAWGAGSGPLAAAAPVPGGVLGVAEAPSGKPVNIDFATSSSIPPISIMNEPAPAAPKPAATAAGNAAGHAAPSAAAKRPPAAPSAQAPANGQAAAAGGQAPANAQAAVRRPPPPPKPKPPVAAPVQLAPAEANPDN

SEQ ID NO: 4973 - protein, 307 aa, Rhodopseudomonas palustris BisB18
MNWAWANSIDQLWRQPSFPIWLTIAAAGCFAIILFVTLLRAQKSVANAALAVIALLAIGTAAATTIRGFGPGEGSSRPANAPETANAALPALACLDELAGEAVLAGCEKQLFGSPDTIAAAVGATASRIARLTAMGDVAAANKVMTPDLERLRRSLERDRYGLVAYVLMARDRCQANECAAYTSLTDHNQIAANMDERVYEGLVLRYAAAWNAPANSPALAALPPSLPTGKPTTADFPTSASIPPVTIMTPEPSASARPAAPAANAQALARPPQPAAKKPPAPKPRATAPVQLAPTQPAPAAEGATE

SEQ ID NO: 4974 - protein, 347 aa, Rhodopseudomonas palustris BisB5
MEWASWSAAADRILHSPNLPIWAAIAASAVFALILVIALLRADKSVANGVLGIVTLLAVGVAGFASWRVFVDGAGSGLRGVDAARAISPMPALACVDDLAGDAVQAACERALFGSPETVAAAVSYASARLAQLTSLGDVASANKRMTPDMERLRRSIERDRYGLIAYVLTAQDRCVPDRCAAFQSLTDPSRIAANMNEHVYETAVTRAAPSWGAGSGPLAAAAPGGVMGIVEAPSGRPTNADFPTSSSIPPISIMAEPPPAPKSSATAGTPSPRPAATAAGAAGGNAAAHNSPSAAAKRAPAPAPASADAQAPANAQAAVRRPPPKPKPPVAAAPVQLAPEEASSDN

SEQ ID NO: 4975 - protein, 313 aa, Nitrobacter hamburgensis X14
MNWAWVTSHDQLWHSPTFPMWLTLLVAIFFAIIVLLTLVRAEKSAANGVLTIIALLAIGVAGAVTIRGFGPDGGEAFGSKHLSAPVNVAMPALSCVDGLAGDVVEVACEKALFGKPDAAAAAVSYVASEISRLRSFGDVAAANGVISPELQALRRAIERDRYGLVAHVLVARDHCQPSDCAAFQSLTDHSQVAANMEERVYEKLVMRYAPSWSEPAATADAAMPGTPTSALVSEPTGHPTTMDFPTAASIPPVNIMTPEPPTGAASPPPPTSAAAQTVPKPRPAAARKPHAPKPHPAEPVRLTPAPSSAGAQN

SEQ ID NO: 4976 - protein, 310 aa, Bradyrhizobium BTAi1
MWLTVAAAGFFALIVLATLLRAEKSVANGALTVITLLAVGIAVASMMRSQDQGARGGSDPASTASVSFAPPGLACVDDLAGDLVLSNCEKNLFGSPEMTAAAVSYAAAMLSRLAQAGDLASANKVMTAELLALRRAVERDRYGLMAYVLLTRDRCTPTDCVMFRAVGDRQQLVNNMEGRTYEGLVTRYASQWNAPAAQTAQSAAAGTFAGLAPTAPTGKPTNAEFPSSANTPAVSIMNPEPTASTRSVAPAPAAPKPPTQLAPAPAPPPTVAASHAQAPAAAKKAAPKPKPAATAPQAAPEAAEPAANNE

SEQ ID NO: 4977 - protein, 338 aa, Xanthobacter autotrophicus Py2
MQWVDQLLGVLNASFAVPGWVAVAAAVAGVVFVVLLFARSEPNDHPVTILVLLGMLAGGLAVGGAVVRAITGTAAGGQAQALEQRAATLDSAAAQTPALGCLTADTSLAVACEAVLFERPDSVSAARGLVRERIALVEDATDILRKADVPGLSARVMTWRRPLELDPFGFTAAVLAEEFGCTPSFCPPAVVLGDSTRVVANMTEGRYQSLVAKYAPIWERNARNRGTLNPAPPVRTGPFGFAVVPHDNGTGGSGTPQDRTPQERPPVANLPVEDAPAPPAPAATPASPTPLPPSRPSRPAAAPAAAPPAARPATPPRPRPQAAPAAPAPDAVEPAGDE

SEQ ID NO: 4978 - protein, 346 aa, Rhodopseudomonas palustris TIE 1
MDSAAWSAWFDQILHSPNFPMWATVSVAAFVALLVLITLLRADKSVANGALVAITIGAIGLAGYSAFRGFGSSGSSQASGEARDPIAKAMPALACVDDLAGDMVLAACEKALFSSPETVAAAVSYASARLARLTALGDAAAADKQMTPELTRLRRAIERDRYGLIAYVLSSQDRCQPTDCAAFRSLTDSSRIAANIGDHLYETTLTRYAPSWGGLLMTAGAGPVPASAAGATLPVPGTPALAGVTEAPSGKPTDIDFPTSASIPPVSIMTEPTPAKPAAAAATNAKSAPAAKKPPAPPAAAQASATHNAAGAAAANPPPAKRPPAPPKPKPPAPVQLAPEEAPAEN

SEQ ID NO: 4979 - protein, 408 aa, Nitrobacter winogradskyi Nb-255
MAINHFDSPTGHIADNVAGFARTLRACGLPVGPGAVIDALKALRLIDIGNRADVFSTLQAIFMTRHDHAPIFAQAFDLFFCIAEEGKNMLDPVQPLDQARKPPPSASRRVLEALSRPAITSEREAPQGQEMRPSVSDLEVLQKKDFAQMSAAELAQVTQIIANMKLPQARLHTRRIRPDPRGSRLDLRRTLRGGLHTGGEIVDIHRLGRIDKPAPIVALLDISGSMSEYTRLFLHFLHGITNRRGRVSVFLFGTRLTNVTRALRARDPDEALAACSSVVEDWAGGTRIATSLHDFNKLWSRRVLGQGAVVLMITDGLEREAGSELAFEMDRLHRSCRRLIWLNPLLRYDGFEPRARGIKMMLPHVDEFRPVHNLSSIEGLIAALSQAPGRHGRGAARGLNEGHYARSR

SEQ ID NO: 4980 - protein, 405 aa, Rhodopseudomonas palustris HaA2
MQRNPMTAMDHLNPPTGKMADNIVGFARALRAAGLPVGPGAVIDALEALQLIDIGNRADLYATLEAIFVKRREHALIFAQAFALFFRAAEEWQHMLDSIPLPDHAKKKPPPASRRVQEAMAPSTTRDFPAAEEQEVRLAVSDKEILQKKDFAQMSAAEIAEVTRSIARMRLPQAELRTRRVRPDKRGLKLDLRRTLRASLRTGGDIVDIRKLGLIDKPAPIVALLDISGSMSEYTRLFLHFLHAITDDRKRVSTFLFGTRLTNVTRALRARDPDEALASCTSSVEDWAGGTRIATSLHGFNKLWARRVLGQGAIVLLISDGLEREADSKLAFEMDRLHRSCRRLIWLNPLLRFGGFEPRAQGIKMMLPHVDEFRPVHNLTSMQGLIEALSSAPPPHHFSAIRSAA

SEQ ID NO: 4981 - protein, 400 aa, Rhodopseudomonas palustris BisB18
MTDIDHLNPPTGKMADNIVGFARALRAAGLPVGPGAVIDALNALQLIEVGHRGDFYATLQAIFVKRHEHSLVFAQAFALFFRAAEDWKHMLDSIPLPDHAKKKPKPAARRVQDALAQPTSHEVPQAQEQELRLSVSDKEILQKKDFAQMSAAEIAQVTRAIAQMKLPQAELRTRRHAPDPHGLRLDLRRTLRGSLRTGGDIVDIRKLGRIDKPSPIVALLDISGSMSEYTRLFLHFLHAITDARKRVSVFLFGTRLTNVTRALRERDPDEALANCSSAVEDWAGGTRISASLHVFNKQWARRVLGQGAIVLLISDGLEREADAKLSFEMDRLHRSCRRLIWLNPLLRFGGFEAKAQGIKMMLPHVDEFRPVHNLTSMQALIAALSAPPPVHHRALIRSAA

SEQ ID NO: 4982 - protein, 414 aa, Rhodopseudomonas palustris BisB5
MLLILCSITLSEFDMPTIDHLNPPTGMMADNVVGFARALRAAGLPVGPGAVIDALNALQLIEIGNRDDLYATLEAIFVKRREHALIFAQAFALFFRAAEEWQHMLDSIPLPDHARKKPPPASRRVQEAMAPSTTRDFPSAEEQEIRLAVSDKEILQKKDFAQMSAAEIAEVTRSIARMRLPQAELRTRRVRPDKRGLKLDLRRTLRASLRTGGDIVDIRRLGLIDKPAPIVALLDISGSMSEYTRLFLHFLHAITDDRKRVSTFLFGTRLTNVTRALRARDPDEALASCTSSVEDWAGGTRIATSLHVFNKAWARRVLGQGAIVLLISDGLEREADSKLAFEMDRLHRSCRRLIWLNPLLRFGGFEPRAQGIKMMLPHVDEFRPVHNLTSMQGLIEALSSAPPPHHFSAIRSAA

SEQ ID NO: 4983 - protein, 410 aa, Nitrobacter hamburgensis X14
MAINHLDPPTGRIADNVIGFARALRAAGLPVGPGAVIAALNALHLIDIGNRADVFTTLESIFVTRHDHGLIFAQAFDLFFRAAGQWKNVLDSVPLPDQAKKPPSPASRRVDEALSQPAITSESEASQEQETRLSVSDREVLQERDFAQMSAAEIAEVTQVIATMKLPQAELRTRRTRPDHRGLRLDLRRTLRGSLRTGGEIVDIHRLGLIDKPAPIVALLDISGSMSEYTRLFLHFLHAITDARKRVSVFLFGTRLTNVTRALRARDPDEALAACSSVVEDWAGGTRIATSLHNFNKLWGRRVLAQGAIVLLITDGLEHEADSKLTFEMDRLHRSCRRLIWLNPLLRYDGFEPKAQGIKMMLPHVDEFRPVHNLSSIKGLIAALSPALAPYRRDPSAPQLELSGRHARSR

SEQ ID NO: 4984 - protein, 380 aa, Rubrobacter xylanophilus DSM 9941
MVEEEPAPRMLEAAVAFGRVLRGAGLAVGTDRLVGFARALEELDAGRREDVYWAGRITLTSRPEDIEVYDRAFEAFWERGEEAPPPPRGGAELRIPEPEDSVMPAKESVEADERGEEAVGLRYSPVEVLRKKDFALYSPEEFAELQRMLSDLRLSGALRRTRRLEPARRGRHDPRRTMRGAMRTGGETVRHRFRRAKDQPRRVVLLCDVSGSMSPYSRALLRFLHAGVISGARLEAFSVGTRLTRITRELSTRDPDRALRQAAGAVRDLSGGTRLGDALKEFVDRWGQRGMARGAVVVILSDGWDRGDVALLAEQMRRIRRLAYRVIWVNPLKASPGYRPLAAGMAAALPYVDVFLSGHNFESLEELARAVAEAAGDGRR

SEQ ID NO: 4985 - protein, 418 aa, Mesorhizobium BNC1
MAGNGVEKHATAADPEGRIADNIVYFARALRKAGLRVGPAAVTDAIQAVLVAGIGTREDFYWTLHSVLVTRHEDHAVFDEAFRLFWRSRELIEKMLAMLSPLAPVPLKKEKPRAGETRAGHALLSPDREERREAQPELEIDARLTFSSRELLRGKDFAQMTAEELAEARKAVSSLVMPHDLVATRRHRPDPRGRRIDPRSMMRLGLRTGGDLILPRYKSPRRVHPPLVVLADISGSMSQYTRVFLHFLHALTESRRRVTSFVFGTRLTNLTRQLRYRDPDEALAHCAAAVQDWSGGTRIGEAIGSFNRLWSRRVLGQGAVVLLITDGLERDDVEALAREMERLHKSCRRLIWLNPLLRFDGFEPRARGMRAMLPYVDELRPVHSLDALSDLCEALSAVPRSRARPSALLEGLGKRPPA

SEQ ID NO: 4986 - protein, 403 aa, Acidiphilium cryptum JF-5
MSASDTGRLAPNVMHFARLLRRAGLPVGPGEVIAAAEALTHVDITDRRVMRAALQAVMLRRHEHALLFDQAFSVFWRNPDAAKFAQMLAAMDGRAPREEKAAAGARRLAEAMQAAKSREQEPRPDERREVDALLSASGQERLESLDFEAMSAEEIAAAKAEIARLTLPLDERRTRRFRLAARGCRVDLKRTLRDSMRHSGEVFDIARRVPLTRPPPLVVLCDISGSMARYAQILLHFLHAVANERDRVTTFLFGTRLTNISRQLARRDPEEAFEQVAGAVPDWSGGTRIGEALGQFNRLWARRVLAQGAVVLLVTDGLDREGAVGLADNMARLHRSSRRLIWLNPLLRYDGFAPKSQGARAMLPYVDEFRPVHNLASLRSLVQALSGEAPPRLQAAALWETRQ

SEQ ID NO: 4987 - protein, 401 aa, Bradyrhizobium BTAi1
MPTSINHLAPPTGGIADNIAGFARALRAAGLPVGPGAVIDAMTALEVIDIGKRADVFTTLESIFVKRHEHALIFAQAFDLFFRPAEEWKSMLDSVPLPDHAKKKPPPASRRVQEAMAQPQMHEEPKAQEQDLRLSVSDREVLQKKDFAQMSAAEIAEVARAIAKMRLPQAELKTRRHTTDPRGHRIDMRKTLRQALRTEGEIINFHRLGRIEKPAPIVALLDISGSMSEYTRLFLHFLHAITDARKRVSVFLFGTRLTNVTRALRQRDPDEALASCSANVEDWAGGTRIATSLQTFNKQWARRVLGQGAIVLLISDGLEREADSKLAFEMDRLHRSCRRLIWLNPLLRYSGFEAKAQGIKTMLPHVDEFRPVHNLTSIETLISALSSPLPPHISRVIRPAA

SEQ ID NO: 4988 - protein, 429 aa, Sinorhizobium medicae WSM419
MTGANSGETNSSASREGQGRLADNIVFFARALRRAGLRIGPAAVADAIDAVRLIGIGSRGEFYAALQCTFVKRHEDQAVFDEAFRLFWRSPDLVNKMIALMSPIALPRSGEDRRRRAGEARMRDALLAGRHGAQQPSKAPEVEVDARYTVSGRELLRKADFGQMTAEEIAEARRALSSILLPLDRIRTRRYRPSRRPVRIDPRATMRDAMRLGGDFILPRFREPRFVHPPLVVLADISGSMSQYTKIFLHFLHALTEQRQRVQTFLFGTRLTNVTRQMRNRDPDEALDECIAAVKDWSGGTRIGETLHAFNRRWSRRVLGQGAVVLLMTDGLERDDTAGLEAELGRLHRSCRRLVWLNPLLRFDGFEARARGVRAMLPHVDEFRPIHNLESVSDLVKSLSGQGGRDADPRRFLNHGRLAVDRAPANAPQ

SEQ ID NO: 4989 - protein, 403 aa, Parvibaculum lavamentivorans DS-1
MPARPAENHGRLAENIVHFARVLRRAGLRVGPRQVLDAVEAVEAAGIGPRADFYWTLHATLVKRHEEREIFDQAFHVFWRDPKLLDKMMSLMLPEIETPPGATDEEKSRRLAEALFGETRPQAPEEPDIEIDRSETFSAEELLRTKDFEQMSAAELAEAKAAISRLHLSHDDIRTRRTRPSSRGQMIDMRATLRATLRSGGVIPLKRRTFRRRRPPLVILCDISGSMSVYARVFLHFLHVLANGRDRVHIFLFGTRLTHVTRELKHRDIDEALARVAARVEDWDGGTRIGETLHRFNVDWARRVLGQGATVLLVTDGLDRDAGEGVGPEIARLHRQARRLIWLNPLLRYERFEPKSLGIRALLPHVDEFRPVHNLASLASLVEALSDAHIGRKPERPGRKEAA

SEQ ID NO: 4990 - protein, 405 aa, Rhodopseudomonas palustris TIE 1
MQRNPTAMIDHLNPPTGKMADNVVGFARALRAAGLPVGPGAVIDALDALQLIEIGHRDDLYATLEAIFVKRREHLLIFDQAFALFFRAAEDWQHMLDSIPLPDAAKKKPPPASRRVQEAMSPAATRDMPSAEEQELRLAVSDKEILQKKDFAQMSAAEIAEVTRAIERMRLPQAELRTRRVRPDRRGLKLDLRRTLRASLRTGGEVVDIKRLGLIDKPAPIVALLDISGSMSEYTRLFLHFLHAITDDRKRVSTFLFGTRLTNVTRALRQRDPDEALASCTSSVEDWAGGTRIATSLHSFNKLWARRVLGQGAIVLLISDGLERESDSKLAFEMDRLHRSCRRLIWLNPLLRYDGFEPRAQGIKMMLPHVDEFRPVHNLTSMHTLIAALSSAPPPHHFSTIRSVA

SEQ ID NO: 4991 - protein, 394 aa, Methylobacterium sp. 4-46
MTGRLPDNIAHFARALRRAGLPVGPGDVIDAVEAVVAARIGSREDLYWTLHAVLVRKHEHSVLFEEAFRLFWRRRDLIEALIAQMAPVAPARGREPPKAGALRVREALAPDAPRPRPKQDEAALRATLTVSEREVLKAKDFAQMSTEEVAQARRLIAALALPDDAARTRRFAPTARGRIDPRRSFQRTLRAQGSIDLAFRSPRVRPPPIVALADISGSMAEYSRLFLHFLHALGERRRVHSFVFATRLTNITRELARRDPDEALVRASARARDWEGGTRIAAALHAFNRHWSRRVLGGGAVVLLFTDGLEREVTPELTFEMDRLKRSCRRLVWLNPLLRFDRFEARAAGIRAMLPHVHDFRPIHSLAAMEDLCRALGAGPVRADDPRAWLRRAG

SEQ ID NO: 4992 - protein, 395 aa, Methylobacterium nodulans ORS 2060
MTGRLPDNIAYFARALRKAGLPVGPGDVIDAVEAVQAAGIGTREDFYWTLHAVLVRKHEHSVLFEEAFRLFWRRRDLIEKLIAQMAPVAPDRGREPPKAGALRVREALTPAAAPKPARKQDETALRATLTVSEREVLKAKDFAQMSAEEVAQARRLIAALTLPDDATRTRRFAPQARGRIDPRRSFQRTIRAYGAIDLAFRAPRMRPPPIVALADISGSMAEYSRLFLHFLHALSERRRVHSFVFATRLTNITRELARRDPDEALARASARARDWEGGTRIAEALHVFNRLWSRRVLGGGAVVLLFTDGLEREVTPELTFEMDRLKRSCRRLVWLNPLLRFDRFEARAGGIRAMLPHVHDFRPIHSLAAMEDLCQALRAGPTRAEDPRTWLRRAG

SEQ ID NO: 4993 - protein, 378 aa, Brucella suis 1330
MSFSISVERLIERWQNEGLIDAQTASRLNLDLEKRRSVFSLGSVLATLGGLLLGAAVIMLVAANWQEMPRLMRIGVIFVLIWASYLGGAWRQARGDKVFPAALYVLGAASFGAGIALVGQMYHISGDVHSAALYWTLGVLASAFLLRAQALAAFGAGVACFYLSTFVFADSNLSGADISYRWVGPLLLLAGVAAALFTRSRHAAHFLALFSIGWCLLLYAGQENKTVLLLMIVIGIGLILADGLRHEQLQKLTRFAHPLAAYGLLLVLLSFAILQLDSVITYGGVSAGIDRDILYSMLILALSIGAIAICGRDNGGLRSIAYAAFSIEVLYLAFETVGTMIGTSGFFLTAGILVLLLAAFVRRMESRFGRKQGLEVHP

SEQ ID NO: 4994 - protein, 334 aa, Brucella ovis
MATLGGLLLGAAVIMLVAANWQEMPRLMRIGVIFVLIWASYLGGAWRQARGDKVFPAALYVLGAASFGAGIALVGQMYHISGDVHSAALYWTLGVLASAFLLRAQALAAFGAGVACFYLSTFVFADSNLSGADISYRWVGPLLLLAGVAAALFTRSRHAAHFLALFSIGWCLLLYAGQENKTVLLLMIVIGIGLILADGLRHEQLQKLTRFAHPLAAYGLLLVLLSFAILQLDSVITYGGVSAGIDRDILYSMLILALSIGAIAICGRDNGGLRSIAYAAFSIEVLYLAFETVGTMIGTSGFFLTAGILVLLLAAFVRRMESRFGRKQGLEAHP

SEQ ID NO: 4995 - protein, 376 aa, Ochrobactrum anthropi ATCC 49188
MSFSISVERLIERWQRDGLIDAETASKLNADLEKRASVFSLGSVLATLGGLLLGAAVIMLVAANWQEMPRLMRIGLIFVLIWVSYLGGAWRQSRGDKLFPATLYIVGAASFGAGLALVGQMYHLSGDIHSAAIYWSVGVLVSAFLLRAPVLAAFGAGVACFYLSTYVFDMSSYDDVTYRWIGPLLLLFGAAAALFTRSRHAAHLWAMFSIGWALLVYAEHESNTVLVLMLVVGIGLILADGFAHDTVQRLTRFAHPLAAYGLALALLALVTLQINQMFSYSSVTANLDRDILYSIFILALAIGAIAVAGRNNGGLRSIAYAAFSIQVLYLAFETVGTMIGTSGFFLTAGILVLLLAAFVRRMENRFGRKSSVEARL

SEQ ID NO: 4996 - protein, 416 aa, Campylobacter curvus 525 92
MNPFNKDFLSGEIVKWRDKGIIDTQTAQKIASLYNINLNSTHDTTSFILKLVAYQFFSLAFFTLIGANWEEIPRFGRLLIVLFVLALVNLGGFFTLKKGKENSATALFLLGNFCYGAAIALIAQIYHLGEHMADGVLLWAVGSFALSFAVGRSILIAQSLAIALFWFVMEIEFGLVMHGFLIFVAISCYVLWRDSSRILTGLIFISVFVYLVFAILRATPVELLDSIFIISIVFFALSYCMLCVSVALVVENFGKFHIAEYLKTTSITCGVVVLLVSMTFYDLDLLLFQTDMESVVFYKTVFGYVAAAFIVICALIFAKFRRYYSLLLCVGLFLLPILIENFSDYSKAIFSFISVLVGIVLIKQNYLNFGLIVIFCVAIVRYIDLIGDYIGASLLFMAFAVTVLVMSRKRRAKNEA

SEQ ID NO: 4997 - protein, 431 aa, Parvibaculum lavamentivorans DS-1
MWQRIYLQRLKHDLDLWIERGWVTPANAESILLSAREPAATRRMPGVLAILGAVLIGFAVMSFVAANWAEISKLAKLIMIFGAMWAAYIAAFLLQKRDHPALAQAAVLIGLGLFGAGIMLIAQIYHIVTDDPAGVLAWCIAALSTAWLLPSRPALALGILLTVVWTYFVVEMPGAVSPHWSFWLPWAAALVLSLRLSWSPGLHLSLIAGLIWQAMNAQAIVETYGIVETQLAIIILLEMLAIWLAAVLLSERGPRFASIAEAYAIAFAFAIFWIFQTAPSDNEIASSAAGPLVTGLMAVVVAGLAFLCIARSKLEARHIIGIGALAVLALLFPVLRSGAGETIPWLYAAAFLVLAAWLVSYGTGRGSRFAVNFGFVAFAAEVLYLYFETLGDLLSTALFFALGGVLLIAGSIVMERMRRRLVKAASEGDAP

SEQ ID NO: 4998 - protein, 420 aa, Campylobacter concisus 13826
MNFYNRNFLAKELDRWQKEDVIDKVTALKIANLYDIDINAHSEKTSFILKLVAYLFFALAFFTLVGAYWEEIPRMGRLVIIFGVLALLNFGGVYYLKKGKDKLGTATLFLGNFCYGAAIALIAQIYNISDEPSGGVLLWSVGAMALSFASKKGLLVAQSLVFATIWFVLKGTGGEFAYEFIVFIALGAYTLYKSDSIFLATMLLADIFFYIVSLCARISGFNEFYGYDLMFRAPMAATLSLSYALLLVALFSPLADFRDRLAHLVKGFGKYLGIIILIVCLIAYANGDIYELEEDKFWFAKAFFYSSFGKVFAVFGIASIALFFKEKNKSGLLLGLILFALPFVFSLGVGYANIFFSLANIIVAAVLIKNGELTLGLCMIFLVAVIRYFELIGDYLGATALFIIFAFVVLAVAAKKGRTK

SEQ ID NO: 4999 - protein, 442 aa, Shewanella sediminis HAW-EB3
MRLIQLFKKELSHEARTWVRDELVSEQQANSILARYGTSLNDDTDKNSFGYYLLMSLGVLFIGLALILIVSHNWDEIPRSIRTGSLLLLTLVTNAVGIKLFLSKRIRAGIIWLLFGGMSYGASIMLIAQIYHLGEHFPDGIFWWALGILPLVVFTQSRLLALLSLSLASIWLVVESGEDFFPTLYPIFISVTLWLTLFQARSRLLFLSCVVGLLVWINLGLAWIMGSGYHFDPVAEQLPFSLGLGLIINGVAWWLMRADKSDWREYGLVVHIWLLRAAIITLLVFSFEGVWEEYPSDQSWLSVISVIFILVSGMLAFRLSRASGRYASLPTLMLTGYLTFSFYLVSAFSHMEFISAIATNLMLLLMGILLIRRGIDQSETHYFYTGIVVLLLTAFIRYFDLIGDYIGGAVLFLVAAGILMAAAKYWKHHVTLIALKQGGHSE

SEQ ID NO: 5000 - protein, 445 aa, Shewanella woodyi ATCC 51908
MRLINLFKKELAHEARDWVRDELVSDAQASAILARYGESLDEDPNKNSFGYYLLMSLGALFLGLALILIVSHNWEEIPRVIRTTGLLLLTFSCGVIGSKLFLSGREQAGKIWLFFGGISYGTSIMLVAQIYHLGEHFPDGIFWWAAGILPLVIFTQSRLLALLSFTLATIWAMVETGEDFFPALYPIFAVVTLWLTLFKKTSRLLFVGSIAALVTWFNLALAWAMGGAGYFELFEEQLPLSIAIGILLNGLAWWLMRSKDHDWQEYGLVTHIWLLRGSIITLLVLSFEGVWQDYPMGFDWLSLLGITTLLLFGCLSWGLSRKSGLYASTPAILMTFYFVLCFALVGAFDNMELITAIATNLMLVVMGILLIRRGIDQTQTHYFYTGVVTLLLTAFFRYFDLIGDYIGGAILFMVAAAILMAAAKYWKYHLKLVTKVDDTQVREGE

SEQ ID NO: 5001 - protein, 450 aa, Methylobacterium sp. 4-46
MPLSYRDRVLADIRAWAARGLIDAEQQRLLEAELRREPGLAGLQVALGAVAALLVAVAAITFVASNWAGMPPLWRLVLLVAADALAVGLAALATLRHRRSGDVTLRRLADALAGLSVAVSAAALALMGQTFHLPPDLPGYAVTVAVVATATALALRSGSAGGLAAAGLALAAWADFLQDGAEAAPGLPHPAWPCLVVLATGQLSGRIPARTAGFFLLLLPLASAVAVPAAGPRIDAGRLALFALAVVTAAQAASRLPRLGPGVARRLARLARAAGGFVLLALLARAAGLLGAEPAGSAPSFPRLLAGLALVGLGLALPRPRGTPVPIGPAILAGAALVPLALGAGPPSRGAAAAPALVWTVLLPLLAVAVAARLDGRRALGAVSLAACAAMTLGVLLLGDDLIGVALHLLAAGALAALALAATRRLGAMRPARPGNGPRAGPKDEPRDGP

SEQ ID NO: 5002 - protein, 367 aa, Rhizobium leguminosarum bv  trifolii WSM2304
MYRGRLERDLSLWVGKGLLGQETAGALLAEYDSRPASFSLGRVLMALAAVLLAAAILLVVASNWEAIPRLIRVGVILALIWVVHLAAARMLARGASAAASGLLIIGAMSFGGAISLVGQMYHLSGDEQTVMYLWFAIATISAILFRSGAVAVVAGFLSWASFAVYLENYDTHWIGFDPWMAPVMAAIVIGLVRYTGAERARHLAYLLLIGWLAWLYTLYEEIAVALAFAIGGMAAFVLTALPTRSVASLVRSAGAAPAFYSFLVAAIGFLLLHIEIEDGWPLVVLGVATLAASVLAIALHGRDNGAVRYLAYTTFAAEMLYLASVTVGSILGTSSLFLFSGLVVALVAWIVIRLERRFSANAQGERA

SEQ ID NO: 5003 - protein, 436 aa, Methylobacterium nodulans ORS 2060
MTDMPFSYRERVLRDIRSWAARGLIDLAQQRRLEEEVRRGSDLGGLQVALGIAAALLVGTAALAFVASNWAAMPPFARLLLLIAADALVVGLAGLAAFRQRASGDPTLRHIADALAALSVAVSAAALALMGQTFHLPADLSGFALTVAVVGTVTALVARSGGAAGIAAAALVVTAWPDLDEFGPARAVSWPGWACLGLLAAGQLSGWIPARSAGFLVLLIPVATEIAVVGDGEPRVDAGRLVLLAFGVIALAQVLRLVPALPDRVASRLSRLAGAAAGLLLIGLLIRAAGVTGWPSATATPSAPRLLLMAVWIGLVLLPPRLRGEPLPVGLLILAAAALVPLCLGGPAPPILGEAGWAVWTVLLPILAVAVAARLDHRRTLYAGSLAACLVIALALMMLADNLIGVSLHLLVAGALAALAVAAIRRLPRHAAPSWP

SEQ ID NO: 5004 - protein, 370 aa, Agrobacterium vitis S4
MMYRAKLKKDLDRWTGMGLISKQAAEAMIEDHDGRAGNFNIGGVLLMLSAVLVSAAILLLVAANWQAIPRLVKVSSLILLIWGFHGGAAFCLAQGRQASGHALLVLGAASFGAALSLVGQLYHLSGDLLDLLYLWIGMASLSCLLFRSGAMAAFVGVLALGLAAATLDQFDFSWTLEAVWTPPLLAVLVTGLALFTGNIRVQHISGLLILGWLAWIYAQIMQPGLAMAYVALGVAAFAASALPLLARYMSVQIAGFHALLLAAMGLFILNIEFDHGLPLALVAVTAVGISIAALVLRGRHDGVVRALAYLIFAGEILYLSFTTIDSLLGTSGFFLIAGVIVALLALGVSQMEKLLGTRKRPMAVEGRERS

SEQ ID NO: 5005 - protein, 367 aa, Rhizobium leguminosarum bv  trifolii WSM1325
MYRGRLERDLSLWVGKGLLGQETAGALLAEYDSRPASFSLGRVLMALAAVLLAAAILLVVASNWEAIPRLVRVGGILALIWVVHIAAARMLARGATAAAGGLLVIGAMSFGGAISLVGQMYHLSGDEQTVMYLWFAIATISAILFRSGAVTVVAGFLSWASFAVYLENNDTHWIGFAPWMAPVMAVIVIGLVRYTGAERARHLAYLLLIGWLAWLYTLYEEIAVALAFAIGGMAAFVLTALPPRPIASLVRTAGAAPAFYSFLVAVIGFLLLHIEIEDGWRLVVLGVVTLAASVLAIVLRGRDNGAVRYLAYATFAAEMLYLASVTVGSILGTSSLFLFSGLVVALVAWMVIRLERRFSANAQGERA

SEQ ID NO: 5006 - protein, 871 aa, Dehalococcoides ethenogenes 195
MFSSDELRENYLKFFEEKGHKRIASSSLIPHNDPTLLLTTAGMVQFKPYYLGVAKPENSRMTSCQKCFRTTDIESVGDASHLTMFEMLGNFSIGNYFKKEAIAWAWEYVTQRLNIPAEKLWVTVYLDDDEAIALWKEQGVPEGRIVRLGAADNFWGPAGDSGPCGPCSEIHYDFGQEMGCGKADCNPSCKCGRFCEIWNLVFVQFNQDKSGKRQNLPAPSIDTGMGLERLTILMQFRKNVYETDIFAPVIEKACQLSGRQYGIDAETDKALRIVSEHSRGITFLIADGVIPDKAGRGYVLRRLLRRAVLFGRRLGLEKPFLVDMAGAVIARMSGIYPELNKRQAYVLEMIASEEARFSETLATGLELLEEIVRQTKGGQISGQDAFKLYDTYGFPVEMTTEIAAERGLSVDLGGFEAEMEVQRTKARSSRKFSFDAAATAEAVKNMRHGEKTCFVGYELTRQKSTIMDILTEGGSVDSIEEGDEASIVLDESPFYAEMGGQVGDTGEIITGGGRFEVKNTLHLPNGVFLHQGRVISGCLKIAETAAAHIDEERRRDIARNHTATHILQTALRQVLGEQVQQRGSVVTPERLRFDFSHLKPMTKDEIRRAEEFVNDKIRRNLPVYAEEMPYRHALEEGVTALFGEKYGDRVRVLRVGRPAVSAELCGGTHVSASGEISLFKIVSESSVGAGLRRIEAVTGREAEAYINLQQDSLSELSGMLEAAPEESPRKLAELKEEIDTLKKTVQNLERQMSRGEAEELLSKAEDYKGIKLLVSRMTSVNADTLHETADFLRDKLGSGIIVLGTVSEDKPFFLCMVTPDLIEKGYHAGNIVKKLSQIAGGGGGGKPNMAQGGGRDKAKLDEALQAVKGML

SEQ ID NO: 5007 - protein, 889 aa, Thermobifida fusca YX
MKSAEIARRFLAFFEKNGHTVVPSASLIAEDPTLLLVNAGMVPFKPYFLGQRTPPYPRATSVQKCVRTIDIDEVGKTTRHASFFQMLGNFSFGDYFKEKAIPLAWELLTTSVADGGFGFDPERLWVTVYLDDDEAATIWREKVGLPEERIQRRGKADNFWSMGVPGPCGPCSEIYFDRGPEYGAEGGPVADEDRYLEVWNLVFMQFERGEGSGKEDYPILGELPSKNIDTGMGLERMAAILQGVDNIYETDTLGRILRRAAELTGTTYGENERADVSLRVIADHVRTATMLVADGVRPGNEKRGYVLRRILRRSIRNLRLLSGDESFHMHDLTAVAIDAMGDQYPELRADADKIHSIIDAEEKNFADTLRAGTTLFNRAVRRTKETGGTVFSGADAFQLHDTYGFPIDLTLEMAAEHGLKVDEETFHQLMQRQRETAKRDAQAKKLGNADISVYGNLLETGGPTEFLGYTDSESEARVLGIIVNGESTGAARKGDQVELVLDRTPFYAESGGQLADKGTITVDGRGVVDVEDVQKPIQGLFVHRGTVREGEVVVDDTVHAAIDTGRRASVSRSHSATHLIHSALRNTLGPSAGQAGSENQPGRLRFDFTSDKPLDATEIAQVEEEVNEVLARNIEVQYLETTLDEALRMGALAMFGEKYGNRVRVVDMTEYSRELCGGTHVAATGQLGLVKVLGESSVGSGVRRVEALVGLDALRRVSTESALVGQLSEQLKAPREELPQRIDSLVSRLRAAEKEIERLRAAQVLQAAGKLAESARDHGNSRVVTHRVEDGTTADDMRKLALDVRGRLGEDRPAVVAIAGVPSDRPVVVVAINKEAQQAGLKAGELVGVAARALGGGGGGRPDIAQGGGSDVTAIDTALRLVEQRVAGS

SEQ ID NO: 5008 - protein, 881 aa, Frankia CcI3
MDTAEIRSRFLNHFARRGHTVVPSASLVAQDPTLLLVNAGMVPFKPYFLGDLPAPWPRAASVQKCVRTVDIENVGHTARHASFFQMCGNFSFGDYFKAEAIPFAFELLTEGFGFKADDLWATVYLDDDEAEGIWRKLLPAERIQRRGKEDNFWSMGVPGPCGPCSEIYFDRGCAYGREGGPIADEERYLEVWNLVFMQYERGEGAGYDYPIERELPARNIDTGMGLERMATILQGVDNLYEIDISRPVLDAAGRLTGRRYGADPADDVRLRVIADHTRTAAMLISDGVVPSNEGRGYVLRRMLRRAIRNARLLGAHEPVMSELFAVVGSAMGTIYPELLDNAETITGVAVAEEQAFAETLRTGTTIFDTAARQARSLGSTTLGGEAAFKLHDTYGFPIDLTLEMAAEAGLSVDEAGFRRLMDRQRQAAKADRAARRIGNVDLSAFRPILARSGPTTFTGYEELSRTSGVVGLVGIADGAGLAAAGEDTEVGVVLDATPFYAESGGQEPDLGRLRFDGGEVEVLDVQRPVPDLVLHRVRVLGGELRLGVEVFAEVDADRRRAVSRSHTATHLVHTAFRRALGEGATQAGSLNSPGRLRFDFHALGAVPPSVLADVEDEINEVALRDLPVRAFVTTQEEARRLGAMALFGEKYGDAVRVVDVGDYARELCGGTHVASSAQLGAVKLLSEASISAGTRRVEGLVGLDAFRYLAREHLLVSQLSTALKARPDELVDRVTDIVGRLRDAERELERLRAAAVLAGAGALAEGAEEVAGVAVVTAEVPAGTAPDDVRLLALDVRGRLAGRPAVVAVAKADGSSIVVVTDDAARGRGLRAGDLVRQSWASLGGKGGGKPDVAQGGGGNPQLVPAVFARLRGLVAEHASR

SEQ ID NO: 5009 - protein, 897 aa, Mycobacterium MCS
MQTHEIRKRFLDHFVKAGHTEVPSASVILDDPNLLFVNAGMVQFVPFFLGQRTPPYQRATSIQKCIRTPDIDEVGITTRHNTFFQMAGNFSFGDYFKKGAIEFAWTLLTNPVDQGGYGFDPEKLWATVYLDDDEAIQLWQEVAGLPLERIQRRGMADNYWSMGIPGPCGPSSEIYVDRGPEYGIEGGPEANEDRYIEIWNLVFMQNERGEGTGKSDFEILGPLPRKNIDTGMGIERVACLLQGVDNVYETDLLRPVIDAVAARAPRGYGRGSHSDDVRYRIIADHSRTAAILIGDGVSPGNDGRGYVLRRLLRRVIRSAKLLGIDDAVVGDLMATVRDAMGPSYPELVTDFDRIQRIAVAEETAFNRTLSSGSRLFEEAAQSTKAAGADRLSGRDAFTLHDTYGFPIELTLEMAAEADLAVDEEGFRSLMAEQRQRAKADAAARKQAHTDLTAYRELVDAHPTQFTGFDELTTEARILGIFVDGRRVPVVGHDTATAQHRIELVLDRSPFYAESGGQIADEGTITGTGASQTAKAAVSDVQKIAKTLWVHRVTVESGEFVEGDTVTAAVDPRWRHGATQGHSGTHMVHAALRQVLGPNAVQAGSLNRPGYLRFDFNWQGALTDDQRTQIEEVTNEAVEADFEVHSFTTELEKAKSMGAMALFGEAYPDEVRVVEIGGPFSLELCGGTHVRSSAQIGPVTILGESSVGSGVRRVEAYVGLDSFRHLAKERALMAGLASSLKVPSEEVPARVAGLVERLKAAEKELDRMRLANARAAAVNAVAGAERVGKVRLVAQRMAGGMSAGDLRTLVGDIRGKLGGDPAVVALIAEGDNDTVPFVVAVNPAAQDLGLRANELVKQFGAAVNGRGGGKADLAQGSGKGAAGIDAALAALRAEIDRS

SEQ ID NO: 5010 - protein, 882 aa, Rubrobacter xylanophilus DSM 9941
MEHMKSAEIRRRFLDFFAERDHRIYPSSSLIPHDDPTVLLTTAGVQQFIPYFLGQEKPPHPRAASVQKCFRTQDLEEVGDPSHLTFFEMLGNFSFGDYFKKEAIGWAWEFLTEGLGIPPERLWVTIFEGDENAPEDLEAKRFWMEVGVPEHKIFGLPKSENWWGPAGETGPCGPCSEIYYDYGEEFGPGDPLEDARYGPGGEEGDARFLEVWNLVFNQYEQLRDGSLRPLEQTGIDTGMGLERIAAVMQGARSVYETDLYAPVIERAREYTGVALGDGEETDRALRILADHARGMAFLIADGVRPGNQRREYVLRRIIRRATREAYGRFGLDAGRIASLAETVADYMGGFWGELREARDEIRRVVESEAARFIDIYHSGMRLLEAEISRLEGGRFPGEVAFTLHDTYGFPVEVTREVLAERGISLDEAGFRRAMERQRERAREALEGHERAVAAFRDREIRSRFVGYEREQAETRILAIEPVPDAEGELYLVLEENPFYATGGGQVADTGWISSEKGQLEVVDAIPAGDYQVLRARVERGRFEAGDEVVASINRVRRQQIEANHTATHILHWALRAVLGKEVVQAGSYVGPDRLRFDYRYSGRVTEEELARVQELCLLKITENQPVRYYTTTLEEARKLGAIMLFGEKYGELVRVVEVDGFSRELCGGTHVRGTAEIGAFKITSNRRHGADLYRIEVITGREALYYLTRAAETAERLAAELRLPGVEELPEAVSRLREELQQAREELRQQALKRGLEEVGSLVENAESIDGTKVVTGRVAAADVRDLRQISDDVRNRVGGPVAVVLAADLDGKAVLVANFHPEVSKRVKAGDVVREAAGILGGGGGGSPTMAQAGGGNLEAIPAALERVRQILSRELSGREA

SEQ ID NO: 5011 - protein, 892 aa, Arthrobacter FB24
MKSQEITKRWIDFFVSKGHTAVPSASLVSSDPSLLFTVAGMVPFIPYLTAREEAPYNRATSVQKCIRTGDIEEVGKTARHGTFFQMCGNFSFGDYFKEDAIKFAWELLTTSVDDGGYGLPPEKLWVTVYEEDDEAEQLWLKNTGMPAERIQRMGKADNYWSTGQPGPAGPCSEIYYDRGPSYGVEGGPIADENRYVEIWNLVFMQYQIDNVRSKVDFDITGELPKKNIDTGLGMERLAMILQDVENMYETDQVRPVIDKAAALSGKEYTSAESADDPHHTDDVRMRVVADHIRSALMLIADGVTPSNEGRGYVLRRLIRRAVRSMRLLGVEKACLPDLLPASRDAMKGVYPVVETDFDRISRIAYAEEKAFLRTIASGTARLEDAVKDSKAAGQPLSGADAFALHDTYGFPIDLTLEMAEEAGLKVDEPEFRKLMLEQRQRAQADAKGKKGSHADLSAFQELLAEGETVFTGYTELAGESKVRGILSGGRKVSQASTGEEIELVLAETPFYAEAGGQAADTGLITGDGFVVEVLDVQRPVKGLSVHKAIVREGEIGADSLVQAAVDRERRHSAEQAHTGTHIVHAALHQILGPEALQRGSYNKAGYLRFDFAWGEGLSAATRSEIEEVSNLAIRNNFQVETKVMALAEAKALGAMALFGENYGNEVRVVEIDGAWSRELCGGTHVANTSLIGSLSLLGDQSVGSGNRRVEAFVGMEAFRHLAAERALVTELTEMLKVPSGLLADRIATTLTKLKTVEKELERLRKEQLTAAAAQLVGTAKDAAGVKVIAHDAGQVSGADDLRGLALDLRTRLGSEAAAVAVAGVSNDRPVILVATNEAARAAGVKAGALVRLAAGILGGGGGGKDDVAQGGGTDAAKVPAALTAVVDAITRR

SEQ ID NO: 5012 - protein, 886 aa, Acidothermus cellulolyticus 11B
MESAEIARRWLAFFEKRDHVVVPSTPLVADDPELLFVVAGMQPFKPYFRGDAPAPWPRATSVQKVLRTPDIDEVGKTTRHATFFHMCGNFSFGDYFKETAIPLAWELLTTPVADGGYGFAPDRLWVTVYTDDDEAADIWHRVVGLPVDRIQRRGMADNFWSMGVPGPCGPCSEIYYDRGPEFGVGGGPVANEERYLEVWNLVFMQYERGPGGAKDNYPILGELPAKNIDTGMGLERMAAILQGVDNIYEIDTTRPILDKAAELTGQRYGSGGQNDVRLRMVADHIRAITMLVNDGVVPSNEERGYVLRRLMRRVVRAMRLLGAREPTMHELVATAIAVFTPQYPELSRNAERIFAVADGEEASFFSTLAAGTARFEAAVREAGGGVLSGEQAFVLHDTYGFPIDLTLEMAAEQGVTVDEEGFRALMAEQRRRAKEDAERRKTGAADRAAYRAAAELLGRPVEFTGYTERSGEAVVRGLLVDGAAVPAAHAGQRVEVVLDRTPFYAEGGGQLPDHGVLEFAAGRIDVDDVQQPLPGLIVHRGRVADGEITVGETVLARIDVDRRWAISRSHTATHMVHKAFREFLGDTAAQAGSENAPGRFRFDFTNPSAVPPSVLGEVEERVNDLLLHDLEVTAQIMRQQEAIASGAIAMFGEKYGDQVRVISIGDWSRELCGGTHVPHTGHLGVIKIVSESSIGAGVRRIEALVGLDAYRYLAREAVLVSQLAEQLKAPADELPDRIAGMLARLRDAEKELEKLRQARLLAEAPRLAAARVDVGGLAVVAARVDGDGVDADGLRLLATDLRQRLGGSAVVVLAGVAGGRPVVVAAVGSEALARGVKAGELVGVAAKRLGGGGGGRPDFAQGGGTNPAAVDDAVSAALDAVRAQVG

SEQ ID NO: 5013 - protein, 896 aa, Nocardioides JS614
MDTAEIRRRFVAHFEHNTTVGAHTPVPSASLLLDDPNLLFVNAGMVPFKPYFLGQEAPPYPRATSVQKCVRTPDIEDVGKTTRHGTFFEMCGNFSFGDYFKEGAIELAWDLVTRPLADGGWGLEESKLYPSVYEDDPEAVALWKKVTGLPEERIIRLGKRENYWSMGVPGPGGPCSEILYDRGPDYGPDGDFGPKGEDRYLEIWNLVFMQDELSAVRSKEDFDIAGSLPKKNIDTGMGLERVAFLLQGKANMYEIDVMFPVIQKAEELTGRRYGADHDDDVRFRVVADHVRSSMMLIGDGVTPGNEARGYVLRRLLRRAVRSMRLLGYEDPALPELFPISRDKMGETYTALHRDWERISTVAYAEEHAFRQTLRSGTTIFDQATAELKQAGGSQLSGDKAFALHDTYGFPIDLTLEMAAEQGLAVDEVGFRRLMNEQRQRAKDDAKAKKGQHRDASAYRQVADSLGRPVEFTGYDVVTDEASVRGLVAAGGVVSSAGPGDDVEIILDRTPFYAEGGGQLADQGVIELDNGARVEVRDVQSPVRGLIVHHATVLSGEVSIGLGAHALVDVERRRSISRSHTATHMVHKAFREALGETATQAGSENSPGRFRFDFSAVGAVPESVMADVEARVNEVVLDDLAVHAEVMSQADAVKSGAMALFGEKYGDRVRVVSVGDWARELCGGTHAGSSGKLGVVKLLGESSIGSGVRRVEALVGSDAYRFLAREHVLVAQLSDTLKVRPEQLPERVHDLVEKLREAEKEIERVRVGQLLAAAGELAAGAAKVGPVNLVAHRADGAGGGDVRTLALDVRGRLPQGEPGVVVVIGAVDGKVAVVAALNDEARARGLSANELVRAVGPLVGGKGGGKDDVAQGGGTDASRIDEAITLVTAEVGRVAAG

SEQ ID NO: 5014 - protein, 897 aa, Mycobacterium KMS; identical to SEQ ID NO: 5009

SEQ ID NO: 5015 - protein, 898 aa, Mycobacterium vanbaalenii PYR-1
MQTHEIRKRFLDHFVKAGHTEVPSASVILDDPNLLFVNAGMVQFVPYFLGQRTPPWDRAASVQKCIRTPDIDEVGITTRHNTFFQMAGNFSFGDYFKKGAIEFAWTLLTNPVEAGGYGFDPERLWATVYLDDDEAIGYWQEVAGLPLERIQRRGMADNYWSMGIPGPCGPSSEIYYDRGPEYGIEGGPEANEDRYIEIWNLVFMQNERGEGTSKEDFEILGPLPRKNIDTGMGVERVACLLQGVDNVYETDLLRPAIDLVAGIAPRGYGQGVHEDDVRYRIIADHSRTAAIIIGDGVSPGNEGRGYVLRRLLRRIIRAAKLLGVDDPIMAELMATVRDAMSPSYPELAADFDRIQRIAVAEETAFNRTLASGSKLFDDAARATKASGAEKLSGRDAFTLHDTYGFPIELTLEMAAEADLSVDEEGFRALMAEQRQRAKADAAARKQAHADLSAYRELVDAGPTEFTGFDELSSEARILGIFVDGKRVPVVAHTGREGAQERVELILDRSPFYAESGGQIADEGTVTGTGASETAKAAVTDVQKIAKTLWAHRINVESGEFVEGDTVVAAVDPRWRHGATQGHSGTHMVHAALRQVLGPNAVQAGSLNRPGYLRFDFNWQGALTDDQRSQIEEVTNQAVEADFEVHSFTTELDKAKAMGAMALFGENYPDEVRVVEIGGPFSLELCGGTHVRSSAQIGPVTILGESSVGSGVRRVEAYVGLDSFRHLAKERALMAGLASSLKVPSEEVPARVATLVEKLRAAEKELDRLRLAGARSAAVNAAAGAEQIGDVRLVAQRMAGGISGADLRSLVGEIRGKLGSDPAVVALIAEGDNDSVPFVVAVNPAAQDRGVRADELVKVMGAAVNGRGGGKADLAQGSGKGAAGIDAALAAIRAEIGRS

SEQ ID NO: 5016 - protein, 897 aa, Mycobacterium JLS
MQTHEIRKRFLDHFVKAGHTEVPSASVILDDPNLLFVNAGMVQFVPFFLGQRTPPYQRATSIQKCIRTPDIDEVGITTRHNTFFQMAGNFSFGDYFKKGAIEFAWTLLTNPVDQSGYGFDPEKLWATVYLDDDEAIQLWQEVAGLPLERIQRRGMADNYWSMGIPGPCGPSSEIYVDRGPEYGIEGGPEANEDRYIEIWNLVFMQNERGEGTGKSDFEILGPLPRKNIDTGMGIERVACLLQGVDNVYETDLLRPVIDAVAARAPRGYGRGSHSDDVRYRIIADHSRTAAILIGDGVSPGNDGRGYVLRRLLRRVIRSAKLLGIDDAVVGDLMATVRDAMGPSYPELVTDFDRIQRIAVAEETAFNRTLSSGSRLFEEAAQSTKAAGADRLSGRDAFTLHDTYGFPIELTLEMAAEADLAVDEEGFRSLMAEQRQRAKADAAARKQAHTDLTAYRELVDAHPTQFTGFDELTTEARILGIFVDGRRVPVVGHDTATAQHRIELVLDRSPFYAESGGQIADEGTITGTGASQTAKAAVSDVQKIAKTLWVHRVTVESGEFVEGDTVTAAVDPRWRHGATQGHSGTHMVHAALRQVLGPNAVQAGSLNRPGYLRFDFNWQGALTDDQRTQIEEVTNEAVEADFEVHSFTTELEKAKSMGAMALFGEAYPDEVRVVEIGGPFSLELCGGTHVRSSAQIGPVTILGESSVGSGVRRVEAYVGLDSFRHLAKERALMAGLASSLKVPSEEVPARVAGLVERLKAAEKELDRMRLANARAAAVNAVAGAERVGKVRLVAQRMAGGMSAGDLRTLVGDIRGKLGGDPAVVALIAEGDNDTVPFVVAVNPAAQDLGLRANELVKQFGAAVNGRGGGKADLAQGSGKGAAGIDAALAALRAEIDRS

SEQ ID NO: 5017 - protein, 898 aa, Mycobacterium gilvum PYR-GCK
MQTHEIRKRFLDHFVKAGHTEVPSASVILDDPNLLFVNAGMVQFVPYFLGQRTPPWDRATSVQKCIRTPDIDEVGITTRHNTFFQMAGNFSFGDYFKKGAIELAWSLLTNPVSEGGYGFDPERLWATVYLDDDEAIELWQEVAGLPAERIQRRGMADNYWSMGIPGPCGPCSEIYYDRGPDYGIDGGPEANEDRYIEIWNLVFMQNERGEGTSKDDFEILGPLPRKNIDTGMGVERIACLLQGVDNVYETDLVRPVIDLVAGIAPRGYGQGNHTDDVRYRIIGDHSRTAAIIIGDGVTPGNEGRGYVLRRLLRRIIRAAKLLGVEQPIMGELMATVRDEMGPSYPELVTDFERINRIAIAEETAFNRTLTAGSRLFEDAAETTRKAGSTVLSGDDAFTLHDTFGFPIDLTLEMAAEAGLSVDEEGFRGLMAEQRRRAKADAAARKQAHTDLSAYRELVDAGPTEFTGFDELTTEARILGIFVDGRRVPVVSHVQGGDAPGRVELILNRSPFYAESGGQIADEGTVTGTGASQTAKAAVTDVQKIAKTLWAHRITVESGEFVEGDTIVAAVDPRWRHGATQGHSGTHMVHAALRQVLGPNAVQAGSLNRPGYLRFDFNWQGALSDDQRSQIEEVTNEAVEADYEVHNFTTELEKAKSMGAMALFGENYPDEVRVVEIGGPFSIELCGGTHVRSSAQIGPVTILGESSVGSGVRRVEAYVGLDSFRHLAKERALMAGLASSLKVPSDEVPARVENLVERLRAAEKELDRLRLVNARAAAANAAAGAEQIGGIRLVAQRMAGGISAGDLRSLVGDIRGKLGSDPAVVALISEADDDTVPFVVAVNQAAQDRGLRANDLVKVLGAAVNGRGGGKADLAQGSGKGAAGIDAALAAIRAEMGRS

SEQ ID NO: 5018 - protein, 892 aa, Salinispora tropica CNB-440
MKTAEIRRRYLAHFEANGHAVVPSAPLPAISDPNLLFVAAGMMQFVPYFLGQQTAPYKRAVSVQKCLRTPDIDEVGKTSRHGTFFQMNGNFSFGDYFKDEAIPLAWELSTKPVDAGGLGLDPDRIWPTVYLDDDEAFQIWRSVGVPADRIVRRGKADNFWSMGIPGPCGPCSELFYDRGPEYGREGGPEVDEDRYLEFWNLVFMQFERGPGTGKEDYPILGDLPAKNIDTGMGLERMASILQGVDNLYEIDEVRPILAKAAELTGKRYGAHSGQVASESHPDDVRLRVVADHVRTALMLIGDGVIPSNEGRGYVLRRIMRRAIRSIRLLGWQERAMPELLPVARDCMSASYPELATDFGRIADYAYAEEDAFLSTLRAGTTILDTAIAETRTAGRRAISGAKAFQLHDTYGFPIDLTLEIASEQGLQVDAEGFRRLMADQRARAKADAQARKTGHVDLSAYRTVLDEGGPVTFTGYQEVSRESTVRAVLGAASPHAAAVEGETVELVLDTTPFYAEGGGQQPDLGVITVGGGQVEVLDVQQPVPGLIVHRARVLRGEVRVGETGFAEIDTDRRRAISRSHTATHLVHQTMRNFLGESATQAGSLNAPGRLRFDFNTPTGVAPSVLRDVEQQVNEALLADLEVRAFVTSLAEARRIGAMALFGEKYGEQVRVVEVGDYARELCGGTHVGRSGQLGLVKILSESSIGSGVRRVEALVGIDAFNFLAREHLLVARLAELYRVPSDQVAERVEQTVTQLRDAEKELEKLRAQLVLGGAAALAAQASEVRGVAYVGTEAPEGAAGNDVRTLAQEIRSRIDPARPAVVAVAARANGKASLVVAVNPAARSQGLSAADLVKVAFAGRGGGSPELAQGGGLPAAEAPGLLRTVENAIAGA

SEQ ID NO: 5019 - protein, 871 aa, Dehalococcoides BAV1
MFSSDELRENYLKFFEEKGHKRIASSSLIPHNDPTLLLTTAGMVQFKPYYLGVAKPENPRMASCQKCFRTTDIESVGDASHLTMFEMLGNFSIGNYFKKEAIAWAWEYVTQRLNIPAERLWITVYLDDDEAIALWKEQGVPENRIVRLGAADNFWGPAGDSGPCGPCSEIHYDFGQETGCGKADCNPSCKCGRFCEIWNLVFVQFNQDKSGKRQNLPAPSIDTGMGLERLTILMQSKKNVYETDIFAPIVEKACLLSGRKYGCDAATDRALRIVSEHSRGITFLIADGVIPDKAGRGYVLRRLLRRAVLFGRRLGLERPFLVDMAGAVINRMSGIYPELKKRQTYVLEMIASEEARFSETLATGLELLEEIVRQTKGGRISGQDAFKLYDTYGFPVEMTTEIAAEKGLSVDLDGFESEMEIQRTKARSSRKFSFDAAATAEAVKNMRHAEKTCFVGYELAIQKSTIKDILTEGGTVDSIEEGDEASIVLDESPFYAEMGGQVGDTGEIITDAGRFEVKNTLHLPNGVFLHQGRVINGCLKISEAATAHINEERRRDIARNHTATHILQTALREVLGEQVQQRGSVVTPDRLRFDFSHLKPMSKDEMRRVEEFVNDKIRRNLPVYAEEMPYRHALEEGVTALFGEKYGDRVRVLRVGRPAVSAELCGGTHVTASGEIALFKIMSESSVGAGLRRIEAVTGREAEAFINLQQDSLSELSGMLESTAEESPRKLAELKEEIDTLKKAVQNLERQMSRGEAEELLSKAEDYKGVKLLVSRMTSVNADTLRETADFLRDKLGSGVIVLGTVTEDKPFFLCMVTPDLIAKGYHAGNIVKKLSQIAGGGGGGKPNMAQGGGRDKSKLDEALQAVKGMI

SEQ ID NO: 5020 - protein, 904 aa, Mycobacterium tuberculosis F11
MQTHEIRKRFLDHFVKAGHTEVPSASVILDDPNLLFVNAGMVQFVPFFLGQRTPPYPTATSIQKCIRTPDIDEVGITTRHNTFFQMAGNFSFGDYFKRGAIELAWALLTNSLAAGGYGLDPERIWTTVYFDDDEAVRLWQEVAGLPAERIQRRGMADNYWSMGIPGPCGPSSEIYYDRGPEFGPAGGPIVSEDRYLEVWNLVFMQNERGEGTTKEDYQILGPLPRKNIDTGMGVERIALVLQDVHNVYETDLLRPVIDTVARVAARAYDVGNHEDDVRYRIIADHSRTAAILIGDGVSPGNDGRGYVLRRLLRRVIRSAKLLGIDAAIVGDLMATVRNAMGPSYPELVADFERISRIAVAEETAFNRTLASGSRLFEEVASSTKKSGATVLSGSDAFTLHDTYGFPIELTLEMAAETGLQVDEIGFRELMAEQRRRAKADAAARKHAHADLSAYRELVDAGATEFTGFDELRSQARILGIFVDGKRVPVVAHGVAGGAGEGQRVELVLDRTPLYAESGGQIADEGTISGTGSSEAARAAVTDVQKIAKTLWVHRVNVESGEFVEGDTVIAAVDPGWRRGATQGHSGTHMVHAALRQVLGPNAVQAGSLNRPGYLRFDFNWQGPLTDDQRTQVEEVTNEAVQADFEVRTFTEQLDKAKAMGAIALFGESYPDEVRVVEMGGPFSLELCGGTHVSNTAQIGPVTILGESSIGSGVRRVEAYVGLDSFRHLAKERALMAGLASSLKVPSEEVPARVANLVERLRAAEKELERVRMASARAAATNAAAGAQRIGNVRLVAQRMSGGMTAADLRSLIGDIRGKLGSEPAVVALIAEGESQTVPYAVAANPAAQDLGIRANDLVKQLAVAVEGRGGGKADLAQGSGKNPTGIDAALDAVRSEIAVIARVG

SEQ ID NO: 5021 - protein, 892 aa, Frankia EAN1pec
MPYPDDPGRREPMDTAEIRRRFLNHFSERGHTVVPSASLVAQDPTLLLVNAGMVPFKPYFLGDLKAPWNRATSVQKCVRTVDIDNVGRTARHASFFQMCGNFSFGDYFKAEAIPFAFELIVDGYGFNPDDLWATVYLDDDEAEAIWRTLLPAERIQRRGKKDNFWSMGVPGPCGPCSEIYFDRGPAYGREGGPEADEDRYLEIWNLVFMQFARGEGSEYGYEIVGDLPARNIDTGMGLERMATILQGVENLYEIDISRPVLDAAGRLTGTRYGADPDSDVRLRVVADHTRTAAMLISDGVSPSNEGRGYVLRRMLRRAVRDARLLGAREPVMDELFGVVRAAMGPIYPELVDQAEAITAVAVAEETAFLETLRTGTTLFDTAVTQARSSGSSQLSGESAFRLHDTYGFPIDLTMDMAADAGLTVDEAGFRRLMERQRQAAKADRASRRIGNLDLSAFRPILAASGPTTFTGYTELGRESGIVGIVGIGDGDSLTAAGEGEEVGILLDATPFYAESGGQEADLGRIRFDGGEAEVLDVQRPVPDLVMHRVKVLGGELRVGADVFAEVDVERRRAVSRSHTATHLVHTAFRRALGESATQAGSLNSPGRLRFDFHALGAVPDSVLADVEDEVNEIALRDLEVRWYVTSQEEARRLGAMALFGEKYGDRVRVVDVGDYARELCGGTHVASSAQLGAIKLLSESSISAGTRRVEALVGMDAFRFLAREHVLVSQLSSTLKARPDELADRVADIVGRLRDAEKELERLRAQAVLAGSAALAAGAEDVGGVALVTAQVPAGTPADDVRLLALDVRGRLAGRPAVVAVVEAAGAAVVVATDETARTRGLRAGDLVRHSWAALGGKGGGKPDVAQGGRGDADMIPKVFARLRELVADQSA

SEQ ID NO: 5022 - protein, 892 aa, Salinispora arenicola CNS-205
MKTAEIRRRYLAHFEANGHAVVPSAPLPAISDPNLLFVAAGMMQFVPYFLGQQTAPYKRAVSVQKCLRTPDIDEVGKTSRHGTFFQMNGNFSFGDYFKDEAIPLAWDLATKSVDAGGFGLDPERIWPTVYLDDDEAYEVWRSVGVPADRIVRRGKADNFWSMGIPGPCGPCSELFYDRGPEYGLEGGPAVDEDRYLEFWNLVFMQFERGPGTGKEDYPILGDLPAKNIDTGMGLERMASILQGVDNLYEIDEVRPILDRAAELTGKRYGAHSGHVASESHPDDVRLRVVADHVRTALMLIGDGVTPSNEGRGYVLRRIMRRAIRSIRLLGWQERAMPELLPVARDCMSPSYPELAADFGRIADYAYAEEDAFLSTLRAGTTILDTAIAESRTAGRRAISGAQAFQLHDTYGFPIDLTLEIANEQGMQVDAEGFRRLMADQRARAKADAQARKTGHVDLSAYRTVLDEGGPVTFTGYHEVSRESTVRAVLGEAGPRAAAVEGDTVELVLDTTPFYAEGGGQQPDLGVITVGGGQVEVLDVQQPVPGLIVHRARVLRGEVRAGETGFAEIDASRRRAISRSHTATHLVHQTMRNFLGESATQAGSLNAPGRLRFDFNTPTGVAPSVLRDVEQQVNEALLADLEVRAFVTSLAEARRIGAMALFGEKYGEQVRVVEVGDYARELCGGTHVARSGQLGLVKILSESSIGSGVRRVEALVGIDAFNFLAREHLLVARLAELYRVPSDQVADRVEQTVSQLRDAEKELEKLRAQLVLGGAAALAAQATEVRGVAYVGTEAPEGASGNDVRTLAQEIRGRIDPARPAVVAVAARSNGKASLVVAVNQAARSRGLSAADLVKAAFAGRGGGSPELAQGGGLPAAEAPGLLRTVENAIAGA

SEQ ID NO: 5023 - protein, 893 aa, Bifidobacterium longum DJO10A
MRTADIAKRYLDYFAKHDHLIVPSASLISPNPTTLFTIAGMVPFIPYLMGEQTPPKRRMASNQKCVRTLDIDEVGKTTRHGTFFQMLGNFSFGDYFKEEAIHYAWELLTTSQDEGGYGFDPEKLWMTTFTDDDEARSMWINEGVDPEHIQKMGMEDNFWTTGGPGPGGPCSEIYVDRGPAFGKEGGPIADENRYIEIWDLVFENYEVDNVKSKTDLHIVGELENKNIDTGAGLERLAYLLQGKNNIYETDEVFPVIEAAEQLSGLKYGENEDADVRFRVVADHVRSALMIMSDGVRPSNVGRGYVLRRLLRRTVRSMRMLGVTDPVLPTLFPTSKAAMEASYPELNDTFHEVSESAYGEEDAFRRTLETGTTILDVAVNKAKSDSAEPVVAGEDAFKLHDTYGFPIELTLEMAAEQGVKVDEAKFRELMAEQKSRARADALKKRHNVDLSVYDDFKKTLVSPIDFLGYTDMSARAKVIGIMQEGKGSVPAVTGPANVEVILDRTPFYAEAGGQLADQGEILSDDGAVLEVDDVQKPIKDLIVHQCRLTEGTLVVGAEVNANIDLARRGAIARSHTATHMVHKALREELGPQATQRGSEDAPNRLRFDFQWSKAPAKSVISAVEERVNDKLRDNLAVTTKEMKFDDAIALGAMHLFGEKYGDIVRVVSIGEDGWSRELCGGTHVDHVGKIGMVNILSEASIGSGVRRVDAVVGQGAYDFNAREHALVSQLSDKLNARPDELAERVNALLAKLKESDRRLASMYESQLAASVPALVADTKNSAAPVKVAVKNVGHFGAVDALRKTVLDVRAQLGEDAPVVVALAGVNEDDKPMVAVATNEAARKAGIKAGDLVRGAAKVLGGGGGGKPDFAQGGGVDASKIDEALEALKHEAQKA

SEQ ID NO: 5024 - protein, 885 aa, Mycoplasma arthritidis 158L3 1
MLSSKQIRQMWLDFFASKRHLVVPSKSLIPVNDPSLLWINSGVATLKDYFSGKKIPPAKRLTNSQKSIRTNDIENVGVTARHHTFFEMLGNFSIGDYFKKEAINFGYEFIFDVLKLEKDRIYITYFAEDKETYETWIKCGISPDHLIAGTRDTNFWDVGQGPCGPDTEIFYDRGPKYDSRGIELLKEDLENDRFIEIWNIVFSQYNNDGENNYSELISKNIDTGAGLERIVSIMQDAPTNFDTDLFLPIIKAIEKLTSYKYDINNYFTKEAKQAKINTYFKIIADHMRASVNAINDGVSPSNVGRGYIIRRLIRRSYRAGISLGISASSFLYKLVKVVKDSLIYEIDEENVAKIIKQEEELFAKTIKEGEKLLENEIKKHGTVTTEIVFKMFDTYGFPIELTSEILKEKNIAINLEEFKQYLKEHQEKSRGSLESGMNKVINSLATIPGYVSEFIGYDFLKSASKILYLLDDQKAIAHANDDEISYLILDKTPFYATSGGQNHDHGYLKQGNNIIEVLDVFKDKYWNHVHKVKGSIDASQPIECYVDEPKRLNFARNHSSTHLMYHALRETYPNEPIEQLGSNISFDHFTFDFGLDHRPTVQECRQIEKIMRSYIAFSAKRNYIITTIKKAQEMGAWMTIEESEYHDANKVRVVEFENITKDVCGGTHVPNSSVIEDFKIVSVDSKGTDTYRLRVVTSSALVNEYLTDEIKEKQKLLSILIKNNQAFLPTYNIAFETKIPANSIEKEALLLAYENIEDTIRQDYKKFLKAKQNEVVDISKYESTKINGIETYIFFEDDVTLTKKASVELREKYPDALVLGLSKLAEKNYFFIVASKAYDAHAIFKKITTKLGGKGGGNSIVSQGSLNFDGEKAEIISTMGEVINA

SEQ ID NO: 5025 - protein, 906 aa, Ureaplasma urealyticum serovar 10 ATCC 33699
MLKLSTNEIRKKWIEFFESKDHLFIEPKSLIPKNDPTLLWINSGVSTLKDYFSGKVKPPHKRLVNSQKAIRTNDIFNVGLTSRHHTFFEMLGNFSIGDYFKKEAIDWAYEFLIDVLKIDVKKLWVTVFEDDQFTYDEWIKLGIIKEQIIKCNRDRNFWDVGNGPCGPCTEIHYDRGEHFDPNKVGSKLILEDIENDRYVEIWNIVFSQFNNDGHNNYTELLQKNIDTGAGLERIACISQDVPTNFDSDVFMQITKSVEQFSEYKYDMNEYFHPNVAQNKINFAYKVIADHMRATVFAIADGAIPSNKERGYILRRLIRRTMVLVRRLNINNLLWVDAVVNAIASTMGDFYTYLKDEKTLAKIKMILNKEVQLFEKTLQLGLNIFESSIHNQELDKDITFKLVDTYGFPIELIKEICEQRNVKVDLEAFDAMFKHHQLVSKANKANLKVMESQNESLMQLDVDSTFHYEIFKWENAKIITLFNEDFELVDGLDHEDGYVVFDNTCFYATSGGQQHDTGYIIKNDQQFFVDDVFKAPNRQHVHHVKNASLSMNEYVILQINEQDRKSITANHTAEHLLHYCLKQVLSPDIKQEGAAKYPHKVTFDFTYHAQPTKAQLDKLENVLNEMVQSNFDVQELHMDLDEAKAVGAAAYFEDVYKKLKGKLRVIKMGPSIELCGGTHAHHTSEIERIKIVECASKGAGSWRITMVTGHDNLAKYIHDLYVEYLNEINHLKANLDINDHKLNDLYNAFANWKNLSIDDYDLLNEKFTELKQALINFKIEFDKQNAKQAIIDIKNTFNAQQTNKRIHVFKNTDNKNIFNALNELINENQNTLFISFNLDENKIQYLLAINEKFATTNQINLNKYIKELNTISNGKGGGKPYFVQGGTSEQEKLDELLTAIDKWVINA

SEQ ID NO: 5026 - protein, 865 aa, Dictyoglomus turgidum DSM 6724
MRSSDIRKKFIDYFVSKDHLHLPSASLVPSDDPTLLFTTAGMVPFKPYFLGQGIPPKRRITTVQKCFRTTDIERVGITPRHLTFLEMLGNFSFGDYFKREAIGFAYEFLTKELGIPISKLWISVYEEDDEAYDIWNKEIGIPKERIVRLGKEDNFWGPPGPTGPCGPCSEIYYDFGPKSKDEEDCKPGDPCDRFMEIWNLVFMAYYMDEEGKLSPLPQKNIDTGMGLERITTVVEGVSNVFETDLFVPIIEEIRKIVKDSDSVTERLISDHIRGITFLMGDGVVPTNEGRGYVLRRLIRRSLRRAYKHGIVKPFLYKLVPIVVDIMKDAYPDLIEKKDYIQKVLIKEEDQFLRTLEQGLSLLEDYFRKAPSKTVGGEFAFKLYDTYGFPIELTKEIAEEEGFVVDVDGFNKYMEEQREKARASMEAKLEESFISLSDDEVYLMKSLPKSEFVGYEVLESESKVLFFIGGKHGKKISNGEEVYFLMDKTPFYPEGGGQVSDTGKVYNSEVEVMVLEVKRLGEDFIIHRGKVLKGEFEEGQIVRAEVDKEKRYHTMRHHTATHLLHAALREYLGTHVMQSGSLVSPEFLRFDFTHHSPLTYEDLKIIERKVNENILANHKVEKFWTNLEEAKRMGAIALFTEKYQKNVRIIKINNVSMELCGGTHVDCTGEIGSFYIVKEEGIGSGIRRIFAVCGLKAWEFQKRREEILNKISFVLKSSPDEIYVKLEKLIDEMKEKEKKIKDLEERIIEKELEVLANKIENWGEFSFICTYVDMENEAIKKLGDHLKSKNDNLIMVFFKPSDNKLLGTIMVSKKVNLKGITAKKIVEIIGERFNGKGGGKDTLAQISLPKTDIEDIKRALKETLLK

SEQ ID NO: 5027 - protein, 898 aa, Arthrobacter chlorophenolicus A6
MKQLMKSQEITKRWVDFFVSKGHTAVPSASLVSSDPSLLFTVAGMVPFIPYLTAREEAPYTRATSVQKCIRTGDIEEVGKTARHGTFFQMCGNFSFGDYFKEDAIKYAWELLTTSVDDGGYGLPPELLWVTVYEEDDEAKELWLKNTGVPAERIQKMGKADNYWNTGQPGPAGPCSEIYYDRGPAYGIEGGPLADETRYIEIWNLVFMQYQIDNVRSKDDFDIVGELPKKNIDTGLGMERLAMILQGVENMYETDQVRPVIDKAAELSGKEYTSAETPDDPHHTDDVRMRVVGDHIRSALMLISDGVTPSNEGRGYVLRRLIRRAVRSMRLLGVEQACLPDLLPASRDAMKGVYPVVETDFARISRIAYAEEKAFLRTIASGTARLEEAVKESKAANKQLSGEDAFALHDTYGFPIDLTLEMAEEAGLKVDEAAFRSLMQEQRQRAQADAKGKKGGHADLSAFQDILAQGETVFTGYTELDGESRVRGLLTGGRPVQQAATGDEIELVLSETPFYAEAGGQAADTGLITGDGFVVEVLDVQRPVKGLSVHKAIVREGEIGADSLVRAAVDRERRHAAEQAHTGTHIVHAALHQILGPEATQRGSFNKAGYLRFDFAWGEGLSTATRSEIEEVSNLAIRNNYAVETKVMGLAEAKALGAMALFGENYGSEVRVVEIDGAWSRELCGGTHVANTSLIGSLSLLGEQSVGSGNRRVEAFVGMEAFRHLAAERALVTELTDLLKVPSGQLADRISATLAKLKATEKELDRLRKEQLAASAAQLVNSAKDAAGVSLIAHDAGSVSGADDIRGLALDLRNRLGSAPAAVAVAGVANDRPLVLVATNEAARNAGVKAGALVRLAAGVLGGGGGGKDDVAQGGGTDAGKVGAALAAILDAVERRQS

SEQ ID NO: 5028 - protein, 854 aa, Acidimicrobium ferrooxidans DSM 10331
MDSNDLRRAFREYFVERGHVPVPSASLVPHDPTLLFTVAGMVPFKPYFLGEEVPPYRRATSIQKCMRAGGKHNDLDQVGTTARHLTFFEMLGNFSFGDYFKEGAIPYAWGLVTEVLGLDPDRLWITVHTSDDEAERIWIEACGVRPERIQRLDEDNWWQMGETGPCGPCSEIYYDKGESYGAGGGPAVGSDERFLEIWNLVFMQYDRHPDGSLTPLPAPCIDTGAGLERIVPVLQGHDSVFETDLMWPLMEEAQSLTGRRYGGRFGADAGGDVGLRIMADHARATTFLLADGVVPTNEGRGYVLRRIIRRLVARAQLLGAKGPVVEPMVRMTAAVMGEAYPEVARELETIVQHAAREEERFAATLALGRPLLDAALEGGSVPGALAFKLHDTYGLPIELTMELAAERGVSVDRAGFEEAMAAQRERARQAGLGTEAVEHPVSAEVLREHGRSEFTGYEATEDEGRLLALASEGDVLVAVLDRTPFYPEGGGQLGDTGTIEGDGFRLTIIDTDQPVAGVIRHHVGAVEGEPVIGALVRAVVDAERREGLRVHHTATHLLHWALREVLGPHVKQQGSLVAPDHLRFDFTHWGPLTPDEIEEIERRVAAEIIRDSVVTVELMDRDEAIRRGAVAFFGDRYGDVVRVVHAGESSVELCGGTHLDRLGRIGHLRITSESSIGANTRRVEAVVQLAALEVAHRDRRLLDELERIVPGGRDGIGERVDRIVERAKRAESELARERTRTLAERARALAETRGADGLVVARVDGLDQRGVRELAMLVRDHEGVLGVVIGGVANGVVALAAAVREGAPWRADELLRPVAQAVGGGVGRAEVVAVSGGRRAEALDAALEAVRTAS

SEQ ID NO: 5029 - protein, 890 aa, Actinosynnema mirum DSM 43827
MQTHEIIKRFREHFENAGHAVVPSASLLLDDPNLLFVNAGMVPFKPYFLGEAPSPHKRATSVQKCVRTPDIDEVGKTTRHLTFFQMAGNFSFGDYFKEDAIRLAWDLVTKSQDDGGYGFDPERLWVTVYLDDDEAADLWQKIAGLPPERIQRRDVEDNYWSMGVPGPCGPCSEIYYDRGPEFGAEGGPVVDEDRYLEIWNLVFMQNERGAGGAKRDYPILGELPSKNIDTGMGVERVAFLLQGVDNVYETDLVRAVITKAEELSGRKYGDNPTDDVRFRVIADHARSGVLLVGDGVTPGNEARGYVLRRLLRRIVRSSRLLGVTEPVLQTFAAVVRDTMGPSYPELVSGFARIEQVLKAEEDTFLRTLDAGSRIFETAAGTVKSQGRAILPGDKAFQLHDTYGFPIDLTLEMASEAGLTVDEDGFRKLMAEQRARAKADAAGKKTGHGDQTVYRELLELGATEFTGYTELASEAVLRGIVSGGKRVKSAREGDIVEVVLDRTPLYAESGGQESDAGVIVSGGAELEVVDVQKVARKLWVHQVRVVSGEIAEGEKVEARVDAEWRVGARQGHSGTHVVHAALRQVLGPSALQSGSYNKPGYLRLDFAWTGGLSESTRSEIEEVSNLAVRKDLPVSVVYTDMGGAQEMGAVALFGETYDETVRVVEIGGRWSRELCGGTHVEHSSQIGPITVIGESSVGSGVRRLEAYVGIEAFKYLARERALVQNVAAMLKVPDAEVPGRVEALVERLRVAEKELEKVRSAQLVASAGSLVSQALDVRGVSVLALALPEGTSGADVRAIASEVRGRMADKPGVVALFAPDGDKVSFVVATTAGARDLGLAAGKLVPAFAPAVGGRGGGKPDLAQGGGTNPAGVPQAVAAVLAEVERALEQR

SEQ ID NO: 5030 - protein, 896 aa, Beutenbergia cavernae DSM 12333
MRTAEIRRRYLDYFAERDHTVVPSASLISADPSILFTIAGMVPFIPYIVGTEQAPYSRAVSVQKCIRTNDIEEVGRTTRHGTFFQMNGNFSFGDYFKEGAVEFAWELMTSSQDDGGFGLDPDLLWVTVWEEDAETARVLREVIDFPAERVVPLSRADSFWDTGQPGPAGPTAEWHLDRGADRGPDGGPAVDTAGDRYVEFWNLVFDEFLRGPGPGKDYPLLGELPMKSIDTGMGLERVAAILQGKDNIYEIDEVFGVIARAEELSGRRYGASREDDVRMRVVADHVRSAMMLVSDGVKPSNEGRGYVLRRLLRRSVRAMRLLGVTDPALPELLPVSKDVMKASYPELEADFGRISTIVYDEEDAFRRTLTSGTTILDTAVRRLKESGGSQLGGEQAFALHDTYGFPIDLTLEMAAEQGVSVDEEAFRRLMGEQRARARADALAKRSGHADTSVYRDIAGSLPAPVSFLGYTDAEARVAVVGLLVDGVPAPAAQAPAEVEVVLDRTPFYAEAGGQLADQGQIVLDDGAVVEVDDVQAPIKGLSVHRGRLVEGVLGLGSSGVASIDTARRRAIARAHTATHMVHKAIREHVGESATQAGSENAPSRFRFDFRSGSALPSAALAEINARVNTLLADDLDVTDEVMALDDARAAGAMALFGEKYGDRVRVVSIGGDWSKELCAGTHVASTGHLGLVTLLGESSIGSGVRRVDALVGDGAFGYQAKEHALVGQLTQLVGARGEELPERVSSLMTRLKEAEREIQSLRQGRLLAAAASLAASAALVSGARVVTHDAGEVASVDDVRALVVDLRDRLGEAQAAVVVVGGVAKGRAVVVAATNPAARESGVRAGELVRVAAGALGGGGGGRDDLAQGGGSDPDQIPAALEQVVAAVGRTLDERG

SEQ ID NO: 5031 - protein, 902 aa, Brachybacterium faecium DSM 4810
MRTSEIHRRWLAFFAKKDHEIVPSASLVSSDPSILFTIAGMVPFIPYIVGTETAPYPRAASVQKCIRTNDIENVGRTTRHGTFFQMAGNFSFGDYFKQGAIDYSWEFLTTPQDQGGLGFDPERLWFTVWEQDEESYRHVTEVIGLDPQRVVRLPREEIFWDTGQPGPAGPCGEWHFDRGPEHGPEAVTGTVPEWPGDEQAEDRYIEIWNLVFDQYLRGEGSGKDYPLLGELEQKSIDTGLGVERVAFLLQGKQNMYEIDQIFPVIEKAQELTGRRYGAVEEDDVHLRIIGDHVRSALMLVADGVRPGNEGRGYVLRRLIRRAVRSMRLLGYTQPSMPQLLPISHSLMVESYPELEADFARISEIVHAEEEAFRRTLETGTTIFEGVVGAVKEEGGRVLPGEDAFRLHDTYGFPIDLTMEMASEVGLQVDAEAFRSAMQEQRERARADAAAKKAGHTDTALYSRLLSQRGGEVPFVGYTEDTVATTVESVLVDGQLVDTVHAPAQVEVVLATTPFYAEAGGQLADQGQISLTGGGLIEVDDVQKPVRGLIVHRGRLLEGELAQGASAIATIDVARRGAIARAHTATHMVHESLREELGGSATQAGSENSPGRMRFDFRYGQAVPKSVLEQIEGRVNTLLQDELTVTDQQMSLDEAKALGAQALFGEKYGDIVRVVSIGGDWSRELCGGTHVDSTGAIGTVQLMGEASIGSGVRRVDALVGLSAYRHQAKEHALVSQLSELLKVGAAEELPERVRALTQRMKDMEKQLAALRGQQLQAEAGKLVESASDVAGVRLIAHDAGEGIAAGDLRTLALDLRSRLGEDVPVTIAVAGHDGGRAALVIATNATARERGLAAGTMLRGAAEAMGGRGGGKPDLAQGGGGEPARIPAALTAVREAIAAAPTA

SEQ ID NO: 5032 - protein, 903 aa, Micrococcus luteus NCTC 2665
MKSQEIARRWTAFFESRGHRVVPSASLVSPDPSLLFTVAGMVPFIPYFLGEQTPPSPRVVSVQKCIRTADIEEVGKTVRHGTFFQMCGNFSFGDYFKETAIPMAWELLTSSVEDGGFGLDPERLWVTVYREDDEAERIWREDVGVRPERIQRMGKDDNYWNTGQPGPGGPCSEIFYDRGPAYGVDGGPAADDTRYIEIWNLVFMQYRLSAVRSKDDFDIAGELEHKNIDTGLGLERLAMILQGVENMYETDQVRPVLDRAAQLAGRAYTSTEDPADPHYDDDVRLRMVADHVRSALMLISDGVRPGNEGRGYVLRRLIRRVVRALRLMGVTEPVFPELLPVSRDAMKGTYPVVADEFERISRIAYAEEKAFLRTIAAGTARLDAAVGQARSAGGGIAGPDAFELHDTYGFPIELTLEIAEEAGVAVDEAGFRALMAEQRDRARADAKAKKSGHTDTAVYQRLRAEGQTHFTGYTEHTTESVVRGLLQNGEEVPSAGAGTELELVLDATPFYAESGGQAADTGLITGDGFRLEVLDVQAPVKGLSVHRVKVLDGEVAAGAQALGAIDLQRRLDGEKAHSGTHLVHAALHQILGPEATQSGSFNKEGYLRFDFRWAEALSAGARSEVEDVVNIAIRDDHTVLTQEMSLEEARALGAMSLFGEKYGDRVRVVEIDGAWSRELCGGTHVGRTAQIGSLTLLGEQSVGSGNRRVEALVGLDSFRHLAAERTLVSELSEMFKAPAEELKDRIGATLDRLKAAEKQVAELRAQALQAQAGQLAGQAQDVTTSGGTSVRVLAHHAGDVAGDQLRSLALDLRARIESAGGNAAGTPVLVALTAEAKGRPLVVVATNEAARAAGLKAGAMVKTATGVLGGGGGGKDDVAQGGGQDVTRVGDALDAVVAAVRAA

SEQ ID NO: 5033 - protein, 893 aa, Kytococcus sedentarius DSM 20547
METAEIRRRWLAYFEGKDHAVVPSAPLIHDDPNLLFVNAGMVPFKPYLLGQQTPPWQRATSVQKCVRTGDIEEVGKTSRHGTFFQMNGNFSFGDYFKAGAISMAWEFLTTPEAGGGLGLRKDDLWATVYNDDDEAFDLWLELTDLPAERIVRRDEEDNYWSMGVPGPGGPSSEIFLDRGAEYGRDGGPAVDEDRFMEIWNLVFMQHELSAVRSKSDFDIAGNLPQQNIDTGMGLERIASVLQGVDNLYEIDQVYPVLDRAAEMAGVEYGASSGHIASESHPHDVHLRVVADHVRSGLMLIGDGVVPGNEGRGYVLRRMLRRAVRSMRLLGVTDPALPELLPISRDLMGESYPELVSGWDRISQIAYAEEDAFRRTLEAGTTIFDVAAGQTKDAGQKVFPGDKAFALHDTYGFPIDLTLEMAAEQGLAVDEAGFRGLMTEQRERAKADARAKKSGHANTEVWRELRSLGATDWRAYTDLATDGRVVGLVRDGERVGGLSQGETGQVVLDTTSFYAESGGQVADAGIITLDGARLEVVDVQRPVKGLVAHTVKVASGEVTEGADARAEVDPTWRIEAAQAHSGTHVVHAALRQVLGPSALQSGSYNKPGYLRLDFAWNGALDAATRSELEEVANLAVRDDLPVSAHWMSLPAAREWGALALFGETYDEDVRVIEIGGPWSRELCGGTHVQHSSQIGALTLTGESSVGSGSRRLEAFVGLNALRHLATERALVAELSTIAGVQPTELKDKVSQLVARLKETEREITAMKRQQAQGATAGLVDEAEQVGGIRLVTKELPEVDGGDLRTVAQDVRGRFGDAAAAVALVSTAGAKPVVVVATTQAARDAGVKAGALVKAAATALGGGGGGKDDLAQGGGQDNSRAADALAAIRAAVANA

SEQ ID NO: 5034 - protein, 878 aa, Eggerthella lenta DSM 2243
MKYMTSAEIREKYLSFFEEKGCKRWPSSSLIPDDPSLLLTSAGMVQFKPYFLQQKHLEAPYIGTTTVQKCVRTNDIDIIGTTGRHQSFFEMLGNFSFGEYFKEEMCAWAYEFSTEVLGLPAERLYFTVYLDDDETIEIWKKLGVPDDHISRLGEDDNFWRAGPTGPCGPCSEIYFDQGEDFGCGSPDCAPGCDCDRFLEYWNLVFTQYDGQEDGTFVPLPKKNIDTGMGLERIAAILQGVQSNYETDVLRSLVAVGEKLTGTTYGEDAAIDLSLRIMADHSRAVAFMIADGILPSNEGRGYVLRRLLRRAVMKGHLLGLDKPFLNDYVDEIVNLMGHVYPEIVENRELTRRVILSEEERFGSNLRQGRAFLDEALAELEGEVLPGDRAFTLHDTYGFPVEVTRELCDERGIEVDMEGFGRCMDEQRERARAANTKDAEAAWSTYGGVMNEILEAVGPTEFLGYTKNDAEARVLALVKDGVQVDVLEAGDEGRVVLDATPFYAEKGGQIGDAGVLAKDDAIVAVLDTKEPEKGLIAHTVKVESGRLSAGDAVHAAIDVPRRERIRRNHTATHILHWALREVLGDHVKQAGSYVADSRLRFDFTHFEAMTAEQIAEVERLANQKIMENHPVRAYETSLASAREAGVMALFGEKYGEFVRVLDIEGFSQELCGGTHVSATSEIGFVKITSETSVGANLRRIEAVTSFDALAYMNRVEAELKEAAESLRVPLFDVSERTASNMKTLKDLQTKLKRGREAVADDGINALLETAQTSAAGYPVVFGRMPEADAGQMRNMWDVLRARLGQPGAAVLATEKDGKPTLLAAGTPEAVEVGFDADAVIKAISGNIKGGGGGKAAMAQAGGKDASGIDAALQAARDMLL

SEQ ID NO: 5035 - protein, 889 aa, Catenulispora acidiphila DSM 44928
MESAEIHRRWLDFFQKKGHTVVPSASLISNDPTTLLTIAGMAPFKPYFLGEQPAPWPRATSVQKCVRTLDIEEVGKTTRHGSFFQMCGNFSFGDYFKETAIPMAWELCTTPVSEGGFGLDPEKIWVTVYLDDDEAEEIWKKAGFPAERIQRLGMKENYWSMGVPGPCGPCSELFYDRGPEFGEAGGPAVNDERYMEFWNLVFMQFERGAGGDKGGFPILGELPSKSIDTGLGLERLATILQGVNNLYEIDTSRAILDKAASIAGVTYGRDTRTDVSLRVVTDHVKTATMMIGDGITPGNEGRGYVLRRLMRRAIRNMRLLGAHGATIKDLVEITIGAMGQAYPELIADASRIVAVAVAEETSFLQTLRTGSAMFETVADEAKASGSAVFSGDQAFKLHDTFGFPIDLTLEMASEAGLSVDEEGFRRLMKEQRDQAKADARAKKTGHADMSAYRELLDAAGPSAFTGYHEVSSEGLLKAMLVNGQVGSSAKPGDEVELVLDRTPFYAEGGGQLADHGLIRLGNGALAEVVDVQKPVGDLIAHRAIVRDGEVVLGAEAWGEVDTARRAAISRAHTATHMVHKAFRELLGETATQAGSENSPGRFRFDFASPGAVPHSVLADVEQRVNELLIDDLSVTAQVMSQPEAKAMGAMALFGEKYGDRVRVVSVGEWAHELCGGTHVDNTGRLGLVKLLSESSIGSGVRRVEALVGTDAYNFLAREHVLVSQLAEVVKARPEELVERVGGIMTKLRDAEKEISALKAGQLLQIAGSLVDGASDVHGVAVVTHQAPDGASADDLRKLVLDVRGRLGTRPAVVAVAAAAGERPVVVIATNEGSRGLGLKAGELVRSAAKTLGGGGGGKDDVAQGGGTDATAIPAALEGVGRAVAEKVAA

SEQ ID NO: 5036 - protein, 878 aa, Cryptobacterium curtum DSM 15641
MTTAEIRERYLRYFESKGCKRMPSSSLIPDDPSLLLTSAGMVQFKPYFLQQKHLEAPYIGTTTAQKCVRTNDIDLIGTDGRHLSFFEMLGNFSFGAYFKEEMCAWALDFSLNELGLPKEKLYFTVYEDDDETIEIWKNLGIEASHISKMGEEDNFWRAGPTGPCGPCSELYYDQGPEVGCGRPDCAPGCECDRFLEYWNCVFTQYDAQEDGTLKPLPKKNIDTGMGLERMAAILQSVSSNFDTDVLRGLVAVGERLSGRSYGASDADDRALRVMADHSRSMTFMIADGILPSNEGRGYVLRRLLRRAVMKGHLLGIEGAFLGSFVDEIIQVMGSEYAELVENRDLIKRVVASEEERFGSTLRQGRAYLQEALDGLSGGLLSGEVAFTLHDTYGFPLEVTQEICAESGIEVDVEQFNHLMDEQRSRARRATQDDAEAAWSTYDGSMAALLEQVGATVFTGYDENKSAGHVRALLRDGESVCTLSAGEAGCVVLDRSPFYAEMGGQVADTGTITSPDGASCARVTDVKAPESGLIVHYVQVEQGSFTIDDEVIGSIDVARRERIRRNHTATHILHKVLSEVLGNHVKQAGSYVAPNRLRFDFTHFEAIDRATLDEIENVANRVIMEAHPVHTYETTLDEAREQGVTALFGEKYGEVVRVVDIDGFSRELCGGTHVRNTSEIGFVKIVSEQSTGANMRRIEAVTSFDALAYTDRMRDELRQTAAVFGVPLFDVNERAAIATEQLKTLQAQAKRAKKIAVASDIRTLVDKAISTSRAGYPVLIYRLDGMDAGSLRNTWDIARAHLGETCAVVLASDNEGKPLIMAAGTDAAVAAGFDAGAIIKEVAGAISGGGGGKPSMAQAGGKDPAGLDEALDIARRMLL

SEQ ID NO: 5037 - protein, 888 aa, Saccharomonospora viridis DSM 43017
METHEINKRFLDYFERHGHTKVPSASLILDDPTLLFVNAGMVQFKPYFLGEVPPPYPRATSVQKCVRTGDIDEVGKTTRHNTFFQMAGNFSFGDYFKQGAIELAWEFITTSQDEGGLGLNPDRLWATVYEHDAEAAALWRDVAGLPSERIQFRGPDDNYWDMGVPGPCGPCSEIYYDRGPEYGREGGPVVDEDRYLEIWNLVFMQEMRGELSPKQGHAPIGELPQKNIDTGMGVERVAYLLQGVENVYETDLVRPVITKAEEFSGRRYGADHADDVRFRVIADHARSGVMLIADGVTPGNEARGYVLRRLLRRIVRSVRLLGVHEPVLPEFAAVVRDAMAPSYPEIARDFDRISDVMRAEEEAFLATLTSGSRIFDLAAQETKRAGGTILSGDKAFQLHDTYGFPIDLTLEMAAEQGLSVDEEGFRTLMEQQRQRAKADAASRKTGHGDLSVYRKLLEEHGETEFLGYTDLQATARVLGLLVDGKPVRSASEGSVAELVLDRTPFYAEGGGQIADTGVLIGEGAELKVLDVQRLVPGLFVHRVEVVAGEVGVDTQLTASVDGTRRASIARSHSATHLVHAAVRGAYGNRAAQAGSLNTPGRMRFDFTTPKSVSDDVLTEVEEEVNDYLQTDVEVQAYTTTKDRALELGAIALFGEKYGDRVRVVDMGDYSRELCGGTHVERIGQLGLVKLVSDSSVGSGVHRVEALVGTDALRHVRKEQLLVSQLASTLKVPADEVPSRIQDVLTRLRNAEKEIEQLRLREVLNSASTLAERAREIAGVSVVAERLDQEVDAGALRKLTGEVRNRLGSRPGVVALFAPSGEGKVSFVVATTAEARDAGLAAGKLVPAFAELVGGRGGGKPDMAQGGGSRPEGVEQAIEALRAAVAANR

SEQ ID NO: 5038 - protein, 895 aa, Jonesia denitrificans DSM 20603
MRTAEIRHRWLQFFESRDHHVVPSASLISPDPSVLFTIAGMVPFIPYMLGEQKAPWPRATSVQKCIRTGDIDEVGKTTRHGTFFQMNGNFSFGDYFKREAITFAWEFITGSEESGCLGFDPELIWVTVYHDDDEAASLWRDVAGLPEERIQRRGKKDNFWHTGQPGPGGPCSEIYVDRGPQYGAEGGPVVDEDRYLEIWNLVFMQYSLENVTSKESFDIVGPLRQHNIDTGMGLERVALLKQGVNNMYEIDEVYPVIEAAEKLSGRTYGENNDDDVRFRVVADHIRSSLMLIGDGVRPSNEGRGYVLRRLLRRSIRAMRLLGVTEPAIPALITASKEAMKASYPYLEENFATILATASTEEDVFRRTLNQGLTILDAAVSDAKSQGGSSAALTGEQAFTLHDTYGFPIDLTLEVAAEQGVSVDETAFRSLMQEQRDRARADALAKKQGHGDLGVYQSLLASMAAPVEFLGYTDAQAPAKVTALLVDGQPVATVTAPADVEIVLDRTPFYAEKGGQLADHGRVYSEQGATVDIADVQSPVSGLSVHRGALVDGTLSVSDAVVAEIDVVRRRQISQAHTATHMIHKALQETLGADSTQAGSENSPNRIRFDFRQSQAVPTSALAEIEGRVNDQLRENLEVTDIVTSLDDARAMGAMALFGEKYGDRVRVVSIGGDWSRELCAGTHVPTSGELGIVTILGEASIGSGVRRVDALVGAGAYGHHARERALVSQLSGLLNVRSEELPTRVESLVGKLRDAEKELTTLRQAQLLARAGEIASSAATVGAVRVVTYDAGEVATPDALRTLVLDVRGRLGDSQGSVVAVAGVSKGRPVVVIATNASAREAGVKAGALVRTAAGVLGGGGGGKDDLAQGGGQNPTAITEALAAVSRDVASVQGA

SEQ ID NO: 5039 - protein, 889 aa, Slackia heliotrinireducens DSM 20476
MRYMTTAEIREKYLKFFEGKACKRLPSSSLIPDDPSLLLTSAGMVQFKPYFLHVKEFDPAYVGAATVQKCVRTNDIDIIGTTGRHLSFFEMLGNFSFGKYFKKEMCAWAWEFCLNELELPKEKLYFTVFEDDDETIEIWKSLGVEDSHISRLGEDDNFWRAGPTGPCGPCSEIYYDQGPEFGCGDPNCAPGCDCDRFLEFWNCVFTQYDGQEDGTLAPLPTKNIDTGMGLERMAAIMQGVQSNFDTDVIRGLIAVGERLSGKSYVGKANTVGHGSEQGDIDLSLRICADHSRSVAFMIADGILPSNEGRGYVLRRLLRRAVMHGRKLGIEGAFLNEYVAVIVDLMGHVYPEIVENRALVESVIASEEGAFANTLRQGQAYLAEALKNLEGTTLSGDVAFKLHDTYGFPVEVTEEICSESGISVDHARFEECMNEQRERARAATKDDAEAAWSTYGSIYADLLKELGPTKFVGYEGTDYEGATIKAIIRNGELVGSLHRGEEGEIVLDTTPFYAEMGGEVGDTGMLHGTFGVSEVLDTKAPEKGLVCHRVRVIEGDCHAVDETVNASVDAQRRALITRNHTATHLLHAALREVLGDHVKQKGSYVGPDRLRFDFTHFEGMTPEQIAEVERVANEKVMQAIPTTIYETSLNAAREAGVTALFGEKYGDTVRVVEAGEFSRELCGGCHVSNTAEIGFIKIVSEGSSAANVRRIEALTSVEALNYMNAVEAELKETAAELRVPMFDVSERTASNLATIKDYETKAKNAKKMAAEGNIAEHVKDVVNVGYPLLVVRIDGLDTGGLRNAWDIIRARMETPGACIIGTVNNDKPIIMAAGTDEAVAAGFNAGAVIKNIAGNIKGGGGGKPSMAQAGGKDASGLDAALQAARDMLGA

SEQ ID NO: 5040 - protein, 881 aa, Atopobium parvulum DSM 20469
MADYKTMTTAEIREDFLSFFESKGCKRYPSSSLVPSDPSLLLANAGMNQFKEYYQGIKTMKEIGATSCQKCLRTNDIDNIGDSRHLSFFEMLGNFSFGGYTKRDACTWAMEFISSPEHLGLPLDRLYFTVFTDDDEAIEIWKSLGITEDHITRLGEEDNFWAAGPTGPCGPCSEIYFDQGPEFEGEAPGDDGDRYLEFWNLVFTQFDRQEDGSLPELPHRNIDTGMGLERIAAIMQHEGTNYEGDIMRTLISLGEKLSGKKYHSTDEIDRSLRILADHSRAVTFMIGDGILPGNEGRSYILRRLLRRAVYHGRLLGIQGTFMAEYAHEVAVLLGAEYPELVEKSALIDGILTAEEERFGATLDAGESKLTAELEQLEDGAQLSGEVAFLLHDTYGFPIDLTREIAANAGHVVDMDAFDAAMTEQRERARKSANRDAWGNAQSIWVALSDRLDETVFDGYDNNELSGVRVVALVQDGQEVESATVGSEVEVVLDRTPFYAEMGGQVGDTGRLSGPGLYVHVTDTKHRDGGLESHIGVVEEGTLSIGDSVTATIDAGRRELIRRNHTATHLLDAALKKVLGDHVNQAGSLVAPDRMRFDFTHFEALTKDELDRIEGMVNAEIFAAKPIVTKIMSIEDAKAAGAVALFGEKYGDVVRVVSAGTEDTPFSRELCGGTHARNTADLGLFKIISESSVGSNSRRIEAVTSMGAIEYVDERLAQLDEVAAALKVRPSAVADRVEQLQQDLRAANHKLEAALTGAGSNQVAEALKSAVQLNGYSCVIAKLEGLSGKELRSAWDGIRDASDGQPVACVIASATADGKVSLLAGATDSAVAAGFSAGDIVKEIAEFVGGRGGGKPAMAQAGGSNAAGIDAALDAARTKLGA

SEQ ID NO: 5041 - protein, 891 aa, Nakamurella multipartita DSM 44233
MQTHEIRRRFLDHFERAGHTVVPSASLISQDATVLFTIAGMAPFKPYFLGQSTPPFPRATSVQKCVRTGDIDNVGVTTRHNTFFQMAGNFSFGDYFKAGAIEHAWTLLTSSLADGGYGLDPDRLWVTVYESDDEAERLWQEIAGLPAERIQRRGMADNFWSMGVPGPCGPCSEIYYDRGPEYGIEGGPVADEDRYLEVWNLVFMQDMRGESDGSGKGDFPILGPLPQQNIDTGLGVERLAFLLQGVDNVYETDLLRPIIASMEQLSGKKYGGGDHQADVRFRVIADHSRSGMMLIGDGVTPGNEGRGYVLRRLLRRAVRSARLLGVTEPVMPTLMSIVRDLMSPSYPELATDYERIEKVAATEEKAFLRTIASGSKLFDVAAADLATQHVTTLPGATAFTLHDTQGFPIDLTLEMAAEAGLTVDVAGFERLMKEQKDRARADAKARKGGFADLSEYRRLLDQGATEFTGYSELQTEARIRGLLRDGVPVPAAHEGEEIELVLDRTPLYAESGGQDSDAGTIVGAHGAAEVLDVQKVDRKLVVHRVRITDGEFTTGAQVLAKVDPEWRLGARQAHSGTHVVHAALRQVLGPEALQSGSYNKPGYLRLDFAWDQALSAATRSELEEVANRAVRQDLPVRVLYGSMQEAQAMGAIALFGETYDDTVRIVEIGGPWSVELCGGTHVEHSSQIGPVAITAESSVGSGLRRVEAAVGIEAFHRLVAERTLVSQLASTLKVQPAELPGRIETLLDKLKSAEKELAGLRAAALGNVAGTLAGGAIDVAGVALVAATAPEGTAAGDLRTLASDVRGRLGDRPGVVALFAPAHASVPFAVAVNQGGIARGLAAGELAKAVLPLIEGRGGGKKDLAQGAGTRPDRIPEAIDALRAALLTAAG

SEQ ID NO: 5042 - protein, 254 aa, Brucella suis 1330
MALPLFSAKMLLPVGNPPSLKTLATGLILACGIALPASAKDTLQVALADRSEFLPLSRSSIEANRGNTPALVPLPDALPRAIPKSASDGAPAPLHISKAIPEIHRDFDKLPEPVRAMRERMLEAARSGDIERLRPLLGVQDKATQLALEDNEEDVIDFLKSLSGDEDGREVLAIITDLLDTGYVHLNVGQQNEVYVWPYFYAMPLDKLTPPQIVELFQIVTAGDFEDMKKAGGYIFYSIGIGPDGSWRFFTAGQ

SEQ ID NO: 5043 - protein, 244 aa, Mesorhizobium BNC1
MPTPPPSCRAYAVALALAALFWLPGKSLALNDTFPEYRPVQQQPGGASEGNPDLLSAPTLSEESGEDSTVGAEERSGDVARPDTTPGEEPPEVIYDLSRLPEPVRRMRQLIIDACKSGDIEKLRPLIGSGDSATQLLLGNLEGDPIDFLRQISGDEEGQEIMAILLEVMESGFVHLNAGAENEYYVWPYFFAFPLDELSPQQKVELFTLLTASDYEEMKNFGAYIFYRSAITPDGRWLFFVAGD

SEQ ID NO: 5044 - protein, 248 aa, Sinorhizobium medicae WSM419
MNRNPASRALPVGLVVLLLASAIATGTPALALSEFQGAPPPIGSERNAAPAEETEEAAPEERTPFEIPMPDPLVDRTAVQLKDDEIPAPEVLEPVEVLTDVSKIPEPVARMRELIVEAAASGDIERLRPLLGKGPTQTQVTGTAGEEDPIAALKSLSGDQDGIEVLAILLDLMSTGFVLADKGTPEEAYVWPYFAEKPLSSLTAPEKVDLFRLVTAGDFAGMEEFGSYNFYRVGITPDGRWKFFVAGD

SEQ ID NO: 5045 - protein, 245 aa, Ochrobactrum anthropi ATCC 49188
MSFPIRNFASPRALLAGIILACGIALPAAAASSFDLALADQSDFLQRPGGRAVTDESDSSSPIPLPGALPRAIPRVSPGHEPAPATSSKPMPEIHRDFDKLPEPVRLTRERMLEAARSGDIEKLRPLLGVEDKVTQLSLEDHEEDVIDFLKSLSGDEAGREVLAIIVDLLDTGYVHLNAGKDDEVYVWPYFYAMPLDRLTPPQIVELFEIVTAGDFEDMKKAGGYIFYSIGIGPDGSWRFFTAGE

SEQ ID NO: 5046 - protein, 252 aa, Rhizobium leguminosarum bv  trifolii WSM2304
MHTGKEKISRIPLAPVLLAFSLAAGNIFLAPAAYALSELHKIPGQAANDAPAAPGSAQGQSQPQGGTAPSVPMADPLVNSQNNQGVDKTPGAQDASKPAEVIYDISKVPEPVRKMREQIVEAAASGDLERLRPLMGTGTEQTQVTVGEPTEDPIGTLKDLSGDPDGDEILAIMLDIVSTGFVHVGQGTADEMYVWPYFAEKDLKSLTPPERVELLRIVTAGDLSDMQEFGGYNFYRLGITPQGKWKFFTAGD

SEQ ID NO: 5047 - protein, 258 aa, Agrobacterium vitis S4
MRKACQTGAKATGLKNNVKTMLVCGWMASIAVIALPGSSFALSELQGGAKDAAQQGQQPQTGQQPGLPTDSTSDPKSAPSAEPQQATPADKAKGAAAEAAPHTPVEVIYDISKAPEPVRKLREKLVEAAASGDPERLRALLAGGNDPTALALGNDNGDPIQTIKSVSGDPDGLEVLAIMLDVLSTGFVHVNAGTPEEAYVWPYFAEKPLTTLTPPEKVELLRLVTAGDFENMLEVGNYNFFRIGIAPDGKWKFFTAGD

SEQ ID NO: 5048 - protein, 250 aa, Rhizobium leguminosarum bv  trifolii WSM1325
MHTGKKKVSRISLAPVLLAFSLAAGNVFLAPAAYALSELHKIPGQAANETPPAQGSAQGQSQPQTTPGVPMADPLVNGQNNQGVDKTPGAQDNSKPAEVIYDISKVPEPVRKMREQIVEAAASGDLERLRPLMGTGADQTQVTVGEPTDDPIGTLKDLSGDPDGDEILAIMLDIVSTGFVHVGQGTADDMYVWPYFAEKDLKTLTPPERVELLRIVTAGDLSDMQEFGGYNFYRLGITPQGKWKFFTAGD

SEQ ID NO: 5049 - protein, 460 aa, Ralstonia eutropha JMP134
MTSAVFLGFLVLSLYLAIRSKKGHGAQSMHDFFVASRQFGAFLVFFLAAGEIYSIGTMVGFPGGIYAKGPTYGVWFLGYILLAYPLGYFLGPRIWRAGAKFNAITMADLFKGHYGNRTLELIVAGSSILFLLPWGQLQFTGLVAALKGLGWEFSPVYLVMISAALAFTYIAISGVRASAYIAILKDILMVVAIVATGVAVGMKAGVGDVFHVASVQVSNQMTDTQLRFSMSTMLFQAMGFYVMPFAVQNFFTAKSADTIRRTQIYMPLYMLMYPFLVLASYYAISQNLHLASPNEAFFAAAVRLLPGWLLGLVGAGAALSGLLVLAGICLAIGPIVTRNLLPGMPESKQKRGAKVVIVVYLVLSIGMTLATPNLMLTLINTAYYGVTQFFPGVIVILFGLRVRPLAIGAGILTGQILAMALYLQQADFGGVNIGLIALAVNVLVSAFVHYAPRLTRVQAA

SEQ ID NO: 5050 - protein, 463 aa, Burkholderia 383
MSSVVFTGFILLSFCLALYSRRGVGKQSVHDFFVASRQFGAFLVFFLAAGEIYSVATMVGFAGGIYAKGPTYGIWFLGYILLAYPLGYFLGPKIWEAGQRYNAITLADLFGGYFRSRSTEFVVALSSIVFLLPMAQLQFTGLVAAFRGLGWQFEPLHMVLIAGVLAFLYIMIAGIRSSAYVAVLKDILMVLAIVITGLAVAGHVGVTEVFHAASLHVGNQMNAEQLRFSMSTILLQSLGFLAMPFGVQIFFTAKSADTIRRSQIAMPLYMLMYPFLVIAAYYAISQNLHLRSPNEAFFAAANALLPSWMLGLVAAAAALSGLLVLTSMCLAIGPIVSRNLLPSLPSQRQTGAAKIVIFVYLGVSIAMTSAAPTLMLTLINVTYYGVTQFFPGLIAVLFSLRIRPVAVTAGMLVGQGLALALYLGKVQLGGINLGLPCLAANIATVAAIHYLLGAAKPRTLASQ

SEQ ID NO: 5051 - protein, 464 aa, Burkholderia 383
MSTVVFAALIALSLYLAIRSGRGRGKQSVHDFFVASRQFGTALVFFLTAGEIYSIGTMVGFPGGIYAKGPTYGVWFLGYILLAYPIGYFVGPKIWEAGKRHNAITLPDLFKGHFRSRGLELVVACASILFLIPWGQLQFTGLVAALKGLGWHVEPLYLILVCAALAFTYIAISGVRASAYIAILKDILMLLAIVVTGVAVAWQVGGVHPVFDAASRQVSNTMSGSQLRFSMSTMLFQSLGFYLMPFAAQNFFTARGPNAIRRTQVVMPLYMLMYPFLVIASYYAITANLKLASPNDAFFAAVTHLLPGWLIGLVAAGAALSGLLVLAGICLAIGPIVTRNLMPNLPESRQKRAAKYVIVGYLLLSIATTMLTPNLMLTLINTTYYGVTQFLPGVLILLAGRQVRPVAVGAGMICGQVLAMIFYVFHVDFGGINLGLVCLVVNVLVVAAVHAMLHGRPVKQYAVS

SEQ ID NO: 5052 - protein, 461 aa, Cupriavidus metallidurans CH34 uid250
MSTAVFLGFIVLSLYLALRSRKGTGSQSAHDFFVASRQFGAFLVFFLAAGEIYSVATMVGFAGGIYAKGPTYGIWFLGYILLAYPLGYFLAPKIWEAGQRFNAITLADLFKGHFDNRAVEFVVALSSILFLLPMAQLQFTGLIAAFRGLGWSFQPLHLVLIAAVLAFTYIAISGVRSSAYVAVLKDVLMVVAIVVTGLAVAGEVGVAKVFHVASEHVSNRMNDEQLRFSMSTILFQSLGFYMMPISVQFIYTAKSADTIRRTQVAMPLYMLMYPFLVLASYYALTRSDTLATANEAFFVAATHLLPSWLLGLVAAAAALSGLLVLTGMCLAIGPIVTRNLLPHLPESRQKAGAKGVIVVYLIVSILMTLMAPNLMLTLINTTYYGVTQFLPGMIVILFSLRVRPSAVVLGILTGQLMAVVLYLEKVDLGGINLGLPCLAANVVVMVVLNLLRTPKGLQATA

SEQ ID NO: 5053 - protein, 460 aa, Delftia acidovorans SPH-1
MTTAVFLGFIALSLYLAIRSRTGKGAQSVHDFFVASRQFGAFLVFFLAAGEIYSIGTMVGFPGGIYAKGPTYGVWFLGYILLAYPLGYFLGPMIWKAGLRHNAITLPDLFKGHFGSRALELIVAGSAILFLLPWGQLQFTGLVAALKGLGWNFQPLHLLLISAGLAFTYIAISGVRASAYIAILKDILMVVAIIATGVAVGWHAGVGDVFAAASAKVSNHMTDTQLRFSMSTMLFQALGFYMMPFAVQNFFTAKSSHTIRRTQIAMPLYMLMYPFLVLASYYAISQNLELASPNEAFFAAAVRLLPDWLLGLVAAGAALSGLLVLAGICLAIGPIVARNLLPGLPEAKQKQGAKVVIVIYLLLSIVMTLLTPNLMLTLINTTYYGVTQFFPGMMAILFGWRIRPLAIALGIVCGQALAIVLYLQQPDFGGINLGFISLALNLLVTAIVHCLPRAAHVKTA

SEQ ID NO: 5054 - protein, 464 aa, Burkholderia multivorans ATCC 17616 JGI
MSTVVFAALIALSLYLAYRSRRGHGKQSVHDFFVASGQFGTALLFFLTAGEIYSIGTMVGFPGGIYAKGPTYGVWFLGYILLAYPIGYFIGPKIWEAGRRHHAITLADLFKGHYGSRALELMVALASILFLIPWGQMQFTGLAAALKGLGWHVDPLYLILVCAALAFTYIAMSGVRASAYIAILKDILMLLAIVVTGTAVALKVGSVHPVFEAASRHVSNTMTAPQLRFSMSTMLYQSLGFYIMPFAVQGFFTARGPNTIRRTQVAMPLYMLMYPFLVVASYYAISANLKLASPNDAFFAAVVHLLPGWLIGLVAAGAALSGLLVLAGICLAIGPIVTRNLMPNLPETRQKRAAKYVIVGYLLLSIATTMLTPNLMLTLISTTFYGIAQFLPGVLILLAGRRVRPVAVASGMLCGQALAMLFYLLHVDFGGINLGLVCLVINMLVVAAVHATLRGRPVKHYAVS

SEQ ID NO: 5055 - protein, 461 aa, Burkholderia phytofirmans PsJN
MATAVFLGFLAFSLYLAIRSNKGRGPQSVHDFFVASRQFGAYLVFFLAAGEIYSIGTMVGFPGGIYAKGPTYGVWFLGYILLAYPVGYFIGPKIWQAGKRYNAITLPDLFKGHFQSRALELIVAGSAIVFLLPWGQLQFTGLVAALNGLGWNFKPLYLILFAALLAFTYIAIAGVRASAYIAVLKDILMVVAIVVTGVAVSMEVGVTEVFHAASQHVSNRMNSHQLTFSMSTMLFQSLGFYVMPFAVQNFFTAKSANTIRRTQVAMPLYMLMYPFLVVASYYAISQNLHLASPNEAFFAAAIRLLPGWLLGLVAAGASLSGLLVLAGICLAIGPIVTRNLLPGMPEARQKTSAKVVIVLYLLVSIVMTLLTPNLMLTLINTTYYGVTQFFPGVMVVLFGLRVRPSAIASGMLTGQLLAVILYVMQIDLGGFNLGLVCLGVNLLVLTAVNLTAKPSRAHALS

SEQ ID NO: 5056 - protein, 460 aa, Gluconacetobacter diazotrophicus PAl 5 JGI
MSSVTFCLVILLSLGIALYSRRGHHHQGTRDFFVASGQFGGALLFFLAVGETYSIGTVLGFPAGTVSHGTAFVLWFLSYIVLAFPVGYFLNPRIWQAGQACNALTLADLFRHHVGSRAVEIAMALNAILFLLPFGDMQFVGLLTVLQGFGWQVPSILLTTLAAVMAFFWVALSGIRAPAYVSILKDVLMIVAVVAVGGAALLAMGHLPDPHQAGRAVGQDIADIRPTGRDEAFAMSTVILQSIGFCVAPQTVAFLFTGRSRRIVRRNQVLMPLYMLMFPFLYLVAEYARRSGMALPTPNDAFMTVSLALLPGWMDGLVAAACTLSALVVLAGMCLAIGSLVSHNLLHGLSDRQQRYGAQVVIALYLLFSVVSAAHASGVLVKLNTMYYFGVTQAAPGLFAILLARPVRPAALVAGLLAGDGLSVGLYLGGVDLGGINPGLVGLVANAAILWAGSYMPRRR

SEQ ID NO: 5057 - protein, 83 aa, Rhodoferax ferrireducens T118
MVVIRLARGGAKARPFFNIVVADKRTRRDGRFIERLGFYNPIATANEESIRIAQDRLTYWRSVGAQASPTVERLISQAAKKAA

SEQ ID NO: 5058 - protein, 83 aa, Polaromonas JS666
MVVIRLARGGSKHRPFFNIVVADKRVRRDGRFIERIGFYNPIAKGGEEGLRIAQDRLTHWLGVGAQPSPTVERLVKQGAAKAA

SEQ ID NO: 5059 - protein, 85 aa, Acidovorax avenae citrulli AAC00-1
MVVIRLSRGGSKGRPFFNIVVADKRVRRDGRFIERLGFYNPTAKEGEEGLRIAQDRLTYWKSVGAQVSDTVERLIKQAAKKAVAA

SEQ ID NO: 5060 - protein, 83 aa, Acidovorax sp. JS42
MVVIRLSRGGSKGRPFFNIVVADKRVRRDGRFIERLGFYNPSAKEGEEGLRIAQDRLTYWKGVGAQPSPTVDRLIKQAAQKAA

SEQ ID NO: 5061 - protein, 91 aa, Polaromonas naphthalenivorans CJ2
MVVIRLSRGGSKHRPFFNIVVADKRVRRDGRFIERIGFYNPIAKGGEEGLRIVQDRLTHWIGVGAQASPTVLRLIKQGGATVVAPAAVAAA

SEQ ID NO: 5062 - protein, 83 aa, Verminephrobacter eiseniae EF01-2
MVVIRLSRGGAKGRPFFNIVVADKRVRRDGRFIERLGFYNPTAKENEEGLRIMQDRLTYWKSVGAQSSPTVERLVKQAAKQMA

SEQ ID NO: 5063 - protein, 86 aa, Methylibium petroleiphilum PM1
MVVIRLARGGSKKRPFYNIVAAPARIRRDGRFLERVGFYNPVAAGGEEPLRVAFDRIDHWVSHGAQLSPTVARLVKDAKAKVAPAA

SEQ ID NO: 5064 - protein, 84 aa, Delftia acidovorans SPH-1
MVVIRLSRGGSKARPFYNIVAADKRVRRDGSFIERLGFYNPNARGGEEGLRVALDRVNYWKGVGAQASETAERLIKQATQKTAA

SEQ ID NO: 5065 - protein, 86 aa, Leptothrix cholodnii SP 6
MVVIRLSRGGSKRRPFYNIVAANSANRRDGRFLERVGFYNPVASGGEEALRIAFDRVEHWVSHGAQLSPTAARLVKQAQAKVAPAA

SEQ ID NO: 5066 - protein, 83 aa, Diaphorobacter TPSY uid29975; identical to SEQ ID NO: 5060

SEQ ID NO: 5067 - protein, 87 aa, Variovorax paradoxus S110
MVVIRLSRGGSKGRPFFNIVVSDKRVRRDGRFIERLGFYNPTAKENEESIRIAQDRLAYWKSVGAQASPTVLRLIKQAAAAAPKAAA

SEQ ID NO: 5068 - protein, 168 aa, Dehalococcoides ethenogenes 195
MSQQLPEPAEDLALFQLRLRSEAEASGYHLNPDNAFVKMLAEGLLANRQRYGYQSCPCRLAEGNRKADLDIICPCDYRDADINEFGSCYCALYVDSQIAKGEKKPQPVPERRHAPKTLPKAKTAQAPASLAYPVWRCRVCGYLCGRDEAPDQCPICKADKERFELFMQ

SEQ ID NO: 5069 - protein, 167 aa, Methanosarcina barkeri fusaro
MDKVYKRLNNQVEKSGYHLNPDIEFTKDLVRGLLANEQRYGYWSCPCRLSANNLEEDLDIVCPCYYRDPDLNDYGACYCALYVSDEVIRGERSVESIPERRPPKEQRDAERAEEKKRAEVIESMEFTGKLSKPVWRCKVCGYLCAMDEPPGICPICKAKKERFERFM

SEQ ID NO: 5070 - protein, 114 aa, Desulfovibrio desulfuricans G20
MSKTMTPETLYEMLKKFQEPKGFYFNADMGMTMPLLESLLQTKERYGYMACPCRLALGEYEADRDIICPCVYREPDMEEYGACFCGLYVTKEWNEGTIEHKVVPERRPPEKLLG

SEQ ID NO: 5071 - protein, 167 aa, Methanospirillum hungatei JF-1
MTPDVSENLLDKRHNELIQEAKKSGYNLNPDTVFTRGLVEGLLINANRYGYESCPCRLSLGDKESDLDIICPCDYRDDDLSEYGACFCGLYVSDTIASENLPAPVVPERRPLASERMKKSSSSVPAGGLPFPVYRCKVCGYLCARNNPPEKCPICKAEKERFEIFLR

SEQ ID NO: 5072 - protein, 163 aa, Methanosaeta thermophila PT
MVSDEDVERLYQRLKDDAESAGYHLNSDRQFVMGVVRGLLTNEERFGYMACPCRLPSGKREEDLDIICPCDYRDQDLAEFGACYCALYVSERVARGEEGLRPVPERRGSRSSRPASETAEPHIEGLSKPVWRCRVCGYLCARDEPPEICPICKASRERFERFM

SEQ ID NO: 5073 - protein, 111 aa, Syntrophobacter fumaroxidans MPOB
MMDKEQLYEMLERAQEAKGYYFNKDRKKVLELLESLLINRERYGYMACPCRLASEDRERDRDIICPCVYREPDVAEFGSCYCNLYVSREWNEGKIPETYVPERRPVEKMLF

SEQ ID NO: 5074 - protein, 114 aa, Desulfovibrio vulgaris DP4
MSAPATAEQLFETLRKLQEPKGYHFNADMDMTMSLLENLIATRDRYGYMACPCRLANGTFAQDRDIVCPCVYREEDVREYGACFCGLYVSREWNEGKVPHVFVPERRPPEKIFG

SEQ ID NO: 5075 - protein, 157 aa, Methanoculleus marisnigri JR1
MRDLEVEVEAGGYHLNPDREFTRDLVRGLLANRERYGYISCPCRLASGDRDDDLDIICPCDYRDPDLADYGACYCALYVTADVERGKRAAAPVPERRPGPAERKRQREERALVGRAPGTLNYPVWRCRVCGYLCARNEPPETCPICRVSRDRFERFM

SEQ ID NO: 5076 - protein, 167 aa, Dehalococcoides BAV1
MSSKLPEPSEGPVLFQARLKNEAEASGYHLNPDGSFVKMLAEGLLANRQRYGYPSCPCRLAKGDKKADLDIICPCDYRDADLSEFGSCYCALYVNSHIAKGEKKAQAVPERRHLPETRPETKPAEAPSGLAYPVWRCRVCGYLCGRDEAPDECPICKADKERFERFM

SEQ ID NO: 5077 - protein, 171 aa, Candidatus Methanoregula boonei 6A8
MNVPEILENSVEPAYLALKTDAEKNGYRLNPDTEFTKNLVRGLLKNEQRYGYRSCPCRLASGKKDEDLDIVCPCDYRDADLEEYGACYCALYVNEAIAQGKKQVAPVPERRPPRSQRGKAASVKIASTTAMPIFPLPVWRCKVCGYLCAREQPPGVCPICKATKERFERFV

SEQ ID NO: 5078 - protein, 110 aa, Candidatus Desulfococcus oleovorans Hxd3
MTPEKLYEQLQSVQEPKGYFFNNDRELVFDLLSALLTNKERYGYMCCPCRLASGDRENDRDILCPCGYREADVAEYGSCYCALYVSKEWNDGAVDRVYVPERRPAEKFAF

SEQ ID NO: 5079 - protein, 114 aa, Desulfovibrio vulgaris  Miyazaki F
MSGPATPQALHDMLRKIQEPKGYFFNKDMDMTMPLLESLLVNKQRYGYMACPCRLALGEFEKDRDIVCPCVYREDDVKEFGACFCGLYVSQAWNDDEIAHDIVPERRPPEKLFG

SEQ ID NO: 5080 - protein, 116 aa, Desulfomicrobium baculatum DSM 4028
MTPEELYEKLRPLQEAKGYFFNKDKAFVLDLMESLLINRERYGYMACPCRLASGNRDLDKDIFCPCVYRDPDVAEFGACYCGLYVSKEWNDGSIPQETVPERRDPEKLMAGLLFEE

SEQ ID NO: 5081 - protein, 172 aa, Candidatus Methanosphaerula palustris E1 9c
MTAERTPVADEDAVALFERLNREAGQAGYHMNPDMEFVLGLMRGLLTNKERYGYMACPCRLASGVREKDLDIICPCDYRDPDLAEFGGCYCALYVSNAVLQGRQHLESIPERRPPADEREVKEVGQHAPPLGEVLPFPVYRCPVCGYLCAMNTPPLVCPICKADRDRFVRFF

SEQ ID NO: 5082 - protein, 119 aa, Desulfohalobium retbaense DSM 5692
MNVEELYTKLRALQEPKGYYFNNDTDMVMDLLQSLLINKERYGYMACPCRLASGNKELDKDILCPCVYREPDVADYGSCYCGLYVSKEWNDGRIPHDFVPERRPPEKVLQALQHASSDE

SEQ ID NO: 5083 - protein, 360 aa, Methanosarcina barkeri fusaro
MRLLEKLWGQKPSRKSDKKKNGTSNYPYAVTRVRAMKSKLLPKESYPRLLNMGIDGITRFIQESEYKNDVNELAMKYSGGDLAEHALNRNLALTYDKLVRITGGELNYLVVAYLKRYDIWNIKTLLRGKIYNASAEDIMESLIAAGEFTYTSMSELAAKATYKEIIEALKYSEYYPLLQKFDGTNLAYIENELDKMYYTGLFGAIGKPRSKDRKLFLKVVRLEVDVKNLINLFRLKKAGVMQLDEIMPLMIEGGLELKPEKLATLPYDEFVNELQRTQYWDVISGVTSSDMTSLTTLESRLTRYYLESSTVLSHVSPISVAPILDYIIHKHNEATNLRIIFRGKETGLSDELIKDQLVVI

SEQ ID NO: 5084 - protein, 351 aa, Methanospirillum hungatei JF-1
MVQNSGGPAPYIYVSTRLRVRKAKLLPPEEYQRMLNMSLPEIIRLIGETEYQKEVDELGTSFEGIDLIEVALSWNLAKEYQRVIELAPGSLKEFTMAYLRRWDIYNILTILRGKIQGMKEGKIKEVLIPAGSLDRTILDRVLAEENCERVADALKSWKMYPTLSAELSEGCAVGSFARLENELYKRLYADLLQIARRGVKGGNQFLKFVQLEIDVKNIKTLFRMRGDGYEEDAREFFIPGATFTPEELQQMNQMTSRNEVIDALLARIKAKAIQVALEDLRTEKSEQEVDAELTKTQLDHMEQLSKINPFSIHPILVYLEKKKYEVFNLRAIARGKESRLAGDTIAKYLVI

SEQ ID NO: 5085 - protein, 357 aa, Methanococcoides burtonii DSM 6242
MRLLQKFTRKSSLKQSGSSSNYAYVTARVRAMKSNLLPREVYPRLMNMGIDEITRFIEESQYKQDVDELARTYDGVDLFEHALNRNLAVTFTKLINISEGELNYLISEYLRKYDIWSIKTILRGKYCGASVEEINDSIVSAGQLSYPFLLSLSEKESYESIIDALSGTDYYPTLKEYDGTNLSDIENKLDKMYYTGLSTTVNNPKSNDSKLFSKFIRTEIDIKNLSTLFRLKNAGVEKDEIADLILEGGLHLSIKEIEKLLPLPFSEFVQSLEKYPYWEDISGIVKTEMDSLIELETQLTRSNIKSASSFSHVYPLSIVPIMDYILNKTNEVHNLRIILRGKAANLDEEIIRNQLVI

SEQ ID NO: 5086 - protein, 349 aa, Methanosaeta thermophila PT
MPVLRLPKFGKPVKYAYITGRVRAMKTKLIPNEMYARMLNMDIPEIARYLEETQYKEEIDALAKDYSGAELIEHATFANLAKTYRKLLEVSIDEPQFLILEYLRRWDIWNIKTILRGKFYGASDSEIMKYIVPAGELDQEFLEGLAKKDSINDVITAFEGTDFAEALSKYDGKSLASVENALDKLYYFRMERAVGGTLSVGGGLLLKYVKREIDIRNLITLFRMNKAGIEASIVQENLIPGGKLSEELSRMAGQPYADFVRGLEGYPFWSAISDVATADLDSVSRIEARLKAYLIRYAWSLSNYHPLSILPVLGYIVTKETEVANIRKIVRGKEAGLPNELIEEQMVVA

SEQ ID NO: 5087 - protein, 352 aa, Methanocorpusculum labreanum Z
MTEVMSGTAPYIYVSTRMRVRKAKLIPREEYLRMLNMGLTEFTRLIEEMEYKREIDELSASFKGVDLIENAMSWNLAKEYQRVIALAPGEMKGFTRDYLHKWDIQNILSILRGKELGFSDGKIRAVLVPAGALDASTLDRLVAESSVERIVEQLPVKQMSAILSEGLSEAIETHSFGKIENELYKYYYATLIKAARGGMKGGRPFLKYVMFEIDIKNITSVFRMRAQGGDNAAQQNIWIPGGSFKPEELERLSSVESTDEVVDSLKKKIKVTVLLDALESLREKKPIYSIESTLIAAQLNQMDKVSKRNPFSISPLLVYLERKKYEVSNLRAIARGKEAGLDAETLEKYLVM

SEQ ID NO: 5088 - protein, 351 aa, Methanoculleus marisnigri JR1
MAGVSSGSAQYIYACTRMRVRKSLLIPREDYLRMLNMSLPEITRFIGETIYRSEIDELGTSFSGINLVEVALSWNLAKEYQSILELVPGDLKHFTASYLRRWDIQNVVTVLRGKMQKMQPGKIKEVLVPAGRLDRVALDRLVAEESPERVAESLKGERFYPVIERELPRATETGSFAHLENELYKGYYARLIADAKGGVKGGDIFLKYIRLEIDIRNIQNLFRLRAGHVREDVRELMIPGGSFTVDELQRLSGLESQDEFIDALKRQVKMIPLLNALEEIRGKTALHEIEVALTRVQLDQMERMSKRYAFSILPILVYLEKKKYEVANLRALARGKEAGLPGERLQGYLVM

SEQ ID NO: 5089 - protein, 391 aa, Methanococcus maripaludis C7
MVDALTQLMESAGMPTDVFMTLFVLAGIAIFLVIMIFLIRYLSETAPFAYVNARVRSMESRLLKDHKINELIESAGTTELIGFLEDTDYGPYLSEVMGQSEDPVVVEKALDIHLAHVYQTLANISPDGARKILKLLEKKFDVKNIKTLLRAKYVGLDAEETFKLLIPLGTIPESKLRELSETKAIEEIVSALEGTGYSSVLSEGLTQYEQNGKLTTLEMSLDKLILENLWKNVSVDGTEKDLFKEFIGTMIDIENLKIILKGKADGLSSEAISNYTTSKGYELASWKLKELADVESIEGVISSLEGTKYAPMMAENLEEFEKTKSVYVFEKALDSYLVKMGKKLSLRQPFGIGPIIGLITSKELEIRNLKIIIKGKIEGLSASEIREILVS

SEQ ID NO: 5090 - protein, 347 aa, Candidatus Methanoregula boonei 6A8
MKGISAPTIYVCTRMRVRKAKLLPREEYQRMLNMSLPEIIRIIEETSYKQEIDELGTTFKGIDHLEIALSWNLAKEYQRIQKITPGTLKQFTRAYLRYWDIQNVLTILRGKLHGEKTGRIREVLVPAGNLDKIVLDRLLAEDGPDRVVDALKGQRIYLVLAREYPAAKESGSFAKMENELYKQFYAELIAECGGDAGGRMFLAYIRLDIDIKNVLTLFRLRADKGGEDAKELYIPGGTITAADFSALATAQDYREFTDQLRAKVRTGPVVELLKSIETERPVHEIAALLVHVQMEQMEKLSRRNPFSIYPILVYLEKKKYEVFNLRALARGKQSNLPAETISKYLVI

SEQ ID NO: 5091 - protein, 348 aa, Halorubrum lacusprofundi ATCC 49239
MSAVGSSNPEYVVARVRARRGSLYGDEEYRKLTRMGPAEIARFMEESSYGTEINALGSLHGGVDLIEYALNRNLAGQFDDILDWSEGSLYGLIARYLRKFDAWNVKTVIRGVYTDADQSEIEVDLIRAGEFDDRRIRRLLEADSIDAVVEVLEDTIYGDPLREAYAEYEETGVLVPLENAVDRAFYERLLSGLGNDEPTRQYEAFLKAEVDFRNAANALRLARSGADIDPAAYFIEGGELFTRGSLARLARNLDELVEYIADSQYGDELGPALRELEEANSLIAFEHATDAALLAYGDQLGTIHPVSVTPVISYILAKEREVENIRAIARGKEAGLSADEIESELVIT

SEQ ID NO: 5092 - protein, 357 aa, Halorhabdus utahensis DSM 12940
MSPMRNPSGAKSNYEYVVARVRSRRASLFDEDDYRKLVRMGTGEIARFMEESEYEREMNALGSRHSGVDLIEYALTRNMAKHFEDLLSWSEGQLYDYVARYLRKFDAWNVKTALRGIYSEADAEAIEADFIRAGELTEEDLDQLATAESIEGVIERLEGTIFQEPLEDAFEEFEGTGLLVPLENAVDRTFYEALLAGLPDTAETGSAIGYYLEFLRAEIDFRNLRNALRLVRTGADMDPAEYYIEGGQLFDAAEVRQLVENEEQLLDHIRESQYGSELSSALDALDSAEELIGFEHAIDAALLEYADRLSYRYPVSITAVLSYVLAKEREIDNIRAIARGTESGLSPEEIQRELVML

SEQ ID NO: 5093 - protein, 351 aa, Candidatus Methanosphaerula palustris E1 9c
MTEVTSGPAPYIYTSTRLRVRKAKLLPKEDYLRMQNMSLPEIARFIGESEYKPEIDELGGVFHGIDLIEIALSWNLAKENQSVLGITQGSLMQFTANYLRSWDIGNVLIILRGKQQGFSVNKIKEVVIPAGELDKIFLDRLLAEESPDRIVELLKGWRLYPVLEQEYGRVIESGSFARLENELYKKYYVDLIAVARGGIKGGREFLQYLQLEIDTRNFQSLFRLRAGGMPEDVRELMIPGGDFSLDELARLGAVDSNDELIDALKKRTHLQSLIDALETFREGLPIHEIENVLTRIKLEQMDRMSKRYPFSVAPILVYLEKKKYEVFNLRALARGKESNLSGERIMEYLVI

SEQ ID NO: 5094 - protein, 358 aa, Halomicrobium mukohataei DSM 12286
MTVRFEEQNWESANYEYVITRVRSRRAKLFDDDDYRKLVRMGPSEISRFMEETEYETEMNALGARYSGVDLVEYALNRNLAKHFEDLLRWSDGRLYDYVARYLRKFDVWNVKTIVRGIYSEADAKEVEDDLIRAGELSEQLLDQLVAAGSIEEVVELLDGTIFGDDLAEAYQDYEDSGVLVPLENALDRAFYDVLLSGLPTQPEVDSPTGLYVSFLTAEIDFRNLRNALRLARSGAEIDPAEYHIEGGRLFDADEIGALATSTDQLVQRVRESTYGDDLDAALDTLEAADSLIEFEYALDAALLEYSDQLSNRYPLSVCPVLSYILAKEREVDNIRAIARGREAGLDSDEIEQELVIL

SEQ ID NO: 5095 - protein, 103 aa, Jannaschia CCS1
MRIFGLKACDTCRKAAKALDAELVDIRATPLDPDQIEAFHTEFGAALINTRSTTWRELDEAARAMDPVALIQAHPAVMKRPVIERDGALTLGWSKDVQARYGV

SEQ ID NO: 5096 - protein, 105 aa, Ruegeria sp. TM1040
MKLYGLKTCDTCRKALKSLPDADFKDVRTEGVPADIMAQAYAQFPDKLLNTRSTTWRGLSEEDRAKPPLELLAEHPSLMKRPLIEAEGQLHLGWTKDVQAALGVT

SEQ ID NO: 5097 - protein, 108 aa, Rhodobacter sphaeroides 2 4 1
MILYGISTCDTCKKALKALEAAGHSVEFRDVRAAPLSESEISELVTEFGDAIVNRQSTTWRGLSDWLKASEPEAQLAAQPTLMKRPVIRTEEGLFLGWDAGVQRRLLG

SEQ ID NO: 5098 - protein, 108 aa, Rhodobacter sphaeroides ATCC 17029; identical to SEQ ID NO: 5097

SEQ ID NO: 5099 - protein, 108 aa, Rhodobacter sphaeroides ATCC 17025
MILYGISTCDTCKKALKALEAAGHSIEFRDVRARPLSESEISELVTEFGDAIVNRQSTTWRGLSDWLKASEPEAQIAAQPTLMKRPVIRTEEGLFLGWDSGVQRRLLG

SEQ ID NO: 5100 - protein, 103 aa, Dinoroseobacter shibae DFL 12
MRVYGIKTCDTCRKAVGALGAELRDIRAERLTAAEIDRFLAAFGDALVNTRSTTWRGLDEAARAQAPEALLAAHPTLMKRPVIETPDGTLHLGWGADVKARLL

SEQ ID NO: 5101 - protein, 127 aa, Dickeya zeae Ech1591
MAITLYGIKNCDTIKKARRWLEDHHIDYRFHDYRVDGLTAERLQSFIDNIGWQPLLNTRGTTWRKLEDAYRNTINSEAAAKAVMLEHPALIKRPLLVSDDGKTLLAFSDDSYRHFFTENTSHVLPGN

SEQ ID NO: 5102 - protein, 259 aa, Rhodopseudomonas palustris HaA2
MTVHFIGAGPGAPDLITVRGRDLVMRCPVCLYAGSLVPRELITLCPPGARVVDTAPLDLDAITREFVAATEAGHDVARLHSGDLSVWSAMGEQIRRLEAHGIPYTVTPGVPSFAAAAAALGRELTLPEVAQTVVLTRTSGRASAMPPRENLDAYAATGATLAIHLSIHVINSVVEKLRPHYGDDCAVAVVVRASWPEEQIIRGTLTTIAAQVAEAGIDRTALILIGPSLAASDFRNSALYSTDYDRRYRRSAEDDRARD

SEQ ID NO: 5103 - protein, 261 aa, Novosphingobium aromaticivorans DSM 12444
MTVHFIGAGPGAPDLLTLRGRDLIAGSPVCLYAGSLIPVAVLDHCPPGARIVNTAPLELDQIMAEIAAAHAAGHDVARLHSGDLSVWSAMGEQLRRLRALDIPFTITPGVPAFAAAAAALEAELTLPALAQSLVLTRTPGRASTMPPAESLANFAVTGATLAIHLSVHNLAQVVADLTPAYGADCPVAVVWRASWPDQRIVRATLDTIEQAIAGSMERTALILVGRVLAAQDFAESSLYAPGYDRRFRPQDATSRFGGAAE

SEQ ID NO: 5104 - protein, 264 aa, Jannaschia CCS1
MTVHFIGAGPGAPDLLTLRGRDLIAACPVCLYAGSLVPEAILDHCPEGAQVINTAPMALDDIIGSIAVAHDAGKDVARLHSGDLSVWSAMGEQIRRLDALGIPYTVTPGVPSFAAAAASLGQELTLPGVGQSLVLTRTPGRASSMPEGESLENFGKTGATLALHLSIGNLSQVVADLVPHYGAACPVAVIYRASWPDEKIVRARLGTLEEAMDPGIARTALILVGPAIGASDFTESRLYAADYDRRYRPQTAESPWSEWQHGDD

SEQ ID NO: 5105 - protein, 259 aa, Rhodopseudomonas palustris BisB18
MTVHFIGAGPGAPDLITVRGQNLVARCKVCLFAGSLVPREIVALCPPGARVIDTAPLDLDAIVAEFVAAHDAGLDVARLHSGDLSIWSAMGEQIRRLEALGIPYTVTPGVPAFAAAAAVLGRELTLPGVAQTVVLTRTSGRASAMPSRENLAAYAATGATLAIHLSIHVLDEVVATLRPHYGADGAIAVVVRATWPEQIVLRGTLSSIADKVRSAAIERTALILVGPALATTDFAESALYSTDYDRRFRPNSQTGLIRE

SEQ ID NO: 5106 - protein, 259 aa, Rhodopseudomonas palustris BisB5
MTVHFIGAGPGAPDLITVRGRDLVVRCPVCLYAGSLVPREIVALCPPDARVIDTAPLDLDAITAEFIAAAAAGHDVARLHSGDLSVWSAMGEQIRRLEQHGIAYTVTPGVPSFAAAAALLGRELTLPEVAQTVVLTRTSGRASAMPPRETLEAYAATGATLAIHLSIHVIDDVVERLRPHYGDDGAVAVVVRASWPEQQVIRGTLNTIAAQVAATGIDRTALILVGPALAASDFRDSALYDRGYDRRYRRSAEDGRDHD

SEQ ID NO: 5107 - protein, 264 aa, Ruegeria sp. TM1040
MTVHFIGAGPGAADLITLRGRDLIAACPVCLYAGSLVPEALLSHCPEGAKIINTAPLSLDEIMAEIASAHAQGHDIARLHSGDLSVWSAMGEQLRRLRDLDIPYDITPGVPAFAAGAAALGTELTLPGVAQSLVLTRTSGRASAMPEGETLENFAATGATLAIHLSVHVLDDVVARLTPAYGADCPVAIVWRASWPDQKIVKATLGTVIEATDGARGRTSLILVGRALGAEDFAESCLYGAEYDRRYRPQSADSPWSEWSEGDD

SEQ ID NO: 5108 - protein, 260 aa, Rhodobacter sphaeroides 2 4 1
MTVHFIGAGPGAPDLITLRGRDLIAASPVCLYAGSLVPEGVLAHCPPGCRIVNTAPLSLEAIVEEIAAAHAEGKDVARLHSGDLSVWSAMGEQLRRLRALGIPYDVTPGVPSFAAAAATLGAELTLPGVAQSVVLTRTSGRASPMPEGESLAAFAATGAVLAIHLSVHVLGRVLAELLPHYGADCPVAVVWRASWPDERVVRATLGSLEAALGPELERTALILVGRSLGAEDFAESRLYAGDYDRRYRPVGTHPRFPEEA

SEQ ID NO: 5109 - protein, 257 aa, Paracoccus denitrificans PD1222
MTVHFIGAGPGAADLITLRGRDLIASCPVCLYAGSLVPQALLGHCPPGARIVNTAPMDLDQIVAEIAAAHQAGHDVARLHSGDLSVWSAMGEQLRRLRELGIPYDVTPGVPSFAAAAAALGAELTLPGVAQSVVLTRTSGRASAMPEGETLANFAATGATLAIHLSVHVLDRVQAELVPHYGADCPVAVVFRASWPDQRIHRATLGTLDPAIGEGERTALILVGRALAAEGFDESRLYAGDYDRRFRPVGTAPRFPE

SEQ ID NO: 5110 - protein, 260 aa, Rhodobacter sphaeroides ATCC 17029
MTVHFIGAGPGAPDLITLRGRDLIAASPVCLYAGSLVPEGVLAHCPPGCRIVNTAPLSLEAIVEEIAAAHAEGKDVARLHSGDLSVWSAMGEQLRRLRALGIPYDVTPGVPSFAAAAATLGAELTLPGVAQSVVLTRTSGRASPMPEGESLAAFAATGAVLAIHLSVHVLGRVLAELLPHYGADCPVAVIWRASWPDERVVRATLGSLEAALGPELERTALILVGRSLGAEEFAESRLYAGDYDRRYRPVGTHPRFPEEA

SEQ ID NO: 5111 - protein, 260 aa, Rhodobacter sphaeroides ATCC 17025
MTVHFIGAGPGAPDLITLRGRDLIAASLVCLYAGSLVPEGVLAHCPPGCRIVNTAPLSLDAIIDEIAAAHAEGKDVARLHSGDLSVWSAMGEQLRRLRALGIPYDVTPGVPSFAAAAATLGAELTLPGVAQSVVLTRTSGRASPMPEGESLAAFAATGAVLAIHLSVHVLDRVMADLLPHYGADCPVAVVWRASWPDERVVRATLGTLQAALGAELDRTALILVGRSLGAEDFAESRLYAGDYDRRYRPVGTHPRFPEQA

SEQ ID NO: 5112 - protein, 292 aa, Delftia acidovorans SPH-1
MTVHFIGAGPGAADLITVRGRDLMAACPVCLYAGSLIPRELLAHCPPGARIVNTASMSLDDIVAEIQAAEARGEDVARLHSGDLSVWSAMGEQLRRLREAGIAYTVTPGVPSFAAAAATLGAELTLPGLCQSVVLTRTSGRATAMPEGENLAAFAATGAVLAIHLSIHVAAKVQSELLPHYGADCPVAIVWRASWPDETVVRTTVGGLTEAVATHMERTALILVGRSLQAEDFGESRLYAADYDRRYRPLGTEPRFPATDVHANAALDTARDTLRDTVSDTVIDVPPGSPAP

SEQ ID NO: 5113 - protein, 259 aa, Rhodopseudomonas palustris TIE 1
MTVHFIGAGPGAPDLITVRGRDLVMRCPVCLYAGSLVPREIVALCPKDARVVDTAPLDLDAITAEFVAAAEAGHDVARLHSGDLSVWSAMGEQIRRLEQHGISYTVTPGVPSFAAAAAVLGRELTLPEVAQTVVLTRTSGRASAMPPRETLEAFAATGATLAIHLSIHVIADVVERLRPHYGDDGAVAVVVRASWPEQQVIRGTLSSIAAQVAAEGIDRTALILVGPSLAATDFRESSLYAPDYDRRYRRSAEDGRDRD

SEQ ID NO: 5114 - protein, 260 aa, Methylobacterium chloromethanicum CM4
MTVHFIGAGPGAADLITVRGRDLIAACPVCLYAGSLVAPEILRWCPQGARIVDSAPLDLDAIVAECARAHAAGQDVARLHSGDLSIWSALAEQTRRLDAAGIPFTVTPGVPAFAAAAALLRRELTVPGLAQSVVLTRTSGRASAMPERETLAAFAATGATLALHLSIHVAEQVVTELTPFYGPDCPAAVVFRATWPDERVITGRLATLAQAVAEAGLERTALILVGPALAARDFRESALYASDYDRRFRSVGAAPIRTAP

SEQ ID NO: 5115 - protein, 285 aa, Rhodospirillum rubrum ATCC 11170
MTASADPRSLLAPLGQAIAEGRLIPFLGPDLLETGEAECPVPTSTRGLVERLTARVGVPGRIRGNLWASAQYIETYRHRTTLVKLMTEIFKQTPPVGPLQRWLAGLPGLPLIVDSWYDATLSEAFKDRNDWGQVQAASRHGLAEVVFLRAISAAGVEVPLDAAAAWKTLIYKPHGAIWPLADMLVSDSDYVEALTEIDIQTPIPVAVQEIRATRGFLFLGCRFHDQMLRIYARQILKRSAGPHYALLPEDLTRNELRFLDELSITPLFLDLETAIPLLTGGDGGG

SEQ ID NO: 5116 - protein, 276 aa, Rhodobacter sphaeroides 2 4 1
MTREMLRVALEAVGQGRVVPYLGPGVAALGGALAAPAALSARIEAEVRVPRRAQGNLWAAAQFVETRRFRATLEAMVVKAFAAPTGPNPIHDWLAAVRPPMVVDAWYDAGLVRRFRQGAPDWGLVQGVSRNGEWAEIWHRAYDAADALCSAADPGWRSLLYKPHGMAVPGHSFLVSDSDYVEVLTEIDIQSPIPEEVQNRRTGRGFLFLGCRFDDQLLRTYARQIAKRSARGHVAVIEGPLTRMERLFLEELAIERIDLPLEAVVEELKASGAHAA

SEQ ID NO: 5117 - protein, 276 aa, Rhodobacter sphaeroides ATCC 17029
MTREMLRVALEAVGQGRVVPYLGPGVAALGGALASPAALSARIEAEVRVPRSAQGNLWAAAQFVETRRFRATLEAIVVKAFAVPTGPNPVHDWLAAVRPPMVVDAWYDAGLVRRFRQGAPDWGLVQGVSRNGEWAEIWHRAYDAADALCPAADPGWRSLLYKPHGMAVPGHSFLVSDSDYVEVLTEIDIQSPIPEEVQNRRTGRGFLFLGCRFDDQLLRTYARQIAKRSARGHVAVIEGPLTRMERLFLEELAIERIDLPLEAVVEELKASGAHAA

SEQ ID NO: 5118 - protein, 277 aa, Rhodobacter sphaeroides ATCC 17025
MTREMLRVALEAVGQGRVVPYLGAGVAALGGALASPAALSARIEAEVRVPKRAQGNLWAAAQFVETRRFRATLEKMVVAAFAPPPGTNPIHDWLALVRPPMVIDAWYDPGLVRRFREGPADWGLVHGVSRNGEWAEIWHRTYGPDDSPLPQGADPGWRTLLYKPHGVAVPGHSFLVSDSDYVEVLTEIDIQSPIPEEVRSRRTGRGFLFLGCRFDDQLLRTYARQIAKRSGQGHVAVIEGPLTRMERLFLEELAIERIDVPLEAVIEELKTLGAPAA

SEQ ID NO: 5119 - protein, 288 aa, Bradyrhizobium BTAi1
MNAPLPHIDIVKQADAEALLKDVVARLKAGQVVPFLGPAVSEQSGAPVPMNPEALAAFFGTKVALPRRAKGNAWASAQHIESTRHRSTVTALMAEAFAAPVAPTPLQQYLASLPLPMIVDSWYDGALRTALAGRGDWGEVQGITRAGIGEDRWYRFYDAEGAEADREKASGWTTLLYKPHGGITPAKNFLITDADYVEVLTDIDIQTPIPDTVKDRRTDRGFLFIGCRFNDQLLRTYGRQVIKRSGTEHYVLVEPDSLSKNELKFFIAERLTPIAIPLARATEIIIGG

SEQ ID NO: 5120 - protein, 290 aa, Xanthobacter autotrophicus Py2
MNISVANIETLKLADAEAVLKDVAAELVAGKAAPYLGPGLLELSSPAIPVTPEGLAAFFGTKVALPKRAKGNAWASAQHIESMKHRSTVSALMAEAFAPPVPPLPFHTFLAGLNLPLIVDTWYDGAMRSALEGREGWGEAQGITRAGIGEDRWYRFYDAAGNETDRAAAETWTTVLYKPHGSVAPAKNWLISDADYVEVLTEIDIQTPIPDVVKNRRTERSFLFLGCRFHDQMLRTYARQVTKRSRLPHFAIVDEAVLTKNELRFLLTHAITPIAMPLPKALDIIMSVAA

SEQ ID NO: 5121 - protein, 297 aa, Methylobacterium sp. 4-46
MDPSIQAPPPLAAPRSLAAPDGLAPLREAAALLADDRLVPYLGPGLQAAAGAGGTVPLSPEALAAALGQRQAAPGRIRTNLWAVAQFIEQRRHRRTLAAWMAEIFAPPLAPTPFQTALAGRGLGLIVDTWYDGALRAAFAASGRTDWGEIQGITRAGAHRDVWTRGFDAAGTPVDEAASRGWVTLLYKPHGAARPPGQALVADSDYVEVMTEIDIQTPIPVEVRARRVSRGFLFLGCRFHDQMLRTYARQIMKRSAGPHFAVMTGADLTRNERRFLDDAGITLLDLPLAPALERLVG

SEQ ID NO: 5122 - protein, 275 aa, Gluconacetobacter diazotrophicus PAl 5 JGI
MTPVIDDILAGLRAGRLAPYLGPGVTAMADGVPVPASPADLAAFLGKRVALPKRARGNPWAAAQYIESNRHRSTLTALMDQAYADPVPPGDLHRMLAGFRPPLIVDTWYDGAMRAALTECGAGEWGEIQGITRAGIGEARWYRAYDADGTEVPMDQAEGWRTILYKPHGAVTPARNYIIADSDYVEVLTEIDIQTPIPDIVRKRRTDCGFLFLGCRFDDQMLRTYARQIMKRSAGPYYAVLDTTLLSRNERRFLDDMHIQPVGVPLPAVSALLAA

SEQ ID NO: 5123 - protein, 88 aa, Methylobacterium nodulans ORS 2060
MDSSILKPQAPMRSVAALLRQDRLVPYLGPGPGAGGTVSLSPEALAASLGQRRAAPGRIRTNLWAVAQFIEQRRHRRTYRKIQHRCFG

SEQ ID NO: 5124 - protein, 1028 aa, Methylococcus capsulatus Bath
MLGALVRFAVCRSGVVIALAVLLAAYGLYRAATAKLDIFPEFSAKRVVVQTEAPGLTTRQVEILLTLPIERKLAGIVGLETLRSESIQGLSVVTAVFAEETDIYRDRQLVSERLALLAGQLPEGAGTPVLVPLSSSSATVQTFGLTSETLGPMELRTLADWVMTPRLLAVPGVADVNVFGGAVQQLQVEVDPARLKRFGLDLNAVSLAVRQSFRTQGAGFVENENQRLALQVTGLPLGPESLGNVILNRSPGAVLKLRDVGTVRFGPRPPIGAAAVNGAAGIVMMVIGQYGANTLEVSRGVERGLAELAPMLAARGATLHPRLFRPADYIERALDNLGAHLLAGGLLVMAVLYAFLYDLRTALISAVAIPLSLLGAFVVLQAFGVSLNLMVLGGLAIALGEVVDDAIIDTENIFRRLRENRATAAPRPALTVVYEASLEVRGSVVYASFIVALVFLPLLGLGGVAGRLFAPLGYAYIIAILISLATALTVTPALCVALLTGSKEAAETPPLIRWLQPLYGRWLRWAARQPARLAAGSLAACLLATALAPGLGGDFLPHLREGHYIVHTTSLPGTSLQESLRLGGLVVREILRIPGVESVSQWAGRAERGADTYGSHYSEYEVRLQPMSGSGQQKVLERLRGLLEGFPGIRAEVNTFLTERVNETISGYTSPVAVNLYGDDLDLLDRKARELADEIGRMAGATDVQLRSPPGSPLAEIRLRPDQLQVWGLRPGDVMDAVDTAFAGRTVGHFPLGQRIVETSVILRPDLRQSLDSLRELPLKSQDGTLVSLGEVAEISETGDRYNILHRGGRRIQTVTAGVEGRDLASFVEELRARLDAVLGRSTGVYAEITGAAMEQGVARRELIARACLAGGGVLVLTYLAIGRLRHTAIVLANLPFSLAGGVLAAGISGASLSVGALVGFVTLFGITVRNTIMLLSHYRHLVERERQTWNLDTAVRGAQERLPSILMTALVTALAMLPIASGSDDPGLEIMGPMAAIIIGGLLSSTCLNLALLPAMLLRWGGSFENR

SEQ ID NO: 5125 - protein, 1039 aa, Burkholderia thailandensis E264
MLHAIIRFSLRFRGILFALAALAAGYGLYTLTRAKLDVFPEFAPPMSIVQTEAPGLTSEQVETLVTQPVENGLGGMAGLRSMRSRSMQGLSSITLVFDAHANVMQIRQLVSERVNALAATLPAGVPPPRLLPLTTTTSVVRTIGLTSRTRSLMDLYDLAQWTIRPQLLSAPGVADAIVFGGEARQLQIQVDPAKLMRYGLSIQDVIAAARRSSGVRGAGFIENDNQRIAINADGQVATPERLAGVVLRWSNGVAVHLSDVAAVAWGGAPAMGAASIMGRPGIMLVLESQYGANTLAVTRHIDQTLAALAPMLAKEGVDLQPDVFRPANFIDASIGHLRTALLVGAALVVAVLFLFLLDVRTAIISAVAIPLSLLVAIIVLTSFGVSLNTMTLGGLAIALGEVVDDAIIDVENIYRRLRENRARPTPLPAFRVVLRASLEVRSAVVFATFIVMLIFLPVLTLSGVAGRLFAPLGIAYILAVLASLGVALTLTPAMALALLTRGALPEHEPRLISGMKRRYTALLLKVEQRVKAVVAAAALMCVAALAALPFMSGGFIPALREGHYIVHMGLAPGTSLAESMRIGAQVTQALMRVPGVRLVAQRVGRANEVVDPMGVQLSEFEVDLKPMGASGQRATLHRIRQSLARFPGLTTSVNTFLVERIDETISGVSAPVVVNVFGDDLDVIDRKAQEIARLLGTIRGAASVHVESPPGIPELEIRLDPDQLSRWGFRPADVLDAIQSAYQGAAASQVYHGIRAYDVVVILSPAVRRNLADVGALTLRNPDGLAVPLRALAAIRQVSGRYQITHDGGRRMQTVSVTLGSRVASDFAKEAQARVNREIAMPRGTYAVFSGESEARLRSQRDLLMYGAMSAVGIALLLFLAMKSRRGVVLVMVNLPFALVGGVLSVVLTGGDLSLGSMVGFVTLFGISLRNSIMLISHYEHLVHVEGMPWGIDTAVRGASERLVPILMTALVTALALLPLALTSGAAGNEIEGPMAIVILGGLVTSTALNLIVLPALALRHGRFEPDAPAEPLAAPSNQ

SEQ ID NO: 5126 - protein, 1052 aa, Bradyrhizobium BTAi1
MIDGMRAVAGPQAALIAFAIRFRGIVLALACTILGYGLFSLGEAKYGVFPEFAPPQVSIQTEAPGLSPEQVEVLVTQPIETSINGLAGVESMRSSSIQGLSVLSVIFQPGTDVFRARQLVAERLTAIVNGLPQGVRAPSMTPLVPAAGTVLVIGLTSEQRSLMDLRTIADWTVSRRLLAVAGVAQVTTYGRDIRSLQVQVRADDLVRFGIGMNDVVAAARKATGVRGAGFVDTANQRVILQTQGQSLTPEQLARTVLLHQSGASVVLGDVATVVSAPEPPIGGALINGKPGIMMMISQQYGANTRNVAARVEAALQELRPALDGEKVQLHADLFRPATFIDSAIQNVLFALLIGGALVIVVLFLFLSDWRTSVISCTAIPLSLFSAVLALQWMGQSLDTMTLGGLAIAIGEVVDDAVIGVENVVRRLRENRALPSPRAAARVVYDAMLEVRSAVAYATFAVLLVFVPILALPGLAGRLFGPLGIAYILAVLASLIVALTVTPALAMMLLAGHKPRGAPREPPLARWSRHYYERLLRRLGRFPKLVMATALLITLGGAGLVPWFGGTFLPDLKEGHLILHVSMLPGTSLDESLRLGTMIAEALRAVPEVRSVAQHAGRAEAGIDTAGTHSSEIEVDFQPGLSGNAQELAERRIRAALANFAGINLSIKTYLTERIEETLSGFNAAVVINVFGPDLDDLETAARDIARELGEVWGAIDIQQQSPPGMPQVNVTLRPTDLQSWGLDAVEVLELIRTAYQGDVVGQAYEGNVVFNVIVKLDPEASARPIQIGDMPIRTPSGAYVLLKQIADVYGTSGRYVVLHRNGQRVQTVTANVAERDLESFVAAAKRKIAKEVKLPPGAHVEFTGAAEAQAKSRRDLVVNASLATLGIVLLLALVTKHWRNLALVLINLPFAFVGGVVAVALTGGVLSLGSMVGFVTLFGIALRNSILMISHYEHLVAVEGRSWSLDLAIQGAADRLVPILMTSLVTGLGLLPLALGAGEPGREIEGPMAIVILGGLLTSMALNLLVLPTLAVRFGRFVADPASPAPGLATPG

SEQ ID NO: 5127 - protein, 1064 aa, Methylobacterium extorquens PA1
MLDQRPARGPARDDPPGPPPPALSPASVASGPQAALVAFAVRRPGIVLALVLALAVYGIVALGSAKYDVFPEFAPPTVTVQTEAPGLNPEQVETLVTQTLEVAIGGLPGLATMRSNSIQGLSVITATFASGSDIYRARQLVNERLASITARLPQGVLPPTMTALTSSTSSVLLIGLTSPTQSLMELRTVADWRLRLRLLAAPGVGEVLVYGGDLRSIRIQVRPQDLVRFRIGLNDVLSAGRKATGVRGAGFVDTVNQRITLQTEGQSLTPEAVARTVLINEGGASVVLGDVADVAVAPEPAISAALVDGKPGVLLMVGAQYGANTLDVTAGVEAALAEMRPGLERDGITLRTDLFRPASFVTQATDNVVQALALGGILVVVVLFVFLADWRTALISATAIPLSLIGAVLMLGLFGQSLNTMTLGGLAIAIGEVVDDAVIGVENVMRRLRENRRAAVPLPGARVVLDAILEVRVSVAYATFAVLLVFLPVLALTGVPGRLFGPLALAYILAVLTSLAVALTVTPALARLLLAGRTNLPSREPPVSRRVRGVYISGLARLNRHPRLVFGTSLALTLVAALPVPFFGGVFLPDLKEGHLILHMASAPGTSLQETLRLGERLTAGLKAVPGVRAVAQQVGRAEAGYDLGGTHDSEIHINLEPGLDGEGQERAEAGIRALMAATPGASFSLKTFLTERIEEVVSGFTAPVVISVTGTNLDRIEATARDVARELAEVRGAADVQLKSPPGLPQVNVSLRPTDLRHWGLDAIEVLEIVRTAYQGDIVGQAYEGNAVFNVVVVLEPIVRTRLSTLGNLPLRTPSGSYIRLAQVADIYETAGRYAVGHIGAQRVRVVTANVEGRDVASFTEAAKRKIAREVAQPSGIDIGFGGAAETQAKARRELALYAGLAGLGIVLLLLVVTGSLTNLALVLVNLPFAFVGGVLAVALSGAVISLGSIVGFVTLFGISLRNTIMMVAHYEHLVLVEGRPWNLAAAIEGAADRLVPILMTSLVTGLGLLPLALGAGEPGREIEGPMALVILGGLATSTLLNLAVLPMLALRFARFKPAEGAL

SEQ ID NO: 5128 - protein, 1055 aa, Methylobacterium radiotolerans JCM 2831
MTEPPAAAGRGGPQAALVGFAVRLPKVVLALACAVLVFGLYALAGARYDVFPEFAPPTVTIQTEAPGLDSEQVEVLVTQPVEVAVGGLPGLETLRSTSIQGLSVITAAFQPGSDVDRIRQRVNERLAALAGRMPDGVAAPAMTPLTSSTLTVLLVGLTSETRDAMDLRQVAEWTVRRRLQGVPGIAQVSLYGGGVRALQVQVRPDDLIRFQIGLNDVLAAARKGTGVRGAGFVDTPNQRVLLRTEGQSLTPEALGQIVLHNDGGASVVLSDVATVTAAPEPAISAALVDGKPGVLLMVGAQAGVDTRAVTARLEAALDELRPVLKREGVSVRADLFRPANFVDVATGNVIQALALGGVLVVVVLLVFLADWRAALISATAIPLSLIAAALALQAWGESLNTMTLGGLALAIGEVVDDAVIGVENVSRRLREARGGRRGLPRVVLAAMLEVRTSVAYATLAVILMFLPVLALTGVAGRLFGPLAFAYIVAVVASLLVALTVTPALALLLLGGRLARDTGAAPPDPPVVRWSRAAYLRLLAGIGRVPRIAMAGALLVTLAGAAILPTLGAVFLPDLKEGHMILHMVAIPGTSLQESQRLGTLITGDLKDISGVRAVAAQIGRAEAAEDTAGPHYSEIHIDLEPGLDGAAQRRVEAAIRQLIAGFPGAAFSLKTFLTERIEETVSGFTAPVVVNVVGSDLDRIEAAARSVAQELSEVKGARDVQQASPAGLPQVTVALRPVDLRHWGLDPVEVLEAVRTAYQGDTVGQTYRGNAVFNVLVILDARVRDRLSAVGDLPLRAPGGRYVRLSQVADVYESAGRYQVQHLGAQRVQAVTANVADRDVAGFVAAAKRKIAREVRLPEGVYVTFSGAAEAQAAARRDLLVHAGMAGFGIVVLLAIVTGSAANLLLVLVNLPFAFVGGVAAAALTGGVLSLGSIVGFVTLSGISLRNSVMMIAHYEQMVTRDGRPWDAATAAEGAADRMVPILMTSLVTGLGLLPLALGAGEPGREIEGPMALVILGGLVTSTVLNLLILPVMALRYARFRHQDPADLELTAVGS

SEQ ID NO: 5129 - protein, 1064 aa, Methylobacterium populi BJ001
MLDRRPDQRPDSRPMRDDAPAPAPPGPAPSGLQAALVAFAVRRPGIVLALVLAIAIYGIVALGSAKYDVFPEFAPPTVTVQTEAPGLNPEQVEVLVTQALEVAVSGLPGLATLRSNSIQGLSVITATFATGSDIYRARQLVNERLAAVTARLPQGVLPPTMTALTSSTSSVLLLGLTSPTHSLMDLRTVADWRLRLRLLAAPGVGEVLVYGGDIRSLRIQVRPQDLVRFRIGLNDVLAAGRKATGVRGAGFVDTVNQRITLQTEGQSLTPEAVARTVLVNEGGASVVLGDVADVAAAPEPAISAALVDGRPGVLLMVGAQYGANTLDVTAQVEAALAEMRPGLERDGITLRADLFRPANFVTQATDNVVQALALGGILVVVVLFVFLADWRTALISATAIPLSLIGAVLALGAFGQSLNTMTLGGLAIAIGEVVDDAVIGVENVMRRLRENRRAETPRPGARVVLDAILEVRVSVAYATFAVLLVFLPVLALTGVPGRLFGPLALAYILAVLTSLAVALTVTPALARLLLAGRSDGPVREAPVSRGVRGAYIRTLARLNCHPRLVFTASLALTLAAAIPVPFFGGQFLPDLKEGHLILHMASVPGTSLQESLRLGERITAGLKALPGVRAVAQQVGRAEAGYDLGGTHDSEIHIDLEPGLDGEGQERAEAGIRALMAATPGANFSLKTFLTERIEEVVSGFTAPVVVSVTGTDLDRIEATARDVARELAEVRGAADVQLRSPPGLPQVNVSLRPADLRHWGLDAIEVLEIVRTAYQGDIVGQAYEGNAVFNVVVVLEPAARTRLSTLGTLPLRTKGGNYIRLAQVADIYETAGRYAVGHVGAQRVRVVTANVEGRDIASFTEAAKRKIAREVAQPSGIDIGFGGAAETQAKARRELALYAGLAGLGIVLLLLMVTGSLTNLALVLVNLPFAFVGGVLAVAVSGAVVSLGSIVGFVTLFGISLRNTIMMIAHYEHMVLVEGRRWNAAAAVEGAADRLVPILMTSLVTGLGLLPLALGAGEPGREIEGPMALVILGGLATSTLLNLAVLPMLALRFARFKSLQTSP

SEQ ID NO: 5130 - protein, 1064 aa, Methylobacterium chloromethanicum CM4
MLDQRPARGPARDDPPGPPPAALSPAPVALGPQAALVAFAVRRPGIVLALVLALAIYGIVALGSAKYDVFPEFAPPTVTVQTEAPGLNPEQVETLVTQTLEVAISGLPGLATMRSNSIQGLSVITATFASGSDIYRARQLVNERLASITARLPQGVLPPTMTALTSSTSSVLLIGLTSPTQSLMDLRTVADWRLRLRLLAAPGVGEVLVYGGDLRSIRIQVRPQDLVRFRIGLNDVLSAGRKATGVRGAGFVDTVNQRITLQTEGQSLTPEAVARTVLINEGGASVVLGDVADVAVAPEPAISAALVDGKPGVLLMVGAQYGANTLDVTAGVEAALAEMRPGLERDGTTLRTDLFRPASFVTQATDNVVQALALGGILVVVVLFVFLADWRTALISATAIPLSLIGAVLMLGLFGQSLNTMTLGGLAIAIGEVVDDAVIGVENVMRRLRENRRAVAPLPGARVVLDAILEVRVSVAYATFAVLLVFLPVLALTGVPGRLFGPLALAYILAVLTSLAVALTVTPALARLLLAGRTNLPSREPPVSRRVRGIYVRGLARLDRHPRLVFGTSLALTLVAALPVPFFGGVFLPDLKEGHLILHMASAPGTSLLETLRLGERITAGLKAVPGVRAVAQQVGRAEAGYDLGGTHDSEIHINLEPGLDGEGQEQAEAGIRALMAATPGANFSLKTFLTERIEEVVSGFTAPVVISVTGTNLDRIEATARDVARELAEVRGAADVQLKSPPGLPQVNVSLRPTDLRHWGLDAIEVLEIVRTAYQGDIVGQAYEGNAVFNVVVVLEPIVRTRLSMLGNLPLRTPSGSYIRLAQVADIYETAGRYAVGHIGAQRVRVVTANVEGRDVASFTEAAKRKIAREVAQPSGIDIGFGGAAETQAKARRELALYAGLAGLGIVLLLLVVTGSLTNLALVLVNLPFAFVGGVLAVALSGAVISLGSIVGFVTLFGISLRNTIMMVAHYEHLVLVEGRPWNLAAAIEGAADRLVPILMTSLVTGLGLLPLALGAGEPGREIEGPMALVILGGLATSTLLNLAVLPMLALRFARFKPAESAL

SEQ ID NO: 5131 - protein, 357 aa, Brucella suis 1330
MTYAELGRGSAVARLKDIATIQGVRENQLVGYGLVIGLKGTGDSLRNSPFTEQSMRAMLDNLGISAPRNSTRSKNTAAVIVTANLPAFAGAGSRIDVTVSSLGDATSLQGGTLVMTQLMGADNQIYAVAQGNMIVSGFSAEGEAASVTQGVPTSGRIPNGALVEREVAGSFGKDREMIVELRDPDFTTAVRAADTINVFAKRRYGRGVAIARDAKTIRLSRPKNVPAARFLAELEGLPITTDEVARVVVDERTGTVVIGEKVRISKVAISHGSLTVRVTETPMVVQPEPFSDGETAVEPNTDIAVNQQNAKIGILSGANLENLVKGLNQIGVKPTGIIAILQAIKTSGALHAELVVQ

SEQ ID NO: 5132 - protein, 367 aa, Rhodopseudomonas palustris BisB18
MIARLLWGVIIALSITAADAAVRIKDIANLKGVRENQILGYGLVIGLKGTGDTLRNSPFTEQSLQSMLDNMGINIRGTSLRTRNVAAVVVTADLPPFIAGGSRIDVAISSLGDSSSLLGGTLVMTQLRGADGEVYAVAQGAIAVGGYAVEGAAQSLSQGVATGGRIPNGALIEREVRGRFSDMETLLLELKNPDFVTATRVLDTINQHSRGRYQAGVASERDYRTIILSRPRSVSPVRFIAEIEELLVEPDTPARVVIDERNGTVVIGRNVQISTVAVTHGNLTVRITEAPIVSQPSPFSPRGETVVVPQTFIDANEPGAKIAILRGTDLQRLVRGLNQIGLKPSGIIAILQAIKAAGALQADLVIQ

SEQ ID NO: 5133 - protein, 369 aa, Mesorhizobium BNC1
MILRAFLWGLMLFLAAAPAGAASKTQIKHIAQLQAARDNQLVGYGLVIGLNRTGDSLRNAPFTEQSMRAMLQNLGIASEDGRSRAENVAAVIVTANLPPFVQSGARIDVTVSSLGDASSLAGGTLVMTPLRAADGEIYAVAQGSVIVSGFNAQGQAETLTQGVPTSGRVPNGAIIERSVTASFDELLALTLQLRNPDFSTAVRVADVVNAYTSRHFGAPLASEQDSRTVIIKKPKGVSAARFYAQIENLPVEVDAPARVVVDERTGTVVIGSDVRISRVAISHGALTVRVTEMPRVVQPEPFSRGETAVEPYTVIDATQPDASVAVLDGPDLQTLVSGLNRLGVKPDGIIAILQGIKSAGALQGELVLQ

SEQ ID NO: 5134 - protein, 412 aa, Bartonella bacilliformis KC583
MRVYHHLFHYFLAFWFSFFAVFFPIFANGQEEGTRYNSAVESDAALLGSGGDPSQMHYSDLARPGAVARLKDIAEIQGVRSNQLVGYGLVIGLNRTGDSLRNSPFTEQSMRAMLDNLGISPPAGASRANNIAAVIVTAEMVPFATPGSRIDVTVSSLGDATSLQGGTLVMTPLLGADGKTYAVAQGNMVISGFGAQGVAESVTQGVPTSGRIPNGALVERKIEGNFNKSNEIILELRNSDFSTAVRVTDLINIFSNQRYKQGVAKERDSKTIVLSKPRNISITRFIAEIERLPIPTDEVARVVVDERTGTVVIGEKVRVSRVAISHGSLTVRVTEDPLVSQPNPFAEGNTVIVPRTNVDIAQPPSNIGILNGVDLDNLVKGLNQIGVKPTAIIAVLQAIKTSGALHAELIVQ

SEQ ID NO: 5135 - protein, 371 aa, Sinorhizobium medicae WSM419
MKMRACKWLLTLAVAFAATLSSAYAASRIKDVASLQAGRDNQLIGYGLVVGLQGTGDSLRSSPFTDQSIRAMLQNLGISTQGGDSRTRNVAAVLVTATLPPFASPGSRLDVTVGSLGDATSLRGGTLVMTSLSGADGQIYAVAQGSVVVSGFNAQGEAAQLNQGVTTAGRVPNGAIIERELPSKFKDGFNLVLQLRNPDFSTAVGMAAAINRYAAAQFGGRIAEALDSQSVLVQKPKMADLARLMADVENLVIETDAPARVVINERTGTIVIGQDVRVAQVAVSYGTLTVQVSETPTIVQPEPFSRGQTAYEPNTTIEAQSDGGTVAILNGSSLRSLVAGLNSIGVKPDGIIAILQSIKSAGALQAELVLQ

SEQ ID NO: 5136 - protein, 413 aa, Ochrobactrum anthropi ATCC 49188
MRKTCAAQIATLFAVLALVFQPVAGFADESSKNAREFGSAVDADADWLGSGGDPSKMAYAELGRGSAVARLKDIATIQGVRENQLVGYGLVIGLKGTGDSLRNSPFTEQSMRAMLDNLGISAPRNSTRSKNTAAVIVTANLPAFAGAGSRIDVTVSSLGDATSLQGGTLVMTQLMGADNQIYAVAQGNMIVSGFAAEGEAASVTQGVPTSGRIPNGALVEREVAGNFGKETEMIVELRDPDFTTAVRAADTINVFAKRRYGRGVAIARDAKTIRLSRPKNVPAARFLAELEGLPITTDEVARVVVDERTGTVVIGEKVRISKVAISHGSLTVRVTETPMVVQPEPFSDGVTAVEPNTDIAVNQQNAKIGILTGANLENLVKGLNQIGVKPTGIIAILQAIKTSGALHAELVVQ

SEQ ID NO: 5137 - protein, 375 aa, Methylobacterium extorquens PA1
MIRRLLLAVLLGLLTGLGFAVMTGPVFAAGTRIKDIATLKGVRDNQLFGYGLVTGLQGTGDTLRNAQFTEQSLQSLLDRLGINVRDARLRTRNIAAVMVTADLPPYTGTGSRIDVTVTSMGDATSLRGGTLLMTSLTGGDGLVYAAAQGPLAVSGFSVQGQAEQLTQGVPTAGRIPNGAMIEREVPGTFRDLPELVFELKNPDFKTATQISDAINAWSLGAFGRRIASARDQRAVVVMRGRQMAQTRLVAQIGDLTIQPDTPARVVVDQRTGTVVIGRNVTISTVAVTHGNLTVRVTEAPEVSQPEGFSNGQTVVVPRTEVSAREERGKLAILGGSDLQTLVRGLNQVGLKPTDIIAILQAVKTAGALQAELVVQ

SEQ ID NO: 5138 - protein, 366 aa, Methylobacterium radiotolerans JCM 2831
MRPLILLLLAGLALWPASASATRIKDIATLQGVRDNQIVGYGLVTGLQSTGDTLRNAQFTEQSLQSMLDRLGVNVRDQRLRTRNVAAVMVTANLPAYVEPGSRVDVSVNSMGDATSLRGGTLLMTPLSGGDGQVYAVAQGALVVSGFSVTGQAESLVSGVATAARIPNGALVERAVAGTFSELPGMALELKNPDFHTAVLISDAINAYTLQKYGRRAASPRDYRTVVLSRPGHVGRTRFMAEIGELQVQPDIPAKVVIDQRTGTVVIGRNVQVSTVAVTHGDLTVRITETPQVSQPAPFSDGQTTVVPRTDIEAGERTARLAIVAGPDLQTLIRGLNNVGMKPTDVIAILQAVKTAGALQAELVIQ

SEQ ID NO: 5139 - protein, 370 aa, Beijerinckia indica ATCC 9039
MTRRIFSLLACCCLACFSVAPAFASVRIKDIAALQGVRDNQIMGYGLVVGLQGTGDTMRNSVFTEQSIQSMLDRLGVNVRGINLRTRNVAAVLVTADLPPFVQPGSRIDVTVSSLGDASSLLGGTLILTSLLGVDGQTYAMAQGQVAVTGFAETGPAASVVQNVPTAGRIANGALIEREVPGQLRSIGPLVLQLRNPDFGTAVKITDAINAFGVHKYGHELAHEIDQRSVALNKPANLGTTRFIAQIGDLSIEPDTPARVVIDSRSGTVVIGQDVQISTVAVTQGNLTVRISNAPVISQPAPFSQGKTVVAPITEIDANQGGGPISIVRGSNLRSLVAGLNQIGLKPDGIISILQAIKSAGALQADLVVQ

SEQ ID NO: 5140 - protein, 377 aa, Methylobacterium populi BJ001
MTPLRRLFLAVLLGLLTGLGFAVMTGPVFAAGTRIKDIATLKGVRDNQIFGYGLVTGLQGTGDTLRNAQFTEQSLQSLLDRLGINVRDARLRTRNIAAVMVTADLPPYTGTGSRIDVTVTSMGDATSLRGGTLLMTPLTGGDGLVYAAAQGPLAVSGFTVQGQAEQLTQGVPTAGRIPNGALIEREVPGTFRDLPELVFELKNPDFKTATQISDAINAWSLGAFGRRIASARDQRAVVVMRSRQMAQTRLVAQIGDLTIQPDTPARVVVDQRTGTVVIGRNVTISTVAVTHGNLTVRVTEAPEVSQPEPFSNGQTVVVPRTEVAAREERGKLAILGGSDLQTLVRGLNQVGLKPTDIIAILQAVKTAGALQAELVVQ

SEQ ID NO: 5141 - protein, 370 aa, Methylobacterium sp. 4-46
MDRILALLLALLVAPLAALPALAGTRIKDIAALQGVRDNQLVGYGLVTGLQGTGDTLRNAQFTEQSLQSMLDRMGVNVRDSRLRTRNVAAVMVTADLPPYATVGSRIDVTVTSLGDATSLKGGTLLMTPLSGGDGQVYAAAQGPMAVSGFSVGGQAETVTQGVPTAGRIPNGALIERQVPGSLQDLPQLVLELKNPDFKTATLIVDAVNAYALQRFGRRVAIPRDQRSVVLHKPPAIAQTRFIAEVGDLTIQPDTPARVVVDQRTGTVVIGRNVQISTVAVTHGNLTVRVTETPEVSQPNPSSRNGQTVVVPRTEVSAQEQQGRLAVLGGSDLQTLVKGLNQVGLKPSDIIAILQAVKTAGALQAELVVQ

SEQ ID NO: 5142 - protein, 373 aa, Rhizobium leguminosarum bv  trifolii WSM2304
MKLFFRFLTLVAVLAMSLADVAPAWALTSRIKDIASLQAGRDNQLIGYGLIVGLQGTGDGFRASPFTEQSMRAMLQNLGISTQGGQSNAKNTAAVMVTANLPPFASPGSRIDVTVSSLGDATSLRGGTLVMTSLSGADGQIYAVAQGAAIVTGFQAQGQAATVTEGVTTAGRVPGGAIIERELPSRFKDSVNLVLQLRNPDFSTAIRIADIVNGYASARFGGPVAEAKDSQEVVIQKPRTADLTRLMADIENLIVETDTPAKVVINERTGTIVIGSDVRVSPVAVSYGTLTVQVTETPQIIQPEPFSQGRTAVQPQTDIAAEQTGGRVAIIDGPDLRTLVAGLNNIGVKPDGIIAILQGIKSAGALQAELVLQ

SEQ ID NO: 5143 - protein, 367 aa, Methylocella silvestris BL2
MMLRAGLIVVFSAIFCCAATASVRIKDITSLQDVRDNQLVGYGLVVGLQGSGDTLRNSTFTEQTMQSMLDRMGINVRSFALRTRNVAAVLVTADLPPFIQPGTRMDVTVSSLGDATSLYGGTLILTSLTGVDGQTYAIAQGQVAVAGFAVQGQAETITQNVATAGRIANGALVEREAPGHLRDIGPLALVLKNPDFNTAVQIAEVINKFSMRRFRLRVAQDRDLNSVALVRPPGISTARFMAEIGDLMVDPDAPARVVIDARSGTIVIGQDVQISTVAVTHGNLNVRIVETPEVSQPAPFSNGRTVVVPRTEIDTNQQGGHIGIVKGASLRELVAGLNRIGLKPMGVIAILQAIKSAGALHADIVIQ

SEQ ID NO: 5144 - protein, 375 aa, Methylobacterium chloromethanicum CM4
MIRRLLLAVLLGLLTGLGFAVMTGPVFAAGTRIKDIATLKGVRDNQLFGYGLVTGLQGTGDTLRNAQFTEQSLQSLLDRLGINVRDARLRTRNIAAVMVTADLPPYTGTGSRIDVTVTSMGDATSLRGGTLLMTSLTGGDGLVYAAAQGPLAVSGFSVQGQAEQLTQGVPTAGRIPNGAMIEREVPGTFRDLPELVFELKNPDFKTATQISDAINAWSLGAFGRRIASARDQRAVVVMRGRQMAQTRLVAQIGDLTIQPDTPARVVVDQRTGTVVIGRNVTISTVAVTHGNLTVRVTEAPEVSQPEPFSNGQTVVVPRTEVSAREERGKLAILGGSDLQTLVRGLNQVGLKPTDIIAILQAVKTAGALQAELVVQ

SEQ ID NO: 5145 - protein, 371 aa, Agrobacterium vitis S4
MSIRVLLFSIFTGFLLAAAGPALAQGSRIKDVASLQAGRDNQLIGYGLVVGLQSTGDSLRSSPFTDQSMRAMLQNLGISTQGGQSSAKNVAAVMVTATLPPFGSPGSRIDATVSSLGDATSLRGGTLIMTSLSGADGQIYAVAQGSVVVSGFTAQGQAATVTEGVTTSGRVPNGAIIERELPSKFKDSVNLVLQLRNPDFSTSLGMARRINNYATATYGAPIAEARDSQEVVIQKPRTADLAQLMADIENLVVETDTPAKVVINERTGTIVIGADVRVSKVAVSYGTLTVQVNETPQVIQPQPFSSGTTATQPQTDISAQKTGDKVAIVDGPDLRTLVAGLNNIGVKPDGIIAILQGIKSAGALQAELVLQ

SEQ ID NO: 5146 - protein, 373 aa, Rhizobium leguminosarum bv  trifolii WSM1325
MKLFFRFVTLVAVLAMSLADVVPAWALTSRIKDIASLQAGRDNQLIGYGLIVGLQGTGDGFRSSPFTEQSMRAMLQNLGISTQGGQSNAKNTAAVMVTANLPPFASPGSRIDVTVSSLGDATSLRGGTLVMTSLSGADGQIYAVAQGAAIVSGFQAQGQAATVTEGVTTAGRVPGGAIIERELPSRFKDSVNLVLQLRNPDFSTAIRIADIVNGYASARFGGPVAEAKDSQEVVIQKPRTADLTRLMADIENLIVETDTPAKVVINERTGTIVIGSDVRVSPVAVSYGTLTVQVTETPQIIQPEPFSQGRTAVQPQTDIAAEQTGGRVAIIDGPDLRTLVAGLNNIGVKPDGIIAILQGIKSAGALQAELVLQ

SEQ ID NO: 5147 - protein, 353 aa, Nitrobacter winogradskyi Nb-255
MDAVLTASVPPVLHPAEGAVSSHVNVRGALTRRAPNKAGSIVSVVDQKAVELPPRISEAGVADYFALLKPRVMSLVIFTALVGLMIAPGHIHPVLGFIAILCIAVGAGASGALNMALEGDIDVLMSRTANRPIPRGRITRGEAMGFGLTLSFFSVMTLGALVNWYAGGLLAFTIFFYVVIYTMGLKRRTAQNIVIGGAAGALPPVVAWAAATGSLSVEPLLLFLIIFFWTPPHFWALALFRSDDYARAGVPMLPVVAGPDATRLQILLYTIVLVAIAAAPWPLGYFDWVYGVTSLILGAGMLVLAIEVYRHRTGSQALRATRRLFAFSILYLFALFAVLLLDVVAKAVAPLIW

SEQ ID NO: 5148 - protein, 313 aa, Rhodopseudomonas palustris HaA2
MSVIDTNQIDLVAPRISEAGVADYIALLKPRVMSLVVFTALVGMLLAPGDFHPVLAITAMLCIAVGGGAAGALNMWYEDDIDGQMTRTANRPIPRGRVTRPEALTFGITLSFFSVMTLGILVNWVAGALLAFTIFFYVVIYTMWLKRSTAQNIVIGGAAGALPPVVAWAAVTGSLAVEPLLLFAIIFFWTPPHFWALALFRNDDYARAGVPMLPVVAGQDHTRLQILLYTIVLVAVAAAPWPLGYFSAIYGVASLALGGWMLVLALRVYRHRTGSAALRATRNLFKFSILYLFALFSILLLEVVAKAVWRLFA

SEQ ID NO: 5149 - protein, 313 aa, Rhodopseudomonas palustris BisB18
MSVVESHDIEFAAPRISEASVADYIALLKPRVMSLVIFTALVGLLLAPGYIHPVLAFTSILCIAVGAGASGALNMWYEDDIDAKMTRTANRPIPRGRVSKPEALTFGLVLSFFSVVTLGILVNWFAAALLAFTIFFYVVIYTIWLKRWTAQNIVIGGAAGALPPVVAWAAAAGSLSVEPMLLFAIIFFWTPPHFWALALFRAGDYANAGVPMLPVTAGPDATRLSILLYTIVLVAVAFAPWPLGYFDAIYGITSLALGGWMLLLTLRVYRLRHGSAALRASRSLFKFSILYLFALFAVLLLEVIVRGVIGALA

SEQ ID NO: 5150 - protein, 313 aa, Rhodopseudomonas palustris BisB5
MSVIDTNQIDLAAPRISEAGVADYVALLKPRVMSLVVFTALVGMLLAPGDFHPVLAVTAMLCIAVGGGAAGALNMWYENDIDALMTRTANRPIPRGRVTRPEALTFGMTLSFFSVVTLGVLVNWIAAALLAFTIFFYVVIYTMWLKRSTAQNIVIGGAAGALPPVVAWAAVTGSLAVEPLLLFAIIFFWTPPHFWALALFRNDDYARAGVPMLPVVAGPDHTRLQILLYTIVLVAVAAAPWPLGYFDAVYGIASLALGGWMLVLAIRVYRHRSGSAALRATRNLFKFSILYLFALFSILLIEVVAKAVWQLFA

SEQ ID NO: 5151 - protein, 328 aa, Nitrobacter hamburgensis X14
MRRARRAAYLNKVSCVLPVVDQNAIELPPRISEASVADYFALLKPRVMSLVIFTALVGLMIAPGHVHPVLGFTAILCIAVGAGASGALNMALEGDIDVLMSRTANRPIPRGRITRGEAMGFGLTLSFFSVMTLGALVNWYAGGLLAFTIFFYVVIYTMGLKRRTAQNIVIGGAAGALPPVVAWAAATGSLSVEPLLLFLIIFFWTPPHFWALALFRSDDYARAGVPMLPVVAGPDATRLQILLYTIVLVAIAAAPWPLGYFDWVYGVTSLVLGAGMLVLAINVYRHRTGSTALRATRRLFAFSILYLFALFAVLLLDVLAKAVAPLIW

SEQ ID NO: 5152 - protein, 330 aa, Maricaulis maris MCS10
MDTIVTPSDHRAEGEAVSTASPRDYFDLMKPRVMTLVVFTAFAGLIAAPVDADPFLAFMSILCLAVGAGAAGALNMAYDADIDATMQRTRKRPIPRGVVSVSNAYGFGVVASILSVLLMALASNYLAAGLLAFSIFFYAVIYTMILKRSTPQNIVIGGAAGAFPPMIGWVAATGEISLDAVILFMIIFLWTPPHSWALALYKSGDYAAANVPMMPVAKGAKSTRLQILLYSIVLVIFAGAPVLTGLGGAVYGATSLGGGALFLLLAWRIFRSRAGEAGSAEEGALYAVRAGDKAARDLFAYSIGYLTVLFAALIVEHAFGAYVAIPGVSP

SEQ ID NO: 5153 - protein, 312 aa, Bradyrhizobium BTAi1
MSVIDQNAIAVGPRISEADVGDYLALLKPRVMSLVIFTALIGLLIAPGHFHPVLAITSLLCIAVGAGASGALNMALEGDIDSLMSRTANRPIPRGRVTRQEALAFGITLSFFSVLTLGILVNWYAGALLAFTIFFYVVIYTLWLKRWTAQNIVIGGAAGALPPVVAWVAATGSIAPEPLLLFLIIFFWTPPHFWALALFRSDDYARAGVPMLPVVAGPDATRLQILLYTILLVAIAAAPWPLGYFDAVYGVVSLALGAGMLWFAIEVFRKRERSQSLRANRKLFAFSILYLFALFATLGLEAVARMIAPLIW

SEQ ID NO: 5154 - protein, 316 aa, Sinorhizobium medicae WSM419
MTVIDNHEAVGMEGAPRLSEASARDYFELLKPRVMSLVVFTAFAGLILAPGHINPFIGFTAILCIAIGAGASGALNMWYDADIDAVMSRTAKRPIPAGKILPQEALAFGLTLSAFSVIILGLAVHWLAAGLLAFTIFFYVAVYTMWLKRSTPQNIVIGGAAGAFPPMIGWACVTGGISVESIVLFLIIFLWTPAHFWALALFKMGEYGAVGVPMMPNVCGEATTKRQIVIYAVLTAISGICPTLLGFASLGYGALATALGLGFVGYSLGVLRMPEGDKRMVPAKKLFAFSIVYLFAIFSALLVDYAIARIWFGGVI

SEQ ID NO: 5155 - protein, 318 aa, Parvibaculum lavamentivorans DS-1
MSDTAISNQRDTAAFPEGGMGSARDFFELLKPRVMSLVIFTALVGIAVAPGGIHPVIAFTALLCIAVGAGASGALNMWYDADIDARMARTANRPIPAGRVTAREAAVFGSILSVFAVMTMGVLVNWVAAALLAFTIFFYLVVYTMWLKRRTPQNIVIGGAAGAFPPMIGWAAVTGSVSIEPFVLFLIIFMWTPPHFWALALYRSGDYEKVGVPMLPVVSGEKETRRQIMLYSLALVPVTLLPGFLGFAGALYMGATAALGAGFLWLAFGIWRTEPGAAQDKAAKRLFGYSILYLFLIFSLLLVEKMLGLGGTAFALAL

SEQ ID NO: 5156 - protein, 315 aa, Xanthobacter autotrophicus Py2
MRDEQASLTNPEPYAFAAAGEGLASPRDYFELLKPRVMSLVIFTALVGLVRAPGDVHPIIAFTALLCIAVGAGAAGALNMWWDADIDAIMSRTRKRPVPSGRVTAHEALAFGLTLSAFSVVVLGLLVNALAGALLAFTIFFYVVIYTMWLKRSTPQNIVIGGAAGAFPPLVAWAAASGTVSLEPVLLFAIIFFWTPPHFWALALYRADDYARAGVPMLPVTAGPDETRLQILLYTLFLVPLAASPAVLGYVGYAYGAVAVLAGAWMIALAWRVYRRREGEAAVKAAKGLFGFSIVYLFALFATLLGEAVIGGLLR

SEQ ID NO: 5157 - protein, 317 aa, Methylobacterium extorquens PA1
MTSLSNSLSADTGTTSFSPAAGGEVSDFFALLKPRVMVLVIFTALVGMVVSDATVNPVIAAISLLMIAVGAGASGCLNMWWDADIDALMTRTAKRPIPDGRIRPDEALAFGIVLSVGSVLILGLASNWLAAGLLAFTIAFYAVIYSMWLKRATAQNIVIGGAAGALPPVVGQAAVTGHVGIESLVLFAIIFIWTPPHFWALALVKSGEYARAGIPMMPNVAGPDSTRRQIIWYSLVLAPLALLPVWLGFGGWLYAVVGVLGGLGMLAGAVQVYRLREGEPERKAAMGLFAFSILYLFLLFSALLAEQGLGLFRAVAA

SEQ ID NO: 5158 - protein, 316 aa, Methylobacterium radiotolerans JCM 2831
MTSLTNTIGPDVPGPALTTAGGDVPDYFALLKPRVMVLVIFTALVGMVVSQGHVQPAIGAISLLAIAVGAGASGCLNMWWDADIDAVMSRTATRPIPSGRITSEEALGFGLFLSVASVVVLGLAANLLAAALLAFTIVFYAVVYSMWLKRATAQNIVIGGAAGALPPVIGQAVVTGSIGIESLILFAIIFIWTPPHFWALALIKADEYARAGIPMMPNVAGPASTRRQIVWYSLLLAPLGLVPVALGFGGLVYAVVGLVGGLGMVAFSIRVLRNPEGDAERRAAMGMFGFSILYLFALFSALLAEQSFGLFRPVLG

SEQ ID NO: 5159 - protein, 321 aa, Beijerinckia indica ATCC 9039
MTFISQAPSVSISSAGPSDYFALLKPRVMSLVIFTALAGMLIAPDPVHPIVGFASLLAIAVGAGASGALNMWYDADIDAVMKRTAKRPIPLGRVMPNEALAFGLTLSFLSVFTLGIVANWLAAGFLAFTIFFYVVIYTMWLKRSTPQNIVIGGAAGAFPPMVGYAAATGHFSLSSFILFAIIFIWTPPHFWALALGRSEDYRQAGIPMMPNVKGAARTRLEILLYTLLLAPLGVAPWLLGFASFVYGMLSIALGAAMLFFAARVYIVQEGPSADRHAKALFGFSILYLFLLFAEIVVERLVPIVVAMGAWLTSGMFPGFFH

SEQ ID NO: 5160 - protein, 317 aa, Methylobacterium populi BJ001
MTSLSNSLSADAGRASLASAAGGEVSDFFALLKPRVMVLVIFTALVGMVVSDATVNPVIAAISLLMIAVGAGASGCLNMWWDADIDALMTRTAKRPIPDGRIRPDEALAFGIVLSVGSVLILGLASNWLAAGLLAFTIVFYAVIYSMWLKRATAQNIVIGGAAGALPPVVGQAAVTGHVGIESLVLFAIIFIWTPPHFWALALVKSGEYARAGIPMMPNVAGPDSTRRQIVWYSLLLAPLALVPVWLGFGGWLYAVVGVLGGLGMLAGAVQVYRLREGEPERKAAMGLFAFSILYLFLLFSALLAEQGLGLFRAVAA

SEQ ID NO: 5161 - protein, 312 aa, Rhodopseudomonas palustris TIE 1
MSVIDVNPIPLAPRISEAGVADYIALLKPRVMSLVVFTALVGLLMAPGSFHPVLAITAIICIAVGGGAAGALNMWYEDDIDAKMTRTANRPIPRGRVTRPEALTFGMTLAFFSVVTLGILVNWIAAGLLAFTIFFYVVIYTMWLKRWTAQNIVIGGAAGALPPVVAWASVTGSLAVEPILLFLIIFFWTPPHFWALALFRNDDYARAGVPMLPVVAGPDHTRLQILLYTVALVAVAAAPWPLGYFDAIYGVASLALGGWMLVLAVRVYRHRSGSAALRATRNLFKFSILYLFALFALLLVEVIAAAVLRLIG

SEQ ID NO: 5162 - protein, 317 aa, Methylobacterium sp. 4-46
MTSLTNSLNPARSLAPASNGDVADFFALLKPRVMALVIFTALVGMTVTKSHVNPVIAAVSLLMIAVGAGASGCLNMWWDADVDAVMSRTRTRPIPAGKIRPDEALAFGMTLSVGSVLMLGLAANWLAAGLLAFTIAFYAVIYSMWLKRATAQNIVIGGAAGALPPMIGQAVVTGTVGIEGLVLFLIIFVWTPPHFWALALVKSGDYAKAGIPMMPNVAGPDSTRRQIVAYTLLLAPLGLAPVALGFGGLIYGLVALLGGLAMLALSLQVYHRREGEGADKAAMGLFGFSILYLFLLFSALLAEQGLGLFRPVSQLFG

SEQ ID NO: 5163 - protein, 316 aa, Rhizobium leguminosarum bv  trifolii WSM2304
MTVIDNHGALAKDGELSEASARDYFELLKPRVMSLVVFTAFAGLVLAPGHIHPVLGLIAILCIAVGAGASGALNMWYDADIDAIMSRTAKRPIPAGRIAPSEALAFGLVLSGFSVVILGLAVNWLSAGILAFTIFFYAVVYTMWLKRSTPQNIVIGGAAGAFPPMIGWACVTNSVTIESTVLFLIIFLWTPAHFWALALFKMRDYEAVGVPMLPNVAGERVTKHQIVAYAVLTAVCGILPSFLGFASFGYGLVAAALGAIFIYCSIAVWRMPDGDLKMIPAKKLFAFSIFYLFAVFSALMIDRLASIFVSHTGGWF

SEQ ID NO: 5164 - protein, 316 aa, Methylocella silvestris BL2
MSFVSDSNTAIDQAAISIASPADYLALMKPRVMSLVIFTALTGVLIAPTHVNPIIGFASLLAIAAGAGASGALNMWYDSDIDAIMRRTQKRPIPAGRVARESALAFGMVLALLSVITLGFVANWAAAALLAFTIFFYVVIYTMWLKRSTPQNIVIGGAAGAFPPIVAYLAVAGQVSLPALALFAIIFVWTPPHFWALALVKAGDFERAGIPMLPNVKGPDRTRRDILLYTLLLAPIGMTPYFIGFASPAYGLLSFGLGGVMILHAVRVYLAREGDQANRVAMRMFGFSILYLFLLFAAIVAERILALLPISSATPW

SEQ ID NO: 5165 - protein, 317 aa, Methylobacterium chloromethanicum CM4
MTSLSNSLSADTGTTSFSPAAGGEVSDFFALLKPRVMVLVIFTALVGMVVSDATVNPVIAAISLLMIAVGAGASGCLNMWWDADIDALMTRTAKRPIPDGRIRPDEALAFGIVLSVGSVLILGLASNWLAAGLLAFTIVFYAVIYSMWLKRATAQNIVIGGAAGALPPVVGQAAVTGHVGIESLVLFAIIFIWTPPHFWALALVKSGEYARAGIPMMPNVAGPDSTRRQIIWYSLVLAPLALLPVWLGFGGWLYAVVGVLGGLGMLAGAVQVYRLREGEPERKAAMGLFAFSILYLFLLFSALLAEQGLGLFRAVAA

SEQ ID NO: 5166 - protein, 317 aa, Methylobacterium nodulans ORS 2060
MTSLTNSLNPAQTLAPASNGDVADFFALLKPRVMALVVFTALVGMTVSPSHVNPVIGAVSLLMIAVGAGASGCLNMWWDADIDAVMTRTRSRPIPAGRIRPEEALTFGLVLAVGSVLMLGLAANWLAAGLLAFTIVFYTVIYSMWLKRATAQNIVIGGAAGALPPMIGQAVVTGSVGIEGIILFLIIFIWTPPHFWALALVKSADYAKAGIPMMPNVAGPDSTRRQIVGYTLLLAPLGLAPVALGFGGLIYGLVALLGGLAMLVLSLQVHRRREGESADKAAMSLFGFSILYLFLLFSALLAEQGLGLMRPIPVLLG

SEQ ID NO: 5167 - protein, 325 aa, Agrobacterium vitis S4
MTGQDSIMAAIDNSNIIGLDSEICLSEAGAKDFFALLKPRVMSLVVFTAFAGLVLAPGTINPILGVIAILCIAVGAGASGALNMWYDADIDAVMTRTARRPIPAGRIRPQEALAFGITLSVFSVSILGLAVNWFAAAFLAFTILFYAVVYTMWLKRSTPQNIVIGGASGAFPPMIGWACVTGGVSLDSVILFMVIFLWTPAHFWALALYKMRDYGSVGVPMMPNVAGETSTKRQMFVYAVLTGVFAVAPAFTGLASLWYGLVAGVLSAVFVACSVAVWRMREGDERMAPARKMFAYSIFYLFAVFSALLVDHYAASLLAHASGAL

SEQ ID NO: 5168 - protein, 316 aa, Rhizobium leguminosarum bv  trifolii WSM1325
MTVIDNHEVLAKDGELSEASARDYFELLKPRVMSLVVFTAFAGLVLAPGHIHPVLGLIAILCIAVGAGASGALNMWYDADIDAIMSRTANRPIPAGRIAPSEALAFGLVLSGFSVVILGLAVNWLSAGILAFTIFFYAVVYTMWLKRSTPQNIVIGGAAGAFPPMIGWACVTNSVTIESTVLFLIIFLWTPAHFWALALFKMRDYEAVGVPMLPNVAGERVTKHQIVAYAVLTAVCAVLPSFLGFASFGYGLVAAALGAIFIYCSIAVWRMPDGDLKMIPAKKLFGFSIFYLFAVFSALMIDRLASLLVSHAGGWF

SEQ ID NO: 5169 - protein, 305 aa, Wolbachia endosymbiont of Drosophila melanogaster
VLEILNVVLLLLLLTVTVFIVFSRHLVVSAVLMCVFSSLIALIYLIMNAPDVAITEASVGAGLSTVFTFAALSLIKNHKVNLSHNPITLFFMLFLAVCLSYFMIQLPDFGSHNAPIHLHVAPYYVENTEKATGIPNIVTAILASFRGYDTFGETIVVFTAALCITLILKEEKENDRSDIKCSNIFDDTFYHFIWFIHTISRLHSGWRFSSRNNYCLRDNIIFNAIWCIYNSKSNTLFCDIDRVRYFNLWRNGRCNNFTWPKFFILYLVNQNRSKIRYFFGGIRCSIYCLLLYVNYIYKFCSEKTM

SEQ ID NO: 5170 - protein, 982 aa, Thermobifida fusca YX
MIWLLVAHFTAAALAPALVRKWGRQAFFALALVPASAAIWALPRAPGVIAGEPELFFLPWAPNYQLALAFRMDALSLVMLLLAAGIGALILLYCARYFSDDEPGLGRFAGVLTGFAGAMIGLVLANDLIQLYLYWELTTVFSYLLIGHYPERRDNRRAAAMAINVTTMGGLTMLVGLVILGESAGTYLISGILAEPPSGTAVTVALVLILVGALSKSAIFPFSLWLPAAMQAPTPVSAYLHAAAMVKAGVYLIARLTPAFGDIPAWQYTAVILGTATMIGSGWRALRQHDLKLLLAHGTVSQLGFLTAIFGIGTRDAALAGLAMLCAHALFKAPLFLVVGIIDHSTGTRDLRELSGLRKKMPVVFWTSVVALMSMAGLPPMAGFAAKEAAFGAFEHADTLLATLALAGVVVGTLFTVGYSLRFLWGAFFDKENTSPTPLLHPPGPLFVAPAIVLAALSLLGGFGASLADPVFASYADTVPGAGHDPAHLALWHGFSLPLLLTALCLAGGLLLFRWRVMVAWLGARFALPEAGNVYRRIVYYLSSFATQVTGLTQRGSLPLYLGTILVSLLVVSTAPIVWGRLWTLDVPPVRWIDTPPQLIPAAIIIIAALWTLIVRGRLFAVVLVGMTGYGTATLFALHGAPDLALTQFLVETVSLVVFVLVLRRLPPQFSTPVLRSRRLVNLAIGIGSGILVAVMAYLTLAGRQAESISEGFPAAAEEAGGSNIVSVLLVDVRSWDTMGEISVLAAVAAGVASLLFVRRRTRLPHTHIETGRIVARLPQPPSNGESEWSPLPLTYVGDIITPRVAHKPLWLPGVLTLAQERRSIIFEVVARLMFPVIILISVFLLLTGHSHVGGGFAGGIVAGLGLMVRYLAGGRHELYLSLRLPPGLLIGLGLSITTGTALAGAIFGTEIFAGGAFDLHLPFLEPIHLTSALAFDFGVYVLVIGLIQDILYSLGAGIDEQAEKDSRTGKAPEYESEEVTA

SEQ ID NO: 5171 - protein, 311 aa, Ehrlichia chaffeensis Arkansas
MMLTDVNFIINVILSLFLVFVSSCLVLFKSLTVNVIMMCIFSFLMALLHLVMDAPDVAITEAAVGAGISTILMLVALSLIDTDEKQTCGNIKIFPIIVVLGVFVSLMYVIPDLPVFGDANSFANNHVASYYVKNTYSYMGIPNIVTAILASFRGYDTFGETVVIFTASLGISLLLAKDNHHVRSSVANSIYFNDTCYNFVWIVYSISWLSRWWFSGWCYCCICNYFTWYIIWIKGHFKSDITLYCQINWWYWYFDIWRYWYCIYVTWWISLVFYFGSSIGTKVRDISCRTRCGHDCVFYVDYFFFCIFLRI

SEQ ID NO: 5172 - protein, 334 aa, Shewanella sediminis HAW-EB3
MRTKDLLAVVMLTGIYGLLSASFFVVLDAVDVAFTEASVGAGISGLLMLAAITMTGRTEAPKRHKPLLALLVVFITGGMLIYGTLDMPYFGSFDAPVHQHVAPRYINDSMQEIGVPNIVTSVLASYRAFDTLGEVAVIFTAGIGVLSLLSLPLRRRSLQLGESSNESKKDQMHEQHMVLRIISKILIPFILLFALYVQFHGDFGPGGGFQAGVIFAAAIILYAMLFGLDTARRVFNQSLIQLIAAIGLLLYASVGVVSLFNGGNFLDYNVLADDPIAGQHLGILLIELGVGCTVAAVMIIIYFNFAGRREAQQQATEINSIELSFTKQNKGEGE

SEQ ID NO: 5173 - protein, 345 aa, Shewanella pealeana ATCC 700345
MLTGIYGLLSASFFVVLDAVDVAFTEASVGAGISGLLMLAAISMTGRTESPKRHKPLLALFVVLITGGMLIYGTMDMPYFGSFDAPIHQHVAPRYINDSMQEVGVPNIVTSVLASYRAFDTLGEVAVIFTAGIGVLSLLALPQRRKSYRLDEPKKEQMYQQHIVLRVISKALIPFILLFALYVQFHGDFGPGGGFQAGVIFAAAIILYAMLFGLDNAKRVFSLSLFQLLAAIGLLLYASVGVVSLFNGGNFLDYNVLADDPIAGQHLGILLIELGVGCTVASVMIIIFFNFAGRREAQQHSTKQNCHELISPELNRNVLNSTELNSTELNSAELSITVLNNGEVK

SEQ ID NO: 5174 - protein, 331 aa, Shewanella woodyi ATCC 51908
MVIAIAIVRTRDLLAVVMLTGIYGLLSANFFVVLDAVDVAFTEASVGAGISGLLMLTAITMTGRKEAPRRHKPFLALFVVLVTGSMLIYGTMDMPYFGAVDAPVHQHVAPRYIHQSMEEVGVPNIVTAVLGSYRAFDTLGEVAVIFTAGIGVLSLLSLPRRRRAVKSDEATVEQMHERHMVLRIVSKVLIPFILLFALYVQFHGDFGPGGGFQAGVIFAAAIILYTMLFGLETAKKVFNPSIIQLLAAVGLLIYACVGVVSMLNGANFLDYNVLADDPVAGQHIGILLIELGVGITVAAVMLSIFFNFDGRRQAQQHCTEQKGEHDVSRTL

SEQ ID NO: 5175 - protein, 356 aa, Desulfohalobium retbaense DSM 5692
MIWQIDLLVLTLVLICGFFSLRIKDLLSAAILYSAYSFMMCLLWAVMGAVDVAFTEAAVGAGASTVFFLAAIYRTTRRTKRLRKLALLSICISGLLLIYATGDFPSFGDPHSPAAEYLSPHYIEQTLEETSVPNIVSAVLADYRGYDTMFETVVVFSAALACFFLLRFRKASPRDRFYRHNLTGVVLHLTGDKKIPEGSVHFERIDSKWTPQTPIVRIVSRLLTPFLQLFGLYVIFHGHHSPGGGFQGGVILGASFLLLALSHDLRFVISRVGEKFLSIFNALGVMLYSGVGLICLGLGANFLDYSSLSAIMPVNEVAARSWGILFVEIGVGITVMASMILIYNNVASEGRWDEGL

SEQ ID NO: 5176 - protein, 384 aa, Ralstonia solanacearum
MIACWKHLAMALLLGSAAALASAQQPASVPAVAPANPAVQPAQPFANVVSESVFDLPRRDLAKEAQDQTARRVTQPGNNAPVWREVNSDQAGYASLPGLESGVLIQRTGQKWRLFRNGVITVWGGWLVVLVPLAILAFFLRRGQIRLKAAPTGRRIERFTPTERYVHWTMAISFVTLGVSGIAMLWGKHFLLPLMGHQLFGWLTYVLKNLHNLVGPLFTVSIVVAFVMWAHDNLPRRGDLQWLLRLGGMFGGHGAEVPSHRFNAGEKLWFWGGLVVFGLILSASGWVLDRIVPGVDYYRSTMQLAEIVHAIAAVGMICMSLGHIYIGTIGMEGAYRAMREGYVDEAWAKEHHVLWYDDIQAGRIPAQRSKPPEPPEAREQPAKG

SEQ ID NO: 5177 - protein, 398 aa, Ralstonia eutropha JMP134
MRPTQNPCRWLAASALAWLALAGSAALAQAPASAPPASAAAIAAQPADANDPATHPAQPLAGIASENIFNVPRRDIAGEARSQQERTVTQPGNNAPVWREVNSDQAHYSSLPAKEAGVLIQRTGQKWRLFRNGVITVWGGWLLVIVPLAILGFFAWRGTIPLREPRTGRMIERFTPIERIVHWTMAISFVLLGVSGIVMLFGKHFLLPIMGHTLFGWLSYLLKNIHNLAGPVFTLSIIVAFVIFVRDNLPSRDDVRWVTSLGGLASGKHVPSGRFNFGEKMWFWGGLVIFGLILSASGWVLDMIVPGLDYYRATMQIANVIHGIAAVLMIAMSLGHIYMGTIGMEGAYRAMRDGWVDEAWAREHHELWYDDIKSGKIPAQRSTTPEPGTAGRRTPGEA

SEQ ID NO: 5178 - protein, 401 aa, Polaromonas JS666
MKHARLAIFLMAVGFTGLTGAQTPATQPAPSAQASGVVTPAPAASASPAAAGGIQSQNIFQVKPDASADPKYAGQTNAERAKVQPGNNAPMWRQVGQGTTGYSSLPKSEAPEAGNLIQPFVQYPGSRLTNAGEAWRQVRNNWLIPYGGALLLIVALAIAIFYFSKGSIKTHGADTGRKIERFTPFERAAHWSNATAFVILAVSGLVMAFGKFFLLPVMGLTLFGWLTYALKNLHNFAGPLFAVSLLIVFVTFLRDNWPQKGDLNWLLKGGGLISGAEPASSRFNAGEKVIFWGGVFFLGVVVVSSGFVLDKLLPGLVYERATMQIAHMVHAVATVLMMCLFLGHIYIGTLGMQGAFKAMGTGYVDETWAKEHHEYWYDDVKAGKIPRQRSEPAPPGQTVQV

SEQ ID NO: 5179 - protein, 401 aa, Acidovorax sp. JS42
MKHLLCALLLASGAAWAQAPAAPASDAAAPAAADAAPVPAAVGAVKSQNIFDVKPDASEEPGYAQQTNGERAKVQPGNNAPMWRQVRDGVTGYSSLPASQAPEAGNLIQPFAQYPGSRYTTAGQAWREVRNNWIIPYGAALLGITVLALAIFFVTKGTLGHADAEAGGRRIERFTPFERAAHWSNAIAFVTLAITGILMAFGKFFLLPVLGAQLFGWLAYAAKNVHNFMGPLFAVSLTVIIVTFIKDNIANRADFVWLSKAGGMFTNKEVPSHRFNAGEKGMFWWGITIPGVFVVLSGLVLDKLIPGWGLLRGEMQIAHMVHATLALWMMALLLGHIYMGTIGMRGAYKAMKTGYVSEAWAREHHELWADDVRSGKIPAQRSGAATAAQTTPSHPAVGGTS

SEQ ID NO: 5180 - protein, 390 aa, Polaromonas naphthalenivorans CJ2
MRQAQLALFLIAACLAGAAGAQAPAPAASSPSVVAPAAVGGIQGQNIFEVKPDASEIPGYASQTNGERARVQPGNNAPMWHQVGAGATGYSSLPKAQAPEAGNLIQPFVQYPGSRLTNAGEAWRQVRNHWLIPYGGALLLIVLGAIALFYMGKGSIKLHGAKTGRRVERFTPFERSAHWANAIAFSILAISGIVMAFGKFFALPVMGGMLFGWLAYALKNLHNFAGPVFVVSLLIVFFTFVRDNLPSRGDLRWLLQGGGMFSGKEVPSHRFNAGEKLVFWGGVFFLGMVVVASGLVLDKLLPGLVYERGTMQIAHMVHAVATVLMMAMFTGHIYMGTIGMEGAYEGMRTGYVDETWAKEHHEFWHDDIKAGRIPAQRSEPAPPASPAVQA

SEQ ID NO: 5181 - protein, 388 aa, Methylibium petroleiphilum PM1
MTHTMLRWWAAGCLAWLGSVAVAQGTPVADPAVSPVAQAAPTAPAASAAALALPDANETNAQRAKTQPYNNAPFWRAVRESGQQSGISNLPGAEKGVLIQQFVQYPGSRFTTAGEAWREVRNRWIIPYGGALLLIVVVAIGLFFLAKGPIGVHAPDTGRKIERFTYFERAAHWSNAVAFVALAVSGVVMAFGKFFLLPVIGGTLFGWLAYALKNLHNFAGPVFAVSLVIVFFTFVRDNLPRKEDLLWLAKGGGLFNGAHVPSHRFNAGEKLIFWGGVFALGIVVVGSGLVLDKLIPGLAYTRGDMQIAHMIHAVATVLMMAMFLGHIYLGTIGMKGAYRAMRDGQVDAAWAREHHELWYDDIQAGKIPAQRTPSPTPAAGTQGAAVQS

SEQ ID NO: 5182 - protein, 353 aa, Polynucleobacter necessarius asymbioticus QLW P1DMWA 1
MKRSFSKVLRTLIVAAGLSLALASGMSLAERAPMAPLPSASGVDISPSSIPANPNALANGTQAQSQPANPSIFIAPNSDPQNYVSIPDKQAGVLIQRAGQQWRVIRNGIITVYGGWLLAIAFFGIAGVYTLKGSVKLHEPLSGVMIKRFSGFDRLVHWVMAFSFLALAFTGLMILFGKYFAMPLMGGVAYGSFLMVCKNIHNFTGPLFTLSIVIFFLLFVGKNIPEKGDLQWMLTFGGMFSGKHVPAGFFNMGEKFWFWFGMTFLGLLISASGFVLDMIVPFMQIEYLRGTMQIANMIHSSAAILMTAMAMGHIYIGTIGMQGSIDGMKTGYVDATWAKEHHEIWYNKVDKKG

SEQ ID NO: 5183 - protein, 384 aa, Leptothrix cholodnii SP 6
MQDILRHLTRSVVLAVLLAGGLAAPVLAQQAVSAGASAPAGFVVQAEPKPDETNAQRAQTQPGNNAPFWRSVRESGEQAGYSSLPGVERGTLIQSFVQYPGSRYATAGEAWRQVRNNWIIPYGGALLLIVAVAIAIFYWRVGALGGHIPDTGRKVERFTPFERAAHGVNAVAFTVLAISGIVMAFGKFFLLPILGGLVFGWLTYVLKTLHNFAGPLFAVSLLVVIVTFVRDNLPRKGDLNWMLRMGGLFGDHEVPSHRFNAGEKLVFWGGVFALGLIVVASGLVLDQLVPSLDYTRGQMQIAHMVHGVATALMMAMFIGHIYMGTIGTRGALDGMRTGQVDEAWAQEHHELWYDDIKAGRIPAQRSGGAAPASAPTGGAAGAHT

SEQ ID NO: 5184 - protein, 387 aa, Ralstonia pickettii 12J
MGTSWKHLVMAVLLGGAAAWASAQQPASAPAANHAPVNPAVQTAQPFSNIVSENVFDLQKRDLAKEAQDQAARRATQPGNNAPVWREVNSDQAHYASIPGLEAGVLIQRTGQKWRLFRNGVITVWGGWLMVLVPSAILAFFLWRGMIPLKEAPTGRKIERFTPTERYVHWTMAISFVTLGVSGIVMLWGKHFLLPILGHQLFGWLTYLLKNLHNLVGPLFTVSIIVAFVIWVRDNLPRQGDVKWLLSLGGMFAGEHGAEVPSHRFNAGEKLWFWGGLVVFGLILSASGWTLDRIVPGVDYYRSTMQLAEVIHAIAAVGMMSMSLGHIYMGTIGMEGAYRAMRDGYVDEAWAKEHHELWYDDVKAGKIPAQRSQPPAPPAPSEQPAKS

SEQ ID NO: 5185 - protein, 401 aa, Diaphorobacter TPSY uid29975
MKHLLCALLLASGAAWAQAPAAPASDAAAPAAAVAAPVPAAVGAVKSQNIFDVKPDASEEPGYAQQTNGERAKVQPGNNAPMWRQVRDGVTGYSSLPASQAPEAGNLIQPFAQYPGSRYTTAGQAWREVRNNWIIPYGAALLGITVLALAIFFVTKGTLGHADAEAGGRRIERFTPFERAAHWSNAIAFVTLAITGILMAFGKFFLLPVLGAQLFGWLAYAAKNVHNFMGPLFAVSLTVIIITFIKDNIANRADFVWLSKAGGMFTNKEVPSHRFNAGEKGMFWWGITIPGVFVVLSGLVLDKLIPGWGLLRGEMQIAHMVHATLALWMMALLLGHIYMGTIGMRGAYKAMKTGYVSEAWAREHHELWADDVRSGKIPAQRSGAAPAAQTTPSHPAVGGTS

SEQ ID NO: 5186 - protein, 408 aa, Variovorax paradoxus S110
MKQALTALALCCAVLGTAFAQAQPPAAPGTASAPAAPAATAAPEAAVGGIRGQNIFEVKPEASADPNYANQTNGERMKVQPGNNAPMWRQVGQGVTGYSSLPKSQAPEAGNLIQPFVQYPGSRLTNAGEAWRQVRNDWIIPYGAALLFVVLLALAIFYFTRGPIRLHGQETGRKIERFTPFERATHWSNAIAFVTLAITGIVMAFGKFFLMPWMGSALFGWIAYALKNVHNFVGPLFVVTTVFMVFTFIRDNLPRASDLQWLARFGGLFGGKEVPSHRFNAGEKLVFWGGVLFLGLFIIGSGLFLDKLLPGFVYTRGEMQVAHMVHGVATLLMMAMIMGHIYIGTLGMTGAYKAMRTGYVDETWAREHHELWYDDIAAGKIPAQRTAPAGSAAAPAARPVRPAEGTPS

SEQ ID NO: 5187 - protein, 387 aa, Ralstonia pickettii 12D
MGTSWKHLVMAVLLGGVAALASAQQPATAPAANTAPVNPAVQPAQPFSNIVSENVFDLQKRDLAKEAQDQAARRATQPGNNAPVWREVNSDQAHYASIPGLEAGVLIQRTGQKWRLFRNGVITVWGGWLMVLVPSAILAFFLWRGMIPLKEAPTGRKIERFTPTERYVHWTMAISFVTLGVSGIVMLWGKHFLLPILGHQLFGWLTYLLKNLHNLVGPLFTVSIIVAFVIWVRDNLPRQGDVKWLLSLGGMFAGEHGAEVPSHRFNAGEKLWFWGGLVVFGLILSASGWTLDRIVPGVDYYRSTMQLAEVIHAIAAVGMMSMSLGHIYMGTIGMEGAYRAMRDGYVDEAWAKEHHELWYDDVKAGKIPAQRSQPPAASAPSEQPAKS

SEQ ID NO: 5188 - protein, 62 aa, Methanosarcina barkeri fusaro
MEQRKCYFCGKMLEPGTGKLYVKKDGSTYYIHSSKCMSNFNLGRLPRRTEWTEKGKIQLKKA

SEQ ID NO: 5189 - protein, 63 aa, Methanospirillum hungatei JF-1
MIDTHICSFCGLQMEPGTGKMYVKKDGQIFYYCSTKCQKNHKLGRIPRRVRWTTAGRKALGKV

SEQ ID NO: 5190 - protein, 62 aa, Methanococcoides burtonii DSM 6242
MEQRKCSFCGELLEPGTGLLFAKRDGSTYYFCSSKCKGNFDLGRLPRRTVWTEQGRIYLKKA

SEQ ID NO: 5191 - protein, 56 aa, Methanosaeta thermophila PT
MEERRCSFCNTRITPGTGKLYAKKDGTVYYFCSSKCEKNMRLGRVSRKIKWARKGA

SEQ ID NO: 5192 - protein, 58 aa, Pyrobaculum islandicum DSM 4184
MKIYKCAFCGADILPGYGIMYVKTDGTTLRFCSRKCFVSAVKFKRDPRRLAWVRKRQK

SEQ ID NO: 5193 - protein, 63 aa, Methanocorpusculum labreanum Z
MVDTYTCSYCGKQLEPGTGKLFVRKDGAVFYFCSSKCQSNYNLGRIPRRVAWTAAGRKARGKE

SEQ ID NO: 5194 - protein, 63 aa, Methanoculleus marisnigri JR1
MVDKYVCNFCGEVLEPGTGKMFVKKDGTILYFCSTKCQNNYRLGRVPRRVEWTAAGRKARGKE

SEQ ID NO: 5195 - protein, 62 aa, Methanococcus maripaludis C5
MEWKTCSFCEGTIEPGCGKKYVKKDGSVMHFCSSKCEKNFKLGRVGRKLKWTNTFKRINRGQ

SEQ ID NO: 5196 - protein, 65 aa, Pyrobaculum arsenaticum DSM 13514
MKIYQCAFCGADIPPGYGIMYVKSDGTVLRYCSRKCFVSATKYGRNPRKLAWVRKLQRKQKQSTS

SEQ ID NO: 5197 - protein, 61 aa, Metallosphaera sedula DSM 5348
MVVSHKCSFCGGDIPPATGMMHVRNDGTILWFCSNKCRKYMLKYHKDAKKLKWTTSYSRVR

SEQ ID NO: 5198 - protein, 62 aa, Methanococcus vannielii SB
MEWKTCSFCEGKIEPGCGKKYVKKDGSVMQFCSSKCEKNFKLGRVGRKLKWTNMFKRMNKGQ

SEQ ID NO: 5199 - protein, 64 aa, Methanococcus aeolicus Nankai-3
MEWKTCNFCGKSIEPGTGKKFVKKDGSVMFICSSKCEKNYKLKRVARKLRWTPIYYNNKHSNKK

SEQ ID NO: 5200 - protein, 62 aa, Methanococcus maripaludis C7
MEWKTCSFCEGTIEPGCGKKYVKKDGSVMHFCSSKCEKNFKLGRVGRKVKWTNTFKRINRGQ

SEQ ID NO: 5201 - protein, 63 aa, Candidatus Methanoregula boonei 6A8
MVEQHICSFCGEPLEPGTGKMFVKRDGTIFYFCSTKCQNNHKLGRVPRRVEWTTAGQKGTNKE

SEQ ID NO: 5202 - protein, 62 aa, Methanococcus maripaludis C6; identical to SEQ ID NO: 5195

SEQ ID NO: 5203 - protein, 66 aa, Nitrosopumilus maritimus SCM1
MSLLVKPCNFCNRPVAKGSGTMLAKNDGTVLWFCSAKCKKNALELKRDPRKFKWTKKYVKGGIRKK

SEQ ID NO: 5204 - protein, 58 aa, Thermoproteus neutrophilus V24Sta
MKIHKCSFCGAEIPPGYGIMYVRNDGTIQRYCSRKCFVSATKYGRNPRKLAWVRKRQK

SEQ ID NO: 5205 - protein, 62 aa, Halorubrum lacusprofundi ATCC 49239
MVETRTCDYTGEEIEPGTGTMYVKTNGQILHFVDSKAEKNYFLGREARDLEWTEEGRNQGGE

SEQ ID NO: 5206 - protein, 139 aa, Halorhabdus utahensis DSM 12940
MPQTRECDYCGADIEPGTGTMFVRKNGTTIHFCSSKCEKNADLGREARDLSWTEAGRGTGGDAAAEQQTDTADADEQAETENEDEAAEDAAAADDADEAEDEVEADEAEDEVDADDESDAEADADAEETDTEEPTEADA

SEQ ID NO: 5207 - protein, 63 aa, Candidatus Methanosphaerula palustris E1 9c
MVEMHTCTFCGEGLEPGTGKMFVRRDGSIYYFCSTKCQNNFKLGRAPRRVAWTKAGRKALGKE

SEQ ID NO: 5208 - protein, 143 aa, Halomicrobium mukohataei DSM 12286
MPRIRECDYCGADIEPGTGTMFVRKSGTTIHYCSSKCENNADLGREARNLEWTEAGRETTAAEQKAAAEAEAAAEAADEQTADEADADEDESAETDEAADEDESAETDEAADEDESAETDEAADEDEAESTEADDEETEEAEA

SEQ ID NO: 5209 - protein, 83 aa, Brucella suis 1330
MSTSARLRKHSVSIRGHATSYTLEDPFFKIIEEIAAARNMTVAALVAEIDSRRERTINLSSALRLHVLDWLKSKLPESNSCPP

SEQ ID NO: 5210 - protein, 84 aa, Nitrobacter winogradskyi Nb-255
MKSPVVKRSIVVAGHKTSVSLEEAFWNGMKEISSHRDMTLSELVGEIDSNRQQGNLSSAIRLFVLDYFRSRAATSGPENSPSLG

SEQ ID NO: 5211 - protein, 94 aa, Rhodopseudomonas palustris HaA2
MKSPVVKRSIVVAGHKTSVSLEEAFWNGMKEISGVRDMTLSELVGEIDGNRQQGNLSSAIRLFVLDYFRSRAMQQPQQPQPVVEAKVDSSIVAH

SEQ ID NO: 5212 - protein, 87 aa, Rhodopseudomonas palustris BisB18
MKSPVVKRSIVVAGHKTSVSLEEAFWNGMKEISGLRDMTLSELVGEIDSNRQQGNLSSAIRLFVLDYFRTRAVQPMPEVKTESLAAH

SEQ ID NO: 5213 - protein, 91 aa, Rhodopseudomonas palustris BisB5
MKSPVVKRSIVVAGHKTSVSLEEAFWNGMKEISGVRDMTLSELVGEIDGNRQQGNLSSAIRLFVLDYFRSRALQQQQPAVEAKVDSSLVAH

SEQ ID NO: 5214 - protein, 84 aa, Nitrobacter hamburgensis X14
MKSPVVKRSIVVAGHKTSVSLEEAFWNGMKEISSLRDMTLSELVGEIDSNRQQGNLSSAIRLFVLDYFRSRAMAAESENSPSAG

SEQ ID NO: 5215 - protein, 73 aa, Rhodobacter sphaeroides 2 4 1
MNGRPEKHSLTLKGHRTSVSLEADFWRAFREIAAERGLPLNALAAEVDEARDPEVGLASALRVFVLRHYRTGR

SEQ ID NO: 5216 - protein, 91 aa, Paracoccus denitrificans PD1222
MATNDPPAAGPLPLPLPPMSAPSKRSVTIGGHRTSVSLEDAFWRELRELARAGGRTTATLIAEIDAARPPEVGLATALRLFVLAEIVKNRA

SEQ ID NO: 5217 - protein, 73 aa, Rhodobacter sphaeroides ATCC 17029
MNGRPEKHSLTLRGHRTSVSLEADFWRAFREIAAERGLPLNALAAEVDEARDPEVGLASALRVFVLRHYRTGR

SEQ ID NO: 5218 - protein, 72 aa, Rhodobacter sphaeroides ATCC 17025
MRPEKHSLTLRGHRTSVSLEEDFWRAFREIAAERGLPVNALAAELDEGRDPEVGLATAIRLFVLRHYRDRRV

SEQ ID NO: 5219 - protein, 95 aa, Bradyrhizobium BTAi1
MKSPVVKRSIVVAGHKTSVSLEEAFWNGMKEISGLRNMTLSELVGEIDSNRQQGNLSSAIRLFVLDHFKNRAAGTPAGEPKATVDSRHTASAAAP

SEQ ID NO: 5220 - protein, 83 aa, Brucella ovis; identical to SEQ ID NO: 5209

SEQ ID NO: 5221 - protein, 84 aa, Sinorhizobium medicae WSM419
MNPFASKGKVVKHSATLHGHRTSFTLEEPFWQELKAIAKDRDMPLARLIAEIDDGRGQEGNLSSALRVYVLAWVKARADATGGA

SEQ ID NO: 5222 - protein, 78 aa, Ochrobactrum anthropi ATCC 49188
MNSSGGLRKHSVSIRGHATSYTLEDPFFELVEEIAATRELSVAALIAEVDSKRDRSINLSSALRLHVLDWLKSRIIQG

SEQ ID NO: 5223 - protein, 79 aa, Methylobacterium extorquens PA1
MTRAPLRENAKRSVMIAGHRTSVSLEAEFWTALQEIAQARGQSVQALIGAIDSERGARNLSSAIRVFVLGAFRDERAPS

SEQ ID NO: 5224 - protein, 74 aa, Methylobacterium radiotolerans JCM 2831
MSAGITKRSVMIAGHRTSVSLEDPFWAALRAIAEARGQSVQALIGHIDAGRDGQNLSSAIRVFVLEAVRAMPET

SEQ ID NO: 5225 - protein, 87 aa, Beijerinckia indica ATCC 9039
MQDVPSHKAASPTPASIIKHSVTIAGHATSISLESAFWDALKEIAEARTLSVAALIAEIDAARVESSPSRKNLSSAIRVYILRTVRK

SEQ ID NO: 5226 - protein, 103 aa, Methylobacterium populi BJ001
MTLGPLRENAKRSVMIAGHRTSVSLEAEFWSALQEIARARGQSVQALIGAIDSARGERNLSSAIRVFVLGAFRGASAPSESTLADGAGIGQGVQEPGGGMGEA

SEQ ID NO: 5227 - protein, 92 aa, Rhodopseudomonas palustris TIE 1
MKSPVVKRSIVVAGHKTSVSLEEAFWNGMKEISSVRDMTLSELVGEIDSNRQQGNLSSAIRLFVLDYFRSRALQAQQQAVADTKTESSLTAH

SEQ ID NO: 5228 - protein, 82 aa, Methylobacterium sp. 4-46
MTGSAAGLRKRSVMIAGHRTSVSLEDPFWEALQRLARARGLSVPALIGRIDAGRAGQNLSSAIRVFVLRALQEEAGGPEAPT

SEQ ID NO: 5229 - protein, 74 aa, Rhizobium leguminosarum bv  trifolii WSM2304
MIRKHSATLHGHRTSFSLEDEFWDELKVIAASRSMPLAALISEIDDHRPPDSNLSSALRLHVLAWAKAAAGRGL

SEQ ID NO: 5230 - protein, 86 aa, Methylocella silvestris BL2
MSAAPLDEGARDLRSNVKHSLTIAGHRTSISLERAFWERLKRIAAERGSSLAACVAEIDAARGSANLSSAIRVYILQSALSPEAGE

SEQ ID NO: 5231 - protein, 103 aa, Methylobacterium chloromethanicum CM4
MTRAPLRENAKRSVMIAGHRTSVSLEAEFWTALQEIAQARGQSVQALIGAIDSERGARNLSSAIRVFVLGAFRDERAPSERPLADRAGIGQGVQETGGGMSEA

SEQ ID NO: 5232 - protein, 88 aa, Methylobacterium nodulans ORS 2060
MTGAPEGLRKRSVMIAGHRTSVSLEGPFWEALQQLAAARGLSVQALIGRIDAGRAEQNLSSAIRVFVLREVQAAQTAEPLSRVGEGQG

SEQ ID NO: 5233 - protein, 80 aa, Agrobacterium vitis S4
MAQSMPLIRKHSISLHGHRTSFSLEDAFWQEIRAIAENRNVAIAALIADIDSKRPADCNLSSALRLYVLEWLKQSGSDSH

SEQ ID NO: 5234 - protein, 74 aa, Rhizobium leguminosarum bv  trifolii WSM1325
MIRKHSATLHGHRTSFSLEDEFWTELKTIAAARSILLAALISEIDDHRPPDSNLSSALRLHVLSWLKAGASHQP

SEQ ID NO: 5235 - protein, 311 aa, Rhodopseudomonas palustris BisB18
MRVLITGARGFIGRHVLRRLEADPRVTEIHATQSRRRDSDNGQARTVWHSLDLLQPDAAHALCLKLRPTHVLHAAWITAHNDYWGSPENLAWLAASCDLLRAFAASGGERFVQIGTAAEYDWSYGCMVEGVTPERPNTLYGSAKKSFHDVLQAASAKLGLSAATGRVFFGYGPYENAGRIIPYACRQLALGQPAEFSSGAAWRDFLYIEDLAAAAVALLNSPLEGAVNLASGDPIQLRRIVELIGEISGRAELIRLGARPDREGDPAMIVASPTLIRSTGWQPSYSLRRGLETTYAWWASEVARADADGRR

SEQ ID NO: 5236 - protein, 284 aa, Pelobacter propionicus DSM 2379
MKILLTGATGFVGSHVIRRLIERGHNVTVVVRDQTKILSCPLLRDTDIICGDILEPAFVLKVPPDSFDAVMHLAWPYLPDYYSMRHLEAAFPASFQFLKLLIQLGVRQVLVTGTCFEYGLRNGPLSEEMDTHPVTPYALSKDILRRALEMLQKDIQFTLQWARPFYMYGTGQNPCSLLAQLDASIERGDKVFNMSDGEQLRDYLAVETVAGHLAELVERPQFDGILNICSGTPISVRRLVEERISVRGAAIRLNLGHYPYPAHEPMAFWGDATKMSKTLAPSSH

SEQ ID NO: 5237 - protein, 309 aa, Prochlorococcus marinus MIT 9515
MKNLVFILGSNGYVGSALVKKFISKDNFVIGLGRSETSRQYKEKYIKDSNFHYFSLKDKNILSIKSQIKDYVSEFNMNSIFINSAWHGDKSLSDGNLSEQIANIYLSNDAIKLATEIRCDKFLYIGSVFENYIDKFTNSNWYEHKYNFKDQLNYSLAKNICRDFNRLVSYLQKIEYIHCSFSVFIDQDLSGKGYIPSTLKKISKGLEYSEPENKELFDITLLDEGCEAIYLLSQKAKINKNYYIGTSFPKTLKDIFITFEEAKLKKHKSHEILYESPYNDLFCINNLEKDIGYKPTKTFNKFSFEFFNK

SEQ ID NO: 5238 - protein, 282 aa, Methanocorpusculum labreanum Z
MKILVTGSTGFVGRHVVQWLVDHGYEDVVATGTSVEKAKEFPWFSKVKFIPCDYFAEDINYHKFFDRPDLLIHLAWKNLPNYMERFHMEENLPVEMRFLRSFAASNMTKIAAIGTCYEYGVVNGCISEDHPTNPNTIYAAAKDTLRRYLAFLGAESGISWNWIRLFFLYGEGQSPKSLLPQLDAAIARGDPDFPMSGGEQLRDYLPVEKVAEYICRIALSKESGVVNCCSGAMISVRRLVEERVAASGSSIRLKTGVYGYPAYEGMAFWGDNTQLREVIGDA

SEQ ID NO: 5239 - protein, 346 aa, Methylobacterium extorquens PA1
MKRVLVTGGAGFVGRHAVAALAARGFEVHAIGRTAPEGAHAFHAADLLDPVQRRAVVQAASASHLLHLAWITTPGRYWQAPDNLDWTAASLDLVRTFREAGGTRAVVAGTCAEYDWTGINLLPRAELESPSPRTRGKGFGEPVVATLSPQAGRGDAAAIQEGHLAEAAPCRPATLYGAAKDGLRLILQAYAATAGLSLGWGRLFYLYGPGETPGRLVGDAARALLTGQRLATSEGRQRRDFLHAADVGAAFAALLDSGVEGPVNIGSGEAVPVRRILETIGALTGRPDLIDFGARPLGPAEPARIEADIRRLTDEVGFSARYGLEQGLEQTVAAWRAALSNAASIP

SEQ ID NO: 5240 - protein, 315 aa, Methylobacterium populi BJ001
MKRVLVTGGAGFVGRHAIPALAARGFEIHAAGRTEPEGVHAFHAADLLDPGQRRAAVQRAGASHLLHLAWVTTPGRYWQTPDNLDWTAASLDLVRAFRETGGRRAVVAGTCAEYDWTTIARLGEATAAGTGHLPESAPCDPATLYGAAKDGLHRILASYAASAGLSLAWGRLFYLYGPGETPGRLVGDAARALLAGQRLATSEGRQRRDFLHIADAGAAFSALLDAPVEGAVNIGSGTAVSVRSILEEIGARTGRPDLIDFGARPLGPAEPACIEADIRRLADEVGFCPRYGLKRGLAETVASWRAALSNGASGP

SEQ ID NO: 5241 - protein, 302 aa, Cyanothece PCC 8801
MKKVLVTGATGFIGRHCLPLLLSRDYEVHGLYLKSPPDNFLAVQWHKANLLDSEQVTVLMAKIKPTHLLHFAWFAVPGKYWSSLENFLWVQASLHLLQTFVNHGGERIVMAGTCAEYDWQYGYLSERTTPLISDTVYGTCKHSLQILLNTFAQKVSISSAWGRIFFVYGPHEYPQRLVASVIRSLLTGEIARCSHGNQIRDFLFVQDVADAFIALLDSQVKGVVNIASGFPIALKDVIYNIASQLNRENLIQLEAIPTTPNEPRLLVADVGRLFEEVGWRPQYNLAHGLQVTIDWWEQQLTQ

SEQ ID NO: 5242 - protein, 346 aa, Methylobacterium chloromethanicum CM4
MKRVLVTGGAGFVGRHAIAALVARGFEVHAIGRTAPEGVHAFHATDLLDPAQRRAAVQAASASHLLHLAWITTPGRYWQAPDNLDWTAASLDLVRTFREAGGNRAVVAGTCAEYDWTGINLLPPAELESPSPRTRGMGFGDPVVATLSPQAGRGDAAAIREGHLAEVAPCCPATLYGAAKDGLSRILQAYAATAGLSLGWGRLFYLYGPGETPGRLVGDAARALLAGQRLATSEGRQRRDFLHVADVGAAVTALLDSEVEGPVNLGSGEAVPVRRILETIGALTGRSDLIDFGARPLGPTEPACIEADIRRLTDEVGFSPCYGLEQGLEQTVAAWRAALSNAASIP

SEQ ID NO: 5243 - protein, 306 aa, Desulfomicrobium baculatum DSM 4028
MSERVLVTGGSGFVGLPLVAALAAEGAWVEALGCRNVGPELPGVRWHRVDLHHSGDVRLLLRELRPAVLVHCAWNVEHGRFWSAPDNRVWLDVSFELAMRFFETGGRRFVGIGTCAEYASQDLNDNMPWSESRKIDPCTLYGQSKAELWRRLLALAERRPGAQASWARLFHLFGAGEHPERLVSSIIRSVLAGREACCGSGRLVRDFSSVWFVAGALAALARSRVTGPVNVGCGQPRSIAALSRQVARFAGRPDLLRLGALPDRPNDVPVMVADTKRLRLEVGHSQRPVIEDDLRRLISLYRLQNS

SEQ ID NO: 5244 - protein, 302 aa, Cyanothece PCC 8802
MKKVLVTGATGFIGRHCLPLLLSRDYEVHGLYLKSLPDNFLAVQWHKANLLDSEQVTVLMAKIKPTHLLHFAWFAVPGKYWSSLENFLWVQASLHLLQTFVNHGGERIVMAGTCAEYDWQYGYLSERTTPLISDTVYGTCKHSLQILLNTFAQKVSISSAWGRIFFVYGPHEYPQRLVASVIRSLLTGEIARCSHGNQIRDFLFVQDVADAFIALLDSQVKGVVNIASGFPIALKDVIYNIASQLNRENLIQLEAIPTTPNEPRLLVADVGRLFEEVGWRPQYNLAHGLQVTIDWWKQQLTQ

SEQ ID NO: 5245 - protein, 165 aa, Jannaschia CCS1
MSMHAPLASPTQTGFLAGYLESLAMVERLHRLLLDVIKDEFERLGVLDINAVQALLLFNIGDNEVTAGELKSRGYYQGSNVSYNLKKLVDMGYMHHQKCEIDRRSVRVRLTEKGRHVRDTVDGLFERHSEGLEKQGVMSADGVDRLNHSLKRIERFWSDQIRYIY

SEQ ID NO: 5246 - protein, 165 aa, Ruegeria sp. TM1040
MSMERPISQLDRKGFMTGYLDALALVERLHRLLLDVIKDEFERVGVLDINAVQALLLFNIGDNEVTAGELKTRGYYQGSNVSYNLKKLVEMGYMHHQRCEIDRRSVRVRLTPRGREIRDIVASLFSRHAEGLETKGVISAEGIEDITGSLKRMERYWSDQIRYIY

SEQ ID NO: 5247 - protein, 169 aa, Rhodobacter sphaeroides 2 4 1
METGMTVHAGILDGTQKAFLLGYLESLSLVERLHRLLLDVVKDEFERIGLLEINPVQALLLFNVGDNEVTAGELKTRGYYQGSNVSYNLKKLVELGYMHHQRSEIDRRSVRVRLTDKGRHVRQVLSDLFARHAEGLERRNVVGVSGMEDLNQALRRMERYWTEQIRYIY

SEQ ID NO: 5248 - protein, 172 aa, Paracoccus denitrificans PD1222
MQQRSSAQTVPALRPPPPQTDRTEAYLESLQILERLHRLLLDLVKDEFERLGRSDLTPVQALLIYNLGTSEVTAGELRSRGMYQGSNVSYNLKKLVELGYVHHERCDMDRRAVRVRLTQAGQEVRDCVAQLFARHAEGLDLSGVLDDPPIEAVNLQWRRVERFWAEQIRYIY

SEQ ID NO: 5249 - protein, 165 aa, Rhodobacter sphaeroides ATCC 17029
MTVHAGILDGTQKAFLLGYLESLSLVERLHRLLLDVVKDEFERIGLLEINPVQALLLFNVGDNEVTAGELKTRGYYQGSNVSYNLKKLVELGYMHHQRSEIDRRSVRVRLTDKGRHVRQVLSDLFARHAEGLERRNVVGVSGMEELNQALRRMERYWTEQIRYIY

SEQ ID NO: 5250 - protein, 165 aa, Rhodobacter sphaeroides ATCC 17025
MTVHAGILDGSQKAFLLGYLESLSLVERLHRLLLDVVKDEFERIGVLEINSVQALLLFNVGENEVTAGELKSRGYYQGSNVSYNLKKLVELGYMHHQRSEIDRRSVRVRLTEKGRTVRGILSDLFSRHAEGLERRGIVGPAGMEDLNQALRRMERYWTEQIRYIY

SEQ ID NO: 5251 - protein, 165 aa, Dinoroseobacter shibae DFL 12
MSLHARLEDAPDLGVLTGYLESLSLVERLHRLLLDVIKDEFERVGVLEINAVQALLLYNIGDNEVTAGELKSRGYYQGSNVSYNLKKLVEMGYMHHQRSEIDRRSVRVRLTEEGHKVRRVVGDLFARHASGLESKGVLGRESLEEINTALRRMERYWADQIRYIY

SEQ ID NO: 5252 - protein, 261 aa, Brucella suis 1330
MKDAAKTASWLDLANPTRFLAFAGRVVPWLGLASAIFLAVGLYMVFLSPDDYQQGSTVRIMYIHVPFAWLSMMCYSIMAVSSLGTLVWRHPLADVSVRAAAPIGAVFTALALATGSLWGKPMWGTWWVWDARLTSVFVLFLMYLGIIALSRAMDDPARSAKPVAVLTLVGFINVPIIKFSVDWWNTLHQPASVFRLDGPTIDGSMLRPLFVMAIGFTLLFFTLHMMAMRNEIWRRRVASMKKLAARNVDRNRAGQVEEGAL

SEQ ID NO: 5253 - protein, 243 aa, Nitrobacter winogradskyi Nb-255
MSLIDLANPSRFLTLAGRILPWLVAVTALVLAVGLYQSAIAPDDYQQGATVKIMFIHVPNAWLSMFVWGVMSVAALGTLVWRHPLADVAAKTAAPIGAAFTFLALLTGSLWGRPMWGTYWEWDARLTSVLILFLMYLGLMALWRAVEDPSRAARAAAVLTLVGSVNIPIIKFSVDWWNTLHQPASVVRMGGSTLDRAFLIPLVVMAIGFTLLFLTLHIAAMRNEILRRRVRTLQMLQASKSVA

SEQ ID NO: 5254 - protein, 250 aa, Rhodopseudomonas palustris BisB18
MTLIDLANPTRFLKLTERVLPWLTGLTALLLAIGLVQSALAPDDYQQGATVKIMFVHVPNAWLAMFVWGIMSLSALGTLVWRHPLADVAAKAAAPIGAAFTFLALVTGSLWGRPMWGTYWEWDARLTSMLILFLMYLGLIALWRAVEDPSRAARAAAIFTLVGAINLPIIKFSVDWWNTLHQPASVLRVGGPALDKSFLMPLLVMAIAFSLLFITLHLAAMRNEILRRRVRALQMLQASEQQGQLRSGAL

SEQ ID NO: 5255 - protein, 244 aa, Rhodopseudomonas palustris BisB5
MTLTELANPTRFLSLAGRLLPWLAGATALLLTVGLVLAMLAPDDYQQGATVKIMFVHVPNAWLAMFVWGVMSLASLGTLVWRHPLADVAAKTAAPIGAAFTFLALLTGSLWGRPMWGTYWEWDARLTSMLILFLMYLGLIALWRAVEDPSRAARAAAVLTLVGAINLPIIKFSVDWWNTLHQPASVMRMSGPALDKAFLSPLLVMAVGFSLLFLTLHVAAMRNEILRRRVRTLQMMQASRAEAA

SEQ ID NO: 5256 - protein, 243 aa, Nitrobacter hamburgensis X14
MTLIDLANPSRFLALAGRILPWLVAVTVLVLAIGLYQSATAPDDYQQGATVKIMFIHVPNAWLSMFVWGVMSIAALGTLVWRHPLADVAAKTAVPIGAAFTFLALLTGSLWGRPMWGTYWEWDARLTSVLILFLMYLGLMALWRAVEDPSRAARAAAVLTLVGSINIPIIKFSVDWWNTLHQPASVIRMGGSTLDRAFLIPLLVMAIGFTLLFLTLHIAAMRNEILRRRVRTLQMLQASKSAA

SEQ ID NO: 5257 - protein, 256 aa, Mesorhizobium BNC1
MNEKTVRRWTDIANPTRFLELAGAVLPWLWGATVLVLAAGLTMAFTAPEDYQQGITVRIMYVHVPFAWLSMLCYTVMAGSALGTLVWRHPLADVSLKAAAPIGAVFTALALATGSIWGKPMWGTWWVWDARLTSVFVLFLMYLGIIALTRALDDPGRSARAAAILTLVGFINIPIIKFSVDWWNTLHQPASVFRLDGPTIHPSMLWPLLVCAVGFTLLFLALHLMAMRTEIWRRRVIAMRRLSARAAEIKPLEAAR

SEQ ID NO: 5258 - protein, 258 aa, Bradyrhizobium BTAi1
MSLIDLANPTRFLALTARLLPWLALVTVVLLAAGLYLSALAPDDYQQGATVKIMFIHVPNAWLSMFVWGVMSLASLGTLVWRHPLADVAAKAAAPIGASFTFLALLTGSLWGRPMWGTYWEWDARLTSVLILFLMYLGLMALWRAVEDPTRAARAAAVLTLVGAINLPIIKFSVDWWNTLHQPASVMRMGGPALDKSFLIPLLVMAIGFSFLFVTLHVAAMRNEILRRRVRSLQMMQARAYTGSAPASGATGPIVGAA

SEQ ID NO: 5259 - protein, 262 aa, Brucella ovis
MMKDAAKIASWLDLANPTRFLAFAGRVVPWLGLASAIFLAVGLYMVFLSPDDYQQGSTVRIMYIHVPFAWLSMMCYSIMAVSSLGTLVWRHPLADVSVRAAAPIGAVFTALALATGSLWGKPMWGTWWVWDARLTSVFVLFLMYLGIIALSRAMDDPARSAKPVAVLTLVGFINVPIIKFSVDWWNTLHQPASVFRLDGPTIDGSMLRPLFVMAIGFTLLFFTLHMMAMRNEIWRRRVASMKKLAARNVDRNRAGQVEEGAL

SEQ ID NO: 5260 - protein, 256 aa, Sinorhizobium medicae WSM419
MSENSLAIRKFSDLANPTRFLALAARALPWLAALTALFFAAGLWLSFTTEGDYQQGETVRIMYVHVPSAWLSMMCYTVMAISALGTLVWRHPLADVSAKAAAPIGACFTFLALVTGSLWGKPMWGTWWVWDARLTSVFVLFLMYLGLIALNRAMDDPSRSARVSAVLVLVGFVNIPIIKFSVDWWNTLHQPASVIRLDGPTIDPEFLRPLIVMAIAFTLLFFTLHIGAMRNEIWRRRVASLRRQAARNAGREQLAP

SEQ ID NO: 5261 - protein, 265 aa, Ochrobactrum anthropi ATCC 49188
MEKDMTKDAVKTTSWLDLANPTRFLAFAGKVLPWLAVLSVLFLAAGLYMVFFLSPEDYQQGMTVRIMYIHVPFAWLSMMCYSIMAVSALGTLVWRHPLADVSIRAAAPLGAVFTALALATGSLWGKPMWGTWWVWDARLTSVFVLFLMYLGIIALSRAMDDPAKSAKPVAVLTLVGFINIPIIKFSVDWWNTLHQPASVFRMDGPTIDGSMLRPLFVMAIGFSLLFFTLHMMAMRNEIWRRRVASMKKLAARNADRNRKAQEGAV

SEQ ID NO: 5262 - protein, 244 aa, Rhodopseudomonas palustris TIE 1
MKLTELANPTRFLTLAGRLLPWLAAATALALAAGLTQGMLAPDDYQQGATVKIMFVHVPNAWLAMFVWGVMSVASLGTLVWRHPLADVAAKTAAPIGAAFTFLALVTGSLWGRPMWGTYWEWDARLTSMLVLFLMYLGLIALWRAVEDPSRAARAAAVLTLVGAVNLPIIKFSVDWWNTLHQPASVVRMGGSTLDKAFLIPLLVTAIGFSLLFLTLHLAAMRNEILRRRVRSLQMMQASRAEAA

SEQ ID NO: 5263 - protein, 253 aa, Rhizobium leguminosarum bv  trifolii WSM2304
MSQTSLAISKFSDLANPTRFLALAARVIPWLAGITALCFLIGLYLSFSTEGDYQQGETVRIMYVHVPAAWLSMMCYTIMSISAIGTLVWRHPLADVSAKAAAPLGAAFTLLALVTGSLWGKPMWGTWWVWDARLTSVFVLFLMYLGLIALSRAIDDPSKAARVSAVLILVGFINIPIIKFSVEWWNTLHQSASVMRLDGPAIDPEFLRPLFVMAIAFTLLFFTLHIMAMRNEIWRRRIAAQRRLAARMASREE

SEQ ID NO: 5264 - protein, 260 aa, Agrobacterium vitis S4
MTDNSLASTKLTARLNALANPTRFLALVARVLPWMAGITVILLAVGLTLAFTTEGDYQQGDTVRIMYIHVPAAWLAMMCYSVMAISAIGTLVWRHPLADVSHRAAAPLGAAFTFIALVTGSLWGRPMWGTWWAWGDARLTSVFILFLMYLGLIALNRAMDDPSKSARISSVLILVGFVNIPIIKFSVEWWNTLHQPASIMKLGGPSVDPEFLRPLLIMAVAFTLLFFTLHLMAMRNEIWRRRIMAQRRLAARVASQESAS

SEQ ID NO: 5265 - protein, 253 aa, Rhizobium leguminosarum bv  trifolii WSM1325
MSETSLAISKFSDLANPTRFLALAARAIPWLAGITALCFAVGLYLSFATEGDYQQGETVRIMYVHVPSAWLSMMCYTIMSVSAIGTLVWRHPLADVSAKAAAPLGAAFTLLALVTGSLWGKPMWGTWWVWDARLTSVFVLFLMYLGLIALGRAIDDPSKAARVSAVLILVGFVNIPIIKFSVEWWNTLHQSASVLRLDGPAIDPEFLRPLFVMAIAFTLLFFTLHIMAMRNEIWRRRIAAQRRLAARMASREE

SEQ ID NO: 5266 - protein, 884 aa, Pseudomonas putida KT2440
MSDSARADALLANLPRTGRGRLKVFLGAAPGVGKTFAMLQAAHAQQRQGVQVLAGVVETHGRAETEALLGGLHQQPLLRSQYRGVTLEEMDLDGLLRAAPALALVDELAHTNAPGSRHAKRWQDVQELLAAGIDVYTTVNVQHLESLNDKVRDITGVQVRETLPDWVLQEAFELVLIDLPPRELLERLREGKVYVPEQARAAIDAYFSQTNLTALRELAMQTAAAQVDADLAHGYRQRGQEAPALRGRLLVGIDGDDQAERLVRHASRVAQRRHLPWSLVHVDNGRLRDETARHRLQAAQQLAERLGGEVVLLRAGEVARTLIQHAVERRASLVLVGQSRNRLRRRLFGAGVAARLLRESRGLEINVLDRDVQPPAPRSAVRRVWVWRHYLLALLATVMAAGLAWAVSSVLALPNISLVFLAAVLLVAVRSSLGPALACAALSFLVYDFLFIPPNFSFTIQREEDVLTLVFFLLMAALTGNLAARQRRQLQALRETQAQTSQLLDLSRRLTVATDRQAIFKAAGQHLDGWQDAQVCLLERNAEGQLQVASGEACTFSDTERAAADWAWQHGQAAGHGSDTLPNGRWWWWPLAVDDQPLALLGVRPRNGQPLSDPRRRLLTALGQPLAQALARARLAEQLEAARLHGETEQLRSALLASVSHDLRTPLTAMRGSIDSLLALGDAIPAEDRRELLEGTRNEAERLDRYIQNLLDMTRLGHGGLKLARDWVAPADIVGSALNRLRVVLAPLRVHTDVPTELPLLFVHAALIEQALVNVLENAARFSPANGRLELQVAVHDDQLRLTVSDQGPGIPEADREKIFDMFYTAARGDRGGQGTGLGLAICQGMIGAHGGQILVGEGIDGQGTSITLCLPLPPQPEAESETP

SEQ ID NO: 5267 - protein, 887 aa, Pseudomonas syringae tomato DC3000
MSDSGRADALLAQLPREGRGRLKVFLGAAPGVGKTYAMLQAAHAQLRQGVRVMAGVVETHGRAETEALLNGLPQQPLLRTEYRGMTLEEMDLDALLKAAPSLVLVDELAHTNAPGSRHTKRWQDIQELLAAGIDVYTTVNVQHLESLNDQVRGITGVQVRETLPDWVLQEAFDLVLIDLPPRELLERLRDGKVYVPEQARAAIDAFFTQTNLTALREMAMQTAAAQVDNDLAQGYRQLGQSAPAVRGRMLVGIDGDMHAERLVRHASRVAQRRHLPWSAVHVDDGQTLDEQSRARLQNAQQLAERLGGEAVSLRAGEVARTLVQHAIERRASVVLVGQSRRHWRRRVFGGGVAARLLREGHGLEISVLDDSEELPDQPPRARPAREVVWFDYGLAFVATLIASLVAWGVAGVLALPNISLIFLAAVLLVAVRSSMGPALACAGLSFLAYDFLFIPPSFSLNIQREEDVLTLLFFLLMSALTGKLAARQRRQLQALRDTQEQTSELLDLSRKMTAATDRKAVLNAAEQHFSGWKELYLCLVDRDTQGGLVVETGGPLTFSEAERAAADWAWQHDQPAGSGTGTLPSGRWWWWPITAEEGPLALLGVCAREGQSFTDQHRRLLAALTQPLAQALARAQLAQELEAARLHGETEQLRSALLASVSHDLRTPLTSMRGSIDSLLALGEAIALEDRRELLEGTRDEAERLDRYIQNLLDMTRLGHGALKLARDWVSPADIVGSALNRLRAVLTPLQVSTQVTGDLPLLYVHAALIEQALVNVLENAARFSPLGGRLQVTAGVVDSELFFSVSDEGPGIPEDERAKIFDMFYTAARGDRGGQGTGLGLAICQGMIGAHGGRLTVEEGIDGLGTRITLFLPLQAQPDAEMEEPA

SEQ ID NO: 5268 - protein, 885 aa, Geobacter sulfurreducens
MLKLAQAEEAEAKRGKLKIFLGYAAGVGKTYAMLQAARERRHEGRDVVAAYVESHGRPETDALLEGLEILPAARIEYQGVMLPELDIDGVLARRPQLALVDELAHTNAPGSRHEKRWQDVEELLAAGIDVFTTVNVQHFESLNDVVAQITGIAVRETVPDRLLDLAAEIRLVDIPPEDLLQRLREGKVYVPEQAAFAAEKFFRAGNLIALRELSLRRAAVRVDEEMRAYMEARAIPGPWPAAERLLVSISGSPFSERLIRTTRRLADELKAPWFTVYVETPGNGRHEQENRKRVWKDLRLAESLGAQVATVTATSVAEALIDYARRHNVTRIVVGKPAKPRWREFLRLPLVDRIIRLSGAIDVHVVSYEPAEAGKGPVLPVRRGPISFSGYLASLALVVAASLACLLLRPFLAPTNMVMIYLLAVVLAALRLGLKPAILTAFLGVLAFDFFFIPPHLTFAVADTQYLITFVALFTVGVVISTLVSTVRERAEAVREREEQTASLYYLSRDLAAAADIETLVAAVIRNIGETLFARAAVLLPEGDRLRVAAASKGLKPDVKEMAVADWAFRNRQTAGQGTETLASAGFLYLPLQTSGSVLGVLGVRLKNDADYRSTQVRRMLDAFTSQTAMALERVQLSRQAEQAQILQARENLERALLNSISHDLRTPLVAITGALDTLRDKVHTLADESRLELLDTAWEEAERLNRFVGNLLDMTRLESGAIKLKRELSDVQDLIGCALAALERRIGERGIDVRLAPDLPLVRIDMVLMTQVLVNLLDNALKYSPPDSGVEITARVDGGRLRIEMADRGPGIPEQDLKRVFDKFYRIAVPEGAQGTGLGLSICKGIVEAHGGSIRAENRTGGGLRVIVTLPLAGGAKEGVSHGP

SEQ ID NO: 5269 - protein, 887 aa, Pseudomonas syringae pv B728a
MSDSGRADALLAQLPREGRGRLKVFLGAAPGVGKTYAMLQAAHAQLRQGVKVLAGVVETHGRAETEALLNGLPQQPLLRTDYRGMTLEEMDLDALLKAAPSLVLVDELAHTNAPGSRHTKRWQDIQELLAAGIDVYTTVNVQHLESLNDHVRGITGVQVRETLPDWVLQEAFELVLIDLPPRELLERLRDGKVYVPEQARAAIDAFFTQTNLTALREMAMQTAAAQVDNDLAQGYRQLGQSAPAVRGRMLVGIDGDIHAERLVRHASRVAQRRHLPWSAVHVDDGQTLDEQSRARLQSAQQLAERLGGEAVSLRAGEVARTLVQHAIERRASVVLVGQSRRHWRRRVFGGGVAARLLREGHGLEISVLDDSEALPDQPPRARPAREVVWFDYGLAFAATLIASLVAWGVAGVLALPNISLIFLAAVLLVAVRSSMGPALACAGLSFLAYDFLFIPPSFSLNIQREEDVLTLLFFLLMSALTGKLAARQRRQLQALRDTQEQTSELLDLSRKMTAATDGKAVFSAAEQHFSGWKELHLCLVDRDGEGGWVVETGGPLTFSEAERAAADWAWKHDQPAGSGTGTLPSGRWWWWPITAEEGPLALLGVCAREGQSFTAQHRRLLAALTQPLAQALARAQLAQELEAARLHGETEQLRSALLASVSHDLRTPLTSMRGSIDSLLALGEAIPLEDRRELLEGTRDEAERLDRYIQNLLDMTRLGHGALKLARDWVAPADIVGSALNRLRAVLAPLQVSTQVTGELPLLYVHAALIEQALVNVLENAARFSPVDGRLQVAAGVVDSELFFSVSDEGPGIPEDERAKIFDMFYTAARGDRGGQGTGLGLAICQGMIGAHGGRLSVEEGIDGLGTRITLFLPLQAQPDVELEESA

SEQ ID NO: 5270 - protein, 951 aa, Ralstonia eutropha JMP134
MPELRSPAERPDPDTLLQRMQEEGARAARGKLRVYFGASAGVGKTFAMLAAARSLREQGVDVVIGVVETHGRAETEALIDGIERLPMKDVPYRDRVLKEFDLDGALARRPALVLVDELAHSNAAGSRHPKRWQDIQELQSSGIDVWTTVNVQHLDSLNEAVGGITGIRVWETVPDAVFDGADEVILVDLPADELLRRLREGKVYLPEQARHAVRNFFRKGNLIALRELALRRTADRVDDDVRAYRRAESIQSVWRTREAVLACIGTGSDAEQVVRSARRLAGQLDCDCHVITVAAPRLASVPDAERVRLESAMRLAEELGARTETLAGSDMVQAVAGYVRRHNLTKVVLGRTPTRWRREDDSLLMQGRSLLAWVLSPFLGARAWLFGRKSFADALSAACPEIDVIRVAADTTRVDVKPASAPIPLEESEAAHAQERRVRMQSYLWAIAWCAGATAVSMLARPWFDLVNIAMLFLVAVVGVALRHGRAAAALASVVAVGAFDFFFVPPRMSFSVSDVQYLLTFLVLLSVGLVIGQLTAGLREQAEVAVQRETDARTLYELARELSSALMNEQIVSIGSRFLRAAFDARSAFFLVGPDGRLLPPVVDTQGQAGGHSDAIDRVLAQWVFDHGQPAGTGTHTLPAGTVLYLPLKAPMQTRGVLAVEPQAWRAFAQPALRRQVDVFATLIAITIERLHYVDVAQRALLSMESERLRSSLLAAVSHDLRTPLTSLIGMAETLQRGDPPLAPRVADTVSAMRDQARRMSTMVVNLLDMARLQGRDVRMQKEWQSFEELVGAALGALRDALVGHRVAVADLHKMPLVECDAVLMDRVLCNLLENAAKYTPAGTEIRIRAEVVDDEVRLVVEDDGPGVPPGSERQIFEKFTRGERESVTTGVGLGLAVCDAIVQAHGGRIWVEPVRDAATAGAGIGARFIVALPRGNPPVIEPEAADIPA

SEQ ID NO: 5271 - protein, 900 aa, Rhodopseudomonas palustris HaA2
MSTSTATARASPDALLALAGKEGRGRLKIFVGAAPGVGKTYAMLSAARSERDGGRDVVAGLIETHGRLETEHLLQGIEVLSRHPIVYRNRVMREFDLDGALARKPSLLLVDEYAHTNVPGSRHPKRWQDIDELLAAGIDVWTTLNIQHLESLNDVVLKISKIRVRETVPDKAFDRADEIVLVDLPPDELLKRLAQGKVYVQDTAARAVESFFKPQNLTALRELAMRRAAERVDAALVERMQAHAIEGPWAAGERILACVGPDTGSPGVVRTAKRLADLMDAPWIAVTVERSGVNPDSAARRQIDEALKLAESLGAETHTLTGNDIPDELLRFARFENVTQMVIGRARGGALRQWLAGSLPQQLMQRSTDIAIHLVPVQGEPAERDSRSLAARLNASKPAHFVYATVAVAGAVAVGKAFAQAIPTASLSVVFLMAVLFSAVKSGVGPAIFASVLSFFTYNFFFIAPLYTFTVAEPYELLALLMYLVVAIVAATLAGRLRDQARISAGRVRAMRRLYEFTRRLSGLATSDDIAEGAASEIHASLGRPVMVMLPREDDLVLAAAWPPEDALDEAAMMAARWAFTHNEPAGFDTGTLPIVPWRFLPVRTGATTYGVIGVMQKKDSAALDSEAQALLDTLTEQTAAALERAALTRDMVRARTATETERVRNTLLASISHDFRTPLSSILGSATSLSTFGDKLDDAATRDLLANIREEAEGLDEMVRNLLSITRIESGALELRRDWVDLREIAARVIEAARRRGAAQHIDLDCPADSPLVRADAALVEQALGNIVANAVAHTPPTSHILIDAENDASSVKLRVTDDGPGVAVADLPRIFDRFVRSASGTAPSSSRGQGVGLGLAIAKGIMEAHGGAVSALSPVANGHGTRFVLTFMRDRTQETPQP

SEQ ID NO: 5272 - protein, 894 aa, Nitrobacter hamburgensis X14
MSGEPATRASPDALLALAKKEGRGHLKIFLGAAPGVGKTYAMLAAARSEIAGGRNVVVGLVETHGRRETDQMLDGFEVLARKPIVYRNQVMHEFDLDAARARKPGLLLVDEYAHTNVPGSRHPKRWQDIDELLRAGIDVWTTLNIQHLESLNDVVQKISKVRVRETVPDKVFDQADEVVLVDFPPDELLKRLAEGKVYVQDTAARAVENFFKPQNLTALRELAMRRAAERVDASLIERMQAQAIDGPWAAGERILACIGPDPVSPTVVRTAKRLADLMDAPWIAVTVERPGASLNSAARQRLDEVMKLAESLGAETQTLTGADLPAELLRFAKFENVTQIVVGRSRGGFFSELLRRSLPYELVRRTQDIAIHLVTRESDVSEPASGWLLHNRSPLRPLPFVYATLTVAAALAVSKVLTELMPIPNLSMVFMLSVLVSAINFGVWPAIYASVLSFFIYNFFFIPPLYNFTIAEPYELLALVIFLVVAIVTSAMAGRVRDQARVSAGRVRAMRRLYEFTRRLSGLATRDGIAEGAAGEIHASLARPVVVLLAEGDGLALTAAWPPEDALDTATMTAARWAYNHAEPAGADTGTLPIIPWYFVPLRIGDKALGVIGVAKDKDTPPLDSEARTLLDTLSEQTAAALERAALASEMVSARTATETERVRNTLLASVSHDFRTPLSSILGAATSLLSYGDKIGAAAKTDLLGQIKQETEGLDEMVRNLLAITRIDSGALELRRDWIDLREIVERVASAARRRSAPQRIDITMPPDLPLVRADAALAEQAIGNVVANAIVHTSKETHIVIDAQSGLSDITVRVTDNGPGIGSDILPHVFNRFVRGNGADDVHDGGEGTGLGLAIARGIMEAHGGSITVDSPVEGQPGARFVMVFPREDGAT

SEQ ID NO: 5273 - protein, 967 aa, Cupriavidus metallidurans CH34 uid250
MYAWQSPAWHNHRHQPPLPMTDPDARPDPDALLQRMQAERARAARGKLRVYFGASAGVGKTFAMLGAARALREQGVDVVVGVVETHGRAETEALLDGLERLPLREVPYRDRVLAEFDLDGALARRPALILVDELAHSNAAGSRHPKRWQDIQELQATGIDVWTTVNVQHLDSLNQAVGGITGVRVWETVPDAVFDGADEVVLVDLPADELLRRLREGKVYLPDQARHAARNFFRKGNLIALRELALRRTADRVDDDVRAYRHAESIDLVWRTREALVACIGAGDDAEQVVRSAQRLAGQLDCDWHVVTIATPQLMPPSNEVRARMRAAMQLAEELGARTETLAGNDMVKAVAGYVRRHNLTKVLLGRAPADWYARGNWIDKGRALLARALSPLLGVGNRLFGRQMFADALAAGCPEIDVIRVAADSTRADLRPRVQEGLSTEAHDAEAEAELARVRRHNYGWAVVWCMAATFLSTLTRPWFDLVNIAMLFLVAVVGVALRHGRGPAALASVISVAAFDFFFVPPRMSFAVSDVQYLLTFFVLLTVGLVIGQLTAGLREQAQVSVRRETDARTLYELARELSAALTAQQIVEIGGRFLRAAFDADGTFFLVAENGRLMPMAGGEKTPEPRTGKGDAIDKVLAQWVFDHGQPAGTGTHTLPGSTVLYLPLKAPMQTRGVLAVEPRAWRALADPALRRQADVFATLIAIAIERIHYVDVAQRALVSIESERLRSSLLAAVSHDLRTPLTGLIGMAETLQRAEMPLPASVAETVEAMRVQAQRMRTMVVNLLDMARLQHHDLALKRGWQSLEELIGAALASMRDVLGRHHVEVMNLVELPLVECDDVLMERVLCNLLENAAKYTPAGTAIRIRGAVVGDEVQLSVEDEGPGVQSGQERYIFEKFTRGERESATSGVGLGLAVCEAIMQAHGGRIWVEAAHPHGSRFTLALPRGNPPAIEPESLDEPIPDHH

SEQ ID NO: 5274 - protein, 885 aa, Pseudomonas aeruginosa UCBPP-PA14
MTDTARADALLADLPADGRGRLKVFLGAAPGVGKTFAMLQAAQAQLRQGVKLRAGVVETHSRAETESLLAGVPQQPLRSLEYRGMKLQEMDLDGLLADPPALALVDELAHSNVPGSRHAKRWQDIQELLAAGIDVYTTVNVQHLESLNDQVRDITGVQVRETVPDWVLQEAYEIVLIDLPPRELLERLREGKVYVPEQARAAIDAFFSQTNLTALRELAMQTAAARVDADLNHRYRQRGEEAPALRGRLLVGIDGDEQAERLVRHACRVAERRHLPWSVVHVDTGGLRGEQARMRLQGAQQLAERLGGEIVVLRAGEVARTLLQHARERRASLVLVGQSRRRWYRRAFGGGLAGRLLRDGQGLEISALDSEADLRPAEPRPRYPVVWNDYLLALLATALASGLAWVVAHLLELPNISLVFLMAVLLVAVRSSLMPALLCAVASFLAYDFLFIPPHFSFAIHRHEDLLSLAFFLFMAGLTGNLAARQRRQLEALRDTQEETSLLLELSRKLTAATDRQAVLAAAAQQFDDWKDVEVCLLGQVNGEWKTEAGVQRQLADQERVAADWAWAHDQPAGLGTGTLPGGRWWWWPLSAEEGPLALLGVAPLDGQPLSPQRRRLLAALGQPLAQALARARLAEDLEAARLHGETEQLRSALLASVSHDLRTPLTAMRGSIDSLLALGEAIPPADRRELLESTRDEAERLDRYIQNLLDMTRLGHGGLKLARDWVAPGDIVGSALNRLRAVLAPYRVQAIVANDLPLLYVHAALIEQALINVLENAARFSPSHGRLRIEVSQDAAELRFAVSDEGPGIPEAEREKIFDMFYTAARGDRGGQGTGLGLAICQGMIGAHGGRISVGEGLDGRGTTLVLHLPLHPQPDLGQLEGDE

SEQ ID NO: 5275 - protein, 899 aa, Polaromonas naphthalenivorans CJ2
MNLPAGQRPDPDELLQRLQQQEAQRARGRLRIYFGASAGVGKTYAMLGAAQRERKDGRDIVVGVIETHGRSETAELLAGLEQLPLREVAYRGRTLREFDLDAALARKPAVLLVDELAHSNVEGSRHPKRWQDVQELLDAGIDVWSAINVQHLESLNGTVGAITGIRVNETVPDTVLDAADEIILVDVTPDELTARLKAGKVYLPQQAERAAQNFFRKGNLIALREIALRRTAEHVEDDVRSYRVEKSISPVWNTEGALLACIGPHEGAEQTVRTAARLAGQLNVRWHAAYVETPRLQRLKEAERDRILAVIKLAGELGATTAVLAASDAAAELVAQAQALNCATLVVGRPALPDWRTLWSGRSMTRRLARLAPTLDIVEVADARSSRRLAPAVPRSDDDAASAWHGSLPRYAWAVASSVAITLLATPLLNVFDLANIVMLFLLGTVLVALKLGRGPAALAAFLNVAAFDYFFVAPRLSLAVSDVQYLVTFAVMLVVGLLTGQLTAGLRFQARISSSRERRAQSLFELTRDLSAALMPSQVAELGEAAVQRDFGGQALVLTTDARDQLVLPVHAPPGFDASVADWAFRHAQAAGLATSTLSAQTWHYVPLKATMRVRGVLALQPARPRWLLIPEQLQQLDTLARQIAIALERVHYVDIAQQAVVEMESERLRNTLLAALSHDVRTPLTALIGLAESLQRSQPPLEPQQAGMAQAMAQQARQLNALVSNLLDMARLQNGAVSLHRDWQSVEEVAGSAIRAAQPALNGRTVRTDIAPDLPLVEFDAALMERVLVNLLENAAKYGAPPFEIHARAAPDSLVLSVRDHGPGLPPALRGREAELFEKFTRGQAESATPGVGLGLAICKAIVDAHRGKIVAGNAQGGGAQFTITLPRGSPPEPAPE

SEQ ID NO: 5276 - protein, 897 aa, Serratia proteamaculans 568
MVEEEQQRPDPDSLLALANEKPRGRLKVFFGACAGVGKTYAMLQEAQRLRAQGLNVLVGVVETHGRSETAALLGGLDLLAQKRIQYRGRMVQEFDLDAALARHPALILMDELAHSNAHGSRHPKRWQDVEELLDAGIDVLTTVNVQHLESLNDVVGGVTGVRVRETVPDHVFDEATEVVLVDLPPDDLRQRLNEGKVYIPGQAERAIEHFFRKGNLIALRELALRRTADRVDDQMRAFRDTQGRERVWHTRDSILLCVGHNSGNEKLVRIAARLAARLGCHWHAVYVETPKLHRLPESQRRAILRALRLAQELGAETATLSEPDEERAVLRYAREHNLGKIIIGRRSEQRWKLRGSFADRLGKLGPDLDLVIVALENDSPPQPGKEHDSRNFGEKWRMQLRGCAVAVALCALITLLSQWLLPGFDQANLVMVYLLGVAIVALFFGRWPSVLAAVINVASFDLFFVQPEWSFAVSDMQYLLTFGVMLTVGITIGNLTAGVRYQARVARYREQRARHLYEISRGLSQALTTEDIAKTSRHFLSSSFQAKTVLLLPQEDGKLQQMVGETGGLLSVDEAIARWSFDKGMPAGAGTDTLPGVPYQLLPLATSKQTFGLLAIEPSNLRQLMVPEQQRLLQTFAVLIASALERLHLARSAEEAKLDAEREQLRNSLLAALSHDLRTPLTVLFGQAEILTLDLAAEGSNHATQASQIRQQVLSTTRLVNNLLDMARIQSGGFNLRKEWQSLEEIVGASLHMLEPLMTQHQIKVELPAELVLVNCDGSLLERVFTNLLENANKYAGYDATIGIRAHTLPEWLEVEVWDDGPGIPEGKMQLIFDKFSRGNKESAIPGVGLGLAICRAIIEVHGGRIWAENGANGGASFRFVLPLEKPPEIDSEAFDL

SEQ ID NO: 5277 - protein, 884 aa, Pseudomonas putida GB 1
MSDSARADALLANLARTGRGRLKVFLGAAPGVGKTFAMLQAAHAQQRQGVQVLAGVVETHGRAETEALLAGLQQQPLLRSQYRGVTLEEMDLDGLLQASPALALVDELAHTNAPGSRHAKRWQDVQELLAAGIDVYTTVNVQHLESLNDKVRDITGVQVRETLPDWVLQEAFELVLIDLPPRELLERLREGKVYVPEQARAAIDAYFSQTNLTALRELAMQTAAAQVDADLAHGYRQRGQEAPALRGRLLVGVDGDDQAERLVRHASRVAQRRHLPWSLVHVDNGRLRDETARHRLQAAQQLAERLGGEVVLLRAGEVARTLIQHAAERRASLVLVGQSRDRLRRRLFGAGVAARLLRESHGLEVNVLDRDVQPPAPRSAVRRVWVWRHYLLALLATVMAAGLAWAVSSVLALPNISLVFLAAVLLVAVRSSLGPALACAALSFLTYDFLFIPPNFSFSIQREEDVLTLVFFLLMAALTGNLAARQRRQLQALRETQAQTSQLLDLSRRLTVATDRQAVFNAAGQHLDGWQDMQVCLLERNAEGQLEVASGEAHAFSDTERAAADWAWQHGQAAGHGSDTLPNGRWWWWPLAVDEQPLALLGVRPRNGQPLSDPRRRLLTALGQPLAQALARARLAEQLEAARLHGETEQLRSALLASVSHDLRTPLTAMRGSIDSLLALGEAIPAEDRRELLEGTRNEAERLDRYIQNLLDMTRLGHGGLKLARDWVAPADIVGSALNRLRVVLAPLRVHTDVPAELPLLFVHAALIEQALVNVLENAARFSPTQGRLELQVAVQDDQLRFIVRDQGPGIPVADREKIFDMFYTAARGDRGGQGTGLGLAICQGMIGAHGGQILVGEGIDGQGTGITLCLPLPPQPEAESETP

SEQ ID NO: 5278 - protein, 874 aa, Azotobacter vinelandii DJ
MTHAMNEARDVPERTAAQSSHGEGGGRLRRGRLRIYLGAAPGVGKTLAMLQAATELLRQGVDLRVGSLDCADDAARGELRMRLAALPGGREAAGELDLDALLARPPALLLVDRLARANPPGSRHAQRWQDVQELLAAGIDVHATLDVSHLESLKNRVEALTGQPVTETLPDWLLEEAHEVLLIDCLPGELRDFAPTTLAALRALALQVVAGRADSEVQRRYRPSGREAPAVLGRLLVAVDGDEQSEQLVRHASQVARRRQLPWTLVHVDDGRARGEESRRLLQAAQRLAERLGGEVVGLLGDEVADTLLRHARERRASVLLVGGHRRRWFGRGVVERLLRRARGLEIGVLAAEEAVSVPSFAVRGFVAGPLDYALALLATLLASAVAWGFSRMLALQNISLVFLAAVLLVAVRSGFGPALCCALLSFFAYDLLFIAPTFSLIVAHRVDVLGLLFFLLMAALTGNLATRQRRQMQALRETQAETAALLDLTRKLSAATDRRAVLAAAVEQFAAWRDLDVRLLGPDGAGALRVEAGVAGDLGKSERAAAEWVWQHELPAGLGTDTLPDGRWWWWPLSGERGPLALLGIAPRDGRPLPASRRHRLVALCQPLAQALARAQLAEELQAARLRGETEQLRSALLASVSHDLRTPLTVMHGAIDSLLTLDGQIAAADRRELLESTRDEAERLDRYIQNLLDMTRLGHGGLKLERDWVAPADIVASSLQRLRPVLASFRLETRIAGELPLLHVHAALIEQALVNVLENAARFSPPGGRLRVAVDSDGGELRLSVSDQGPGIPPAEREKIFDMFYTAARGDRGGPGTGLGLAICQGILGAHGGRVTVGEGLDGQGATLTLHLPLQPQPPGESERDDEAPVLP

SEQ ID NO: 5279 - protein, 920 aa, Variovorax paradoxus S110
MSDIPRPDPDALLAQLRSDEARALRGKLRIYFGASAGVGKTWAMLSAAQRERAAGRDVLIGVAETHGRSETAALLAGLELLPLREVDHRGRRLAEFDLDAALARKPAVLLVDELAHTNAPGSRHAKRWQDVQELLAAGIEVWSALNVQHLESLNGTVGAITGVRVHETVPDTVLDEADEVVLVDVTPDELAARLAAGKVYLPQQAERAAQNFFRKGNLIALREIALRRTAEHVEDDVRGWRVEQSGAAGRNGKDGQGGELQAWNTSGAILACVGPHEGDAQTVRTAARLAGQLNVRWHAAYVETPRLQRLAAEERDRILAVLKLAEELGAATAVLTGSDVAEQLAEQARRLNCATLVLGQPEPATGWRRWWPATPMPLPRALARRAPALDIMEVGRADSSRRLSRAPIAATRADDDDHEKAPVHWPGYAWATAASIALTLLCTPLAHVLELSNIVMLFMLGVVGVAMRFGRGPSALAALLNVAAFDYFFVPPRLSFAVSDVQYVLTFAIMLGVGLLVGQLMAGLRFAAGVSTSRERRARSLFELTRELSAALESTQVVALGAAAVQGHFGGQALVLVTDAADQLVLPKSPPEGFDAQVADWAFRHGQPAGLATATLAAQPWHYVPLQAPMRVRGVLALSPAQPRWLLIPEQAQQLDTLARQIAIALERVHYVEVAQQAVVEMESERLRNALLGAISHDVRTPLTALIALAESLQTLPPEAHAEAARAIVAQAHELHALVNNLLDMARLESGIAGGAVNLRRDWQSVEEVVGSAIRAARPALGPAVVQTALEPGLPLVEFDAVLIERVLVNLIENATKYGAPPIVVGARAEPGMLRLTVRDHGPGLPAALLGREQKLFDKFTRGETESATPGVGLGLAICRAVVSAHGGEIAAANAQGGGAEFTVSLPRREPPETAEEAQP

SEQ ID NO: 5280 - protein, 113 aa, Jannaschia CCS1
MLSLRLYMLQRITALLMAPLVIGHLAVMIYAIQGGLSAEEILGRTQGSFAWFAFYGTFVVAVAIHGAIGLRTILHEWGGLRGFALEVVMWIIGLGLFAMGARAVWAVTFGGAA

SEQ ID NO: 5281 - protein, 111 aa, Rhodobacter sphaeroides 2 4 1
MLDLRLYMLQRLSALVMAPLVLGHLALMIYAVQGGISAGEILARTQGSLGWALYYGLFLVAAAIHAAIGLRVILAETLTLRNRPLLDLFTLAVGAVFLILGLRALHAVTLA

SEQ ID NO: 5282 - protein, 111 aa, Verminephrobacter eiseniae EF01-2
MEQGLFALQRLSAMAMAPFVLVHLGLILYAARADLTAQDILARTRGSWGWIAFYTLFVLSLSIHVPIGLRCILIEWTHLGRRAASVLCLVFALALLFMGLRAVVALGGLAA

SEQ ID NO: 5283 - protein, 111 aa, Rhodobacter sphaeroides ATCC 17029; identical to SEQ ID NO: 5281

SEQ ID NO: 5284 - protein, 109 aa, Methylobacterium radiotolerans JCM 2831
MSPLLYLAQRGTAAILAVTIAVHLGTIVYAVRGGLTAGEILGRTQGNLAFLLFYAVFVLAAAIHAPIGLRSVLREWAGWRGRSLDVAMIALSALLAGLGLRAALAVYVA

SEQ ID NO: 5285 - protein, 109 aa, Methylobacterium nodulans ORS 2060
MNVRLYVWQRGTAALMAPLVLIHMAVMFYATRHGLSASDILSRTRGSIAWALFYGTFVAAAAIHAAIGLRGILTEWVPMQPRTASLAASAFGVLLVVLGARAVFAVVFG

SEQ ID NO: 5286 - protein, 111 aa, Variovorax paradoxus S110
MEARLFALQRLTAMVMAPFVFTHVGLIIYAVRGGLTAGEVLSRTQGNWVWIAFYGLFVISVAVHVPIGVRNILIEWLRLGRSAASLVSLVFGAALLYLGLRAVAAVGGLMP

SEQ ID NO: 5287 - protein, 95 aa, Methylococcus capsulatus Bath
MSSRVEQIRERLQGALAPLHLEIIDESASHAGHAGAMAGGGHFHATIVSAAFDGKSLVQRHQMVYSALGDMMHNEIHAFSMKALTPSEHPTTGNF

SEQ ID NO: 5288 - protein, 88 aa, Dechloromonas aromatica RCB
MSAETIELLRQRLVVLQAESITIIDDSHRHAGHAGARDGGHYQLQIVAQAFAGKSTIARHRMIYDAAGDLMRGRIHALSIRAEVPGEV

SEQ ID NO: 5289 - protein, 87 aa, Thiobacillus denitrificans ATCC 25259
MSTADLIRQRLAALEPETYTLDDESAQHKGHAGAASGGGHFRLTIVSPRFRNLSTLARHRLVYDAMGELMQREIHALSVTALTPEEL

SEQ ID NO: 5290 - protein, 93 aa, Nitrosococcus oceani ATCC 19707
MTPEERIVFIQTHLKAALSPQYIAVEDESARHAGHKGHGGGGHYQVTIVAEAFNGKSLLERHRMVYSAVQEGIGQDIHALSIKAYTPQENPLS

SEQ ID NO: 5291 - protein, 91 aa, Nitrosospira multiformis ATCC 25196
MNTIELMKEKLAALEPVVIRIVDESARHAGHEGAKAGGGHYLLTIVSHQFTCKSALARHRLVYDTLREMMHKNIHALGVKAYTPEEFDSIH

SEQ ID NO: 5292 - protein, 92 aa, Methylobacillus flagellatus KT
MTLIEEIRNRLSALSPTMLEIRDDSALHKGHAGNNGGGHFFLTIASAEFSGKSQVMRHRQVYAMLGDLIPHKIHALSIQAIATDDPPVVTID

SEQ ID NO: 5293 - protein, 92 aa, Alkalilimnicola ehrlichei MLHE-1
MSGNERVEMIRQRLEQALDVHSLEIQDDSHKHAGHAGAQAGGGHYQVRVVSPDFAGLNTLQRHRKVYGAMGDAMRNDIIHALGIKALTPDEA

SEQ ID NO: 5294 - protein, 107 aa, Xanthomonas oryzae PXO99A
MNRVEQIRAALQAALAPTELDVVDDSARHAGHAGARDGRGHFNVRVVSAAFVGKPLLARHRAVYAAVGEMMQTDIHALSIKAFAPGEAGGAPGSEQVVPPLDRLPLS

SEQ ID NO: 5295 - protein, 91 aa, Stenotrophomonas maltophilia R551 3
MNAERIERIRDALQQALTPSVLEIEDDSHRHAGHAGARDGRGHFNVHVVSDRFAGLGPLARHRAVYTALGAMMETDIHALSIRALTPSEQG

SEQ ID NO: 5296 - protein, 103 aa, Acidithiobacillus ferrooxidans ATCC 53993
MNKEILGNLLRDALNPEFLEINDRTKSHSGHASSGGGGHYEVRIVSSRFAGLPPLARHRLVNAATDPVRQEIHALTIKAYSPEEFAAQNQPKTQRPAIALNVL

SEQ ID NO: 5297 - protein, 95 aa, Thauera sp. MZ1T
MSATRVERIRAALQERFAPTRLEIGDDSALHAGHAGAREGGGHYRVFIVSEAFQGCSRVVRQRMIYDAVGDMMHKDIHALAIRALTAAEAESQGH

SEQ ID NO: 5298 - protein, 103 aa, Acidithiobacillus ferrooxidans ATCC 23270; identical to SEQ ID NO: 5296

SEQ ID NO: 5299 - protein, 109 aa, Pseudomonas syringae tomato DC3000
MSNGNSVTVQILDKEYSIICPQEERTNLVSAARYLDGKMREIRSSGKVIGADRIAVMAALNITHDLLHKEHLPDVQSSGSTREQVRDLLDKVDLVLATDTPGTPDSTRG

SEQ ID NO: 5300 - protein, 109 aa, Pseudomonas syringae pv B728a
MSNGNSVTVQILDKEYSIICPQEERTNLVSAARYLDGKMREIRSSGKVIGADRIAVMAALNITHDLLHKEHLPDVQTSGSTREQVRDLLDKVDLVLATDTPGTPDSTRG

SEQ ID NO: 5301 - protein, 103 aa, Nitrosococcus oceani ATCC 19707
MNDEAQPVVLHILGKEYRVVCPSGEEEALLTAARYLNKKMEEIKAGGKIIGVERVAVMSALNIAHELLREQSKKEGERELNKRIQTLRHKVEAVLEECRQVDP

SEQ ID NO: 5302 - protein, 97 aa, Saccharophagus degradans 2-40
MTDSNRVYVNILDKDYQIACPAEERDALHRAAEELDERMRAIRNTGSIIGLERIAVMAALNLCHELQQQRKNTAKPNDAESISRMMQKIDKVLTSHE

SEQ ID NO: 5303 - protein, 94 aa, Alkalilimnicola ehrlichei MLHE-1
MTEPVKIQILDKEYMIACPEDEKQGLLQSADYLHRKMKEIRDRGKVLGTDRIAVMAALNITYELLEARQENASMEDVRRRLRALDARIAEATGE

SEQ ID NO: 5304 - protein, 104 aa, Pseudomonas aeruginosa UCBPP-PA14
MSQSNTLTVQILDKEYCINCPDDERANLESAARYLDGKMREIRSSGKVIGADRVAVMAALNITHDLLHRKERLDQESSSTRERVRELLDRVDRALANPADAGEA

SEQ ID NO: 5305 - protein, 96 aa, Halorhodospira halophila SL1
MTEAVKVRILDQDFTVACPEDAKNELLQSADYVDRKMREIRKSGNVVGTDRVAVVAALNIAYELLSVQAENEQLADVRQRLARLDARISEAVDGSS

SEQ ID NO: 5306 - protein, 98 aa, Marinobacter aquaeolei VT8
MSQTPTTVEVRILDKEYLVACPQEEQEALLRAARHLDTKMREIRSSGKVFGTERIAVMAALNITHELLERDTMSDATSSILRAMDNRLDEALGEPSGN

SEQ ID NO: 5307 - protein, 101 aa, Pseudomonas mendocina ymp
MTQSNTVTVHILDKEYCIACPQDERANLESAARYLDGKMREIRTSGKVIGADRVAVMAALNITHDLLHKQQRLDQDASSTRQQVRDLLDRVDQALADDQAS

SEQ ID NO: 5308 - protein, 106 aa, Pseudomonas putida F1
MSSSNSVTVQILDKEYSIICPPEERNNLVSAARYLDGKMREIRSSGKVIGADRIAVMAALNITHEMLHRQEDRNDAPVSGTNREQVRDLLDRVDKALSDDTDTKIG

SEQ ID NO: 5309 - protein, 104 aa, Pseudomonas aeruginosa PA7
MSQSNTLTVQILDKEYCINCPDDERANLESAARYLDGKMREIRSSGKVIGADRVAVMAALNITHDLLHRKERLDQESSSTRERVRELLDRVDRALANPSDASEA

SEQ ID NO: 5310 - protein, 107 aa, Coxiella burnetii RSA 331
MSDNNSEQSLISVKILDRSYHIKCPPDQTQALQEAAAYVEEEMRKIRQTANINSMERIAVVTALNICHELMQLRKQKNNYIDVMNQRIQDLQRRIENFLETNAEIEV

SEQ ID NO: 5311 - protein, 106 aa, Pseudomonas putida GB 1
MSSSNSVTVQILDKEYSIICPPEERNNLVSAARYLDGKMREIRSSGKVIGADRIAVMAALNITHEMLHRQEDRNDAPVTGTNREQVRDLLDRVDKALSDDTDTKIG

SEQ ID NO: 5312 - protein, 106 aa, Pseudomonas putida W619
MSSSNSVTVQILDKEYSIICPPEERNNLVSAARYLDGKMREIRSSGKVIGADRIAVMAALNITHEMLHRQEDRTDAPAGSATREQVRDLLDRVDKALSDDTDTKIG

SEQ ID NO: 5313 - protein, 99 aa, Xylella fastidiosa M12
MSDTEPVSIRILDREYTVGVGIEERKGLISAAQLLDAHMREIRSSNRMASIDRIAVLAALNLAHELQQLHEKHADRERALLTTLDTLQQRLKNAMDTSH

SEQ ID NO: 5314 - protein, 99 aa, Xylella fastidiosa M23
MSDTEPVSIRILDREYTVGVGIEERKGLISAAQLLDAHMREIRSSNRMASIDRIAVLAALNLAHELQQLHEKHADRERVLLTALDTLQQRLKNAMDTSH

SEQ ID NO: 5315 - protein, 99 aa, Xanthomonas oryzae PXO99A
MSNNEPVSVRILDREYTVGVTADERESLTAAARLLDLRMREIRGSNRMAAVDRVAVLAALNLAHELQQLREQQARYDRELANTLDHLNRRLDSVADTPR

SEQ ID NO: 5316 - protein, 98 aa, Stenotrophomonas maltophilia R551 3
MSAEPVSVRILDREYTVGVGGDERDSLMAAARLLDARMREIRGSNRMAAVDRIAVLAALNLAHELQLLRDENARQAVALQQTLADLNRRLDRAIDGTP

SEQ ID NO: 5317 - protein, 104 aa, Thioalkalivibrio HL EbGR7
MSNPAEPVAVQILGKEYKVACPQDERSALIASASLLDRRMQEIRDSGRIIGGDRIAVMAALNITHEMLVTRNQRESLSQNLSARIRALQDKIDHALENGQQMDL

SEQ ID NO: 5318 - protein, 104 aa, Azotobacter vinelandii DJ
MSQSHTITVHILDKDYCIACPPEERANLESAARYLDGKMREIRSSGKVIGAERIAVMAALNITHDLLHKQERLDLQASSTREQVRTLLERVDRALTNNPDELTT

SEQ ID NO: 5319 - protein, 193 aa, Shewanella oneidensis
MQVSSTRKSKVNLLPQEIRDQLHALLRSGTMHQKDILEAVNQMIDEAGLGEDAKLSRTGFNRFAKKFEQVGERIRQSREVAEVWTAKLGQAPTSDVGKLLQEFVRTMAFETSMKMMDAADQEDAEPISPKALGQLALVVQRIEAAAMSSIKVEKEIRSAFAAEAATKVEQIVKQAGISAETAIDIKNQILGIA

SEQ ID NO: 5320 - protein, 187 aa, Methylococcus capsulatus Bath
MPPRSSVYQLPPEVQEELNTRLVGSGFGGYRDLSAWLKDQGYHISKSALHSYGQEFELEFKSSMEAAFTVEKLSKALVAQRDDSEAAMLEAAAMVGQEILLKLMIALRQAESDPTKAAKTISLATRSLADLGRMTLDQKKWQDQLRKQLQEEAGAKLDRLEAGARAGKGKLDAETLRIVRQEVYGLA

SEQ ID NO: 5321 - protein, 185 aa, Methylobacillus flagellatus KT
MAKRSEVQGLPAEVRKWLDQTLAENNFSGYMEIAAALKERGYAISKSSVHRYGQKLENRLAAIKASTEAAEAIVNASPDEGDARSEAIMALVQTEMFDAILNLQEAVESEPEKRMKILASAAKSIALASRASVNQKKWAVEVRAKIAAKLNAASNEAESIAKDAGMSDDTWAAIRAKFLGIKVEV

SEQ ID NO: 5322 - protein, 179 aa, Rhodobacter sphaeroides ATCC 17025
MPPPRKIDLLPVELRAWLQEELRARGFGQYEELAEALNFRLEEAGLDLRIRKSALHDFGSEYKEFVKLQEQASDWAKEWLGDMGMEDQAQRQNVLFQMLTTLAFKVMQAEVTKEGVEISPQNLHFLARMMKDVMSSSGIVQAMQEKEKKAQVAKLDAAVTSGDIDAEAAEKARRILGFA

SEQ ID NO: 5323 - protein, 193 aa, Vibrio cholerae O395
MQVASNRKSKVELLPEDIRNTLNVFIRSGNMTQKDILEAVNQMIDDAGLGDDAKLSRTGFNRYAKRMEDMGQRLRQSREVAEVWVSKLGEAPTSDVGKLLQEFVRTMAFDTSMKMMEQSDGEDGEVISPKALGQLALVVQRIETAAMTSMKREKEIRAAFAAEAAEAAEKIVKQAGISADTATDIKNQILGIA

SEQ ID NO: 5324 - protein, 189 aa, Shewanella baltica OS185
MASETRGRRSKVDLLPDPIRKKLDAGLRNGSIQQIDLLDEINALIKAAGLPEENQLSRAGINRYATKMEAVGKSLREMREITQVWTAELGDKPTGEVTKLILEMARSQLFKALLNQDETGEGADVGMIKDAMLAVQRLESAAMASHKREKEIRTAFAAEAANAAEKVAKTAGLTSDAVALLKREILGIA

SEQ ID NO: 5325 - protein, 193 aa, Xanthobacter autotrophicus Py2
MGKRSSVDVLPQEVKDWLMRLREQGATYDQIVAKLREMDSLAVPIPSRSALHRHMQEAERTKEMVDRQRVVAEAMVKELGEVDDSRVTRGNIAMLHAILTRVQQTALDAMMTGDGNIDMSAGEVMQLAKALDHLGKAAKDDVARTAAIRKLAKEEVLKTAEAAVGAAEAGGHAMSGEELLRKIREDIYGIYEK

SEQ ID NO: 5326 - protein, 189 aa, Shewanella baltica OS195
MASETRGRRSKVDLLPDPIRKKLDAGLRNGSIQQIDLLDEINALIKAAGLPEEQQLSRAGINRYATKMEAVGKSLREMREITQVWTAELGDKPTGEVTKLILEMARSQLFKALLNQDETGEGADVGMIKDAMLAVQRLESAAMASHKREKEIRTAFAAEAANAAEKVAKTAGLTSDAVALLKREILGIA

SEQ ID NO: 5327 - protein, 190 aa, Leptothrix cholodnii SP 6
MPPVGKIAQLPEEIRAWLHATLVKRSFGDIHGVTDQLQAMLQEAGIAMYIGKSAVGAESLKIKRAQESIKASTEAAKLIAESSRDDGDARGEALMALISSDMFDCLMKAREAESEEDPIARLGMMGEAAKAATRLTEASVKQRRWRREVETKAKEAADAVAKIAKTGGLQAAQVKEIREQILGITKRVTA

SEQ ID NO: 5328 - protein, 192 aa, Rhodopseudomonas palustris TIE 1
MANRPSSIDRLPQEVRDWIGRLRDQGCTIDEIITKLRELDKDAVPSRSALGRHLKKAEEVAERLRKSRAVADVIVRRLGESDPDKTTRMNIELMHNILFELATQTEGEDGEPVTFDPMQVMLLAKALDHLGKASKDDVARTVAIEKRAAEKAKAEALRQTEKAIAGAAGTDGQVDGAALLKKIREDIYGITT

SEQ ID NO: 5329 - protein, 206 aa, Rhodopseudomonas palustris TIE 1
MKAARHKRGRLSEIDKLPEWADEAKLWAFEQLKERKLTQLEILDGFNGRLKVAAFEQGITDPPVISRSAFNRTAIRIAILSRRLEETREIAAVIAPKLDEAGDNSLTLMVAETLKTLISEMLGNAGELTADGATAEMLMMTARALAAAEQAKRISADGRRKIEAELNAKASKAVDQVAKAKGLTTETVDAIKAKILGIDTSKGAKP

SEQ ID NO: 5330 - protein, 183 aa, Thioalkalivibrio HL EbGR7
MPKRSKVFELPQDVREELNEKLVATGFQGYEALAGWLAERGFQVSRSSVQRYGSELQAEFEAAMGDVRKTTEMAKAFTEGDDDAKGSLVDATARIVQEQLLRITIALRKAEHEPEKAAKYMASVTHALADIGRMSLGQKKWAREVRREVAQEAADKAAEVAKRGGLSAEVVNDLRRELLGIAK

SEQ ID NO: 5331 - protein, 194 aa, Agrobacterium vitis S4
MAKGRGRLSSLQLLPRECSHVVQWAAEQLQDTTTSQVDIYQEFVTRLEQVQRESRGELEFKIPSLSSFNRYSVNLDELTRQINEAREMASAVASTFDAGKSDDLTLVATEAIKGLVLACARTKKGTIDPKGIAALAAAVHKAAQAQSVSSDRRRKVEAHFAEKAKEAVATVTKSKGLSAEAADEILAKILGVEK

SEQ ID NO: 5332 - protein, 477 aa, Brucella suis 1330
MPVSLSQTRLLADFPAFFRVSGEVVAVVGGGEEALNKARLVAQTAARLRIIAEKAEPHLAAFIESHGVEHIASPFAPELLDGAKLVFVATGDEAGDRAAAAAARARKIPVNVVDRPALCDFLTPAIVNRAPVTIAIGSQGTAPVLAQMVRARIDAAFSPRLGELAHFAESWRPLVERALPKGLARRGFWRTFFSGKVARAVESGDHEAAHRAAAELIGQGQDASGHVWLVGAGPGAEDLLTLRAQRVLMEADVIVHDALVPEGVIAMGRRDAERLPVGKRKGCHSKSQDEINRLLVKLGQEGKRVVRLKSGDPLVFGRAGEEMAALRAAGIGFEVVPGITSAFAAAADMELPLTLRGVASSLVFTTGHDMTGDVLPGWAKLAVSGATIAVYMGSTVAASVASRLIAAGLHEDTAVAVVENASRSNKRMFHGTLKDLPQLENRKELSGPVMVVIGDAVAGAAIGRAQALSLKPVPVAA

SEQ ID NO: 5333 - protein, 478 aa, Rhodopseudomonas palustris HaA2
MRFLPVFLDLAAGPVVLVGAGEMARAKLRLLLSAGAAIRWHVTDGDNDLAGISEADRARITLATGEPAEADLSGAIALMCAGAGDLAALLAARARALGVPVNVMDELSHSTFIFPAIVDRGDVVVAIGTGGSSPVVARRVREMIETLLPARIGDLAALIGRWRKPIKARIAEFPLRRRFWERVVDGPIGKAVLEGRGAEAEDLLEAITDPSAYARDSVSAHTEGHVTLVGAGPGDPDLLTIKALRALQDADVVFYDELVSPEILDRIRRDAARVPVGRRIGKPGIGQEAINALLIEAAQAGQRAVRLKGGDPFVFGRGGEEIEALRDAGVSYAVVPGISAGFGAAAQFEVPLTYRHEALRITFLTAHKAKDAEAVDWTALTDQKMTVVVYMGMAAAPTVRAGLLTAGRSPQTPVGVFARVTRPDAKAAVGTLDDLPALVEQVEVGPAILVIGDVVAHSAPWRRQQLQQLVSTYQVAAE

SEQ ID NO: 5334 - protein, 256 aa, Novosphingobium aromaticivorans DSM 12444
MSNSSSRIGTVHLVGAGPGDADLLTLRAARLVMNARVLVHDGLVDPSILAMAPKGCRMISVAKSRSRHTMKQGEINALLVREALAGNDVVRLKGGDPFVFGRGGEEAEDCLAAGVPVQVVPGVSAAMGAAAAAMIPLTHRESASIVSFVAGQCKGLTDQNWAGLAGVGRTLVIYMGVATSEAIAEKLMADGLAPEMPVAVVENAARPQMRVLRGTLAGLGCLVADNKVRSPALIVIGEVAGRGDMMELRQVLEAAR

SEQ ID NO: 5335 - protein, 499 aa, Rhodospirillum rubrum ATCC 11170
MDSFPIFLTLTGVRVLVVGGGAAAAAKARLALKAGARVSVFAPALSADWQDLRGHPALDHRQGFPGQGGEEEWRDVRLVYAAGESLEEDRAVHAAASARGVLVNVVDRPELCDFLTPAIVDRSPIVVAIGTGGRAPVLARRVRAAIDRLLPARLGALARLAEGFRGTVAQALPDGDRRRRFWDRFFDGAPALAALEGDEPRARTAALRLLNDGEALDNGAPAAGVVHLVGAGPGDPDLLTLKAQRLLQEADALVYDDLVGEGILDMARRDAARIYVGKRKGRASLTQEQIGRLMCDLAAAGRVVVRLKGGDPAVFARLSEEIDALAAAGVAWTVVPGITAASAAAAAIGISLTDRDGAPSVTLLSGHRRAPAAGESEAAVDWRAAARTGGTLAVYMGLSRATAAAEGLIEGGLSAETPVAVVHDASRQGQRVSRGTLGELPRLVAQGALAAPDAPGLVLVGKVVAKAGRLPAIAPVFSTPRAFAGDPSFASQALPSQAG

SEQ ID NO: 5336 - protein, 480 aa, Mesorhizobium BNC1
MAGETAKLNAFPVFLRVEGRRVVIVGSGGEALAKARLMAQSSAEILIVAEKPEPALAAWAAENGAALTRSSYNPALLDGAVLVFAATGDEEADRAVVADARERSIPVNAVDRPELCDFFTPALVNRAPVAVAIGTEGAGPVLAQMIRARIDQMLSPSLGRLALLAASYRAAVEHRLAKGVVRRRFWKAFFTGGPACAVEAGNADRAAWAAEMLLDSQGVEPGHVALVGAGPGAEDLLTLRAQRLLMEADVIVHDALVPEAVVAMGRRDAERIAAGKRKGCHSKTQAEINELLVALGRNGKRVVRLKSGDPLIFGRAGEEIAALREAGISYEVVPGVTAAFAAAADFELPLTLRGIASSLVFTTGHDLKGQALPDWAKLAIDGATVAVYMGRSTAAEVAQHLQEAGLSPDTAVAVVENASLGNRRLFHGTLSDLPALGRRADLSGPVLTIIGDAVAGANLARSEPLAAYHEHGARTPAEEE

SEQ ID NO: 5337 - protein, 478 aa, Brucella ovis
MMPVSLSQTRLLADFPAFFRVSGEVVAVVGGGEEALNKARLVAQTAARLRIIAEKAEPHLAAFIESHGVEHIASPFAPELLDGAKLVFVATGDEARDRAAAATARARKIPVNVVDRPALCDFLTPAIVNRAPVTIAIGSQGTAPVLAQMVRARIDAAFSPRLGELAHFAESWRPLVERALPKGLARRGFWRTFFSGKVARAVESGDHEAAHRAAAELIGQGQDASGHVWLVGAGPGAEDLLTLRAQRVLMEADVIVHDALVPEGVIAMGRRDAERLPVGKRKGCHSKSQGEINRLLVKLGQEGKRVVRLKSGDPLVFGRAGEEMAALRAAGIGFEVVPGITSAFAAAADMELPLTLRGVASSLVFTTGHDMTGDVLPGWAKLAVSGATIAVYMGSTVAASVASRLIAAGLHEDTAVAVVENASRSNKRMFHGTLKDLPQLENRKELSGPVMVVIGDAVAGAAIGRAQALSLKPVPVAA

SEQ ID NO: 5338 - protein, 484 aa, Sinorhizobium medicae WSM419
MPQKLSVFPAFFRVAQKSVAVFGNGDEAFAKVRLLLSTEARIVAYADQPEAAFEAFLNANGIDTIRKPFDARQVEGAVLVFAATGDAAFDRIIVAAARERKIPANAVDQPDYCDFLTPALVNRAPVAVAIGTEGAGPVLAQMIRAQIDQLLSPSLGIVASLAASYRDAVDRLVPRGVARRVFWRRFFSGPVADHVALGDLASARREASKLLDAAGGVRGHVWLVGAGPGAEDLLTLRAQRVMMEADAIVYDALVPQAIVDMGRRDAERLSVGKRKGCHTKSQDEINHLLVRLAGEGKRVVRLKSGDPLVYGRAGEEMAAMREAGISYEVVPGITSAFAAAADFELPLTLRGVASSLVFTTGHDLTGSVLPDWARLAVSGATIAVYMGRTVAASVASRLMQAGLPQDTTVAVIENASRAERRLLHGTLRDLPDLETRTELDGPVMVIIGEAVAGANFERSEPLAAARGNGSGAVEASAKRETIWN

SEQ ID NO: 5339 - protein, 475 aa, Ochrobactrum anthropi ATCC 49188
MSLSQKRLLADFPAFFRVSEEVVVVVGGGEEALNKARLVAQTSARLRIVAEETEHHLADFIANHGAEHVAVPFAPEHVEGAKLVFVATGDEAQDRAIAAVVKAQKIPVNVVDRPALCDFLTPAIVNRAPLTIAIGSEGTAPVLAQMVRARIDAAFSPRLGELAHFAESWRPLVERALPKGLARRSFWRGFFSGRVAHAIENGDREEAQKAASDLIKQRDNAAGYVWLVGAGPGAEDLLTLRAHRALMEADVIVHDALVPEGVIAMGRRDAERLAVGKRKGCHSKSQEEINRLLVTLGREGKRVVRLKSGDPLVFGRAGEEMAALRAAGIGFEIVPGITSAFAAAADMELPLTLRGVASSLVFTTGHDMTGDVLPGWTKLAVSGATIAVYMGSTVAASVAARLIGAGLHEDTAVAVVENASRQDKRLFHGTLKDLPDLESRKELSGPVMVIIGDAVAGAAIDKAEALALRPVSVAA

SEQ ID NO: 5340 - protein, 317 aa, Caulobacter K31
MARPTVRSDSRQPSRLGGGLVALGGGTSVRAPGRVTLVGAGPGDPELLTIKALKALQAADVIVHDGLVSDEILDLAPVAARRINVAKRKSRHTLPQDDINQLLVALALDGLTVVRLKGGDPFLFGRGGEELSACRAAGVDCTVVPGVTAALAASASAGAPLTHRGSAQAVTFVTGHAAPQNGEMGEPDLDWTALSRPNQTVVVYMGVSTAGLIADRLTAAGRAGSTPALIVENASRADERRILTTLADLALAAEGLKGPALLMVGESMAMAVDAVPDNLVLRQAQDEVVSGAAVDLILSLSKDEVASPADQRVSSAR

SEQ ID NO: 5341 - protein, 478 aa, Rhodopseudomonas palustris TIE 1
MRFLPVFLDLATGPVVLVGAGEMARAKLRLLLGAGASVRWYVTDGDRDLAGLTEPERSRISFPEGDPLHADLTGAIALLCAGAGDVAAPLAAKARALGVPVNVMDELSHSTFIFPAIVDRGDVVVAIGTGGSSPVVARRLRELIETVVPARIGELAALIGRWRTPIKARIPEFPLRRRFWERVVDGPIGRAVLEGRLTDAETELKTIDDATDYARHSLGRRADGHVSIVGAGPGDPDLLTLKALRALSDADVVFYDELVSPEILDRIRRDAKRVPVGRRVGQPGIGQDAINKLLIETARSGQRAVRLKGGDPFVFGRGGEEVEALREAGVSYSVVPGISAALGAASQFEVPLTYRHEALRITFLTAHKAKDAEAVDWSALTDQKMTVVVYMGMSAAPTIRDGLLAAGRAADTPVGVFARVTRPDAVSAVGTLDNLPALVEQVDGGPALLVIGDVVAHSAPWRQQQLLQLVSTYQMAAE

SEQ ID NO: 5342 - protein, 478 aa, Rhizobium leguminosarum bv  trifolii WSM2304
MSPKTEQLSVFPAFFRVEGQKTAVFGNGDEAFAKVRLLLNTRARIVAYADRPEADYHAFLIANRIETVRAGFSAEQVAGSALVFAATGDEADDREIVDAARAARIPANAVDQPDYCDFFTPALVNRAPVAVAIGTEGAGPVLAQMIRAQIDQLLSPSLGRLAGLATSYRKSVEQLVPRGVSRRVFWRRFFSGAVADAVANGNLPQARHAADRLLGSMDKVAGHIWLVGAGPGAEDLLTLRAQRVMMEADVIVYDALVPQAIVDMGRRDAERLSVGKRKGCHSKSQEEINDLLVDLGRQGKRVVRLKSGDPLVYGRAGEEMAALRAAGITYEVVPGITSAFAAAADFELPLTLRGVASSLVFTTGHDLTGDVLPDWASLAVSGATIAVYMGRTVAASVAERLMQAGIPSETTVAVIENASRAERRLLHGTLADLPDLQHRDELTGPVMVIIGDAVAGANFELSEPLVRANARLEELARS

SEQ ID NO: 5343 - protein, 485 aa, Agrobacterium vitis S4
MSIESDKLAVFPAFFRVSGAKLAVFGDGDEAFAKARLIANTSATIIAFTRDPAPAYAAFLKRKTIEIDPSPFSPDLLAGMKMVFAATGDGAADRMIVEAARLQKIPANAVDQPDYCDFYTPALVNRAPIAVAIGTEGVGPVLAQMIRAGIDRQLPRSLGKLGRLANSYRHAVDRLLPRGVARRLFWRSFFQGDVADAMEGGDVKAARRRATKLLKSAANTVPEGRIFLVGAGPGAEDLLTLRAHRLMMEADAIVYDALVPQAVVDMGRRDADRIPVGKRKGCHSKSQSEINDLLVALGQAGKRVVRLKSGDPLIFGRAGEEMAALRDAGIAYEIVPGVTSALAAAADFELPLTLRGVSSSLVFTTGHDLTGDVLPDWARLALSGATVAVYMGRTVAASVAERLIAGGLAQDTTVAVVENAGRGDRRLLHGTLRELPGLEAMTELTGPVMVIIGDAVAGANFERSMPLAQARLGLANVDQQQMTRV

SEQ ID NO: 5344 - protein, 478 aa, Rhizobium leguminosarum bv  trifolii WSM1325
MPSKTEQLSVFPAFFRVEGQKTAVFGNGDEAFAKVRLLLNTRARIIAYADRPEADYHAFLIANRIETVRAAFAAEQVEGSALVFAATGDEADDRSIVDAARAARIPANAVDQPDYCDFFTPALVNRAPVAVAIGTEGAGPVLAQMIRAQIDQLLSPSLGRLAGLATSYRKSVEQLIPRGVSRRVFWRRFFSGAVADAVANGNLPQARHAADRLLHAMDKVAGHVWLVGAGPGAEDLLTLRAQRVMMEADVIVYDALVPQAIVDMGRRDAERLSVGKRKGCHSKSQEEINDLLVDLGRQGKRVVRLKSGDPLVYGRAGEEMAALRAAGVTYEIVPGITSAFAAAADFELPLTLRGVASSLVFTTGHDLTGDVLPDWASLAVSGATIAVYMGRTVAASVAERLMQAGIPSETTVAVIENASRADRRLLHGTLADLPDLQHRDELTGPVMVIIGDAVAGANFELSEPLVRANARLEELARS

SEQ ID NO: 5345 - protein, 375 aa, Jannaschia CCS1
MDALPAQTREETGFDGRAYALALASVRMLDALGIWNQVEDHAQPMLEIKASDGRAGEGAAPFFLHFDHAEIEEGPMGHMLEDRYLRRALMAAMEASSLVAHRAASRVLSQDTNGMASVTLDGGEVLRGRLLIGADGKRSGVAERAGIRRMGWDYNQTALVCAVDHDRPHNGIAHQFFMPGGPLAILPLPGNRSSIVWSESEPRASELAAADDDTFMDALRPAFGDFLGNISLTGQRHSYPLSLSLAQAFVAEKLALVGDAAHGVHPIAGQGLNLGLRDVSALAETLADAKRRGEDFARRDVLDRYQQWRRFDTAGLAVATDSVNRLFSNDNPAVRAIRDIGMGAIGALPTLRRRFIREAAGLTGDLPRLMQGRTL

SEQ ID NO: 5346 - protein, 406 aa, Rhodopseudomonas palustris BisB18
MTAQRGIVIGGGAFAGLALALALRQGLGPDVPVIVADPALSLRPSRDPRATAIVAACRRLFDTLGVWQAVAPHAQPILDMVVTDSALEDATRPVFLTFAGQIEPGEPFAHMVENRHLIDALAERAEAAGVELRATAVTGYESRLEATSVTLGDGSVIDAALLVAADGARSKLRERAGISTYGWDYDQAGIVVTVEHERDHNGCAEEHFLPAGPFAILPLVGKRSSLVWTESRAEAARIVALSDAEFHRELEQRFGLRLGEVKALDKPKSFPLGYFVAQSFIGERLALIGDAAHVIHPIAGQGLNMGLKDVAALAEVIVDAARLGIDFGQADVLDRYQVWRRFDTMAMGVATNSLNLLFSNKSTLLRSVRDIGLGVVDRLPPLKELFIRQAAGLGGEVPRLLKGEAL

SEQ ID NO: 5347 - protein, 439 aa, Rhodopseudomonas palustris BisB5
MSGRTAAVITTAVPACFAQLRHGRKNSGARARKMTAPRSIVIGGGAFAGLALALALRQGLGPEVPVIVADPALALRPSRDPRATAIVAACRRLFEALGVWDEVAPTAQPIIDMVVTDSALEDATRPVFLTFAGEVQPGEPFAHMVENKYLIEALAKRAEAEGVELRATPVTSYQSRAEATMVTLGDGSVIEASLLVAADGAKSKLRERAGISTYGWDYDQTGIVVTVAHERDHNGCAEEHFLPAGPFAILPLTGKRSSLVWSESRADAAKIMALPDAQFQAELEKRFGLRLGEVKPLDKPKAFPLGYFVAQSFIAPRLALIGDAAHVIHPIAGQGLNMGLKDVAALAEVVVDAARLGIDPGQVDVLERYQRWRRFDTMAMGVATNGLNLLFSNKSPLLRSVRDIGLGIVDRLPPLKEVFIRQAAGLGGETPRLLKGEAL

SEQ ID NO: 5348 - protein, 408 aa, Ruegeria sp. TM1040
MTDTRDILIVGGGLNGPSLALALAQAGHSVTLIDALPAPLREDAEFDGRSYALALASTRLLQQIGIWAVIEDHAQPMNEIKVSDGVAGRGPSPLFLHFEESDLDEGPMGYMVEDRYLRRALLKALEAEPKITQISGQPVIAQTVSADAITVTLEDGTQLSGALLVGADGRQSGTAARAGIKRTGWDYGQTALVCAISHAQPHNGIAHQFFMPPGPLAILPLPGNRSSIVWSETHAEAARIQALSDQDYLSVLRPRFGSFLGEIDLEGKRFSYPLKLSLANAFYGERLALVGDAAHGLHPIAGQGLNAGLRDIASLAEVLTDAARRGEDLASPLVLARYQQWRRFDTTSLALATDVFNKLFSNDNPILRATRDLGLGLTNALPGLRRGFVREAAGLSGDLPRLLRGRPL

SEQ ID NO: 5349 - protein, 409 aa, Rhodobacter sphaeroides 2 4 1
MTQAADILIAGGGLNGPALALALARNGFSVTVVDGRPAPQRAEPGFDGRAYALALASKRLLAALGLWDGLASQAQPILRVVTADGTTAGGPSPFVLAFDHAEIEEGPMGYLLEDRFLYAAFLAALEAEPRIRLVSGTTVEAQEVGPQGVTVTLSTGAQLSGRLLVGCDGRQSGTARRAGIRRSGWGYGQTALVTAIEHERPHEGTAWQYFLPGGPLAILPLPGGHRSSIVWSESDAAAAGIQRLPDADYLGALRPRFGDFLGSIRLAGDRFTYPLSLSLAHSFVAPRVALVGDAAHGVHPIAGQGLNLGLRDVAALAEVLTLAARRGEDVGSPLVLDRYQQWRRFDATALALGMDMVNRLFSNDNPVMRAGRDLSMGIVNALPGLRRGFIRQAAGLSGDLPRLLQGRPI

SEQ ID NO: 5350 - protein, 409 aa, Rhodobacter sphaeroides ATCC 17029
MTQAADILIAGGGLNGPALALALARNGFSVTVVDGRPAPQRAEPGFDGRAYALALASKRLLAALGLWDGLASQAQPILRVVTADGTTAGGPSPFVLAFDHAEIEEGPMGYLLEDRFLYAAFLAALEAEPRIRLVSGTTVEAQEVGPQGVTVTLSTGAQLSGRLLVGCDGRQSGTARRAGIRRSGWGYGQTALVTAIEHERPHEGTAWQYFLPAGPLAILPLPGGHRSSIVWSESDAAAAGIQRLPDADYLGALRPRFGDFLGSIRLAGDRFTYPLSLSLAHSFVAPRVALVGDAAHGVHPIAGQGLNLGLRDVAALAEVLTLAARRGEDVGSPLVLDRYQQWRRFDATALALGMDMVNRLFSNDNPMLRAGRDLGMGIVNALPGLRRGFIRQAAGLSGDLPRLLQGRPI

SEQ ID NO: 5351 - protein, 408 aa, Rhodobacter sphaeroides ATCC 17025
MTQDADILIAGGGLNGPALALALARNGFSVTVVDGRPAPLRAEPGFDGRAYALALASQRLLAALGLWDGLAPRAQPILRVVTSDGTTATGPSPFVLAFDHAEIEEGPMGYLLEDRFLYAAFLAAMEAEPRIRLISGATVEAQEVGASGVTITLSTGAHLSGRLLVGCDGRQSGTARRAGIRRSGWGYGQTALVTAIEHERPHEGTAWQYFLPSGPLAILPLPGNRSSIVWSESDAAAAEIQRLPDADYLTALRPRFGDFLGAISLAGERFTYPLSLSLAHSFVAPRVALVGDAAHGVHPIAGQGLNLGLRDVAALAEVLTLAARRGEDVGSPLVLDRYQQWRRFDATALALGMDMVNRLFSNDNPILRAGRDLGMGIVNAVPGLRRGFIRQAAGLTGDLPRLLQGRPI

SEQ ID NO: 5352 - protein, 422 aa, Sphingomonas wittichii RW1
MVRWWHVRRRRPKAVRMERQDVIILGGGLVGLTLGIALARHGIMAAVIDPADPDRMLASGFDGRASAVASAPWRMLDAIGVGAYLQGRGCPIDAIRVQDGLSPESLMFEPSADDGALGYMFENRDLRIALDTTARAADGLTLLRPARPVDVRRDLDGVRVTLADGREVAGSLLIGAEGRQSPTREAAGITCARWSYDHVAMIASIAHEKPHGNVAYEIFYTAGPFAILPLVDDAEGRHRSALVWTVDKKHAPAMLGLPDRAYQAEAEKRMGGMLGAVSLISPRSSYPLGFHHAARITDTRLALVGDAAHGIHPIAGQGVNLGYRDVAALTEVLVEGMRLGLDPGDAQLLDRYQRWRSLDSFMVAASTDGLTRLFGIPGRTARTVRRIGLGAVQRLGPLKGRFMAEARGETGKLPRLLQGMAI

SEQ ID NO: 5353 - protein, 404 aa, Sinorhizobium medicae WSM419
MIDVLIAGGGYVGLSLAVSLKKAAPHLDVMVVDAAPEGAWKKDERASAIASAAERMLEILGVWQAIAPEAEPILRMVITDSKTADPVRPVFLTFEGDGGDGRPFAHMVPNTALVGALRRACDELGVSVRQSTLVESFKTGDHSVAVTLAGGEAVESRLLVACDGVRSRLREAAGIKVVEFDYGQSGIVTTVEHERPHGGTAEEHFLPAGPFATLPLKDNRSSLVWTESTYDAERLVKEDDFIFEEELERRFGHKLGRLKVVGGRRAFPLGLTLARDFVASRFALAGDAAHGIHPISGQGLNLGFKDVAALAETIVEADRLGLDIGSLAVLERYQTWRRFDTFRMGVTTDVLNRLFSNDIMPVRVARDFGLGVVDRMPSLKKFFIRQAAGAPGRNDPRLLAGEPI

SEQ ID NO: 5354 - protein, 430 aa, Xanthobacter autotrophicus Py2
MTGLTMSEPQAEMPHAGAGFAATAAAPRADVAIVGGGLAGLSLALALRQGLGPDADIVLFDPYLSHATVDDGRCSAIAAGARRMLTTLGVWQHVGAKAQPIQAMVVTDSRTKDVARPTFLTFDGDVEPGEAFAHMVPNADLQYALIDAARSAGIDLRAQSVDDFTADRSGVSLSAAGAPTLRAQLLVACDGAKSRIRGMAGIANVAWGYGQSGITFAVEHERPHEGRAEEHFLPPGPFAILPLPGNRSSIVWTERTEDAERIVGLPSIVFQEELEQRFGHRLGWVKPVTKPRAYPLGFAMARSFIGERLALVGDAAHLIHPIAGQGLNMGLRDVAALAEAVTDAARVGLDFAGPAVLERYQRWRRFDTLAMGVATDGLNRLFSNRSDALRAVRDLGLGLVDRMPRLKGLFIRDAAGLTGQVPKLLRGEAL

SEQ ID NO: 5355 - protein, 416 aa, Caulobacter K31
MRDHDADVIIAGAGMAGTTLALALASAGVTAVLVDPQPFDAQLAESFDGRSSAIAYSSFRQWRAIGAGEALEPHAQRIEQILVTDGKTPGPASGGPSPFFLRFDSSEIADRSEGEPLGYLIENRQIRTALAKTVIDKGITVLAPVAAKALEVTAAAATLTLTDGRTLSAPLVVSAEGRGSVLRKAAGIGDIGWSYGQSGVVATVRMQHPHQGVAHEYFLPSGPFAILPLTDNRASLVWTESTLRAEALRNASPEAFHSHLMRRFGEFLGKVEMAGPTFVYPLSLSLAERLVAPRLALIGDAAHGVHPIAGQGLNLGLKDAAALAEVVAEALRNGEDIGAESTLERYARWRRFDNVTNALAFDGFVRLFSNDNPLLRLARGVGLAAVNRIAPARRFFMHEAGGGVGDLPKLLRGVGI

SEQ ID NO: 5356 - protein, 406 aa, Rhodopseudomonas palustris TIE 1
MTAPRSIVIGGGAFAGLALALALRQGLGPEVPVIVADPALALRPSRDPRATAIVAACRRLFEALGVWDEVAPTAQPIIDMIVTDSHLEDATRPVFLTFAGEVQPGEPFAHMVENRYLVEALAKRAEAEGVELRATPVTSYDARTEAIGVTLGDGSVIDASLLVAADGAKSKLRQRAGIATYGWDYDQSGIVVTVEHERDHNGCAEEHFLPAGPFAILPLTGRRSSLVWSESRRDAERIVALPEKEFQRELEKRFGLRLGDVKPLDKPKSFPLGYFVAQSFIAPRLALIGDAAHVIHPIAGQGLNMGLRDVAALAEVVVDAARLGIDPGQVDVLEGYQRWRRFDTMAMGVATNGLNFLFSNNSPLLRGIRDIGLGLVDRLPPLKGAFIRQAAGLTGETPRLLKGEAL

SEQ ID NO: 5357 - protein, 404 aa, Rhizobium leguminosarum bv  trifolii WSM2304
MLDMLVVGGGYVGLSAAVAVKQAAPHLNVAVVEAAPEHVWKNDTRASAVIAAAAKMLEIFGIWNEIEPEAQPITKMIVTDSKTSDPVRPVFLTFDGEVAEGRPFAHMIPNVAMVAALRGVCERLGIDIRHGLGATELKTEDSHVTVTLSDGSTLESRLLVACDGVRSKLRDLAGIKTVTWDYGQSGIVATVEHERPHEGCAEEHFLPAGPFAILPLRNNRSSLVWTERTHDADRLVGADDLVFEEELERRFGHKLGALKVIGDKRAFPLGLTLARAFVAPRFALAGDAAHGIHPISGQGLNLGFKDVAALAETIVEADRLGLDIGSINILERYQTWRRFDTFRMGMTTDVLNRLFSNDATPIRIARDIGLGLVDRLPRLKSFFIGQAAGTTAKDNPRLLAGQAI

SEQ ID NO: 5358 - protein, 378 aa, Agrobacterium vitis S4
MDVTVIEAAPEGQWRKDPRASAVIAAATKMLEVFGVWSTIEPQSQPINRMIVTDSRTSDPVRPVYLTFDGEVEEGKPFAYMVPNVAMVGALLDAAGAAGISIRHGVKAAGFSVKGHKAEVALSDGTTLDCRLVVACDGVRSRVRDMAGIKTVTWAYGQSGIVTTVEHERPHEGVAEEHFLPAGPFAILPLTGNRSSLVWTERSEDADRLVAEDDLMFETELERRFGHKLGAIRATGDRRAFPLGLTLARSFIGPRLALAGDAAHGIHPISGQGLNLGFKDVAALAETIVDADRLGLDIGDLTVLERYQTWRRFDTFRMGVTTDVLNRLFSNDITPLRIARDFGLGLVERLPKLKSYFISEAAGTSVKGGPKLLTGQSI

SEQ ID NO: 5359 - protein, 404 aa, Rhizobium leguminosarum bv  trifolii WSM1325
MLDMLVVGGGYVGLSAAVAVKQAAPHLNVAVVEAAPEHVWKNDTRASAVIAAAAKMLEVFGIWNEIEPEAQPITKMIVTDSKTSDPVRPVFLTFDGQVSEGRPFAHMIPNVAMVAALRGACERLGIDIRHGLGATELKTHDTHVTVTLSDGGTLETKLLVACDGVRSKLRDLAGIRTVTWDYGQSGIVATVEHERPHDGCAEEHFLPAGPFAILPLKNNRSSLVWTERTPDANRLVAADDLIFEEELERRFGHKLGSLKVIGDKRAFPLGLTLARSFVAPRFALAGDAAHGIHPISGQGLNLGFKDVAALAETIVDADRLGLDIGSINILERYQTWRRFDTFRMGVTTDVLNRLFSNDATPIRIARDVGLGIVDRLPRLKSFFIGQAAGTTAKDNPRLLAGETI

SEQ ID NO: 5360 - protein, 178 aa, Pelobacter carbinolicus
MSALKGTKTEKNLLEAFAGESMARNKYSYFASVAKKEGYQQIAAIFQETADNEKEHAKLHFKALQGIGSTMDNLKAAAAGENEEWTEMYPRMAEEAREEGFDDLARMFENIASIEKAHQERYERIVKAIEAGTVFTRDSEQLWKCRNCGHLLTAKAASNICPVCDHPQAFFEIEVNTF

SEQ ID NO: 5361 - protein, 166 aa, Chlorobium luteolum DSM 273
MPTTHENLKSAFGGESQAFMKYVTFAKKAEKDGFKNIARLFRTTAEAERIHAEAHLMADDAVGSTAENLETAIGGETYEHNEMYPPMYEQAVSEGHKAKRMFGFAVEAEKVHAALYRHALESVKNGQDIVETAVWLCPVCGHIELVTPPEKCPICNVKAEVYVQVA

SEQ ID NO: 5362 - protein, 146 aa, Frankia CcI3
MPKLDGTKTHENLKEAFAGESQANRRYLYFARRADIEGLTDASSLFRDTAEGETGHAFGHLDFLAEVGDPATGEPLGTTTKNLASAVAGETYEFTAMYPGFAKTAREEGFEEIADWFSTLARAEKTHAGRFKKALDALSAEETADA

SEQ ID NO: 5363 - protein, 191 aa, Pelobacter propionicus DSM 2379
MPSIKGTKTEQNLLKSFAGESQARNRYTYFASVARKEGYVQIADIFEETASQEKEHAKRFFKFMEGGDVEITACFPAGRIGTTTENLLAAANGEHEEHSELYPGFADVAAQEGFNEIAQAWRAISVAEKQHEKRYRDLLANIEAGRVFKREIEVTWRCRNCGYLHTGTVAPELCPACIHPRDHFELLGENW

SEQ ID NO: 5364 - protein, 191 aa, Desulfovibrio vulgaris DP4
MKSLKGSRTEKNILTAFAGESQARNRYNYFGGQAKKDGFVQISDIFAETADQEREHAKRLFKFLEGGDLEIVAAFPAGIIADTHANLIASAAGEHHEYTEMYPSFARIAREEGYEEIARVFASIAVAEEFHEKRFLDFARNIKEGRVFLREQATKWRCRNCGYVHEGTGAPELCPACAHPKAHFELLGINW

SEQ ID NO: 5365 - protein, 167 aa, Fervidobacterium nodosum Rt17-B1
MREMTKKFLEDAFAGESMAHMKYLIFADEAEKKGLKKLANAFRAIAYAEFVHARNHFRALKKLGDTPDNIKSCIAGETFEIEEMYPVYKETAKLQEEKEAQISTHYALEAEKIHAEMYKKALNLVNEGQDYDAEKIYICPVCGYTAEDVAPEKCPVCGAPKSAFVEF

SEQ ID NO: 5366 - protein, 146 aa, Frankia EAN1pec
MPKLDGTKTHENLKEAFAGESQANRRYLYFARRADIEGLTDAASLFRDTAEGETGHAFGHMDFLAEVGDPATGEPVGNTSKNLASAVAGETYEFTAMYPGFAKTAREEGFEEIADWFSTLARAEKTHAGRFKKALDAVVAEETADA

SEQ ID NO: 5367 - protein, 156 aa, Caldivirga maquilingensis IC-167
MANKIPKGTKTYENLKAAFQGESMANRRYLYYARLARQKGLNDIAEVFEKTANAETGHAFGHLMYLGVDPVAEIEINTIEDALKASIYGETYEWTQMYPAFAKVAREEGFLEVAEWLEAVAKVERFHANRFNEALEKYYKSAGVKTEVEDETLGRL

SEQ ID NO: 5368 - protein, 179 aa, Elusimicrobium minutum Pei191
MKLKGTKTEKNLQIAFAGESQARMKYGYYAKKAKEEGYIQISKIFKETAKNEREHAKLWFKFLHEGNIPSTLENLEDAAKGENYEWTDMYANMAKDAEEEGFKDIAFLFKKVAEIEKQHEERYRKLFANIEGDKVFKQDEKVVWQCINCGFTCENKDAPEVCPVCKYAKAYFEIRKINY

SEQ ID NO: 5369 - protein, 191 aa, Desulfovibrio vulgaris  Miyazaki F
MKALKGTKTERNILTAFAGESQARNRYDYFGARAKKDGFVQIADIFAETASQEKEHAKRLFKFLEGGEVEIVAAFPAGIIGDTHANLISSAAGENHEYTEMYPSFARIAREEGFDEIAKVFMSIAVAEEFHERRFLGFAKNVKEARVFVRESSVVWRCRNCGFLHEGNEAPHLCPACAHPQAHFELLGINW

SEQ ID NO: 5370 - protein, 146 aa, Thiobacillus denitrificans ATCC 25259
MSDDPLLDKMDALLKKHRGAGESAHLGPPAAAPAPGQPPAWLPVLTDVIERGTPPAATEAAPQPPAPAVESDAPQAPAASDALAEQLMSELAPRLSEVMEKQVAAELRKNIDETVTNLLSQLDVNMREIVREAVAEKLKQPRKPAS

SEQ ID NO: 5371 - protein, 100 aa, Rhodoferax ferrireducens T118
MNTIPRNLPRFVPTLTEVVEPASLVRTAPSTGRDVDEIIQSVMQRVDRVLDCRLREDADAMLRNLVTEQLHTLQLSLRAELALVVQQAVAEAMALREDDH

SEQ ID NO: 5372 - protein, 109 aa, Polaromonas JS666
MRSSSTPPRFVPTLTEVVRPTAPAGTSSEPVAPAAPPLDSSGLEERVVLRVMQRVDLILERRLREVVGQLILEQTQTLAPRLRGEIELVLRETVSQALAQEASKTPGRP

SEQ ID NO: 5373 - protein, 178 aa, Acidovorax avenae citrulli AAC00-1
MAATPPKGPPKFVPTLTDVVQVSGDAVPGAAHGDAAPSGTEPPPAGDARPAVPAGTPFPAPVPASAAPAATEASAEGVPIAAVPVLAAAPPAAPVEPSVPPLTAADFSGIEEMVIHRIIQRVDVVLDQRLREAIATVVQEQTRSMVPRLREEVESVVRHAVYEAVADELASPGGPAQR

SEQ ID NO: 5374 - protein, 143 aa, Acidovorax sp. JS42
MTTPTKKPPRFVPTLTDVVQMPEAEGSSARPSPPPVTRPATTAASLSVPLPAAPHSPPPLAVPAPVAPLPAGLPYGFEEYVVHRVMQRVDVVLDQRLREAIAVVVQEQTRSMVPRLREEVESVVRQAVYEAVAEELAGERSGH

SEQ ID NO: 5375 - protein, 115 aa, Polaromonas naphthalenivorans CJ2
MSRLTGPPADVPTLTEIVHPVVAGGAASGGAVGVAPASAEMQELMVRRVLQRIDLVLERRLHEAIEQLILEHADGLLPRLREEIELVVRESVSQAFGQESEAFAARPQSRQQDVL

SEQ ID NO: 5376 - protein, 111 aa, Verminephrobacter eiseniae EF01-2
MVLPPKTPPRFVPTLTEVVPQTDAAPAAAPARPLPEDRQEQLLQRVLQHVDKLLEQRLRETLADTVLPGLRAEIEAMVREAVADGRAAGAAGLSGASGAMGTRGASPDAKG

SEQ ID NO: 5377 - protein, 149 aa, Leptothrix cholodnii SP 6
MRPPPDIVPTLTEVVGFSETAPVAADQASPAAGARGANVMPLNVVPLHSLEVDLPVDLSNDRCGPGAADGSLTVGAFPIDEDELTQRVLLDVQRQIDRMFEFRVRESVGPAFARLMESFIEQTRDELAATLRDVVRRAVAQELARHRSR

SEQ ID NO: 5378 - protein, 143 aa, Diaphorobacter TPSY uid29975; identical to SEQ ID NO: 5374

SEQ ID NO: 5379 - protein, 135 aa, Variovorax paradoxus S110
MASTLRTPPRFVPTLTTVLDLPAEPPAAEAATPASAPPPPAVDPAEAVALPPAEQRSEAEIVRLEEQLLHRVLQRVDLSLEERLSDTVSAAVQQQLDAMVPRLREEIEAVLRALVIEAMAAELSENTGSTPASGA

SEQ ID NO: 5380 - protein, 126 aa, Frankia CcI3
MRHLSYLAVLAGCLLGTAPLEVFLGTRVYARPVRLLLTLAPVIVIFVVWDLFAVSAGHWSFDRRRITGILLPGGLPLEELLFFAVVPMCAILTLEAVRAVRGWDVGDEPAHPSATRSDGTPDGDRP

SEQ ID NO: 5381 - protein, 114 aa, Mycobacterium MCS
MDRFHYLLVLGACLLVTLPLEVFGAGVYRQARRAAAAILPIAAVFVVWDLIAIFADVWGYNPRFVTGIGFPGVPIEELLFFIVIPLCGLFTYNAVDTILTYLKRRLRARSAQSS

SEQ ID NO: 5382 - protein, 114 aa, Mycobacterium KMS; identical to SEQ ID NO: 5381

SEQ ID NO: 5383 - protein, 114 aa, Mycobacterium JLS; identical to SEQ ID NO: 5381

SEQ ID NO: 5384 - protein, 146 aa, Frankia EAN1pec
MSRLGHFGGLGHFSYLAVLLGCLVATAPLEILLRTRVYARPRRLLLSVAPVLVVFVGWDLYAIARGHWEFDPRRTTGVLLPGGLPLDEVLFFVVVPVCAVLALEAVRAVTGWQAGDERAGAEQVDGEQVDGERAGDRPADGARGPG

SEQ ID NO: 5385 - protein, 108 aa, Acidimicrobium ferrooxidans DSM 10331
MGHWFYLEVLGLCILVTLPLEVLGARVWRQPRRLALSVGIVAVCFSLIDAVEVYQRLWHYNPRYVTGLRIGDLPIEEVAFFVVIPICSLLTYETVRRRHELVARWRRR

SEQ ID NO: 5386 - protein, 115 aa, Actinosynnema mirum DSM 43827
MEDRWHYLLVLLTCLLVTAPLEALGRGVYRRAGDLVRAICPVVVVFGVWDLVAIARGHWDFNTRFTTGVVLPGGVPVEELLFFVVIPLCSVLTYEAVRGTAALLGGRRRELEAVR

SEQ ID NO: 5387 - protein, 110 aa, Saccharomonospora viridis DSM 43017
MDRWHYLLVLAACLAVTSPLELLGARVYRRPVRAVRAILPAAGVFLAWDVLATAAGVWDFNGRYLVGVELPFGLPLEELLFFLVVPLCGLLTYGCVQAMLAKLRANGTER

SEQ ID NO: 5388 - protein, 115 aa, Nakamurella multipartita DSM 44233
MQHLTYLAVLLACLLLTAPLELVLRARVYGRWRRAAAAILPVAAVFVLWDYLATAAGWWWFDEQFVTGVFIGILPWEELMFFLVVPICALLTFEAVRRLRPGWADAAAPDLEARR

SEQ ID NO: 5389 - protein, 620 aa, Anaeromyxobacter dehalogenans 2CP-C
MADTKLWTRIAVALAAVGALALAVGCPPSKPKGSKRPAAASDIAVAAEKTYVPPGDLDEYYMFSSGGHSGQVFVYGIPSMRHITTIPVFSPYSGTGYGYDDETKAMLGKLTWGDVHHPALSETGGDYDGRWLFVNEMNGRVARIDLRDFKTRQILGPVPNISGNHGSTFITPNSEYILMSSRFSIPIPKGRAVSIDRYASEYKGVAAGIKVDPKTGEMSLGWQVLLPPFDWDLGDAGKKLSEGWFFLTCYNSERATGKLEVTASQRDRDYIAAIDWRLAEKAAAEGKGELIGGVKVLDPKNVPGLVYLMPCGKSPHGVDVSPDGKYVVGSGKLQGVTTAFNFEKVLTAIKNKDFAGEEDGIPVLKYESIKDAEVPVGLGPLHTQFGPDGMAYTSLFVDSALAKWKLGTWEVLDKVPMSYSTGHLAAAEGDTVSPDGKWLVGLNKLSHGRHLSVGPSQPESSQLVDISGDKMKLVYDAFTEPEPHYAQIIKADKLKPIEVYPKEENKHPLAIWDVKDAGVTRKGTEVLAKVVVVRSSMTPALIEVNEGDTVKVALTNIEQTTDELHGFGLLDYNINIVLDPGETKTVTFKADKPGVFPYYCTNFCSALHQEMQGYLVVKPK

SEQ ID NO: 5390 - protein, 647 aa, Anaeromyxobacter sp. Fw109-5
MSSSKSVSKPLAIAAVLVAAAAVAVRCAPREPKGARREAAKSDVSVAAQKTYVAPGDLDEYYMFSSGGHSGQVFIYGLPSMRHLATIPVFAPYPATGYGFDDETKEMLGKLTWGDVHHPALSETKGDYDGRWLFVNEMNGRIARIDLRDFKTRQIIGPVPNVSGNHGSAFVTPNTEYAMMSSRFSIPIPKGTAVSIDKYASEYKGIVAGIKIDPESGKMSLGWQVALPPFDWDLGDAGKLVSDGWMFLTCYNSERGTGKLEVTASQRDRDYIAAINWREAEKAAAEGKGDLIGGVKVLDPRKVPGLVYLMPCGKSPHGVDVSPDGKYIIGSGKLQGVTTAFNFEKVLTAIKNKDFTGEEDGIPVLKYESIKDAEVPVGLGPLHTQFGPDGWAYTSLFVDSALAKWKLGTWEVVDKVPMSYSTGHLSAAEGDTVSPDGKWLVGLNKLSHGRHLSVGPSQPESSQLVDISEDKMKLVYDAFTEPEPHYAQIIKADKVKPIEVYKKEENKNPLAVWDVKDTGASRKGNEVVVKMTAVRSTFTPQLIEVNQGDTVKVAVTNIEQTTDELHGFGLLDYNINLVVDPGETKVVTFKADKPGVFPYYCTNFCSALHQEMQGYLVVRPARAAAPAEGDEGGGARAGREETRRGPR

SEQ ID NO: 5391 - protein, 862 aa, Campylobacter concisus 13826
MQKLFCVASAALLGLSLTAACAASSDLEKVMKERGLSEKDVLAAAKTYQPSGKKDDFIVFSSGGQSGQVLVYGVPSMRIYKYIGVFTPEPWQGYGYDNESKAVLKQGNIRGKEITWGDTHHPNFTEKNGEYVGDYLFINDKANPRIAVINLKDFETTQMVVNPIMKSEHGGSFITPNSEYVIEASQYAAPLDDNYHSMDDYEAVYRGAVTFWKFDYPKGKIDEKASFSLELPPYWQDLSDAGKGESYGWGFTNSINTEMYTGGIEKGLPPFEAGASRNDTDFLHVYNWQILEKLAQDKKNYKVINGHRVITIEAAVKAGALFLIPESKSPHGCDVTPDGRYIIVGGKLDTHASVYDFKKIKELIDKKEFAGTDPYGIPILDREKSMHGQVELGLGPLHTSFDSQDGILYTSLYVDSQIVKWDYKNLKVLDKVNVHYNIGHLDTMEGKSAKPKGKYAIALDKLSIDRFNPVGPLHPQNHQLIDITGAKMDLIYDMPIPLGEPHDVVSIAASKLTPALTYNMGTNSRTGEASPYATLAGQERVERNGKNVTVYATMIRSHINPEHIEVNKGDNVTIHLTNLERAQDETHGFGIDLYNIHASLEPGKTASVNFVADMEGVFPYYCTEFCSALHLEMMGYLLVKDPNKKYESAKNSKLKTLSPEALKAEYDKVIATNKATDDVIQEVVKYLKEKHYEKYPKVKALVDDALDQYGHIKEVKAKADEAYKKGDVNGAILWEYQVWQYMVKTADVGLRAKNNLAKEIATPMSPAAAKGEEAYLKGGCNGCHVIGQVSSGPDLTGVLLRHENGEKWVADFIKDPAKFYNDDYVKAMIDFFKLRMPNQHMSDEEIKNIIQYLKWIDENAGM

SEQ ID NO: 5392 - protein, 648 aa, Opitutus terrae PB90 1
MKRSLHTPLALSLLSLTVLLGGCGRPGGDGAGNGKSGKADANSAAVKTYVAPGQKDEFYLFYSGGHSGQIFVAGIPSMRHLITIPVFTPSPGTGYGFDEETKKMLGGYTWGDVHHPGLSQTDGKYDGRWLFVNDNANNRIARVDLRDFKTKQILGPIPNSSGNHGSSFVTENTENVLVATRFSVPLPKGRYAELNDYEKEFNGMVSGIKVDPQSGEMSVGWQILTPPFDWDLGSTGKGPSSGWAFWTSYNTEMAHDQLEVNASQRERDYAAVVNWKAAEAAVREGKGTDMDGVPVIDPAKVPGVLYFLPVPKSPHGIDVDPSGRWIAAGGKLQPTASVFDFEKIRVAIEKRDFEGEFRGVPILRFESVLEGEVPVGLGPLHTQYDGKGNAYTSLFIESVVTKWKLPPWTDEQKKDLSKAVIDKIPVHFNIGHLVIGGSDTKEPYGRYLVAGNKLSKGRHLSTGPSQPESSQLIDITGEKMAMLYETFTDPEPHFMQILKADVIKPIEVYPKAENKNPNAVWDAKDTSVTRSGNTVEVKALAIRSHFAPERIDAQVGDEVVVHLTNVEQTPDMIHGWGLAEHDINIIVDPGETKTVRFKVTKPGVFPFYCTNFCSALHQEMQGYLAVKPASTASTAPVPTGAGAVAAMP

SEQ ID NO: 5393 - protein, 656 aa, Sulfurihydrogenibium YO3AOP1
MRKLLFGAGIISLSSLLIFGCPSKEQVKSTGGAGGFEDAAKKVYVPPGQYDEFYAFLSGGFNGQLSVYGLPSGRLLKIIPVFSQFPENGYGYTPETKPMLMTSYGFVPWDDSHHPELSQTNGAPDGRWIFINANNTPRIAKISLTTFETTEIIEIPNAAGNHASSFITENSEYLTASTRFSVPIPQKDVEIKSYAQNFKGTISFIKLDPKDGKMSLAFQLLVPGYNYDLAHCGKGPSHDWCFFTSYNTEQAHTLLEINASKNDKDYIAAVNWKKLEQCVAEGKGKDVPTEYYHNILDETKHMATSEVIKSVKMLTPQDCPGSIYYLPTPKSPHGVDVDPTGEYIIGGGKLATVIPIHSFSKMLKAIEGKQFEKEVDGIPVIKYEAVNHCEVPKPCLGPLHTEFDGKGNAYTSCFVSSEVVKYDYKTCKVLDRIPVYYSIGHLMIPGGDSAKPWGKYLLAMNKITKDRYLPTGPELAQSAQLIDISGDKMKMLLDFPTVGEPHYAQGIAASVIKDRVAKIYDLKSNAHPDAIKSEADAKVVRKGNEVHIYLTMIRSHFTPDNIEGVKVGDKVYFHITNLEQDWDIPHGFAVLGMNNSEVLVMPGQTKTLVWEPKKEGVYPFYCTDFCSALHQEMQGYVRVSPAGSNPQIKYGTNKDL

SEQ ID NO: 5394 - protein, 620 aa, Anaeromyxobacter sp. K
MADTKLWTRIAVALAAAGALALVVGCPPSKPKGSKRPAAASDIAVAAEKTYVPPGDLDEYYMFSSGGHSGQVYVYGIPSMRHITTIPVFAPYSGTGYGFDDESKAMLGNLTWGDVHHPALSETGGDYDGRWLFVNEMNGRVARIDLRDFKTRQIIGPVPNISGNHGSTFITPNSEYILMSSRFSIPIPKGKAVSIDRYASEYKGVAAGIKVDPKSGQMSLGWQVLLPPFDWDLGDAGKKLSEGWFFLTCYNSERATGKLEVTASQRDRDYIAAIDWRLAEKAAAEGKGELIGGVKVLDPKTVPGLVYLLPCGKSPHGVDVSPDGKYVVGSGKLQGVTTAFNFEKVLTAIKNKDFAGEEDGIPVLKYESIKDAEVPVGLGPLHTQFGPDGMAYTSLFVDSALAKWKLGTWEVLDKVPMSYSTGHLAAAEGDTVSPDGKWLVGLNKLSHGRHLPVGPSQPESSQLVDISGDKMKLVYDAFTEPEPHYAQIIKADKLKPIEVYPKEENKHPLAIWDVKDAGVTRKGNEVLAKVVVVRSSMTPALIEVNEGDTVKVALTNIEQTTDELHGFGLLDYNINVVLDPGETKTVTFKADKPGVFPYYCTNFCSALHQEMQGYLVVKPK

SEQ ID NO: 5395 - protein, 632 aa, Desulfitobacterium hafniense DCB 2
MEKGLFKKIVLSLAGLLVGLVIAVYLSAQLNPEAEAAAAFGGKNISVDGVPDDVVQAALKTYVPPGQLDEYYMFASGGHSGNVFVYGVPSMRRIRTIPVFTPESAVGYGWTTESKEMLGEWSWGDVHHPALSETKGDYDGRWLFVNDNANSRAARIDLDSFRTSQILDIPNIYGPHSAVFMTPNSEYFMLGSRFAGPIPYGTYSPIENLSKDYNCVLAAVAIDPNNGEMSVGWEVLMPPWSFDLSDAGKLDSEGWAFLTTYNTEEAYELLEVNASQREMDYVVALNWKMLEQAANEGKYKIVDGVKMIDPLDVPGSVYLVPAMKSPHGVDVTPDGKYFIANGKVAPVATVFSFEKFKECIDNKDFQGEERGFPVVNYEKVRVAEVPVGLGPLHTQFDGNGYAYTTLFIDSTIAKWSLDTFEVVDVTPVHYCPGHLCAAEGDTVSPDGKYLVSLNKLAKDKFLSVGPSHPESAQLIDLTTDKMKILMDVPTDPEPHFAQMIKADKITTWEVFEKDPSQPGAVYEKENARIERDGNNVTVYQMGFRSRYYPDHVEVNEGDHVTWYLTNTDFDEDITHGFGICLYDLNAEAQPGETIKFEFVADKAGVYPFYCTNFCSALHQEMQGWFIVKPKGL

SEQ ID NO: 5396 - protein, 620 aa, Anaeromyxobacter dehalogenans 2CP 1
MADTKLWTRIAVALAAVGALALVVGCPPSKPKGSKRPAAASDIAVAAEKTYVPPGDLDEYYMFSSGGHSGQVYVYGIPSMRHITTIPVFAPYSGTGYGFDDESKAMLGNLTWGDVHHPALSETGGDYDGRWLFVNEMNGRVARIDLRDFKTRQIIGPVPNISGNHGSTFITPNSEYILMSSRFSIPIPKGKAVSIDRYASEYKGVAAGIKVDPKTGQMSLGWQVLLPPFDWDLGDAGKKLSEGWFFLTCYNSERATGKLEVTASQRDRDYIAAIDWRLAEKAAAEGKGELVGGVKVLDPKTVPGLVYLLPCGKSPHGVDVSPDGKYVVGSGKLQGVTTAFNFEKVLTAIKNKDFAGEEDGIPVLKYESIKDAEVPVGLGPLHTQFGPDGMAYTSLFVDSALAKWKLGTWEVLDKVPMSYSTGHLAAAEGDTVSPDGKWLVGLNKLSHGRHLPVGPSQPESSQLVDISGDKMKLVYDAFTEPEPHYAQIIKADKLKPIEVYPREENKHPLAIWDVKDAGVTRKGNEVLAKVVVVRSSMTPALIEVNEGDTVKVALTNIEQTTDELHGFGLLDYNINVVLDPGETKTVTFKADKPGVFPYYCTNFCSALHQEMQGYLVVKPR

SEQ ID NO: 5397 - protein, 699 aa, Halorubrum lacusprofundi ATCC 49239
MTTDPNASDERTARTDEQRDEQSANANAGDAKTAGSAADGTETADDGPEIVDGRTIEHLLTDHERDIAATAEGTEATAAKRPSLDLPRLELGRRDFMKAGAAVGAMSGLAGCTSILADEESNDSGDAAASGEHSVAPGEHDEYYGFLSGGHTGEIRVVGLPSMRELMRIPVFQAESARGFGHDAKSSQMLEEEGGGYTWGDTHHPRVSQTDNDYDGRWLFVNDKANGRMARVDLEYFETDAITNVPNCQGVHGACMQLPDTQLVFGVGEFRVPMPNDGRDVQSPDEYGSVLSAINPETMDVEWQVEVDGNMDNGDGGKEGRWFFATGYNSEEGVTESEMARSDRDYVKAFDIPAIWDAVEAGNYEEISGVPVVDGTMDSSLNEGDRPIVRYVATPKSPHGISVTPDGNYAIASGKLDPSCTVIDIDAIAEVDDPQESIVGQPRIGMGPLHTAYDGRGHAYTTLFIDSQVAKWDYEAAVEAEAGSEEPVIEKHDVHYNPGHLIASESYTASPQGDYLVSLNKLSKDRFLPVGPIHPENDQLFHIGDDDAGMELIKDKPSYPEPHDASIVHKDKIEPAKTWDTDDYEIDYVAEGEESFERVDDSTVEIEMWARRNEYAFPEVTLQEGDEVTLRISNVETTSDVIHSIAIPEYDINLALAPQDTREVTFTADQPGVFWAYCAYFCSALHLEMRSRILVEPDE

SEQ ID NO: 5398 - protein, 204 aa, Dechloromonas aromatica RCB
MNTKRILVLGIGNILWADEGFGVRCVEALNDGWEFPPQVTLMDGGTQGLYLLPYVQEADCLLVFDAVDYGDPAGKLREVVGDQVPRFMGAKKMSLHQTGFQEVLMAAELTNKLPAELVLIGVQPEELEDYGGSLRDIVKAQMVPSLNLALDWLERWGVVGRVREGKAESLTDAALAMDVYEGERPPADQAYRLGDARFLNMEAA

SEQ ID NO: 5399 - protein, 221 aa, Cupriavidus metallidurans CH34 uid250
MRTTPTESTCHPGGDTLPARIVVLGIGNLLWADEGFGVRCIEALQRRWEFADHVQLIDGGTQGLYLIQHVQEADRLLIFDAIDYGLAPGTLKLVRDDDVPRFMGAKKMSLHQTGFQEVLSLATLTGKYPQQVLLIGCQPQELEDYGGSLRPVVKAAMEDALALGVAELERWGARPVERRTPLAPREAVTLDELALTAYEAQRPAAEEACRIGDDRLLVKDL

SEQ ID NO: 5400 - protein, 206 aa, Rhodobacter sphaeroides 2 4 1
MPASPPARVLILGIGNVLWADEGFGPRCIEILAESHAFPSQVKLLDGGTQGLYLLPFLEEADALLVFDAVDYGLVPGTLMIARDDEVPAFMGAKKMSLHQTGFQDVLATAQLLGRCPARLTLIGCQPEELEDYGGSLRPVVAAQIAPAIGLALAELAHWGVTPLPGRSPAEGLADPSLRRDAYETGRPGPDEACRTGDARFFPEPC

SEQ ID NO: 5401 - protein, 208 aa, Alkalilimnicola ehrlichei MLHE-1
MGQEPDILVLGIGNLLWADEGFGVRAAEALAAEYDLPEDRVRLLDGGTQGLYLLEYVTAAHRLLVFDAVDYALPPGTLKVVRGADVPKFMGAKKMSLHQTGFQEVLATADLLGQLPEALVLIGVQPEELEDYGGSLRASVKARVPEALAIALDCLREWGVSPAPRCRSARPRLNDSALDMARYEADRPDEGAACRYGDPRVLAVRGQA

SEQ ID NO: 5402 - protein, 222 aa, Paracoccus denitrificans PD1222
MTAPPASNASGSSGRGQMPAEAPANILVLGIGNVLWADEGFGVRCVEEMAARHALPERVRLLDGGTQGLYLLPFLEEADALIVFDAVDYGLPPGTLKLVEGAEVPAFLGAKKMSLHQTGFQEVIATAQLLGRCPAQLMLIGCQPVELEDYGGGLRPEVAAQIGPAIEIALAKLAEWCVQAGEGATSGQLADPAIRREAYETGRPAASDACREGDARFFPGAG

SEQ ID NO: 5403 - protein, 223 aa, Polaromonas naphthalenivorans CJ2
MRKNPPENACHGDGDQPETICVMGIGNVLWADEGFGVRCIEALQQRYEFAPHVSLIDGGTQGLYLIQHVQEATRLLIFDAVDYGLAPGTLKLVEDDEVPRFMGAKKMSLHQTGFQEVLSLAMLTEKYPRSVLLIGCQPEYLEDYGGSLRPRVKLALEDALAHGLATLREWGARPTLRTQPLSMHDAVTFCELDLLRYEDERPSETEACRSGDDRFFPATPQTA

SEQ ID NO: 5404 - protein, 224 aa, Methylibium petroleiphilum PM1
MSARPSAGDCHDLGGNPEAEVICVLGIGNVLWADEGFGVRCIEALQRRYEFAPHVQLIDGGTQGLYLIQHVQAATRLLIFDAIDYGLTPGTLKLVENDDVPRFMGAKKMSLHQTGFQEVLMLALLTEQYPKQVLLIGCQPEELEDYGGSLRPRVKQALEDALAHGVDTLRQWGARPVPRTAPLGEHESVTFSELDIGRYEEQRPPEELACRVGDERFFPPVAQN

SEQ ID NO: 5405 - protein, 206 aa, Rhodobacter sphaeroides ATCC 17029
MPASPPARVLILGIGNVLWADEGFGPRCIEILAESHAFPAEVKLLDGGTQGLYLLPFLEEADALLVFDAVDYGLVPGTLMIARDDEVPAFMGAKKMSLHQTGFQDVLATAQLLGRCPARLTLIGCQPEELEDYGGSLRPVVAAQIAPAIGLALAELAHWGVTPLPGRSAAEGLADPSLRRDAYETGRPSPDEACRTGDARFFPEPC

SEQ ID NO: 5406 - protein, 206 aa, Rhodobacter sphaeroides ATCC 17025
MPASLPDRVLILGIGNILWADEGFGPRCIEALAERHAFPSRVRLLDGGTQGLYLLPFLEEADALLVFDAVDYGLAPGTLLTVRDDEVPAFMGAKKMSLHQTGFQDVLATAQLLGRCPARLTLIGCQPEELEDYGGSLRPAVAARIAPALQVALEELAAWGVTPLPGQSHVEGLADPSLRRDAYESGRPSEMEACRSGDDRFFPEGA

SEQ ID NO: 5407 - protein, 208 aa, Xanthobacter autotrophicus Py2
MDDDRQVARILVLGIGNILWADEGFGVRVLEALDASHVFPDTVTLLDGGTQGLYLLPYLEEADGVVIVDAVDYGLVPGTLHILADGEVPAVLAARKVSLHQTGFQEILGLLALRGKTPARIVLVGVQPELLDDYGGGLTATIAAQVEPAARKVLDILKDEFGVMPAPRAGEGSLVTAAVGRQSYESERPSAEAACRIGDPRVLATSRS

SEQ ID NO: 5408 - protein, 218 aa, Beijerinckia indica ATCC 9039
MNTEPLTGDEQNEATILVLGIGNILWADEGFGVRVVEYLAENYTFPAKVRLMDGGTQGLFLLSYLENLEGLVIVDAIDFGLPPATLHEVQGDDVPATIGARKMSLHQTGFQEVLALLDLRGCAPRRLSLIGVQPVTLDDYGGGLTPEVAAQVEPVARRVLECLRDDYGLETLSKTVEPSQGERFMAPAVARTPYETERPDAEMACRHGDDRLLARLKG

SEQ ID NO: 5409 - protein, 214 aa, Burkholderia phymatum STM815
MATTTAHTLPHIVVLGIGNVLWADEGFGVRAVERLNARWQWPEHVDLVDGGTQGLALLPFVESADRLIVFDAVDFGLKPGTLAVREGDAVPACLSARKLSLHQAGFSDVLACAQLRGNYPDNVVLIGVQPVELDDFGGSLRPAVRAQIEPAIAVACEWLRRWGASPVTHADCDALVSSLNANGLALSRYEGERPSPHSANRHGDTRFWHPSEPC

SEQ ID NO: 5410 - protein, 202 aa, Salmonella enterica serovar Newport SL254
MAEVTILGLGNLLWADEGFGVRAAEKLFEQYADNEKVDVVDGGTQGLALLPWLQQTEKLLIMDAIDFGMAPGSLAMFRDEQVPAYLTAKKLSLHQTSFSEVLALLQLTGGQLSEIVLIGVQPECLDDYGGSLTPQVKAQLMPAVYLAQEVLAQWGITASSAALPTERLNHYSLCMERYEDERPDAQSACRVGDIRVLQREKS

SEQ ID NO: 5411 - protein, 202 aa, Salmonella enterica serovar Heidelberg SL476
MAEVTILGLGNLLWADEGFGVRAAEKLFEQYADNEKVDVVDGGTQGLALLPWLQQTEKLLIMDAIDFGMAPGSLAMFRDEQVPAYLTAKKLSLHQTSFSEVLALLQLTGGQLSEIVLIGVQPKCLDDYGGSLTPQVKAQLMPAVYLAQEVLAQWGITASSAALPTERLNHYSLCMERYEDERPDAQSACRVGDIRVLQREKS

SEQ ID NO: 5412 - protein, 202 aa, Salmonella enterica serovar Schwarzengrund CVM19633; identical to SEQ ID NO: 5410

SEQ ID NO: 5413 - protein, 202 aa, Salmonella enterica serovar Agona SL483
MAEVTILGLGNLLWADEGFGVRAAEKLFEQYADNEKVDVVDGGTQGLALLPWLQQTEKLLIMDAIDFGMAPGSLAMFRDEQVPAYLTAKKLSLHQTSFSEVLALLQLTGGQLSEIVLIGVQPECLDDYGGSLTPQVKAQLMPAVCLAQEVLAQWGITASSAALPTERLNHYSLCMERYEDERPDAQSACRVGDIRVLQREKS

SEQ ID NO: 5414 - protein, 202 aa, Salmonella enterica serovar Dublin CT 02021853; identical to SEQ ID NO: 5410

SEQ ID NO: 5415 - protein, 207 aa, Azotobacter vinelandii DJ
MTAPNILILGIGNLLWADEGFGVRCVELLNERYRFPDGVRLMDGGTQGIYLVQHVQQADCLIVFDAVDYGLAPGTLKIVRDDEVPRFMGAKRMSLHQTGFQDVLALAAFSGAYPRELLLIGVQPEELEDFGGSLREPVRAQLEPALRVALEFLAERGVVAAARDGDAERLAPAPLALGRYEAGRPAEELAYRHGDIRFIPQQPLEDD

SEQ ID NO: 5416 - protein, 152 aa, Methylococcus capsulatus Bath
MAEVPASPMESAFIKELVKQWRAQDSYGTWEGKSDEQLLDPYILDKEKRASIPIIGDPDPETLWRLELFYNAVGLSIERATKVMVTPMMKMSHEGFGRMVLIAGRLIVVNKQLRDVHRFGFPSMEKLAEEGEKLVNAGVEMIRRYPDVANYS

SEQ ID NO: 5417 - protein, 158 aa, Anabaena variabilis ATCC 29413
MTPENNVNGTATSVVSTSPFLKALVLQIRGQDAYGVYRSWSDDLLLKGFVVTKQKKREISVQGEVDPVTISRIMSFFKAIAARIEQETGLISQVVLDLSHEGFGWALVFSGRLILTVKTLRDAHRFGFDSLEKLAEEGDRYVAKGVDLANRYKEVSKL

SEQ ID NO: 5418 - protein, 158 aa, Anabaena variabilis ATCC 29413
MSSTEIVNQPVSSKALNSPFVEELVRQIRAQDSYGFYRNWSDELILKPYIVSKQAKRQISVEGDVESATKARIMSFYRAIASQIEQKTGSLSQVVLDLSHEGFGWVLVFSGRLLLVARTLRDAQRFGFDSIEKLAAEGEKLTLKGIELAEKYTEVTKL

SEQ ID NO: 5419 - protein, 147 aa, Frankia CcI3
MTAKTGFLGDLVDQLRAGDTYGQLERFSDEDLLRPFIVTREQRREIAVNCDIDAAVEGRVRSFYQAVAAATEKATGAFTTTVLDLSHEGFGRVIICAGRLVVLSDALRDVQRFGFGSMDELSARGESLVTGATKQIERWNEVARDDS

SEQ ID NO: 5420 - protein, 154 aa, Rhodopseudomonas palustris HaA2
MTEVATTADAAIDSLFVKELVKQLRAQDTHGVWENKSDLKLLEPYIIDKAKRREIPLMGDPDPETLWRLELFYNAVALSIERETKIMVSPMMKMHHEGFGRMILSAGRLIVVNKHMRDVHRFGFDNLGKLAEEGDKLVDAGVEMIRKFPDVAAL

SEQ ID NO: 5421 - protein, 155 aa, Rhodopseudomonas palustris BisB18
MVEASVAERDPALDSVFVKELIKQWRAQDTHGAWEGKSDFTLIEPYIITKEMRREIPIVGDPDPETLWRLELFYNAVCLAIERETGLMVSPMMKMHHEGFGRMILAAGRLIVVNKQLRDVHRFGFDSLAKLAEEGDKFVTSGIEMIRKYPEVAAY

SEQ ID NO: 5422 - protein, 165 aa, Burkholderia xenovorans LB400
MAEATAESSVVPGTASDETLLATPFVQHLVKQLRAQDTHGAWDGKSDLQLLKPYIHTAEERRAIPIMGDPDPETLWRLEIFYSAIAVAIERQTGQMVSPMMKMSHEGFGRMVLIAGRLVVVNKQLRDVHRFGFASLQKLAEAGGKFLDEAVGMIRTYPAVAQYGA

SEQ ID NO: 5423 - protein, 155 aa, Rhodopseudomonas palustris BisB5
MTDATATASDATIDSLFVKELVKQLRAQDTHGVWESKSDLKLLEPFIIDKAKRREIPLMGDPDPETLWRLELFYNAVALSIERETRIMVSPMMKMHHEGFGRMILSAGRLIVVNKHMRDVHRFGFDNLGKLAEDGDRLVNAGVEMIRKFPEVAAL

SEQ ID NO: 5424 - protein, 170 aa, Polaromonas naphthalenivorans CJ2
MTEQASIETPVTPVTPASPASDEALMGTAFVQQLVKQLRAQDIHGTWEGKTDLELLKPYIHTAEERRALPILGDPDPETLWHLEIFYNAIAVAVERETGQMVSPMMKMSHEGFGRMVLIAGRLVVVNKQLRDVHRFGFPSLAKLADAGGKFFDEAVAMIRAYPAVAQYGA

SEQ ID NO: 5425 - protein, 156 aa, Bradyrhizobium BTAi1
MSDTAVVAEVVPAEQRPFVKELIKVWRAQDTHGAWEGKKDIDLLEPYILDKEKRRALPIIGDPDPETIWRLELFFNAVALSIEKATGVMISPMLKMSHEGFGRMVLIGGRLIVVNKQLRDVHRFGFDNLGKLADEGDKFVNAGVEMIEKFKDVANY

SEQ ID NO: 5426 - protein, 156 aa, Xanthobacter autotrophicus Py2
MSEAAQVIEPVSAEDNPFIKQLIKVWRAQDTHGAWEGKADLDLIADYIVDKEARRALPIIGDPDPETIWRMELFFNAVCLLIERETKVMITPMLKMSHEGFGRMVLIGGRLIVVNKQLRDVHRYGFDNLGKLAEEGTKFVSSGVEMIRKFPEVANY

SEQ ID NO: 5427 - protein, 155 aa, Frankia EAN1pec
MTAPAPTAGGQFEGFLRDLVDQLRAGDTYGNLDRLPDAQLISPFILTREQRRQIASNCDIDAVIEGRVRSFYQAVAASVEKTTGVITTTVLDLNHEGFGRVIVFGGRLVVLSDVLRDVQRFGFNSLEDLAARGEAMVTAAAKLVDQWREVARDDS

SEQ ID NO: 5428 - protein, 159 aa, Leptothrix cholodnii SP 6
MTEATAVEAPSEEALLKDPFIVELIKQIRAQDTHGTWEGKSDAKLLEPYILTAEQRRALPMMGDPDPDTLWRLDLFHNAIGLSIERATGCMVSPMMKMSHEGFGRAVLTAGRLIVVNRHLRDVHRFGYASLAKLAEAGTRLVNEGVGMVEKYKEVATYG

SEQ ID NO: 5429 - protein, 156 aa, Beijerinckia indica ATCC 9039
MSEAAVATPDLAAMDTVFVKELVKQWRAQDMHGTWEGKSDFDLIEPYIVDKVKRKEIPMVGDPDPETIWRLELFYNAIGLTIERETGCMVSPMIKMSHEGFGRIILMAGRLIVVNKMLRDVHRYGYDNLNKLADEGAKAVAAGVAMIEKFPEVAKY

SEQ ID NO: 5430 - protein, 154 aa, Rhodopseudomonas palustris TIE 1
MTEATTAPDAALDSLFVKELVKQLRAQDTHGVWEGKSDLKLLEPFIVDKAKRREIPIMGDPDPETLWRLELFYNAVALSIERETRIMVSPMMKMHHEGFGRLILSAGRLIVINKHMRDVHRFGFDNLGKLAEEGDKLVAAGSEMIRKYPDVANL

SEQ ID NO: 5431 - protein, 155 aa, Acidithiobacillus ferrooxidans ATCC 53993
MPENTAMAALLPEESLFFRELVKQWRAQDSYGTWEKKSDMELLAPYVLDKEQRRAIPIIGDPDPEILWRVELFYNAVGLATERASGVMVSPMMKMSHEGFGRMVLIAGRLIVVNKQLRDVHRFGFPSMEKLAEEGDKLVAGALEMIEKFPEVARF

SEQ ID NO: 5432 - protein, 158 aa, Methylobacterium sp. 4-46
MSETATLERAPEEAALATPFLTALVRLLRAQDSYGAWEKKPDAQLLRDFIVSKEQRRQIPIMGDPDPDVLWRVELFYTAVGLAVEARAGLIASPMMKMSHEGFGRVLLTAGRLIVLNKYLRDVHRFGFESLAKLAEAGGRAIDEAAAMIAAHPDVARI

SEQ ID NO: 5433 - protein, 153 aa, Gluconacetobacter diazotrophicus PAl 5 JGI
MSQAGVIDDPMATSFMKALVGRIRAEDMYGAWERKTNEMLLDDYIVSKEERRTMPMISDPDPDTLARVETFFQAVGLAIEQETGLIASPMMKMSHEGFGRVILTTGRLVVFMKTLRDVHRFGFDSLSALAAEGAKAVNAAVAEINRFPEVARA

SEQ ID NO: 5434 - protein, 155 aa, Methylocella silvestris BL2
MVETVDVAEVPAVDSPFVKELIKQWRAQDTHGSWDNKSDLDLIAPYIVDKEARKQLPIIGDPDPEILWRVELFFNAVGLAIERATGCMVSPMMKMSHEGFGRQVLMAGRLIVVNKQLRDVHRFGFLTLEKLAEEGTKYVQQGVEMIEKFPEVAKY

SEQ ID NO: 5435 - protein, 159 aa, Cyanothece PCC 7424
MTTTTTTNPEADAIFIAENEFLKELVQQIRSQDHYGVFRNWEDRLVLANFIVSKKKKREIAVTGEVDPATQLRILSFYRAIAARIEKSTGKLCQVVLDLSHEGFGWSLIWSGRLMVTCRTLRDAHRFGFESYEKLAADGEKLVNTGIELIEKFPEVANI

SEQ ID NO: 5436 - protein, 156 aa, Cyanothece PCC 8801
MTTTALENPAQFVAENEFLQEVVRQIRAYDSYGFYRSWSDELVLSPFVVSKKKKREISTEGDIDPATKLRILCFYRGIASLIEKETGQLCQVIVDLNHEGFGWALVWSGRLLSVSRTLRDAHRFGFESLEKLAEEGEKLSKAGIELSQRFPEVARL

SEQ ID NO: 5437 - protein, 155 aa, Acidithiobacillus ferrooxidans ATCC 23270; identical to SEQ ID NO: 5431

SEQ ID NO: 5438 - protein, 157 aa, Cyanothece PCC 7425
MTTSTPTPAVDPDVLSHPLLKAIVAQIRANDPYGTYRNWSDELLLKPYIVSKAQKREISVEGEVDPITKGRIMAFYRAIAHQIEVSTGMLSQVVIDLSHEGFGWALVFSGRLLLVSKTLRDAQRFGFDSFEKMVAEGDKLIQSGIALAQRFPEASHY

SEQ ID NO: 5439 - protein, 160 aa, Methylobacterium nodulans ORS 2060
MSETDTLERAQAADAAALATPFVTALVRLLRAQDSYGAWEKKPDAVLLKDFIVSKDQRRQIPIMGDPDPDVLWRVEMFFTAVGLAVEERTQLIASPMMKMSHEGFGRVLLTAGRLIVLNKYLRDVHRFGFESLTTLAEAGTKAADEAAALIEAHPDVARS

SEQ ID NO: 5440 - protein, 156 aa, Cyanothece PCC 8802
MTTTALENPAQFVAENEFLQEVVRQIRAYDSYGFYRSWTDELVLSPFVVSKKKKREISTEGDIDPATKLRILCFYRGIASLIEKETGQLCQVIVDLNHEGFGWALVWSGRLLSVSRTLRDAHRFGFESLEKLAEEGEKLSKAGIELSQRFPEVARL

SEQ ID NO: 5441 - protein, 214 aa, Brucella suis 1330
MRKAGTIQCDGQRIALSAMGRKRPKEQKKPTLTAASVRETYEIEPGEKVEINPAESPLAMLYRRRNADGRAFISEDEFRAGERLRADFTRGSLMPSVTSRWDVQAGSGGHYGAGGMAELTDIALASRIRVERALEAVGPELSGILIDVCCFLKGLETVERERQWPVRSAKVLLKAGLAMLHRHYNPPREGERRRGAVLHWGAEDYRPEIRPRSV

SEQ ID NO: 5442 - protein, 213 aa, Rhodopseudomonas palustris BisB18
MTDRNRKPARHAAEAARSAATAEAGEAIDGFRARHLELARREVMTAAGLSKVTVNDGESPLAWLARRKGRDGRAMITPTQFIAGEKLRADFTRGQLTPRVTSNWDAPSGRQRAAGGGGGEMTDVVIASRQRLRAALQACGPEFAGLLMDVCCFLRGLEEVESQRGWPSRSAKVVLQLALDRLARHYGLDDQATGAAAARLRSWMADDAGFSAG

SEQ ID NO: 5443 - protein, 272 aa, Mesorhizobium BNC1
MKRPTTKKSLPEKERRRVLRFLAGGEAQIRSAAKEGMLLLDAGERGMIAASPPVLSNLVTERLVVRADARLSLSAEGRAALRRDAHPDAPFRAQHMELETEIAVVGNGEQIICKNLAESPLAQLARRRTRGGEPFLAPSEFRAGERLRADYTRGQIMPKISANWSQAVADARRGSNENGIAELTDAALAARQRVENALTAVGPELAGVLVDICCFLKGLEQVEMERGWPVRSAKVVLKAALAALSRHYEPPCPRRGSKVLHWGAEGYRPVLR

SEQ ID NO: 5444 - protein, 237 aa, Maricaulis maris MCS10
MSAPRWMRALARPGARMVPPGDIEARAVVLPQGDRRRRPTSRLSPSRFEEAMRCGWLARRDNGLVLSADGQAALKAGTRGEDPDPASRHREMEERPVMDREGHVSTARANRREGPLGPWLDGLEPHQRQAGERFIADYHRSTLMSPVTRNWSPTAQRRSEGRRHGPEDAAVSALAAKERVMNALDALGPAFARVIEAALVHEDSAAALERRFGWAARSGRTVLGLALTRLAEIYRLV

SEQ ID NO: 5445 - protein, 264 aa, Brucella ovis
MTRQISAAETRIIRFLKQGGCELQDSVRETHALLVGEQGTIAASRLEIERMRKAGTIQCDGQRIALSAMGRKRPKEQKKPTLTAASVRETYEIEPGEKVEINPAESPLAMLYRRRNADGRAFISEDEFRAGERLRADFTRGSLMPSVTSRWDVQAGSGGHYGAGGMAELTDIALASRIRVERALEAVGPELSGILIDVCCFLKGLETVERERQWPVRSAKVLLKAGLAMLHRHYNPPREGERRRGAVLHWGAEDYRPEIRPRSV

SEQ ID NO: 5446 - protein, 263 aa, Ochrobactrum anthropi ATCC 49188
MTTQLLASEARIMRFLKNGGCEVQDSIRASHVLLATDQGTIAASRAELEAMQKKGLLYWNEERLVSSQPTIKRAKEGGKPLRNPARTLQTIDYEQGEKIEINPEESPLAMLYRRKNANGSSFISESEFLAGERLRADFTRGSLMPSVTMRWDTSVGGGRSGPGGMAELTDIALASRIRVERALEAVGPELNGVLVDVCCFLKGLETVERERQWPVRSAKMLLKVGLAALHRHYNPQLEKERGRGAVLHWGADDYRPQMRPQNM

SEQ ID NO: 5447 - protein, 268 aa, Parvibaculum lavamentivorans DS-1
MSASRRDRAFEREVRRVFRHFLEPGARAGTLPDGGIGLYGPRGGKPAIKTEQTFWSLCEARDLVTAGTGDDKGFWRPSEAGRAFYRRLVAEADPFGEQHRLMGTRVLRDAGGGEARLPVNEAESPLAWLRHRKGADGQHLIDATQFEAGERLRADFTVGQLTPRVTADWSAVTASGKRARDPAEIADHALAARQRVNRALVAVGPRLSDILLAVCCHLEGLEAAERSFGWPKRSAKLVLQIALDRLAAHYGMTKASDQAVAATARASD

SEQ ID NO: 5448 - protein, 180 aa, Xanthobacter autotrophicus Py2
MAPRKTSSPKVQPRRAAPADAAAPQMNLAESPLAWLARRTGKDGRALVDPTQLIAGERLRADFTRAQLTPRITSRWSEVSGAGTPEAFTDMVLAAKLRVARAMTAVGPELSGVLLDVCCFLKGLEAVERERLWPARTAKVVLGLALDRLAVHYGLSGSTQGRARAPVRSWHAAPETPAQG

SEQ ID NO: 5449 - protein, 237 aa, Caulobacter K31
MSGVFEQALEAEHLAARAERLLRRPGALIEVKGLGYVVRFGPRRRAMLTVDEAAFRVLARDGALASRREGGWRLVKPAAPPTPPPGRPGVIEGERVVIEGSNEHVVLKANLGESPLAWLARRGGLEPVEAAAGERLREDFQRAGSLGRLTMDWDAQPRSTGGSGPRLDPALRARAAKDRIAAALAAVGPGLREILERVCLAETALQVAERELGLPRRAGKTVLKLALQRLATHYRMG

SEQ ID NO: 5450 - protein, 283 aa, Agrobacterium vitis S4
MGAMRKPTAHSPQNPASAIKPLLRLLRLASRGVLLEPAGPGETALLRPQDGVLLGRVPDALLHKALADGLVRRKGNALAATGEAESFLKRAMAEREDEIFAGQHGERATETLVESDGSRSTVRRNLDDQPFSTVARLRDRTGKPYLPPEAVAAGERLAADFERGHLQPRITASFEPRLAQKHKGARPSGPDLTDSALAARLRVGEALTALGPELSGVALDICCFAKGLEAVERERQWPARSAKLMLRTALLALARHYTPPPARTASGLRHWGQSDYRPPISRP

SEQ ID NO: 5451 - protein, 170 aa, Enterobacter sp. 638
MSSIIKKCSVAAVLALAALMPDFRLLNTSPEGLALLADLEGCRLTPYQCSAGVWTSGIGHTAGVVPKGDITEREAAANLVADVLNTEQRLAVCVPVKMPPRVYDTLVSFSFNVGTGAACRSTLVSFIKRQQWWQACDQLTRWVYVNGVKNKGLENRRARERAYCMKGVPQ

SEQ ID NO: 5452 - protein, 170 aa, Escherichia coli HS
MNPSIVKRCLVGAVLAIAATLPGFQQLHTSVEGLKLIADYEGCRLQPYQCSAGVWTDGIGNTSGVIPGKTITERQAAEGLISNVLRVERALERCVKQQPPQKVYDAAVSFAFNVGTGNACSSTLVKLLNQRRWADACRQLPRWVYVKGVFNQGLDNRRAREMAWCLQGAN

SEQ ID NO: 5453 - protein, 170 aa, Serratia proteamaculans 568
MSSLAKRCSVAAILALAALLPQFNTLHTSEQGLRLIADFEGCRLSPYQCSAGIWTNGIGHTAGVKSGSVINERQAAANLIEDVRTVEHGIARCMAVEMPQPVYDAVSAFAFNVGVSAACNSTLATFIKRQQWQAACDQLPRWIYVKGVKSQGLERRRHAERALCLQGIQR

SEQ ID NO: 5454 - protein, 171 aa, Escherichia coli C ATCC 8739
MNPSIIKRCLVGAVLAIAATLPGFQQLHTSVEGLKLIADYEGCRLQPYQCSAGVWTDGIGNTSGVIPGKTITERQAAEGLISNVLRVERALERCVKQQPPQKVYDATVSFAFNVGTGNACSSTLVKLLNQRRWADACRQLPRWVYVKGVFNQGLDNRRAREMAWCLKGAGL

SEQ ID NO: 5455 - protein, 169 aa, Salmonella enterica serovar Newport SL254
MGSFVKRCSVAVVLALAALVPDFRLLHTSPEGLALIADLEGCRLRPYQCSAGVWTSGIGHTAGVVPKRDITEKEAAANLVADVLNVEKRLAVCVPVDMPPAVYDALVSFAFNVGTGAACRSTLVYHLKHRQWWQACDQLTRWVFVNGERNTGLENRRFRERTYCLKGAK

SEQ ID NO: 5456 - protein, 169 aa, Salmonella enterica serovar Agona SL483
MNPSIVKRCLVGAVLAIAATLPGFQSLHTSVEGLKLIADYEGCRLQPYQCSAGVWTDGIGNTSGVVPGKTITERQAAQGLITNVLRVERALDKCVVQPMPQKVYDAVVSFAFNVGTGNACSSTLVKLLNQRRWADACHQLPRWVYVKGVFNQGLDNRRAREMAWCLKGA

SEQ ID NO: 5457 - protein, 170 aa, Salmonella enterica serovar Dublin CT 02021853
MNPSIVKRCLVGAVLAIAATLPGFQQLHTSVEGLKLIADYEGCRLQPYQCSAGVWTDGIGNTSGVIPGKTITERQAAEGLISNVLRVERALERCVKQQPPQKVYDATVSFAFNVGTGNACSSTLVKLLNQRRWADACRQLPRWVYVKGVFNQGLDNRRAREMAWCLQGAN

SEQ ID NO: 5458 - protein, 169 aa, Pectobacterium carotovorum PC1
MKSLVKRCVIATVLALAALVPDFSLLKTSQEGLALIADLEGCRLSPYQCSANLWTNGIGHTAGVVPGKTITEREAAVNLVADVLRVEKALARCMAVNMPQAVYDAIVSFAFNVGVGAACRSTLAFFINKGQWRNACDQLLRWVYVNGEVSRGIETRRQRERAVCLKGAA

SEQ ID NO: 5459 - protein, 400 aa, Nitrobacter winogradskyi Nb-255
MLDRRDMMKRIGAGLALGVGLAPLKVLALDRVTMPFDNGERPLVKYPQKRPMIGITSRPPQLETPFPVFNEGPITPNDAFFVRYHLADIPLDIDPATFTLEIKGKVDHPLRLSLEDIKAMAQTEIVAVNQCSGNSRGFVDPRVAGGQLGHGAMGNARWRGVSLKTVLDRAGVQHGAKQVVFGGMDGPVSDTTPDFAKALDVDHARDGEVMLAHLMNGRDLPFLNGFPLRLVVPGYYGTYWIKHLNEITVIDNTYDNFWMKKAYRIPDNACACVEPGTTPTATVPIGRLNVRSFITNIPEGAQLRRGGKILKGIAFDGGTGIRNVEVSVDGGKTWKGTRLGRDYGRYAFREWKTPVRLAPGPHELKVRATSNGGDVQPAEARWNPAGYMRNVIETVRVTVS

SEQ ID NO: 5460 - protein, 402 aa, Nitrobacter hamburgensis X14
MLDRREMLKRVGAGLALGAAASLPPFKAFALDNVTLPFDNGERPLVKYPQKRMMIGQTSRPPQLETPFSVFNESVITPNDAFFVRYHLADLPLNIDPATFTLEIKGKVDRPLKLSLKDIRKMKATEVVAVNQCSGNSRGFSSPRVAGGQSGNGAMGNARWRGVPLKAVLDQAGVQRGAKQVVFDGMDGPVSDKTPDFAKALDIDHSRDGEVMLAYLMNERDLPFLNGFPLRLVVPGYYGTYWVKHLNEITVIDSVYDNFWMKTAYRIPDNACACVEPGTAPKATVPINRFNVRSFITNVADGAKLATGGKLLKGIAFDGGTGIKEVAVSIDGGKTWKAARLGRNYGKYSFREWKVPVKLTAGPHELKVRATSNGGQVQPAEALWNPAGYMRNVIETVRVTAA

SEQ ID NO: 5461 - protein, 426 aa, Deinococcus geothermalis DSM 11300
MDDQLALSRRAALSLLGGAGAALALGRGALAQAAVPTTPAPTFSGPGPLESWNGLGPLIALPQKVPLIRLVDRPPLYETPRAYFQSPLTPAAAFFVRSNLALFPASIDLTTWRLKVEGNVRRPRSFSLAALLRDFEPVSVTAVMQCTGNSRSRFQPRRPGGQWGNGAMGCATWTGVRLRDLLDRAGIQSGGVQVQFQGLDQGAGAPGSGGAEYKKSLDLDDPVLDECIVAYAMNGQPLPLLNGFPVRLVVPGYFATYWMKTLSFIRVLTEPDTNFWMASAYLQPDNPRGTTTPQAVKDKKVKFRPVGSMPVRSFIMTPDETVKVPAGLPITVQGLALSGRGAVTKVEVSTDGGKTWRNAQLGQDLGKYAFRPWSFAWTPKQPGQYTLAVRATDASGATQTDQPIWNPSGYLWNTIERQTVTVGQTG

SEQ ID NO: 5462 - protein, 408 aa, Polaromonas naphthalenivorans CJ2
MNRSNHHDTGRRQFLRHAGLGAASLGALPLRSLAAGIENLPFGNGARELVAYPQKRPLLRITTRPPHLETPFSVFGEGIITPNDAFFVRYHLANFPTTIDAQAYRLKVGGHVKQPLSLSLAELKALAEPAEVVAVNQCSGNSRAFAQPRVFGAQLGNGSMGNARWVGVPLRAVLEKAGVLAGARQVAFNGLDAPVLAATPDFVKALNIDLALSPEPLIAWTMNGTDIPFLNGYPLKLIVPGYFGTYWVKHLSEIEVLDHDFDGFFMSTAYRVPDNACMCVPAGTAPTATRPITSLPVRSFMTSLADGAHVPAGRALLLKGIAFDGGSGIQKVEVSEDGQPWREAALGKDLGRFSFREWRLPLTPSRKGPMTLSVRATNRQGDEQPATASWNPGGYARNVIETTRIVAV

SEQ ID NO: 5463 - protein, 406 aa, Polynucleobacter necessarius asymbioticus QLW P1DMWA 1
MNSENFTNRRKVITAALAGGVSSLLPSWASSAEMINMPMAYGERELVAFPGKKPMIVLTSRPPQLETPFKYYDQHVITPNDEFFVRYHMAGIPTSIDPNTYKLKVGGNVEKPLEISLSELKKNFPSQRIVAVNQCSGNSRGLFEPRVNGGQLGNGAMGNAAWVGISLKDILNAANPGKGSKQVTFNGLDQPVLPSDSDFVKGLDIDHAMDGNVMVAYQMNGTDIPFLNGYPIKLIVPGYYGTYWVKHLSEIQVVNDVYNGYWMNPAYRIPDNDCNCVEPGTAPSKTIPINQFTIRSFITNFTNSSIVTVGKPVQARGVAFDAGYGIKKVLFSQDNGQNWVEARLGQDLGRFSFREWRVEFTPKQQGVLDLRVRAFNHAGQVQPMTATWMPAGYMRNVVETVQINAV

SEQ ID NO: 5464 - protein, 416 aa, Acidiphilium cryptum JF-5
MKQSFSSEGGATRRATLLGTASIAGLALASRAGAAAPQTVTLPFANGERPIVPAGTFPQKGEMILQRTRAPLLETPFEVFRDNLFTPNDRAFVRWHMADFPESIDTAKYRIRVSGLVNKPVEITLDELMHGFPIRKIAAVNQCSGNSRGFIEPRVPGAQWAHGAMYNAMWTGVPLRHLLARAGVKAGATHVAFRSLEQGGGLYPADVRFEKAIPLSRANDGEVMIAFQMNGANLPLLNGYPVRLIVPGWYSTYWVKMLTEIEVMDHPSTDFWMATAYKIPDTPTGSMTPGEPGIKMVPINEMKPRSFFGSVTNGARLPAGRPVVVRGFAFGGGSALKSVAVSIDGGASWRPARLGQNHGAYGFRDWQIPVRFPKPGAYRLMVRATNAAGHVQPAKAGWNPGGFLYNAIEHVDVTVA

SEQ ID NO: 5465 - protein, 412 aa, Sphingomonas wittichii RW1
MDRFDMMMRAPLDRRQMLAGAAAMLAAVPAGAQGLVDLRLPGGPSRRPLAGGFPGKGEMIVQRIHPPLLETPMEVFDGDVFTPNDRFFVRWHWSDFPTSVDAGAFRLAVHGRVRRPLSISLAQLLRMPRVELAAVNQCSGNSRGLFEPRVPGAQWAHGAMGNARWTGVRLRDLLDRAGVLADAVAVRFAGLDGTTVEGAPRYEKALAIDHARDGEVMIAFAMNGEQLPLLNGFPIRLIVPGYYSTYWIKMLSDIEVLAAPDDGYWMAKAYRIPTTPGADIAPGTKDFPTVPIGRMVPRSFVTSLREGQAVPLRPVLPVGGIALGGDRGVARVELSADGGRSWLPTRLGPDHGRYSFRRWDADLPLAGPGRLTLMVRCTNDAGEGQPMKPVWNPSGFMRGNVEAVSIEVRADA

SEQ ID NO: 5466 - protein, 406 aa, Xanthobacter autotrophicus Py2
MVTRRQALRSVGGMVLGYGASLVAGSRVAAAAAETITLPFANGERPLVTYPGKRALIGLTSRPPQLETPFSVFNEGILTPNDAFFVRYHLADIPLEIDPAAFRLEVKGKVSTPLSLSLDELKTKFDPVEYVAVHQCSGNSRGFFDPRVGGGQAGNGLMGNARWKGVPLKAVLEKAGIASGAVEVYFTGLDNPVIPETPRFAKSLKLDHALDGEVMLAYQMNGEDLPWLNGFPLRLVVPGYFGTYWVKHLNQIAVLDKPLDNFWMSTAYRIPDNDCACVPAGGKPEKTVPIGRFAVRSFLTNVLDGAKVAAGKPLALRGIAFDGGSGIARVEVSADGGKTFMPAALGADLGKYSFREWTANMTLPAGPHALKVRATNALGQTQPMEARWNPSGYMRSVVETTNVVAG

SEQ ID NO: 5467 - protein, 405 aa, Xanthobacter autotrophicus Py2
MLNRRQMLKSAGGTALGIGAGLAVGARLTAFAAETVTLPFANGDRELVAYPGKRPLIRLTTRPPQLETPFSVYNDGLITPNDAFFVRYHLADIPTEIDPESFRVEVKGKVDKPLSLSLMDLKSRFDAVELVAVHQCSGNSRGFFEPRVGGGQAGNGLMGNARWKGVPLKAVLDKAGVQAGAVQVSFGGLDGPVVPDTPDFAKALDIDHARDGEVMLAYEMNGAELPWLNGYPLRLVVPGFYGTYWVKHLNEITVLDKPFQSFWMDTAYRIPANACACTEPGKAPTATVPINRFDVRSFITSVQDGAKLKAGELALRGIAFDGGYGVSDVEVSADGGKSWQAASLGEDLGKYSFREWKMTIPLQKGAHTLMVRAVNRIGQSQPMEPLWNPAGYMRNVVEHTRIVAA

SEQ ID NO: 5468 - protein, 402 aa, Methylobacterium radiotolerans JCM 2831
MTDPARRAFLKSAALGALAAGSGLRPARADEAAQLPFGNGERPLVAYPGKRPLLQTTARPPQLETPFAVFDAGAITPNDAFFVRYHLADIPLEIDPEAFRLNVGGHVERPASFSLAELKALPGGTEIVAVNQCSGNSRGFFEPRMAGGQLANGAMGCARWTGVPLRTVLDRAGVKAGAVQVAFNGLDRPVLPETPDFAKALTLDQAGDGQVLLAWGMNGADLPWLNGYPLRLVVPGYYGTYWVKHLDTVTVLDKPFEGFFMKTAYRIPDNACACTEPGQAAAATVPIGRLNVRSFLTNLTDGAQVKAGPVALRGIAFDGGSGIREVAVSTDDGATWTRAALGGDLGPYAFRTWSLATALTPGAHAIRVRATANDGSTQPTTSRWNPSGYMRNGVETTRVRAA

SEQ ID NO: 5469 - protein, 407 aa, Methylobacterium radiotolerans JCM 2831
MHGLDRPMNRRLLLGGLGLGSLAAAMPAWAAGSVKLPLPGGPDVRDLTTAFPGKGEMILQRTHPPLLETPFAVFDEGVFTPNDRFYVRWHWASIPTEVDAGTFRLKVHGHVEKELSLSLDAIAGLPRFEIAAVNQCSGNSRGLFEPRVPGAQWANGSMGNARWTGVRLKDVLERAGVKAGAVQVRFSGLDEPVVDDAPDFKKSLDLDHANNGEVMIAYAMNGEQLPLLNGFPLRLVVPGWYSTYWVKMLSDIEVLDKPDDQYWMKTAYRIPDVPGANIKPGQTGFKTVPINRMVPRSFVTNLTDGAKVAAGTPVAIRGIAFGGDCGVKAVDFSGDGGATWFPAQLGKDEGPYSFRRFEGSLPALASGTHTVRVRCTNTNGVAQGMDRVWNANGFMQNGIETVSFQAA

SEQ ID NO: 5470 - protein, 414 aa, Burkholderia ambifaria MC40 6
MSQHDYDPVSLHRRRLLAGLGALGAAAFMMPTLARGTQSGTIELPFENGSRPLTSDLPQKSNVILQRTRPPLLETPFDVFDQGVFTPNDRFYVRWHLANIPNSIDPATYRVAVHGAVKRTLNLSLDDLMRRFPRYEIAAVNQCSGNSRGFFSPRVPGGQWGNGAMGNALWKGVRLKDVLDHAGVRANAVCVRFNGLDSGVIPQTPKFLKSVKIDHARDGEVMLAYAMNGEPLPLLNGYPLRLVVPGWYATYWVKMVTDIEVLDTPDDNFWTAKAYKVPANHFANVRPGETDVPQIPINRMLPRSFFTNMSTGDKVGAGQPVLVRGIAFGGINALARVQLSTDGGRSWADTQLGHDYGKYSFRQWQTNVRFAQRGPQMLMVRAIDSTGQAQPATPNWNGAGFMRNVIESIQLDVA

SEQ ID NO: 5471 - protein, 412 aa, Sulfurihydrogenibium YO3AOP1
MNRRELLKKGLLMTATGLLLPKELFAQVDKSLLGPAADLLLDGTIKEQILEALPGKKPLIKKAFRAPNYETPFKYFDEIFTPNDVFFVRYHLANIPQDIDEKTWKLKITGDAVEKTLELTMEDLKTKFEQVEIVALKACSGNMRGLFNPHVPGVQWGYGAMGNAKWKGVRLKDILNKAGLKANALEVAFNGAESGLMPTTPDFVKSIPVWKATQEEVLVAYEMNDEPIPYLNGYPLVLVVPGWTATYWIKHLTDITVISTPLDNFWMKNAYRVSVDKFPIRERFLSQMNSEDMPITEVTINSIITNIEKGQVFKLGQPIEVKGLTWDGGYGIKMVEVSVDGGKTWVEAQLDKDYGKFSWRQFSYVFKPNKKGNYTIMVKATNSIGQTQPIKAIWEPHGYGYNAIQKINIKVI

SEQ ID NO: 5472 - protein, 401 aa, Methylobacterium sp. 4-46
MVDRDRRAFLQRGVLAGAALASAPWRAAAEEIATLPFGNGERPLVAYPGKRPLLQMTSRPPQLETPFRVFDEGVITPNDAFFVRYHLADIPVAIDPERYRLEVKGHVETPLALSLAEIRALPASEIVAVNQCSGNSRGFFAPRVAGGQLANGAMGNARWTGVPLRTVLDKAGLRRGAVQVAFDGLDGPVIPETPDFVKALTLDHARDGEVMLAYAMNGEDLPWLNGYPLRLVVPGYYGTYWVKHLSAITVLDKPFEGFWMTSAYRIPANSCACTEPGEAPKATVPIGRFTVRSFVTNLADGATLPAGETPLRGIAFDGGEGIAEVAVSTDDGRTWTRAELGEDLGRYSFRPWTLRVDLTPGAHAVRVRATNRAGQSQPLDPLWNPAGYLRNVVETVRVRAA

SEQ ID NO: 5473 - protein, 403 aa, Methylobacterium chloromethanicum CM4
MLDRRDLIRRAGLSTLASLGGGSLAPLRVLAGDAVMLPFGNGERPLIAYPGKRPLLQMTARPPQLETPFSVFDEGPITPNDAFFVRYHLADIPTEIDPETYRLAIKGRVEKEISLSLADLKAMPTTEIVAVNQCSGNSRGFFEPRMAGGQLANGAMGCARWTGVPLKAVLDKAGVKAGAVEVAFAGLDGPVIPETPDFAKSLKLDHARDGQVMLAWGMNGQDLPWLNGYPLRLVVPGFYGTYWVKHLESISVLDKPFDGFWMQKAYRIPDNDCACTEPGKAADKTVPISRFTVRSFLTNLTDGADVKAGRTDLRGIAFDGGSGIKAVAVSTDDGKTWTDAQLGQDLGPYAFRPWTLSVNLSPGAHAIRVRATANDGGSQPMEARWNPAGYLRNVVEITRVRAA

SEQ ID NO: 5474 - protein, 403 aa, Methylobacterium nodulans ORS 2060
MLDRRELLRRAGLGAVVFSGTTLVSPLRGLADELARLPFGNGERPLVAYPGKRPLLEMTSRPPQLETPFGIFDEGVITPNDAFFVRYHLADLPTAIDPDSFRLEVTGHVETPLSLSLAELRALPGSEVVAVNQCSGNSRGFVAPRVAGGQLANGAMGNARWAGVPLRSVLDKAGLRRGAVQVAFEGLDGPVLPATPDYAKALDLDHARDGEVLLAYAMNGAELPWLNGYPLRLVVPGYYGTYWVKHLNRITVLDQPFESFWMKSAYRIPANACACTEPGQAPTATVPIGRYNVRSFVTNLADGARVPAGETLLRGIAFDGGSGVTEVAVSTDDGRTWRRAALGEDLGRYSFRPWSLRVDLAPGAHAIRVRATNRIGQTQPLDPLWNPAGYMRNVVETTRVQAA

SEQ ID NO: 5475 - protein, 401 aa, Methylobacterium nodulans ORS 2060
MLQRRDVLRGAAMLATAGPFATLARAAAPESVTLPFGNGKHPLVAYPGKRPLIQMTSRPPQLETPFSVFDEGVITPNDAFFVRYHLAGLPNEIDPESFRLEIKGKVDRPFSLSLTELKTLETVEVTAVNQCSGNSRGFFEPRVAGGQLANGAMGCARWRGVPLKTVLDRAGVQASATQVMFEGLDGPVLPATPDFAKALDLDHARDGEVLLAYAMNGEDLPWLNGYPLRLVVPGYYGTYWVKHLNRITVLDTRLQNFWMKAAYRIPDNTCACTKPGESPAGTVPINRFTVRSFITNLLDGDRVRADAETTLRGIAFDGGYGISDVLVSGDDGRSWTAAKLGEDHGRYAFRGWQASLRLPTGEHKLRVRAMNRIGQSQPLDPLWNPAGYMRNVVETTRVTAR

SEQ ID NO: 5476 - protein, 402 aa, Methylobacterium nodulans ORS 2060
MIQRREILRFAGLGALAVGGASLKPVRAFADELARLPFGNGERPLVAYPGKRPLLEMTSRPPQLETPFGIFDEGVITPNDAFFVRYHLADLPTAIDPDSFRLEVTGHVETPLSLSLAELRALPGSEVVAVNQCSGNSRGFVAPRVAGGQLANGAMGNARWAGVPLRSVLDKAGLRRGAVQVAFEGLDGPVLPATPDYAKALDLDHARDGEVLLAYAMNGAELPWLNGYPLRLVVPGYYGTYWVKHLNRITVLDQPFESFWMKSAYRIPANACACTEPGQAPTATVPIGRYNVRSFVTNLADGARVPAGETLLRGIAFDGGSGVTEVAVSTDDGRTWRRAALGEDLGRYSFRPWSLRVDLAPGAHAIRVRATNRIGQTQPLDPLWNPAGYMRNVVETTRVQAA

SEQ ID NO: 5477 - protein, 303 aa, Brucella suis 1330 [sequence omitted]

SEQ ID NO: 5478 - protein, 304 aa, Mesorhizobium BNC1
MEQPHIPAGLPEDVENKKEAARAWFETLRDKICAALEGLEDELSGPHSSYAPGRFEQTPWLRQEGAGGGGVMSIMHGRVFEKVGVHTSTVHGEFSPEFRRQIPGAEEDPRFWASGISVIAHPQNPHVPTVHMNTRMVVTTRQWFGGGADLTPMLNRRRSQEDPDAIAFHKAMRFVCERHAAVADYEKFKNWCEEYFFLPHRNEPRGIGGIFYDWLKSPEENGGWDADFAFTQDVGRAFVMVYQHIVRKNFNTNWTEADREEQLIRRGRYVEFNLLYDRGTIFGLKTGGNVNSILSSLPPVVKWP

SEQ ID NO: 5479 - protein, 303 aa, Brucella ovis
MKREDIPAIIPADIEEKKKAAQSWFEELRDRICASYEQLEDELQGPLSDREPGRFVRTPWQKDDGNGGGVMSIMHGRVFEKVGVHVSTVHGEFSPEFRKQIPGAEEDPRYWAGGISLIAHPQNPNVPAVHMNTRMIVTTRQWFAGGADLTPVLDRRRTQEDPDTLAFHKAFRFICEKHKDIVDYQRLKEWCYEYFFLPHRDEPRGIGGIFYDWLHSPEEKGGWDSDFAFTRDVGRGFSVVYPHLVRQNFNKDWTEADRDEQLIRRGRYVEFNLLYDRGTIFGLKTGGNMNAILSSMPPVVKWP

SEQ ID NO: 5480 - protein, 303 aa, Sinorhizobium medicae WSM419
MERPQLPQGLPADIERKKAEAKAWFESLRDTICADFEAIEDDLAGPLSDRPAGRFVAKDWLRDEGNGGGGRMSMMEGRVFEKVGVHTSTVFGEFSPEFRDQIPGASEDPRFWASGISLIAHPVNPNVPAVHMNTRMVVTTSNWFGGGADLTPVLDRRRIPTDADTVLFHRAMEIACNRHKVADYPKFKQWCDEYFYLKHRNEPRGTGGIFYDWLRSDEEIGGWEADFAFTRDVGKAFAIVYPRIVRTNFNMPWTEQDRSEQLVRRGRYVEFNLLYDRGTIFGLKTGGNVESILSSLPPLVRWP

SEQ ID NO: 5481 - protein, 304 aa, Ochrobactrum anthropi ATCC 49188
MQRDEIPAIIPTDIEEKKQAAQRWFEELRDRICASYEQLEDELQGPLSDREPGRFVRTPWQKDEGRGGGGVMSIMHGRVFEKVGVHVSTVYGEFSPEFRKQIPGAEEDPRYWASGISLIAHPQNPNVPAVHMNTRMVVTTRQWFGGGADLTPVLDNRRTQDDPDTLAFHKAFRFICEKHKDIVDYQRVKDWCDEYFFLPHRNEARGTGGIFYDWLHSPDEKGGWDADFAYTRDVGRGFSVVYPHLVRQNFNKDWTDADRNEQLIRRGRYVEFNLLYDRGTIFGLKTGGNVNSILSSMPPVVKWP

SEQ ID NO: 5482 - protein, 303 aa, Rhizobium leguminosarum bv  trifolii WSM2304
MERPELPIGLPEDIEEKKAAARSWFEGLRDTICASFEALEDELEGPLSDQEPGRFVAKDWSRENGAGGGGRMSMMEGRVFEKVGVHTSTVHGEFSPDFRAQIPGAKDDPRFWASGISLIAHPVNPNVPAVHMNTRMVVTSSRWFGGGADLTPVLSRRRTQEDEDSQLFHKAMEIACRNHAVADYDAYKAWCDDYFFLKHRNEARGIGGIFYDWLHSNEDAGGWDADFAFTRDVGRAFSMVYPKIVRSNFNKLWTEADRDEQLIRRGRYVEFNLLYDRGTIFGLKTGGNVESILSSLPPVVRWP

SEQ ID NO: 5483 - protein, 304 aa, Agrobacterium vitis S4
MQRPILPKGLPDDIEVKKATARAWFESLRDQICRSFEALEDELTGPLSDRAPGRFTPKDWQREEGLGGGGRMSMMNGRVFEKVGVHTSTVHGEFSPEFRKQMPGAEEDPRFWASGISLIAHSCNPHVPAVHMNTRMVVTTSQWFGGGADLTPVLDRRRTQDDADTVAFHAALEAACAAHPDVADYPHYKAWCEEYFFLPHRQEPRGIGGIFFDWLHAGEKFDLWAANFAFVQDVGRQFAAVYPDLVRRNFNTPWTEEDREEQLVRRGRYVEFNLLYDRGTIFGLKTGGNVESILSSLPPLVRWP

SEQ ID NO: 5484 - protein, 303 aa, Rhizobium leguminosarum bv  trifolii WSM1325
MERPELPIGLPDDIEEKKAAARNWFEGLRDTICASFEALEDELEGPLSDQEPGRFVAKDWSRENGAGGGGRMSMMEGRVFEKVGVHTSTVYGEFAPDFRAQIPGAKDDPRFWASGISLIAHPVNPHVPAVHMNTRMVVTTSRWFGGGADLTPVLSRRRTQEDEDSQLFHKAMEIACRNHAVADYDAYKAWCDEYFFLKHRNEARGIGGIFYDWLHSSEEAGGWDADFAFTRDVGRAFAMVYPKIVRSNFNKLWTEADRDEQLIRRGRYVEFNLLYDRGTIFGLKTGGNVESILSSLPPVVRWP

SEQ ID NO: 5485 - protein, 139 aa, Syntrophomonas wolfei Goettingen
MSNLRNCSKCGRVFPYMGRNICPRCLEKEEDEYQVVRRYVRDHPGAGVIEVVEETGVEEDKILQFLRDGRLQAKGLTASLRCERCGQSINSGRFCESCINEVNAEIQGHLPQKAKSEEPKRPPRGKVKDKMHIKDRGFF

SEQ ID NO: 5486 - protein, 147 aa, Clostridium thermocellum ATCC 27405
MPDIRNCKRCGRLFNYIGGRPICQDCKKQDEEEFKRVKEYLYEHPKASIIEVSNALDISVQKIKSYLREGRLEIVGTEGNVVLECEKCGKSINTGRFCNECSRELTEGFKATAQEISKSVSGDTDKKKTSGMGMKYLNRYERWNSDK

SEQ ID NO: 5487 - protein, 138 aa, Thermoanaerobacter sp. X514
MEIRNCKRCGRLYTYTGIDLCPVCYRQDEEDFMKVRDYLDTHPSATMLEISQNTQVSTKKIMDFLKEGRLILTSNNVNIGLRCERCGKPILTGRFCDECKTKLAKELMKGYSIQSDDKEEEKQTGERLYVYENQKKKK

SEQ ID NO: 5488 - protein, 138 aa, Natranaerobius thermophilus JW NM WN LF
MQNLKNCKRCGKLFLKTTRDICPDCHQKEEDDFLKVKQYLDKNPGATIVEVSEETEVSQKQIRKFIEEGRLLTSKYEALTIECKRCGKEISQGKYCESCQGELSQQFESVKGEPKQTDDETKETGKVHIKDRVDKRRR

SEQ ID NO: 5489 - protein, 144 aa, Halothermothrix orenii H 168
MNLKNCPKCGKLFAVQGSEKICPVCKKEEEDDFQKVKEYLWDNPGATIEEVHEETGVERETIIKFVKEDRLIAEGLDLEILLECERCGDPITHGRFCEKCQQELVEGLSPTPRKKKKPRKKTKRTRDKMFIADRVVKRKKNTDQ

SEQ ID NO: 5490 - protein, 137 aa, Clostridium cellulolyticum H10
MPDLRNCRRCGRMYNFIGGAPICQDCKNADEEVFKKVKDYLYDNPGATLSQVAMELDVSVEKIKMFLKEGRLEITDESNIILECERCGKSIKTGRFCRECQNEVSVDLEKTTKTIHLDNSDQNRSNGIGMRYLNKKL

SEQ ID NO: 5491 - protein, 146 aa, Anaerocellum thermophilum DSM 6725
MDVRNCRRCGKIYLYDGSPICPQCRKEEEEDFKKVKEYLYDHPGATLPEVSNATGVSPEKILRFLKEERLEIVGESNIILECERCGKAIKTGRLCDECKKEVGTRFLSYLDDKKLQESKKKNEEFAKRKEAGYRYLSKELKEDENK

SEQ ID NO: 5492 - protein, 135 aa, Geobacillus WCH70
MGELTNCPRCGRLFVKHSIRDVCEQCYKEEEALFEKVYQFLRKRENRTATMAQVVEATGVSESLITKWIKIGRLQLVHFPNLGYPCESCGTMIREGQLCPKCRTRFQTQLKQLEKEKQRQRQRMVTYYVQKDEEH

SEQ ID NO: 5493 - protein, 190 aa, Rhodospirillum rubrum ATCC 11170
MIEQIGSVEEADAGKVLESLVLSFSPSLLPLRQRWRNNGLSADFLGDYVTTFFPGAGDDTTTADRQKHAKAAVSYIANELLENAMKYSAAESTRPITITLSLEAERITFIETNPVSRARAATFHSYATELIASDPMEMYLRILEEERSDDDGSGLGLITMINDYNASLSWRFEDPGEDTVMVSTIVQIPV

SEQ ID NO: 5494 - protein, 185 aa, Sinorhizobium medicae WSM419
MTTLYGLEDLAVGPGENVTKLRLFDGPLDLGWKHCAMTSDFVAEFAALRYKTSRVVYKEVRHNVGYLTNELIENAVKFRAGGEIVVEASIASNTFRTKVSNLVDKGTADTFRHILSEITIGDPSDLLIQRIEANATGSGSGSGLGLLTLMSDYGAHFAWVFGSGEEDGKIPLETYASIAIPDLSN

SEQ ID NO: 5495 - protein, 179 aa, Anaeromyxobacter sp. Fw109-5
MSTPTVLGAFPEVTPPPLSAIELEVFPIDLVTEWRRCGMIADFMADYMGQGFERPDTARSVLSTVMNELVENAAKFSADARAPARASIRHHGEVVHLEIQNEATEQHLQSLRDLLPALARGDAADVFHRRVQDRRGLGIALLAKDYGATVGATVLPAQAGGRVTVCLRVELSAAEVEQR

SEQ ID NO: 5496 - protein, 186 aa, Rhizobium leguminosarum bv  trifolii WSM2304
MTPTVFGIESLTDISLDSGTRLTLTDGPLQLGWKHSGMTADFIAEVMALPFLRSKKDYMQAHHDIGYLSNELIENAVKFRQPGEILIEAGISEGSFLIRVRNTIDGATASRFQQLLQRLQSKDPGELLLEQIETNAISSASGSGLGLLTLLSDYDAKMAWAFEENTDERIILTTTAAVAMPPSSNP

SEQ ID NO: 5497 - protein, 193 aa, Cyanothece PCC 7424
MSQIFGDFRQDLPESEQCLMISFSPCSVPLQQRWCNNGLSADFVANYLATFFPCNKDDPNSLKRQAHLKSTVSYIANELLENATKFHDENTTASIQLGTYLIQNLVILLATNCSSIRVANQLELVIEKLINSEPEELYIQHLEMLAEDENYLGSGLGFLTIIHDYFAKIGWKIEPLPSEVNLVRVTTMVQVRV

SEQ ID NO: 5498 - protein, 195 aa, Cyanothece PCC 8801
MKTSEIYGDFDDNLPDNDQFLVISFSPSSIPLKQRWRNNGLSADFMADYLTTFFPIDENDVKTIARQKELKAGVSYIANELLENAMKFHDDRTEDPIRFGIRLLEDTVVLFSSNCVSLETWLKFQPIVNDLITCDLEELYVTQLEKLAEDDESRASGLGLITIMNDYGATLGWKIDKTQEKDDLITINTMAQLKI

SEQ ID NO: 5499 - protein, 198 aa, Cyanothece PCC 7425
MNTVDKSTIKIFGDFVEDIPATQEYLTIGFSPRGGAWRQRWSTNGISADFLGDYFATFFPGDELLEGRDRQETVKASVSYLANELLENAMKYGSTEYPVSISLYLYVKEIIFVVSNSATAEVAQKYQAFIEQVQTTDINELYLKQLELAASGGGGSGMGILTLINDYAARFSWKFELLPNSSLTRVTVMAHLDLEAMT

SEQ ID NO: 5500 - protein, 190 aa, Thioalkalivibrio HL EbGR7
MTQDHGQIREIRHDRNTESLDLSFWPGSLPLKQRWRNNGLSADFLGDYVTTFFPLDETDPSTRARQSEIRGAVSFIANELLENAMKFHDESLPEPITMRLCLFPEEIVFQQGNATGSEAADSFRAFVERLRDSDPNELYIQQLEEGAVSEGSAGLGYLTMINDYGAELAWRFEPLVSHGFRVTTQVTIKI

SEQ ID NO: 5501 - protein, 186 aa, Rhizobium leguminosarum bv  trifolii WSM1325
MTPTVYGIESLAGISLDSSTRLKLSDGPLQLGWKHSGMTSDFIAEVMALRYSRSRKDYVQAHHDIGYLSNELIENAVKFRQPGEILIEAGIFDGTFLIRVKNTIDGVTSSRFQQLLHRLQSRDPGELLIEQIETNAISAESGSGLGLLTLLSDYDAKMAWAFEGKDNQRIILTTTAAVAMPPSSNL

SEQ ID NO: 5502 - protein, 195 aa, Cyanothece PCC 8802; identical to SEQ ID NO: 5498

SEQ ID NO: 5503 - protein, 582 aa, Shewanella sp. MR-7
MSLPQPLMFTVGLIDQITKPIAKITQSLGGLASNYQTGTMQMASGIGGIAASGYALQQALMPAIEMDRALGEVKSLGVQDDALKMLANNSYDYALQYGKSATDFVRSSYDIQSAIAGLNAADLSRFTMSSNVLAAATKADAATVTSYMGTMYGIFKNDAMQMGEGAWVERLTGMTATAVQAFKTDGKKMADAFGALGASADKTPLEEQMAIMGTLQATMQGSESATKYKSFLAGVGKAQDALNLKFTDSHGAMLPIVDILNKIKGKYGDVISVAEGDELAKAFGSQEAVSMVKLLLNDINGLSGSINMLGKVKGMEQAEKMAAAMTDQSERLAQSWYVIRAAVGTAILPAFNSFIGKVADAGKEVIWFTNMFPNITRWLGYVAIGFTLAVAAGGLFTLMMGTGKMAMTTYGLAVMAWTGANALFTSGLATMRAMLLAVNIAMYANPIGLIVAGIAAAIAVVGALIYYWDDLKATMGEWGWVQAIVGIFNTVWGGVKSIFNDTINWIIEKLNLIPGVDISTNVSAGSMPSVDAISPVQANLTRGGISQQIANANNSKSTTVGNINIYPQKVDTNFANYVEMHS

SEQ ID NO: 5504 - protein, 731 aa, Marinomonas MWYL1
MSALQRLDFIVSLMDRVSGPANKMMKTMDTVTSNIQTGYQKIGYGVAGLFSVGYAFDQMLEPAKEMRTALGTISSLGVENAALENLRKTSMATAVQYGTDATEIVNASYKLQSAISGLTGNELSMLANKSAMLATATKGGLESTNAYVGQMFNIHAVEADAIGKTAFMDKLISKTAKAVQLFNTDGSQMGEAMKNIGKQATAMKVPLEEQLAVMGFLQNTMVEGGRSGNAYSSFLANISKAETTLGMKFTDSQNKALPMIDIITKLQDKFGDLSKAGDQQMLQKAFGKRGQQVLAAMAGSLDTFKGNLESIKAVKGLDDVTAMAMAIADPWDQSAAAVKNFRMEFGERLLKVFSPVYTAITDTMTTLTKWMDMFPHLTGWVIKGVVGIGVLVGSLSALSVAVGLSKFVMVGWSVVATSVGFIWGTLGKVISISRATWFAMNLQVALSGGLMNMLKINMLTTWATMAAGTIQTTAMTLATGFWSKSMMVASIGSKGLTAGLALMKFGFLSSITAVWAFSAALWANPITWIVVGVVALTAAVVAAVVYWDEWTGKLVEWGTAFLDFIGVFDFVDGVLAVWDKIPQWWNSLMGWFGSFDVGSLFSSFLSGFGLVDGVLALWNKLPEWWASFKNYLSGMNVFSFVGDSIDWLIDKINMIPGINIDTAKDMPKPVAAPASLSNQAPKMAGGGLVNQISNATSNNNNSRNVGDVHINNYGQAMDGRTFANELAFAAG

SEQ ID NO: 5505 - protein, 658 aa, Yersinia pseudotuberculosis YPIII
MKSLDFTLSMIDKITRPLKSVQASVKGFAESSQAAFGKIAIGGAALFGVVQGMKGALGPAAEFAGALNEASAKGVSDSALQKMSADALKFSMQYGRSAVDVVRSSADVRSAIGTLSDRDLPRFTLATNVLAAGMKTTGSEAAAYMGQMYNQFDSYAARIGKVKFAEEVAGKTAYMAQSFGVSMQTMADLMAGSKGVGANYGVGIDEQFAVLGQLQKTLGTEASGSYENFMKGAADGAKTLGLSFVNASGQMLTMPEMLDKLQGRYGKTIEGNLKAQAELDKAFGDGANVIKQLYGNVDLLKRNIGELGSNDGMKRAGEMAKKMADPWERLMAIWTGMRVILGLTLLPVLYPIMNRVSEIGERFARWMQLFPNIARLIGYAMLALLSFAAAGAIANMVMGISMFIWMGLKLLWGALCAVTKIHTAAIWLYNTAIIAVNATMRIMRGVLLAVRMAAISAGISFSFMTWPILLIIVAIAALAAGIYYLITYWDEIKAAIADTAAFQWLSGVVTAVGAVFSVVWKGIVAGWEWLVSAITGLSPLAGISAMADTIGNVFSGLWDWLKSTFAETYNWIIDKLNYIPGVNIEAKSIPSQESSPISSANNLLTGGQIQNIEKGGINKEISNNAKTVTDNSKRFENVNINMQGGMTPEQLMEWQELN

SEQ ID NO: 5506 - protein, 656 aa, Salmonella enterica serovar Newport SL254
MKQLDFTLSLIDKLSRPLKQAQSSVTGFAEKSKAAFMQIGGGVLALAGTGMAIRGALSPAIEMYDALNDAASKGIDDQALKAVQRDALRFSTTYGASAVEFVQSTESINSAIAGLTGNELPKVTKVANTLAFALKSTAAETAEFMGQMFGNFSADAERLGKVQFAEQLAGKMVYMRKTFGTEMATIKDLMEGARGVGTNYGVGLDEQLAVLGQLNRTLGTEASSAYEGFMTGAVEGAKKLGLSFTDATGKMLSMPEMLIKLQGKYGKSLEGNLKAQAELDAAFGDSSAVVKHLYGNVALLQRNITELGGSDGLKRTQEMASKLVKPWDRFVQILKAIQTVIGLTLIPVLYPVLNRLADMGQTFARWMQLFPNIARVIGYAAMALLGFAAVGAVANIVMGVSKFIMMGWKGVWKLLTAVTKIDTAWTWLNTKAKLAWANVMKSLRGILLALRMQAIMTGTAINFMSWPVLLVIGAIALLAAGCWLLIKHWDTVKAAVMETSAFQACARVVAWLAGVFSTAWQFISEGWNSFIALLTGFSPSQALSGLASGIVSMFDNVWQSVKGGFLKSWNWIVEKLNKIPGVDISMANETSSPPLTVNNLSTGGELKGIDKGGISKSVSNNSRSVTDNSRKINTVNIYPKEMITPGQLMEFQELGV

SEQ ID NO: 5507 - protein, 656 aa, Salmonella enterica serovar Heidelberg SL476
MKQLDFTLSLIDKLSRPLKQAQSSVTGFAEKSKAAFMQIGGGVLALAGTGMAIRGALSPAIEMYDALNDAASKGIDDQALKAVQRDALRFSTTYGASAVEFVQSTESINSAIAGLTGNELPKVTKVANTLAFALKSTAAETAEFMGQMFGNFSADAERLGKVQFAEQLAGKMVYMRKVFGTEMGTIKDLMEGARGVGTNYGVGLDEQLAVLGQLNRTLGTEASSAYEGFMTGAIEGGKKLGLSFTDATGKMLSMPEMLIKLQGKYGKSLEGNLKAQEELDAAFGDSSAVVKHLYGNVALLQRNITELGGSDGLKRTQEMASKLVKPWDRFVQILKAIQTVIGLTLIPVLYPVLNRLADMGQTFARWMQLFPNIARVIGYAAMALLGFAAVGAVANIVMGASKFIMAGLRGIWVAMTAVTKAYTAMVWLAQIAVIAWNATLKFLRGALLAVRMAAIMAGIGINLMSWPVLLVIGAIALLAAGCWLLIKHWDTVKAAVMETSAFQACARGVAWLAGVFSTAWQFISEGWNSFIALLTEFSPSQALSGLASGIVSMFDNVWQSVKGGFLKSWNWIVEKLNKIPGVDISMANETSSPPLTVNNLSTGGELKGIDKGGISKSVSNNSRSVTDNSRKINTVNIYPKEMITPGQLMEFQELGV

SEQ ID NO: 5508 - protein, 655 aa, Salmonella enterica serovar Agona SL483
MKQLDFTLSLIDKLTRPLKQVQSSVTGFAEKSKAAFTQIGGGALALAGTGMAIKGALSPAIEMYDALNDAAAKGIDDQALKAVQRDALRFSMTYGASAVEFVKSTENINASIAGLAGNELPKVTKVANTLAFALRSTSAETAEFMGQMFGNFSADAERLGKVQFAEQLAGKMVYMRKVFGTEMGTIKDLMEGARGVGTNYGVGLDEQLAVLGQLNRTLGTEASSAYEGFMTGAIEGGKKLGLSFTDATGKMLSMPEMLIKLQGKYGKSLEGNLKAQAELDAAFGDSSAVVKHLYGNVALLQRNITELGGSDGLKRTQEMAGKLVKPWDRFVQILKSVQTVIGLTLIPVLYPVLNRLADMGQTFARWMQLFPNIARVIGYAAMALLGFAAAGAIANIVLGVSKLIKLGAIALWKTLTSVTKIYTATVWIASKAVAAWNLTLKFLRGTLLAVRMAAIMAGIGINLMSWPVLLVIGAIGLLAAGCYLLIKHWDDVQAAVMNTAAFTAVAGVVEWLAGVFSTAWQWIKDGWNGFINLLTGFSPSQALSGMAGGIVSMFDNIWQSVKGSFLKSWNWIVEKLNKIPGVNISLANESPPALTTNTLSTGGELKGIDKGGISKSVSNNSRVVTDNSRKINTVNIYPKEMITPGQLMEFQELGV

SEQ ID NO: 5509 - protein, 704 aa, Aliivibrio salmonicida LFI1238
MSAHLDKLMMQVALIDSVTKPLKGIQNTVTETADVGRSGWEKMAGGTAGVIAAGFAVQQALMPAIEMDRVLGEVKSLGVVDEDLQQLQKTALAFSVEYGKSAQEVVGAAYDIKSAFGDITGPELSDITKSSAVLAAATKADTATITDYMGTMYGVFKNQANDMGVGIWSKNVAGMTAQSVEMFKTTGKGMSDAFTSVGANATAAGIKMNEQMAILGTLQSTMSGSEAGTKYKSFLTGVGGAQDKLNMKFVDSQGAMLPMVDILNKLKGQFGDTLDVAESDALKKAFGSDEAVSMIKLLMADTNGLASSINSLGNVKGMSKAENMAGAMTDQWQRLEAAWFAIRAGAFGLILPSINAIAGSMADGFNVLLGWTQELPVLTQYLGYFALTIVAGAGLIAAWNMVVGLASLMSAGWSSATLLLTTVMKGFNLVMRMARFAALGFAMAAAVAQVPLLPLILGIGAVVAAVGAVIYFWDDLKAAWSDFSFIESLGSMVDWLIEKINLIPGINIGGESSGIPQMDTLELSTATPTHYASKAAVPDYSYGYQAPVTQEVAVTPNVTEPVIPKVSEQSVNYGSQYSGLNTVPSYQGNVYYQNQIPVQPESSDLIIGSVVAQPEVPEVNGIVTYDGAIPPLTDTDKSKEMSAPISAYIGGNAEGKANVSQQLKQMSAGSTDNSRTQHVGDVYITQEQAFTPEDLSAWNEMSTP

SEQ ID NO: 5510 - protein, 407 aa, Rhodopseudomonas palustris HaA2
MTATDDTPTPWLSIVGIGEDGVAGLSDKARALLANADLVIGGERHLAMVAALGRPTLPWRVPFAVSLPDVLAQRGRSVVVLCSGDPFWHGAGAVLADHLAPSEWTALPAPSTFSWAAARLGWRLEETITLGLHARPITMLRPHLQPGSRLIVLVRDGAAVAQIAAYLTATGFGPSSLTVLEALGGPRERILRAAAANYTLTDVAAPVAIGIDVVAQPDSAIIPHASGLPDELFQTDGQLTKRAIRAVTLSSLAPRGGELLWDIGAGSGSIGIEWLLAARSNRAIGIEARPDRLACARGNADALGVPHFDLRLGQAPEALADLPTPDAVFIGGGAGNPGVLDAVWQALPPGGRLVVNAVTLETEALLIACHGRHGGELLRLGVERAAPVGGLTAWRAAIPVVQWSVRK

SEQ ID NO: 5511 - protein, 399 aa, Novosphingobium aromaticivorans DSM 12444
MAPEAWLTIIGIGEDGPDGLSAAARTALAQAGLVMGPARHLSLLPAITCTMIEWPVPFADGIALLMQHRGQRVVMLASGDPFWFGAGSSVARLLDPGEWVAIPAPSTFTLAVARLGWPVQDVACLGLHAAPLDRLKPHLAPGRRVIALLRDGAAVAALADYLTGQGFGASALHVMEALGGPRERVRTARAEGLSFTDIAHPVAAGIECAGHGPSLPLTAGRPDHWFASDGQLTKRPVRALTLSALAPCAGELLWDIGAGSGSIGIEWLLAHLANRACAIEADPVRADRVRANAAALGVDRLKVVVGIAPDALPPGPLPDAVFIGGGLSEALLDTLWARLPAGTRLVTNAVTLESEALLARWHGQKGGSLLRIELADAAPLGNRHGWRARYPVVQWSVTL

SEQ ID NO: 5512 - protein, 399 aa, Jannaschia CCS1
MANLPWITIIGLGEDGPEGLPPASRDALAAAEIIMGPARHLALIGPTNAQQVEWPVPFADGIDVLRGHGGRPVAVLVSGDPFWYGAGRAMSKAFGRDAWRAIPVPSVFSLVSSRMGWPIEDTLCIGLHARPFEQLRAKLAPGRRIIATLRDGPAVSGVAHFLRDTGFGGSTLTVCEAVGGPREVVTQVSVAEALKGGFSHPVTVAVELHGTGEVIPLASGRPDALFQTDGVMTKRPVRALTLSALAPRAGEHLWDIGGGSGSIAVEWALADRTCTATVVETRADRVALIRANVESFGLTDQVTVLEGMAPGAMADAPPANAVFIGGGLSPEMLQFVTALPKGTRVVANAVTLEAEAHLAQAQGSFGGDLMRIEIAHAQPLGPKRGWTSAYPVVQWSVTL

SEQ ID NO: 5513 - protein, 370 aa, Rhodopseudomonas palustris BisB18
MIVGGPRHLALVAALAKPTQAWEIPFAASLPKLLAQRGKRVVALCSGDPFWYGAGSVIADSVPAAETLALPAPSSFAFAAARLRWRLEETTTLGLHARPLDLLRPHLHNAARLIVLARDGAAPAKIAAYLTGLGFGPSRLTVLEALGGARERVRATTADDFALDDIQSPVAVAIEAIATPGAIIMPRIAGLPDDLFQHDGQLTKREIRAITLSTLAPRGGELLWDIGAGSGSIGIEWLLAHPTNRAIGIEPREDRLANARANAASLGVPHFDLRLGSAPEALQDLPTPDAVFVGGGASRDGVLDAVWQALPRGGRLVVNAVTLETEAELIAQQARHGGSLLRLAVERAGAVGGMTGWRAAMPVVQWSAVK

SEQ ID NO: 5514 - protein, 369 aa, Rhodopseudomonas palustris BisB5
MVGGDRHLALVAALNKPSLPWRVPFSASLPEVLAQRGRNVVVLCSGDPFWHGAGAVLADHLPPQEWSALPAPSTFSWAAAKLGWRLEDVVPLGLHARPIATLRPHLRDGAQLLVLLRDGAAVADVAAYLTTSGFGASDIVVLEALGGPHERIRRTTASNYAYADVAAPVALGIVAVAEPGATIIPCTSGLPDDLFQHDGQLTKREVRAVTLSTLAPRGHELLWDIGAGSGSIGIEWLLAARSNRAIGIEARPDRLATARANAEALGVPHFDLRLGQAPDALTALPPPDAVFIGGGASRPGVMETVWQSLPAGGRLVVNAVTLETEALLIDWHGRHGGELLRLAVERASPVGGLTGWRAAMPVVQWSVRK

SEQ ID NO: 5515 - protein, 387 aa, Rhodobacter sphaeroides 2 4 1
MADPWLSIIGLGEDGPAGLPDASRAALEAAEVVVGGPRHLALVDARARGMEWPVPFDPAPVLALRGRPVAVLASGDPFWHGAGGSLAAALSPGEWRAYPAPGVVALAAARLGWRQEELLALGLHAAPFERLLPELAPGRRGVCTLRDGPAAGALAAFLAAEGWGESRLWVMEALGGPRERVRATTAGAFSLTDVAAPVTVAFEAEGGRAQPRSAGLPDSLFAHDGQITKAPVRALTLAALAPRRGEILWDLGAGSGSVSVEWCLAGGRAVAVELRPERAANIRANAARFALPLEVVEGRALDNLPALPAPDAIFVGGGFDEALFAALPPTARLVVNAVTLETEALLAALQARHGGELLRIELARAAPLGRMRGWEAARPVVQWSLVR

SEQ ID NO: 5516 - protein, 390 aa, Paracoccus denitrificans PD1222
MADPWLSIIGIQEDGLAGLPPASRDALDRAEIVFGAPRHLELAGIGGQRGRAWPVPFGLDPLLALRGESVAALVSGDPFWHGAGGSIAAVLQTGEWRAFPAPGTFSLAAARLGWRLEETACLGLHAAPFARLRPVMARGARAICLLRDGTAPAQLAEWLVAQGLGPTRMVVMEALGGPRERIREARAQGFALDCIAPVAVALDGADLPSGAGLPRGFGLPDDSFAHDGQITRRAIRAVTLAALGPRTGEMLWDIGGGSGSVSVEWCLNGGRAVTLEPRTDRIANIAANIKAFGLADRMRAVQGAAPDFLHDLPAPDAIFIGGGASATLIDALPPARLVANAVTLETEALLIGLHAQRGGSLTRIALEEAVPLGRMRGWTPARSVTQWSWP

SEQ ID NO: 5517 - protein, 387 aa, Rhodobacter sphaeroides ATCC 17029
MADPWLSIIGLGEDGPAGLSDASRTALEAAEVVVGGPRHLALVEAGARGMEWPVPFDPAPVLALRGRPLAVLASGDPFWHGAGGSLAAALSPGEWRAYPAPGVVALAAARLGWRQEELLAMGLHAAPFERLLPELAPGRRGVCTLRDGPAAGALAAFLAAEGWGDSRLWVMEALGGPRERVRATTAGAFALADVAAPVTVAFEAEGGRALPRSAGLPDSLFAHDGQITKAPIRALTLAALAPRRGEILWDLGAGSGSVSVEWCLAGGRAVAVELRPERAANIRANAARFALPLEVVEGRALDNLRALPAPDAIFVGGGFDEALFAALPPTARLVVNAVTLETEALLAALQARHGGDLLRIELARAAPLGRMRGWEAARPVVQWSLVR

SEQ ID NO: 5518 - protein, 407 aa, Rhodopseudomonas palustris TIE 1
MISSDDTAQPWLSIVGIGEDGLDGISARARALLDAAELVVGGDRHLALVAALHKPSLPWRVPFAASLPNVLARRGRRVVVLCSGDPFWHGAGAVLADHLAANEWTAVPAPSTFAWAAARIGWRLEDTATLGLHARPVATLRPHLRPQARLIVLVRDGAAVVEIAAYLAANGFGASELTVLEALGGPRERVRRTTASIFAFPDVTAPVALGIAVVAEPNAIIMPCISGLPDELFQHDGQLTKREIRAVTLSTLAPRGHELLWDIGAGAGSIGIEWLLAARSNHAIGIETRPDRLATARANAEALGVPQFDLRLGSAPDALAGLPTPNAVFIGGGAGRPGVMDAVWQALPAGGRLVVNAVTLETEALLIDWHHRHGGELLRLGVERASPVGGLTGWRAAMPVVQWSVHK

SEQ ID NO: 5519 - protein, 413 aa, Methylobacterium chloromethanicum CM4
MSSGDAARDAATGAPWLAIVGIGEDGRAGLSPAAAAALAGARVVYGGRRHLALAGSLAAEARAWPSPITDAYPEILALRGEPTCILATGDPFHYGIGAEIARLVPAAEIRAYPQPSAFSLTCARLGWPLAECACLTLHGRALARIVPNLQPGARLLVLSWDETTPAAVATLMTKRGFGGSRLTVLEAMGGPRERVRTAAAAAFDLGDIDPLNTLAIDVLAEPRARAVPLAPGLDDAWFENDGQLTKAEIRAVTLAALAPRRGQRLWDIGGGAGSVSIEWMLRHPAQRAVAIEARPERAAQIRRNAEALGVPDLAVVEGEAPAALAGLPPPDAVFVGGGVGAPGLLPAAIAALGAGGRLVANSVTLEAEAVLLAAFTERGGSLRRLSVARADPVGGLHGWRPAMPVTQWVWTKP

SEQ ID NO: 5520 - protein, 881 aa, Frankia CcI3; identical to SEQ ID NO: 5008

SEQ ID NO: 5521 - protein, 892 aa, Arthrobacter FB24; identical to SEQ ID NO: 5011

SEQ ID NO: 5522 - protein, 886 aa, Acidothermus cellulolyticus 11B; identical to SEQ ID NO: 5012

SEQ ID NO: 5523 - protein, 896 aa, Nocardioides JS614; identical to SEQ ID NO: 5013

SEQ ID NO: 5524 - protein, 892 aa, Salinispora tropica CNB-440; identical to SEQ ID NO: 5018

SEQ ID NO: 5525 - protein, 892 aa, Frankia EAN1pec; identical to SEQ ID NO: 5021

SEQ ID NO: 5526 - protein, 892 aa, Salinispora arenicola CNS-205; identical to SEQ ID NO: 5022

SEQ ID NO: 5527 - protein, 898 aa, Arthrobacter chlorophenolicus A6; identical to SEQ ID NO: 5027

SEQ ID NO: 5528 - protein, 890 aa, Actinosynnema mirum DSM 43827; identical to SEQ ID NO: 5029

SEQ ID NO: 5529 - protein, 896 aa, Beutenbergia cavernae DSM 12333; identical to SEQ ID NO: 5030

SEQ ID NO: 5530 - protein, 889 aa, Catenulispora acidiphila DSM 44928; identical to SEQ ID NO: 5035

SEQ ID NO: 5531 - protein, 888 aa, Saccharomonospora viridis DSM 43017; identical to SEQ ID NO: 5037

SEQ ID NO: 5532 - protein, 895 aa, Jonesia denitrificans DSM 20603; identical to SEQ ID NO: 5038

SEQ ID NO: 5533 - protein, 891 aa, Nakamurella multipartita DSM 44233; identical to SEQ ID NO: 5041

SEQ ID NO: 5534 - protein, 116 aa, Ralstonia eutropha JMP134
MFRFDEGLKVYLHREAVDFRKSINGLSALVEQSLGLDPFARAVYVFRNRRADRIKLLGWDRNGYWLFLKRLEADRFAWPRGTAVATLSVEQLHWLLDGIDISAVQRHPQRHYQRAV

SEQ ID NO: 5535 - protein, 117 aa, Ralstonia eutropha JMP134
MFRFDAGLQVYLHRNAVDFRLGINGLIALVEQSMQLDPFARAVYAFHNRRRNRVKLLLWDRNGFWLLLKRLEEDRFVWPRREQTVIELTTEQLHWLLDGIDVDAVQRHPPRQYQHTA

SEQ ID NO: 5536 - protein, 117 aa, Burkholderia xenovorans LB400
MFRFDNDLRIYLHREPIDFRAGLNTLVTMVEQSMQLDPLARAVFGFHNRKRDRVKLLLYDRAGFWLMLKRLEVDRFAWPRRQQAVIELTVDQLHLLLDGVDLDALRPHPARQYCFTS

SEQ ID NO: 5537 - protein, 117 aa, Burkholderia xenovorans LB400
MFRFEADLKVFLHREPIDFRAGINSLVTLVEQSMQLDPFARAVYAFHNRRRNRIKLLLYERNGFWLMLRRLEEDHFIWPRRQQAVIELTTEQLRWLLEGIDIEAMCRHPARRYRHAS

SEQ ID NO: 5538 - protein, 97 aa, Polaromonas JS666
MRCGFDSLAARIQTALTENPFSGHIFVYRGRRGDLIKLLWWDGDGLCLLAKRLERGRFIWPQAESGVISLTSAQLSMLLEGIDWRRPERTWVPQRAV

SEQ ID NO: 5539 - protein, 117 aa, Nitrobacter hamburgensis X14
MFRLGADLKVYLHREPIDFRAGINSLAVLVQETMALDPFAPAVFAFCNRRRDRMKLLFFDRSGFVLVLKRLTEDKFRWPRREAAVVRLTTEQLHWILDGIDIDAMVRHPLRQYQVAG

SEQ ID NO: 5540 - protein, 116 aa, Burkholderia cenocepacia HI2424
MFRLSDELKVYVHRDAVDFRKSINGLAAIVEQSMKLDPFEQAVYVFSNQRRDRIKMLLWDRNGFWLLMKRLEQDRFVWPRKEAVLKLRTEQLHWLLDGIDIEAMRAHPTRYYQRVT

SEQ ID NO: 5541 - protein, 117 aa, Sinorhizobium medicae WSM419
MFRLGADLKVYLHREPIDFRAGINSLAVLVQETMALDPFAPAVFAFCNRRRDRMKLLFFDRSGFVLVLKRLTEDKFRWPRREVAVVTLTTEQLHWILDGIDIDAMVRHPVRQYQVAG

SEQ ID NO: 5542 - protein, 115 aa, Xanthobacter autotrophicus Py2
MIPVPSGVKVWLATGHTDMRKGFAGLSLQVQEVLRHDPHGGHLFVFRGRRGDLIKVIWHDGQGACLFSKRLERGRFLWPSPADGVVTITPAQLGYLLEGIDWRHPQQAWRPGASG

SEQ ID NO: 5543 - protein, 117 aa, Burkholderia phymatum STM815
MFRFDADLRVFLHREPIDFRAGINSLVMLVEQSMQLDPFARAAFAFHNRRRNRVKLLFYERTGFWLMLRRLEEDHFVWPSRQQAVIELTTEQLHWLLDGIDIDAMHRHPARRYRHAS

SEQ ID NO: 5544 - protein, 116 aa, Burkholderia phytofirmans PsJN
MFRLDDELKVYVHRDAVDFRKSINGLAAIVEQSMKLDPFARAVYVFSNQRRDRIKMLLWDRNGFWLLMKRLEQDRFVWPRKEAVLMLRTEQLHWLLEGIDIEAMRAHPRRYYQRVT

SEQ ID NO: 5545 - DNA, 600 bp, Acidithiobacillus ferrooxidans ATCC 53993
atggcagattctattatgtgtatagaaaccctacacaactgtctggttcgcgtgcacatgaaacgactggatctgctgaatcgcctatccgccctggaacagaaggggcttgtcgtctattccagacgagacctggagaagatttttccggaagaggatgagaaagcgctggagaagagcttgcaacgcatgtgccaggacaaccttctggttcgcgccgctcgcggcatctacgtttttggtccagctgtgccgcgtcaccggggctggctgatcgagcggatcgcgcaggccctgcgcccgggagatttcaattacgtttctctggaaagtattctctcggaatatggtgtgatctcacagattcctgtggatcgcttgacggtaatgaccacaggcgcgaaaggactccacaagaccccctttggggctattgaattcacgcacaccaagcgcactattccggatcttctggaaagaacattagtcgtcaaggggcgtccattgcgtattgccagaaagcaggctgccatccaggatctccatcgtgtaggacggaacatagacttgattgatcgggacgaggtggatgatgaataa

SEQ ID NO: 5546 - DNA, 630 bp, Ammonifex degensii KC4
atgcggatgacggagtggtaccgccttttccaggagaacagctttaaaaaggtgttcaccttcgacgacctgcatgtactaaccgggctacccacccgggagcttaaggtagagctctcccgcctggtcaagcgcggtctcgccgaacgcctggcaaaaggcgtctacgcgaacccctttaactatccctcccctgcggagatagcaatggtgctgaggcccccgtgctacatctccatggagcactgcctctcggaagaaggcatcctctcccagcactccttcaccgtcacctgcgtcactctagggaccccgggcaccgtccgcaccagcagaaccatcttcgagtaccaccgcatcgcccgcagactcttctggggatggcgtgaggacggacagggagtcagatgggcctggccggaaaaagcgctgctagacctgatctacatccggcacctgcgaaccagggaactctccagggaaaggcttctctctctgctggacgacatgtacctcggagagctgaacggggagaggctcgtggaattcctgtcccggttcgggagcccgcatgccgaaaagatcgccgatatcctcacagaggcgggcctcacgatcagtcccagctga

SEQ ID NO: 5547 - DNA, 552 bp, Bifidobacterium longum DJO10A
atgaaaagaagcgaggcgattgaccagctgcgcgagatggatgccaagtactcgtgctacgtgtattgcaagaacgaactggccgtcgtgctgggtgagcaggggcagaaactgaaccgaaccctgtccagcctggtatcggcgaaggcgttggttcgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggtcgcgaaggcgagttccataccccgtatggggtgatcgagttcacgcactgcaagctcagctgggaccgcatcctgccgaacctgatcgcccgcgatgacggactgacgccgctcgcgtcgaaacagtgggcgtatcgtgacctgaaggccgtcggacgcaatctcgatctggtggatatggatgaattggaggacgacgatgactggaactga

SEQ ID NO: 5548 - DNA, 552 bp, Bifidobacterium longum longum ATCC 55813
atgaagaggagcgaggcgattgatcagctgcgcgagatggatgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcggacgcaacctcgatctggtggacatggacgaattggaggacgatgatgactggagctga

SEQ ID NO: 5549 - DNA, 552 bp, Bifidobacterium longum longum F8
atgaagaggagcgaggcgattgaccagctgcgcgagatggatgccaagtactcgtgctacgtgtattgcaagaacgaactggccgtcgtgctgggcgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcgggcgtaatctcgatctggtggatatggatgaattggaggacgatgatgactggagctga

SEQ ID NO: 5550 - DNA, 600 bp, Bifidobacterium longum
gtgtacatgaatatgcgtttttacatatattcatgtacacttatatgcatgaagaggagcgaggcgattgatcagctgcgcgagatggatgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcggacgcaacctcgatctggtggacatggacgaattggaggacgatgatgactggagctga

SEQ ID NO: 5551 - DNA, 552 bp, Bifidobacterium sp. 12 1 47BFAA
atgaagaggagcgaggcgattgaccagctgcgcgagatggatgccaagtactcgtgctacgtgtattgcaagaacgaactggccgtcgtgctgggcgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggccgtgagggcgagttccgcaccgcgtacggggtgatcgagttcacgcactgcaagctcagctggagtcgcatcctgccgaacctgatcgcccgcgatgacggactgacgccgctcgcgtcgaaacagtgggcgtatcgtgacctgaaggccgtcggacgcaacctcgatctggtggacatggacgaattggaggacgatgatgactggagctga

SEQ ID NO: 5552 - DNA, 540 bp, Cellvibrio japonicus Ueda107
atgcatcaaacaaccgccattcagcgccttgcagcctgcgataagaccggccggtatgtttttacctatagagacttggccaagatctttccggaagacagcgtccgtaccttgcaggccgggctgaaacgcctggtacaacaagggattttaatcaatccggcaaagggcatttatctgtatagcctgtcccgacacaaagacagcaataccctcgaacagatcgccaagaccatccgccggggcgaatacaactacgtcagcctggaatcggcattgtccgagtacggtgccatctcccagattccgatagatcgtttaacggtgatgactaccgggcgcaaaggcgaatataaaacctctttcggcactatcgaatttacccataccaaacgcccggttagcgatattgtcagcaatcgcatcgatgtcggccgcccgctgaaactggccagtaaagctgccgcctatcgcgatttaaaacgggtcggccgaaatacccatctggttgaagagcaggttatttatgaagatcactga

SEQ ID NO: 5553 - DNA, 579 bp, delta proteobacterium sp. MLMS-1
atgacaccgacaccccaccgccaacccggtcgccgtttggccgctgtgctcgaggaagtggccgattccgagcactatctctttaccctggccgatctgcgcggagccctgccggaaatcggtgccggggctttcaagaccctgttgagccgggccgaaaagcgcggtctgctgcagcgggtctgtcgtggcctctatctttatccccgggttgattacccccgcgatctgctgctgttccacgccgccgcccggctgcgggccgatgccttcaactatatcagcctggagaccgccctcagcgatgccggggtaatctcccagattccgctcaactggatcaccctgatgagttccggccgccgcaacatcgtgcgctgcggccgtttcggcaccattgagttcatccatacccgccagcagccggccgccctggccgctgagctgacctacgacccccgctgccggctctggcgggcctcggtttccctggccctgcgggacatgcgcgccacccggcgcaatctcgacctgatcgacgaggagcttgcccgtgagtttgcccatgaatctgattga

SEQ ID NO: 5554 - DNA, 579 bp, delta proteobacterium sp. MLMS-1
atgacaccgacaccccaccgccaacccggtcgccgtttggccgctgtgctcgaggaagtggccgattccgagcactatctctttaccctggccgatctgcgcggagccctgccggaaatcggtgccggggctttcaagaccctgttgagccgggccgaaaagcgcggtctgctgcagcgggtctgccgtggcctctatctttatccccgggttgattacccccgcgatctgctgctgttccacgccgccgcccggctgcgggccgatgccttcaactatatcagcctggagaccgccctcagcgatgccggggtaatctcccagataccgctcaactggatcaccctgatgagttccggccgccgcaacatcgtgcgctgcggccgtttcggcaccatcgagttcatccatacccgccagcagccggccgccctggccgctgagctgacctacgacccccgctgccggctctggcgggcctcggtctccctggccctgcgggacatgcgcgccacccggcgcaatctcgacctgatcgacgaggagcttgcccgtgagtttgcccatgaatctgattga

SEQ ID NO: 5555 - DNA, 537 bp, delta proteobacterium sp. MLMS-1
atggataggaagaccgcaatcaaagtattggctgaatgggatgaagccggccgttatgtgttcacattgcgcgatctcgttaaattgtttcccggtgacaatcccaaaactttgcaggcggcggtgaaccggctggtgggtgacggctttttgcagcgggcttcccggggggtttacgtctatcctttggcccgcagcaaggacagtcataccattgagcggatcgccgtggcactgcggcgcggggagtacaactacctcagcctggaatccgcgctttccgagtatggcgccatttcccaaatccccgttgaccgcctgacggtgatgaccaccgggcgcaagggggtgtaccgcaccccgtggggcaccatcgaattcacccacaccaagcggcccattccggatatcctggacagcgcccatgacgttggccggcccctgcggttggcaacgccgatggcggcctggcgcgatctgaagcgggtcggtcgcaatactcatttggttgatcaaggagcgttgaccgatgactga

SEQ ID NO: 5556 - DNA, 537 bp, delta proteobacterium sp. MLMS-1
  misc_feature (50)..(50): n is a, c, g, or t
atggataggaagaccgcgatcaaagtattggcagaatgggatgaagccgnccgttatgtgttcacattgcgcgatctcgttaaattgtttcccggtgataatcccaaaactttgcaggcggcggtgaaccggctggtgggtgacggctttttgcagcgggcttcccggggggtttacgtctatcctttggcccgcagcaaggacagtcataccattgagcggatcgccgtggcactgcggcgcggggagtacaactacctcagcctggaatccgcgctttccgagtatggcgccatttcccaaatccccgttgaccgcctgacggtgatgaccaccgggcgcaagggggtttatcgcaccccgtggggcaccatcgaattcacccacaccaagcggcccattccggatatcctggacagcgcgcacgacgttggccggcccctgcggttggcaacgccgatggcggcctggcgcgatctgaagcgggtcggtcgcaatactcatttggttgatcaaggagcgttgaccgatgactga

SEQ ID NO: 5557 - DNA, 567 bp, Desulfurivibrio alkaliphilus AHT2 uid49487
atgatgccgacaccacacccccaacccggccgccgcttggccgctgtgcttgaggaattggccagccccgagcactatctctttacctcggccgatctgcgcggagccctgccggaaatcagtgccggggccttcaaaaccctgctgagccgggccgaaaagcgcggcctgctgcggcggatctgtcgcggcctctacctttacccccgggttgattatccccgcgatctgctgctgttccacgccgccgcccggctgcgggccgatgccttcaactatatcagcctggagaccgcccttagcgatgccggggtgatctcgcagattccgctcaactggatcaccctgatgagttccggccggcgcaacatcgtgcgctgcggccatttcggcaccatcgagttcgtccataccagccggcagccggccactctggccaatgaactgacctatgacccccgctgccggctctggcgggcctcggtggccctggccctgcgggacatgcgcgccacccggcgcaatctcgacctgatcgacgaggagcttacccgtgaatctgcttga

SEQ ID NO: 5558 - DNA, 540 bp, Eggerthella lenta DSM 2243
gtgaaaagcgtcgaggcgatcaagatcctgcatgggtgcgacctggagggccggatcctcttccggagtcgcgagctgggggctcttttcgatgagcacggcgatacgctccgctcgaccatcaagaggctcaccgcagacggcatcctcgagcgcgtcgcccacgacgcgtacctctacctgctttcccatcccaacggctgcgacctgctcggccacatcgcggcgtttctacgccccggcggcgccacctatgaaagtctcgagtccgcggcatcgcagtggggctttatctcgcaaatcccgctcgggcgcatctcgtgcgtgacgacgggcgcggaaggcctcgtcgatacccggttcggcgccatcgaatttgtacatactgatgatgatttggatgccgtcaaacggggaataatcgaccgtatgccgaggaatcggctgccgatcgcgaccgaggagcgctgcctgcacgacctcgtctcgaggaagcgcagcctggagcttatcgattgggatgaagtggatgttgattga

SEQ ID NO: 5559 - DNA, 525 bp, Helicobacter canadensis MIT 98-5491, ATCC 700968
atgacaagcatacaattattaaaagttcttgatgaaatcgacaagaatcttagaatctctgttttgagtgctaaacagctaagattattttttcccaatgaaagtaagagcgttttttctgtaggattaaacagacaagtcaaaaatggcttacttgtcaagctttgcaatggactatacttcaacaaaagaagtcgccatattcccccaaattttttggaatatgtcgcaactaaaattagagctaaagagacattttatcttagtttagaaagtgttttgagtgagaatgggctaatttcgcaaattcctaatcgcttaactttcatttcttcttctagaagccaaatattccatactccttatgggattattgaatttgtaaaaacttcaaaaaaagagttttttgatgaaaagaatggaattgtctataatgaaaataggggaatttttgaggcgagtgtagagagagctattaaagatgcctataagcataggagaagtattgatttgctagaagaataa

SEQ ID NO: 5560 - DNA, 537 bp, Marinobacter sp. ELB17
atgcagcctatacagcagctagaacagtggctattacgaacaaagtctggaatcaatgcgtacctgtattcagccgcggcttttcgatctctcttcccagaccttagtgcaggcgcctatcgatcgctacttcgtcgtgctgaaaagcgcggattgcttgagcgcgtgtgtaaaggcatctaccaatatgcgggaaatcctgacagcagcggttcaatcctttttcacgcagctgcgcttttacgtgctcgaaattttaattacatcagccttgaaaccgcgctcagcgaagcggggctgatctctcaagttccgatagcctggattacgattgtaagcactgcgaggtcagccacaattaattgcggtcgctttggaacaatagagtttctgcacaccgaacgtgcaatgtccgagatagcaggcgagctgaattacgacgtcagccggcacttattcctggcctcacccacattggcactggcggacatgcagcgatttaaccggcccaccatcaaccttgttacggaggtttag

SEQ ID NO: 5561 - DNA, 525 bp, Marinomonas MWYL1
atgagaaaaaaagaaaaattactgtccgcactatctcatgctactaaagctggtggaggtgttcatacggctacagagatagcatttatgctaggcgaaaaacatacacctgcttttacaaagtttcttacagattgcgtacgaaaaggtgtgttacgaagagttgcagcgggtatttttgaaagtaccattactcctccagatggatccacggcaatttacaaggttgtaaataagctcagaggagacgtacttaactatatcagcctagagagccaacttagctatacaggcgatatttcgcaaattgttatggacagactcactgtgatgacaaaaggcagaagtggcattttttctacaccttatggcgtcattgagtttacacatacaaaaaaaacgatcgaggcaatcgctcctaatatttatttcgattcagatataaaaatgtatcgggccaaaacaatccaagctcttattgatttaaaaaactgtaatcgaaatctgcacatgctggaggcataa

SEQ ID NO: 5562 - DNA, 546 bp, Pantoea sp. At-9b
atggacagaatgactgctattgaacgctttaacgccttcgataagaaagggcgttatgtcttcactactcgtgatctggccaaaattttccatgaagacagtcctaagacattgaatgcaggactgaatcgtctggttaaggatggcatcctttctcgagccattcgtggtgtatatgtttacgcccatgccagaagtaaagatgcctacacacttgagcgcattgttctggcactgcgccggggagagtataactatctcagcctcgaatcagcgttatcagcgtatggtgtcatctcccaaatccccattggccgcatcacggtgatgacaaccggacgctcagaagaacataaaacccctttcggggtgattgagttcacccatactaaacgttctcctgaacagattttacgggatacttatatgggggactcgccgctgcggcaggcgacgatggcagctgcagcaagggatttgcgccgtgtcgggcgtaacacgcatctgatcgatgaatcggagttgaaccgtgaatcagaaagttaa

SEQ ID NO: 5563 - DNA, 564 bp, Parascardovia denticolens DSM 10105
atgcttggtggtatgcggctgcctgggtgtttgaaggttcttgccgagtgggatggtcggttcgaccggtatgtgtatgcgaagcgggatgtggcgaagctgctgggcgagtcgggtgacgtcttgtccgctaccttgtctcggctggtgaaggccggggttttggtgcgggccgcgcatggcgtgtatgtgtatgcgtattcgcggcatgtggctgaggcgaacacggtccatttgattgccaggagtctgcgtcgggggtgtgtgacgtatgagagtctggagtcggctttgttttcgtatggggtgatcagtcaggttcctgttggtcataccatgtatatgacgacgggcaggagcggcgcgtatgataccccgtatggcagtatcgagttcacgcataccaagcggggtgtgggggatatccttcctggtttgaaatatccgcaggggtgtgctttgcctttggccagccggcggatggctgtggatgatttgaggcatgtgggccgtaacctggatttggtgagggaaatggaggatgcggatgagccggaatcatga

SEQ ID NO: 5564 - DNA, 546 bp, Pectobacterium wasabiae WPP163
atggacagaatcactgctattgaacgtttaaatgctttcgataagcaagggcgttatgtcttcacctcccgcgatttagccaagattttccatgaagatacgcccagagcgtttaatgccgggctaaatcgtttagtaaaagatggcattcttacccgtgcgattcgcggtgtgtacgtctataaccatgccaaaagcaaagatgcctatacgcttgagcgcatcgtgttagcgctacgccgtggtgaatataactatcttagccttgaatccgccttgtctgaatatggcgtgatttctcaaatccctattgaccggatcacggtgatgaccaccggacgttccgaagaacataaaacgccttttggggtgattgaatttacccataccaagcggccaccagagcagattttgcaagatacttattttggcaattccccgttacggcaagcgacgaagaaaaccgccctgagggatttacgccgcgttgggcgcaatacccacctgattgacgaatcggagctacatcatgaatcagaaagttaa

SEQ ID NO: 5565 - DNA, 621 bp, Photorhabdus luminescens
atggtttttttgtatacaaataattgttatgatgagtatctacacacaaaacaccctttaaagggattttacagtagagataacacaatggatatgctcacagcaattaacaaattagatgaattcagcaaaatgggaagagccgttttccttttacaggatttggaagtcatctttgctgacgagacttctcgaacattgcaaaaatctattgatcgcctcatcaaagccggactgttacttcgcattaccaaaggggtttatgtctatacgcgggccagcataggaagctatcccttggagactatcgccaaaaatatccgacgaggcgaatataattacatcagcctggagtcagctttatctcaatatgggttcatctcacaaatcccaatcgaccgcctgacaatcatgtctactggcagagctggagagtttaaaacaccgtggggagtcattgaaatcacccacaccagcagagagcctagcgaaattctgaaggcaacattagaaagccgtggccccctgcgtatcgcaaaaaaagagactgctctgcgtgaccaaaaaagagtggggaggaatatgcatttagttcaactagaggaactcaactatgtctag

SEQ ID NO: 5566 - DNA, 570 bp, Photorhabdus luminescens
gtgaacattaaaactacaaatacataccctatggatagatctactgcacttaaacgttttattgactgggacaaaaaagggcgatacgtcttcacccttgccgatctcagaaaaatctttcccgaagatagccccaaaacacgccaagcgggcttaaatcgtctggttaaagaatcgatgctttcacgacctgtacgcggtgtttatctgtttaattttgctcataatcgcgatagttacgctattgaacatattgccaaagctctacgacgtggtgagtacaattacgttagccttgaatcagcattgagtgaatatggcgttatttcacagatcctgatcgataggctcaccgtgatgacaacaggccggaaaggtctttatcacactccactgggtactattgaattcactcataccaaacgccaacaagaagatatcttagcgagtatcacgcaagcaaaccgccctttgagactcgccaaacttgaatgtgcactacgtgatttaaagcgcgttggtcgcaacacccatttagtgaataaacaggagattacacatggtcaataa

SEQ ID NO: 5567 - DNA, 534 bp, Proteus mirabilis ATCC 29906
atggagttaataagagcaattaatgtttttaacaaattcagtaagcaaggtagaaatatcttcctcaccaaagatttaaaaatgctttttcctgatgagtctccgaaaacattacaaaaatcagttgaccggctgatcgcgcatgatgtgctacgccgagcatcaaaaggtgtatatatctatactcaaggttcattggggccttaccctttagaacgtctggccgaaaatattcgacgaggccactacaactacattagtttggaatccgctctatctcagtacggtgtaatttcacagatccccatcgacagacttacgattatgtccacaggccggtctggagagtttgtaacgccttggggcgttattgaggttacccatactgccaagaagcctcttgaaatactcaatactacggtggaaggaagggggccattaagaattgcaacaaaggagactgccattaaggatctaatgaaggttggcagaaatacacacctcatccaacgtgaggaattaaactatgtctga

SEQ ID NO: 5568 - DNA, 534 bp, Proteus mirabilis; identical to SEQ ID NO: 5567

SEQ ID NO: 5569 - DNA, 537 bp, Proteus mirabilis
gtgaaaaagattgaggcaattaaaaagctcttagaatatgacaagcgcggtcgctgcgtttttactaattcagatctggccaacatctttcatcaagataatgaacgagcattgcgtgcaggaattaaacgtttgcaagacgatggcttactcactaggatcattaatggtgtgtacttatacaatttagcgcagtcaaaaggcagcgatacgttggagcaaattgctaaaactattcgacgtggggaatataactacattagcttggagtctgccctttctgattttggtgttatttcgcaaattccagtagatcgcttaactgttatgacaacgggacgttccggtgaattcaaaacgcctttgggtacaattgaatttacacatacaaaacgagctccaatcgacattatagagaataccactttagtcggcagaccacttagattagcaacaaaacaaactgcatacagagacttaaaacgagtcggccgaaatacacatttagtaagcaaggaggaactatatgaaaattga

SEQ ID NO: 5570 - DNA, 525 bp, Shewanella denitrificans OS217
atggcaaaatcagatgagctattaaacgtattagcaaaagcggttaaagcgggcggcggcattcacagtgcaactgagctggcttttatgcttggtgtgccttgtgacccagcctttagaaagttcctaacagattgcgtaaagaaaagacgactaagacgagtgattaaaggtttctatgaaagcgttattacacctcctgagcctgagactgccatttataaaattatcaaaaagctgcgaagtggcgtattgaactacatcagcctcgaaagccagctcagtcatacaggcgatatttcacaaatcgtgatgggcagagttactgtggtgactaaaggtcgaagtggttgttttgatacgccctatggcgtgatcgaatttacccatactaaaaagccaatcgagcaagttgctcccaatttgtactatgaccccgatatcaaaatgtaccgagcgtacaaagaacaagcgattgctgacctaaaacactgtcagcgcaatctacatatgttggagagctaa

SEQ ID NO: 5571 - DNA, 555 bp, Verminephrobacter eiseniae EF01-2
atgaagaaaatcgacctcatccatcggctcgcagccctcgacaaaaggggcgtctacatcttgtcgaaggcggatatcgggaagatgttccccggcgagggcgccaaggccatggagaagtctttgcagcggatggtcgccgaccggctgctgatccgcgccgcccgcgggatctacgtgaaccctgccgccgcaagccgcaacagccggatcatcgaagacttggccaaggcgctgcggccaggtgccctgtcctacctgagcctggaggctatcctgtccgaatatggggtgatctcgcaaatccccatggaccggatcacggtgatgaccacgggggccagcggcacccacgagacgccgtttggcaccatcgagttcacccacaccaagcgctcggtcgccgacatcctcgcgcacacgcaacgcatcgagggccgcccgcttcgaatcgcccacaagatggcggccgtgcgggacctcttgcgcgtcggccgcaacgtcaacatgatcgaccgcgaagcgctcgaagaagacgcggtggaggtcgcatga

SEQ ID NO: 5572 - DNA, 534 bp, Xenorhabdus nematophila ATCC 19061 uid49133
atggataaaatcactgcaattaaaacattagacaaattcagcaagatgggaaaaaacattttcctcttgcaggatttggaaatcatctttgctgatgaagcgccacgaacattgaaaaaatccattgatcgccttatcaaggccgggttattggttcgcatcaccaaagggatctatgcaaatgcactcgcgagcctcggatcttatccgctggagagtatcgcaatcaatatccgacgcggcgaatacagctacatcagcctggagtcagcgttgtcccaatatgggattatctcccaaatccctatcgacagactcacgatcatgtctaccggcaggtcaggggaatttgaaacaccgtggggtgttattgagatcacgcacacaaacaaaaaaccgagtgaaatcctgaaaggaacgctggaaagccgtgggccaatgcgtatcgcaagaaaggaaattgctcttcgtgatttaaggcgagtgggcagaaacacgcacctgattcaaagggaggaattagagtatgcctga

SEQ ID NO: 5573 - DNA, 534 bp, Bifidobacterium longum longum CCUG 52486
atgaaccgcctgagggatatggacacgggtttcggcgtgcacgtgtatcgcaagccggatctggcgctggttctcggggaaacgggacaaaggctcgaccgcaccttgtcgagcctggtagcggcgaacgtgctggtccgcgccgcgcgcggcgtgtacgcgttcgcctggtcggcgcatctcggggaggcgacgctgcataccgtcgcacgccggctgcgcccccgacagctggtgtgggagagcctggagagcgcgctgagccgttggggcgtgatcagccagatcccggtggatcgcgtcacgttcatgaccaccggccgtgagggcttggccgtgaccccatatgggacgatcgagttcacgcactgcgcgctcgactggtcgaggatactccccaacctcgtgccgcgtgacggtgggatgacgccgctcgcgtcgaaacgttgggcgtatcgggacctgaaggccacaggccgtaacctggatctcgtggacatggatgaattggagaacgacgatggatgggagtga

SEQ ID NO: 5574 - DNA, 552 bp, Bifidobacterium longum longum CCUG 52486; identical to SEQ ID NO: 5548

SEQ ID NO: 5575 - DNA, 525 bp, Helicobacter canadensis MIT 98-5491, ATCC 700968
atggcaaaaatagataaattattaagcgccttggctagcgcggtaaaagctggtggtggcattcatagtgcggcagagcttgcatttatgttaggtgaaccttgcaatccaacgtttagaaaatttctgacagatagtgtgaaaaaaggtcaacttagaagagtcgtaaaagggttatatgaaagtgtacttacaccaccagaacctgaaactgcgatttataaaattattaaaaaactacgtagcaatgtattaaattatattagcctagaaagtcagctaagttatacgggaaacatttcacaagtgattatgggtcgagtcaccgttattactaaaggccgcagtggtcgctttgatacaccctatggcgtgattgaatttatccatacaaaaaagccaattgagcagattgctccaaatttgtactatgactctgacataaaaatgtatcgagcaaatacagcacaagccattattgaccttaaacactgtcagcgaaatatacatatgctggatttgtaa

SEQ ID NO: 5576 - DNA, 211 bp, Providencia rustigianii DSM 4541
tcgcttaactttcatttcttcttctagaagccaaatattccatactccttatgggattattgaatttgtaaaaacttcaaaaaaagagttttttgatgaaaagaatggaattgtctataatgaaaataggggaatttttgaggcgagtgtagagagagctattaaagatgcctataagcataggagaagtattgatttgctagaagaataa

SEQ ID NO: 5577 - DNA, 744 bp, Acidovorax delafieldii 2AN
atggtggctccggttcgcaacgccatggaagaagccacggcggccatgcgcaggaccggcgagctgcgaggtcacagccctccccgctcgattgaaaatcgcatcacttgtacaaaagtaatgcgaatactaaactcacccctcatgaaccagtccgaccacatcctcgaactggcccggcaccggcgcgtgctgcgggctgcggatgtgcgcgagcatggctggtcaccgcagcttctgatccggctgcaccaggctggcaagctgcaacggttcgcccgtggcctgtacggactgcctgacgctgaagtcaccgagcaccagacgctgatcgaggtctgccagcgtgtgcccaaggccgtgctgtgtctgctgagcgcgcttcaattccatgagatcggcacgcaactgccgcacgaagtgtggatcgcgctgcccgaggcgacacagaccccggcgctaagctaccccacactgcgcatcacacgcctgcgcggtgccgcgtacaacgaaggcatccagaccgtgaccgaccacggcgcacccatccgtgtgtacagcgctgccaagacggtgaccgactgcttcaagttccgcaacaagatcggcctggatgtggcgctggaggcactgaaagatgcttggcgcagccgcaaggtcaccatgccagagctgagccacttcgccaagaccaaccgcgtcgaacgtgtcatgcagccctacctggaggcagtgacgcaatga

SEQ ID NO: 5578 - DNA, 624 bp, Acidovorax sp. JS42
atgcggatattaaactaccccctcatgaaccagtctgaccacatcctcgaactggcccggcaccggcgcgtgctgcgggcagcggatgtgcgcgagcatggctggtcaccgcagctgctgatccggctacaccaggccggaaagctgcaacggctgggccgtggcctgtatggactgcccgatgctgaagtcaccgagcaccagacgctgatcgaggtctgccagcgcgtgcccaaggcagtgctgtgcctgctgagtgcgctgcaatttcatgagatcggcacgcaactgccgcatgaagtgtggattgcgctgcccgaagcgacacagaccccggcgctgagctaccccacgctgcgcatcacgcgcctgcgcggcaccgcctacagcaacggtatccagaccgtgaccgaacacggtgcccccatccgcgtgtacagcgccgccaagaccgtggccgactgcttcaagttccgcaacaagattggcctggacgtggcgctggaggcgctgaaagatgcatggcgcagccgcaaggtcaccatagccgaactgagccacttcgccaagatcaaccgggtcgaccgtgtcatgcagccctatctggaggcggtgacgcaatga

SEQ ID NO: 5579 - DNA, 561 bp, Agreia sp. PHSC20C1
atgcgagcgttctcgcaatctgaggcgagccgcgcgggagtcgactcgcgccagctttacaggctgctggaaagacagcagattgaacgcatcagtcgtggactgtatcggcgcgccgatctctcgattgtcgacttggatctgattgagattgccgcgcggcgtccggatgccacgatctgtttggagtcggcgctcgcgcgtcatgagttgatcgatgcgattccgactcggactgacattgctattcctcgaggcaagaaacccgcgaagacgcaggctgcggtcgactggcacttgttcgatcgggccacgttccacatcggccgcacgctgctcgagacgggggatgcgggtcagagcattggactctattcgcctgaacggtcgattgtcgacgcgttcaggttgcgtgggacggcagggtacgagacgggtatcgaagcactgcgcaactggctgaagcgcccggcgtcgcagccggcgaagctgttcgagattgcccagtccttgccgcgggcgatcggcccgctgcgcactgcgctggagatcctgacatga

SEQ ID NO: 5580 - DNA, 621 bp, Asticcacaulis excentricus CB 48
gtggagccccctgcccttacacagcagcaacgcctgaatgctatcgtcaaggcccgtccgcttgtgcgcgctcacgagctaagggcccaaggcatcacggctgcaactatctcacgcgcggaggcaagtggtctgataaggcgggtttcgcgcggcctgtaccaaagtctggacagcgatatagataccaaccagccccttgccgaaatttccaagcaaattcccaatggcattatctgtatgacatccgcactggcgtaccatggccttacagaccagatgccacgcagaatatgggtcgccattgctaaggacacatgggcaccgaccgtaagttaccccccgatgcgcctggtccgctttaaagccgcctcaatcagagatggcatagaataccatcttatttcaggtgttgaagttccaatctactccgttgccagaacactggctgacgtatttcgcaacccccgtctggttgatcgctccgtcgcgatagaaagtctgaaatctgccctgagccaacgtaaggcaaccccatcggaaatttacgaggctgccaggcatggtggcacgagcaagacgatagcgccctatctggaagcactgacatccaatggataa

SEQ ID NO: 5581 - DNA, 672 bp, Bradyrhizobium japonicum
gtgataaaacatctgctatatctttccagatcagaggaaacgtcacactccatgccgtccaccagcgcccagcgacttcgcgcgctcgacctcctgaagacccgaggaatgctccggctgaaggatttcatcgccgaaggcatcggcccggagacgcttgcccgtcttgttcgggaggaggcagtcgtccgcccagcacgtgggctctatcaactccccgacgcccacctcgaggctgcccataccctcgccgaggcagcagttctggttccaaagggtgtggtctgtcttacctcggccctccaataccacgaactgacgctgcagatgccgtcggctgtatggatggcgatcgatcgctccgcctggcgacccaagatcgattatccacctatccggttcgtgcgattcaccggatcggcgcttaccgaagggatcgagcgtcaccgcattgagaatgtcgacgttcctatcacggatccggcgaggacaattgtcgattgctttcgctaccgaaccaagatcggccttgacgtcgcgatggaggggctgcgcgaaggcctccgccgtcgccgatgcaagccggatcaactctggcattacgctcgcaaggcgcgggtctggtcggtcatgcgtccctacgtcgaagcaatggtgtccgatggcgcgtga

SEQ ID NO: 5582 - DNA, 588 bp, Brevibacterium mcbrellneri ATCC 49030
gtgatcgacgtgacgactattaacctgacaccagtgttcacactcgaacaggcccgcgcggcgggcctgcgcaaggatgagatctacgacctgctcgcggctgaggagatcgagcgtgtgggacgtggcgtgtatctttaccccggcatgcttgatgagcgctttgtttctctcgccgccgcgaccgccctgcgatcggaggcgacgatgtgcctgaccagcgcgctcgcgaaccatgacctcaccgacgtgatcccgttcgacaccgacatagccttaccgcgcggaaccaggcacccggccgggttcgaccacgtgacatggcacagcttcgccaccgacaccttcaccctcggacgtgaaacacaccgtgttgctccgggtgtgacgttggcgatctattcgcccgagcggaccatcatcgattgcttccgactcatgcatcacctcggtggtgagattgcctacgaggcgctccggcgatggctgcgtcgcaccgggtcaacgccggggaggttgctgcgcatggccgatgccttccccaaggcgaagccgcggctgcgcctggcgttggaggtgctgctgtga

SEQ ID NO: 5583 - DNA, 609 bp, Candidatus Accumulibacter phosphatis clade IIA UW 1
atgcccgacatggacaccactgccgagaggctgatcgaactggctcgatcccgaggactgattcgcccctgtgatctggcaccgtttggaattccccgggtctccctgacccgtgccgtccgcagcggcctgctggagcggatcgggcgtgggctctacggcctgcccggacgcgaggtttcggcccacggtttgctggcggaagtggcgcgcagggtgcccaagggtgttgtttgtctgctctcggcactgcgttttcatggtctgacgacgcaggccccgttcgaggtgtggctggcgatcgagaacaaggccctcgcgccgaaactcgactatccgccactgcgcatcgtccgtttctccggcaaggcattcaccgagggcgtggaggaacacgtcgtggatagcgtgaccatccgtatcaccggcgttgccaagaccgtcgccgactgcttcaagtatcggaacaagatcggtctcgacgtcgccctggaggcgctacgcgaggcttggcacgagaggcgcatgagcagtgacgacatctggcgatacgccaaggtctgccgtgtggccaacgtaatgcgtccttacctggacagtctgacgtga

SEQ ID NO: 5584 - DNA, 594 bp, Parachlamydia sp UWE25
atgagaaattcaaaatacgctgaacagttaaagtcttttcagtacattcccttcttcacagtcgaacaagctgctgatcggaatgtgccaagacatgctatcgcctatttagtcaaaaaaggcattcttgaaaggatttaccctggaacgtatcgctttactgagtatgaacctaaagttgacttccaatgggaaaacttagggttaatagcagcaagtattcccaaaggggtaatctgtttgatctctgctctttgctattacgaattaacagatcaagtaatgagagaaatttggatagctattcctcatgaatcttatgctcctaaaagaccgaatacaaaagtcattagaatgcgtaatactaatcttggaaaaactgaaattgttttaggggaatataaggtgaaaatttttgatcaagaacgttgcatcatcgatgcctttcgctatcttagcaaagaaattgctatcaaagctcttcaaagatatctcaaaaatactgccaataaggcagatctgaaaaaattaggcgcttacgcaaaaaaattacgggtggatatcactccttacatcttatcttgtacgacatga

SEQ ID NO: 5585 - DNA, 612 bp, Chlorobium limicola DSM 245
atgtcacaacaaaggacagctgcagacagggccaaagcccttattcttgccaggggagggctcatccgcacccgggaagcgatcagccttggtattcatccccgaacgctgtacagtcttcgtgacagcggtgagcttgaagagctttcacgagggttttaccagctcaaaagggaaaagcagctcgaatatcctgatcttgttaccgtttccctgagggttccgaatggagtgctttgtctggtctcggcactgtcctttcacgaaatgaccacccaggttccacacagcgtatctcttgcgcttgaaaagggtgccgaacaaccaagaatcgagcatcctccggttacggtataccggttttccccctcttgtttcaagctcggcattgaaacacatcagctcgatggtgtcccggtgaatatctacagcccggaaaagacgcttgtcgactgcttcaaattccgtaacaggatcgggatggatattgtgctcgaagcgcttaaactctatcggcagcgactgcataagaaccttcatgcactgatgcagtatgcagaggtgtgccgtgtagcctcggtcatgaaaccctatctggaggccacactgtga

SEQ ID NO: 5586 - DNA, 615 bp, Chlorobium phaeobacteroides DSM 266
atgttacaacaaagtacagttgcagcagataaggccaaagctcttattcttgcccgggggggcctcattcgtacccgggaagcgatcagtcttggtattcatccccggacgctttacagtcttcgtgacagcggtgagcttgaagagctttctcgagggatttaccagcttagagggtgtaagcagctcgaatatcctgatcttgtcaccgttgcactcagggttccgaatggtgtactttgcctggtttcggcactctcctttcacgagatgaccacccaggttccacacagcgtatctcttgcgcttgaaaaaggtgccgaacaaccaagaatcgagtatcctccggttacggttttccggttttcatcctcttgtttcaagatcggtattgaaacgcatcagctcgatggtgtttcggtgaagatctacagtccggaaaagacgcttgtagactgtttcaaattccgtaacaggatcgggatggatatcgtgctcgaagcgctcaaactgtatcggcagagaatgcaaaagaatctgcatgcactcatgcagtatgcagaggtgtgccgtgttgcctcggtcatgaaaccatatctggaggcaacactgtga

SEQ ID NO: 5587 - DNA, 600 bp, Prosthecochloris vibrioformis DSM 265
atgaaaactacaaaagacaaaatactggatgttgctgggaagcagtcggtgttccgggccggagatattcctggtgtccggaaaccacagactcaactgtgtcgtatggttgccgacggcgagcttatccgtgttggacgcgggctgtattcactcccggacgcagaggttggcgagaaccattcgctcgttgaagcggtgaaactatgccatggaggagtgatatgcctgatttcagcactctattttcatcggattggcacccggcttccttatgaaacatggattatgcgtcagaatcgaaatgtggcaccgctcaaaggttcaccggttcgttttgtctattgtacgggtgaagcgttttcttttggcgtagaaaaacacatgattgaagggactgaagtcagtatttacagtccggcaaaaacggttgccgactgctttaaataccgtaataaaatcggactggatgttgcccttgaagccctgcgggagggttggatggcaaagcttttcaccatgaatgagctctatgctgcggtgaaagtttgtcgtgtgcagaaaattatccagccctatatggagatgctggttcaatga

SEQ ID NO: 5588 - DNA, 615 bp, Conexibacter woesei DSM 14684 uid43467
atgcgcgtaccgtcgcactccaatctcgagtttctgcgggagcgctttgacggccggccattccgcgtgtcggacgccgttgccgcaggcgtgagccgcacgacgttgcaccggctgcgcgcgacgggtgagctggctaccgtcggccgaggggtggtgcagttgcccgatggcgggatgggcctgctgtcggagctggcggtcgtgtcggcgcgagcgccgcgcgggacgatctgcctgaactcggcgctagcgttctgggacctgtccgacgagatccccgagcaggtgcatgtcgcggtgccgcgagggatgcatcggccatcgatcgaccagcctgctactcgtgtgcacgtcttcgacgctcgcacgttcgcgatcgagcgccagcaggcgcacaccgacgccgacgagccgttctggatctactcgcccgagcgctcagtgatcgacgcgatgcgcatggcacgctgggtcggacgcgacaccgcgctgcacgcgctgcgccgctacatcgcgcagcccaggtccgacgctgcccgccttgctgagctggcgcgcgaactcggcggcagcgcccaactgcgaccggcgttggaggcgctgctcagttga

SEQ ID NO: 5589 - DNA, 975 bp, Corynebacterium glutamicum R
atgaggattgaagaaatcgcaacccttgctagtgaccaaaacggactgttcactaccgctcaggcagctcgcctagaagtcgaccgagtgacccttcaccgagcagctcgcaacggcgtggtgcgcagcatccgccacggagtgtatatcttcgagtccgccccgttctcccctgatgaagaacttcgcgcggcctggctctcactcgacccctcacgaacagttgcagaaagactgcagacccctgagcaaatcgtcatatgcaccacctcggctgcccaacaatatggaatcggcgactttgacactccacaacacgagttttacagcgcacaacggaaacaaacccgagcagacgacatccgactccggatccgcacactcgacaacgaagacatagaaattagagacggcctaccactgaccacaccaacacgtatcatcctcgacctgctagaagagcgtcatgacctggtacatatcagccgtctcattgccgatgccgcccgcaaaggactaaaagtggagtggtccagactagctacgcatgctcataagttcgctggagactaccagctcactgatgacggtctcctccaggcactcgccgagtcctccgaatcgacctccgatacagctatggcagcactgtccatgctcgaaagcagttcgcaccttaatgatctgttcaacaaagatctggcaaacctcgtcggaggcttcagcaaacacctgactattcagatgcctgagattcctgatcttgctgcacagctaagtagggtacagctgcctgatattgctgatcagatccctgatcttggcttcctgccgaatgttcactcccagattcatgactacctacaccacgacaacgccgtcaatttcacaaaagattcacacacatccacaaataaaaaagaaatgagaaacacgtccaatgagcaagaaaagccaagaaccacgcaactatag

SEQ ID NO: 5590 - DNA, 615 bp, Delftia acidovorans SPH-1
atgcccgctcctggctccgcgctcgaacaagccgttctggcactggccgaacaacggccgctgctgcgcgcacgcgaccttgccgcgcttggcctgccgaccatggcgctgagccggctggtcgcggcaggccgccttgaacgcgttgcacgcggcctgtacagcctgccgggccggccgctcagcgagcaccgctcgctggcggaagtggccctgcgcgtaccgcaaggggtggtctgcctgctgtccgcgctgcgggtccacggcataggaacgcaggcacccttcgaggtgtggatggccattccccatcactcgcccacgccccgcatagaccagcctgcattgcgcgccatccgcatgtccggtgcggcactgtccgaaggcgtggaaactctgcagatcgatggcgtcggtgtcgccgtcttcaacgcatcgaagaccgtggccgattgcttcaagtaccgcaacaagatcggcctggatgtggcgttggaagcactgcgcgacggatgggcgcagggcaagctgacggccgacgcgctctggcactacgccgccatcgaccgcgtcagcaatgtgatgcgcccctatctcgaaagcatcgccgcatga

SEQ ID NO: 5591 - DNA, 594 bp, Candidatus Desulfococcus oleovorans Hxd3
atgaaagaatctccaataacaatattccggaagcatggtgggcaacttcgaatgagtgaggcgctctctcacggtgttacacggtatatgctctattcgctaagagacaagggaatcatagagcaagtgaccagaggggtctatcggctgacggagctgcctccgctctccaacccggaccttgttacagtaagccttcggttccctaatgccgttatctgtcttatttcagcactgtattatcataatatcacgacccagattccgcattttgtttcagtggcggtgccaagaaactcgcgaataccgtcactcgactatcctcctgttcaggcccatcgattcaatgatgaagcttaccgctccggcatcgaaaatcgtaccattgatggcgcatcagtaaaaatctatgctcccgagaaaaccctggccgattgttttaaattccggaacaaaattggaatggatgttgttcttgaagcgctcaaactatatagaaccaggcaacaattcaacctcgaaaagctgcttatgtacgcagaggtgtgtcgagtaaaaaagattatggcgccttatctggaggcaatgctttga

SEQ ID NO: 5592 - DNA, 594 bp, Desulfomicrobium baculatum DSM 4028
atgaagcagacccctgaagacgtattccgagccaacggcggccaactgcgcatgagcgaagccatcgcgcacggcatctcccgctacatgctctactctctcagggacaggggtgtgatcgagcagctcagccgcggggtgtaccgccttgtagaactgccccccatcggcaaccccgatctggtgactgtcgcactgcgcgtcccgaacgcggtcatctgcctgatttccgccctcgccttccacgagatgaccacacagattccgcacggagtctccgtggccattccacttcaggcaagacggccggagctggaccatcctccgctgttcgtacaccggttttctggtgcgtcgtacacggctggcgtcgaggagcagcggatcgacggggtaccagtcaacatctactcccctgaaaaaaccatcgccgactgcttcaaatttcgaaacaagatcggcatggacgtggtgctggaggcgctcaaactctacaaaacccggaaacccttcaagctcgcagccctgctcgactatgcgaaaatctgtcgggttcagaacgtgatgcgaccgtacctggaggcaaccctgtga

SEQ ID NO: 5593 - DNA, 627 bp, Eggerthella lenta DSM 2243
atgaacaagaaccgccacacctctgcgatagaagagctctcggcttcggaaggcgttttcaccacagcgcaggccgagcgtctcggcatcccccgcaatgcgatcgccaaagcatgcgaggcggggaggctcgtgcgcgtcgcccatggggcgtatcggatggccggggtgccggcatcgcagctcgacgacctggcggccctctggaagctcaccgatcccgcgaagatgacgcacgagcggatgcaggctggcgaatgggacggcgtcaccgttgcgggaagcacggccgcatcgattctcggcatcggggacttctacctctccccctaccgtatcctcgccccgaggcgcatcaactcccgcaacgccgaggcaaggttcggcatacgcggcgtaccccgtgacgacgtgtccttcatcgaaggcatacccgtgacgggagccgagcgaaccctcgtagaccttgtcctggacggcgaggagccgtcgcttgtgcaagacgcgtttgccgacgctcgggcgaaggggctcgatacggaaaagctcgagcgtcttgcggcggaagcgaaggcctccgccagggagagaaagacgatggagcggctcttcggaggggaggcatga

SEQ ID NO: 5594 - DNA, 627 bp, Eggerthella sp. 1 3 56FAA; identical to SEQ ID NO: 5593

SEQ ID NO: 5595 - DNA, 326 bp, Sinorhizobium medicae WSM419
atggcgcttgatcgcgccgcttggcgaccaaaattcgattatccacctatccgattcgtgcgcttcaccggagcggcgctgactgaaggagtcgaacatcaccgcatcgagaatatcgacgttcccattacggatccggcgaggaaattgtcgattgctttcgctaccggaccaagatcggcctcgacgtcgcgatggaggggctgcgcgaaggcctccgccgtcgccgttgcaagccggatcaactgtggcattacgcccacaaggcgcgggtctggtcggtcatgcgtccctacgtcgaagcgatggtgtccgatgccgcgtga

SEQ ID NO: 5596 - DNA, 618 bp, Sinorhizobium medicae WSM419
atgtctggctccgtcactcaacgtcaaatcgcccggaccgtgctcatcgagcgcggaatagcacgcctggcggagcttcggaacgctggtgtgacggcggcaaccatgagccggatggaacgggatggcgaggtgctgcgacttgcccgtggcctctaccaacttcccgacgccgagctcgataccaaccatagtctggcagagaccgccaagcgtgttccgaaagccgttgtctgtcttgtttcagctctcgcattccacggcctgaccgatcagctgccgagacacgtgtggcttgccataggccgcaaagactgggcgccgaaactagatggcacacctattcgtatcgtgcgctttacggacagcctgcttaacgatggtgtcgaaatccatgtggtcgaaggcgttcctgtaaaggtctttggagtcgccaaaacaattgccgattgcttccgccatcgcagcaagatcggtctttctgtggcgatcgagggacttcaggaagcactgcggcagcgcaaggctacgcccagcgacatcgtcaaccaggccgaacgtggtggtgtcggcaccgtgatccgcccctatctcgaggcattgaccgtcaatggctaa

SEQ ID NO: 5597 - DNA, 326 bp, Sinorhizobium medicae WSM419; identical to SEQ ID NO: 5595

SEQ ID NO: 5598 - DNA, 615 bp, Gemmata obscuriglobus UQM 2246
atgccccgttcagccaggcagtctgcccaaactcttgccgcactggcccacgaacagggcgggtatttcaccacaaagcaagcaaaggaagctggttacggctacaaccacctcgattaccacgagacggcgggcaacttcgaacgggtcgaccacggcctctaccgcatcccagcggtgcctcgtgacgagcacgacgagcttattcgcctttcgctctggagccgaaaccaaaaggacgagccccaggccgttgtgtcgcacgactctgccctcgtgctccacgagatgacggacctgcttcccgaccgcatccacctcaccgtgccgcgaacgttccgcaagcccacaccaaccggctgcgtgcttcacaaagcggtaatcgcggaaggtgacgttgaagaacgcacgggttttcgggtcacgagtccgtttcgcacgctgctcgactcggcgcaatcggaggtgagtcaagaggagctcgaaaaggcggtcgcgaacgcgctcacacgcgggctcgtccggcgcacgaagctgtctcaagcggtggaacagaatccacggctgtcacgcctgaaagcggcgctgggccgaattaaggcaaacacaaaataa

SEQ ID NO: 5599 - DNA, 609 bp, Gloeobacter violaceus
atggctactgactctgtttcagcgtcccgtgaatgcctgcagaaccgggctattttcaggttcaaggatctcaatggttccggcctccatcgatctagtctgcggcgtctggaggaagcaggacagatcgagcagattgcccgcggcatttacaggaacaccagggcagacatcaccacccaccacagcctggcagtcgcttctacgctagttcaccgcgggatcgtctgcctgctgtcggctctgcgctttcacgaactgaccacccaggcgccctttgaagtctggatggccattgaccacaaagcctatcgtcccgccgacctggcgatccctctgcgggttgtttggttttccggcgaggcattcacctccggtgttgaagagtatgtggtggaaggagtgccggtgcgggtgtactgtctggccaagaccgtgaccgattgcttcaagtaccgcaataagatcggcctggatgtggctctcgaagcccttcgtgaatgccgccgtgaggggcgttgctcgatggatgagctgtggcattacgcccgtatctgccgggtggcaaacgtcatgcgcccctacctggaggcgctggcggaaacatga

SEQ ID NO: 5600 - DNA, 675 bp, Gordonia bronchialis DSM 43247
atgaggactggcgatggtggatggtccgcggtccgtgagctggcggatcgtcagttcggcctgttcaccaccgctcaggcccgcgaacggggtgtagcagcctatgagctggcccggatggcccaccgcgatctcatcatgcgcgtgcaccacggcgtctacgaagtgccggaatcggacgcctggatgaccttcggcgattgggccgcccaatggctggccttgcaccctgcggccgacatcgagtcccgccgagctgacccggactgcgtcatcagccatgcggccgccgcgcagatgttgcgcctgggcacgatcacagcctccggcctcgagctgagtggaccgcaccggatcaacgtccgagaccacacagtccggacctggcgccggccgatcggtgagcgcggccgcgactgggacctggtcgacggactgcccgtaacgacaccccgacgcacgatcaccgatctgctgatgtcctacggcgatggcggccacctcggtacagcgctgcacacatgcctgaccgaagaactgctcgacgtcgccgaactcaccgcgctgtgtgaacgcgcggctccgcgctgggatcacaccagcggcgaggacctggtgtcgtcactgctgcagcaggcgcaaatgccgaccaccgccggcgcgaccgctcgctga

SEQ ID NO: 5601 - DNA, 600 bp, Gordonibacter pamelaeae 7-10-1-bT, DSM 19378
atgaatgagctttccgcatcggagggcgttttcaccacggcgcaagccatgcgtctcggcattccgcgcaacgtgctcgccaaggctcgcgaagcagggaagctcgtgcgcatcgcccatggtgcgtaccggatggcggggactccggcgtcgcagctcgacgagctgaccgccgcatggaagctcaccgaccccgcgaagatgacgcacgagcgggtgcccgtcgatgcctgggacggcattgccgtcgcagggaacacggccgcctcgatcctcggcatcggggatttctacctctcgccttaccgcatcctcgccccgaggcgcatcaactcgcgcaacgtcgagacgaggttcggcgtgcgcgacatctcccgcaacgaggtgtcgtttgcaagcggcatccccgtgacaagcatcgagcgcaccttggttgacctcgtgctggacggcgaagacccgtcgcttgtggaggacgcgctctccgatgcccgggaaaagggcttagacgaagaaaggctcatacgccttgcggcagatgccggtgcctcggctcaagcgaaaaggaagatggcaaggatcttcggggaggaagcatga

SEQ ID NO: 5602 - DNA, 558 bp, Intrasporangium calvum 7KIP, DSM 43043
atgcctgccgcgacactgcttcgcgccggtgagcgcgccacctcccgcagcacgttctatcggcgtgcaaatgccggcgcctacgagaggattgcacgcggcctctacctgccctcagacgctgacgcggctgactgggactggcttgaggcggccgccaagcatccgaaggcgaccatctgcttgacctcggcgctggcctactacgacctgactgacgacattccccaggcacttgacatcgccattccgaggggcagtcgaactccggcgactgagggggcgatcgcttggcaccacttcgctgctgactccttcggcctgggccggacgacaatagccatccccggctcgaacatgcacattggcatctacagcccggagcggtctatcgccgacgcgttccggctacggggttcgttggggtacgagttggggcgtgacgcgctgcgcaggtggctggggcagggggggaaacctgctgacctgttggagatcgcgtcgaagctgccgcggactcgggggccgctgctgcggacgctggaggtgatggcctga

SEQ ID NO: 5603 - DNA, 597 bp, Legionella longbeachae NSW150 uid46099
atgacaaacaaaaatcctgaggaaattttccgtcaatatggcggacagctaagaatgagcgaggctataaagcatggcatcactcgttatatgctctattctcttaaagataagggaattattgagcaaattagtagaggagtatatcgactcactagtctccctccacttagcaatcaagatctggtaacagttagtcttcgtattcctaatgcagttatttgtctgatttctgcactgtcatatcatggtctaacaacccaaatacctcattctgtatctatagccataccaagagagactcacacgccctcactcgtttatccaccaattcaagtccatcgtttttcagggcaagcatatctggctggtatagaagagcatcttatagatgaggtcaatataaaaatttattctactgaaaaaacaatcgctgattgttttaaatataggaataaaatcggtatggatatagtgctggaagcaataaaattttatcgagctagaaaacaatttaatatgaatgaaattctcaaatacgctagaatttgcagagttgataagggcataaccccctacctggaagcaatcatatga

SEQ ID NO: 5604 - DNA, 609 bp, Legionella longbeachae NSW150 uid46099
atgaagaaagaagacaactacaaacaaaaagtactccagatggctagcaaaacgggcgttattcgaatgtccgatctgaccaagaaggggattactagagcgaccttttcaaggcttgttagagaaaaaaagcttgaaaaactcgctcctgggctttattgcttgccccaagctgagctttcagaaaaagaaagcctggtaattatagcaagccgagttccgcaagcggtgttttgtctgctaactgctttgcaaatccatgatctaacaacacagctacctcgaaaagtatggatagctatgcccaaaggcagtcatgcgccaaaaatggattatccgccgctaaaaatggtgcaatattcagatgaagcctttagcgaaggaattgaaattatagaatcagataatattaaactaagggtgtataaccgtgccaagacaattgcagattgtttcaaacatcgcaataaaattggacttgatgtggccattgaagcgctcaaagaggcttatacaaaaaataaagtcacagttgatgaactatggcattatgcgaaaatttgtcgcgttgcaaacgtaatgcgtccttatattgaggcaattcaatga

SEQ ID NO: 5605 - DNA, 594 bp, Lentisphaera araneosa HTCC2155
atgaaccaagatcaggcactagaatttctccgatcaaacaatggaattcatagaacccgtgacattcttaatgctgggattgcacctaaaactctttacagactaagagaccaaggtcacatctactccctttctcgaggcctctatcgaattaatgaagaaagtatgggtgctcactctacttacgtagaactggctcataagatccctaaagcggttttctgtctcatatcagctcttcactttcatgaaataggtactcaactaccttacgaccattggatatcactgcctcaaggagtcaaagaagccaagcttgaggaatatgacattcagtatattcaccccagtaaaaaactttatcagttggaaattgaagaacacaatatttcaggtgctactatcaaagtttacagccctactaaaacagtggttgactgtttcaaacatcgaaataaagtcggtatcgatgttgccttggaagctctaagagaagctatacaactgaaaaaaacatctcgtaaagagcttattgaacttgccactaaatgccgtatgaaaaacgtaatgatgccatatatcgagtccatataa

SEQ ID NO: 5606 - DNA, 594 bp, Lentisphaera araneosa HTCC2155
atgaagcaagaacaagcactagaatttctccgatcaaacaatggagttcatagaacacgtgatatccttaatgctgggattgcacctaaaactctttatagactaagggaccgaggtcaggtttactccctttctcgtggcctctatcggattaatgaagaaggcatggatgctcactctacttacgtagaacttgctcataagatccctaaagcggttttctgcctcatatcagctcttcactttcatgaaataggtactcaactaccttacgaccattggatatcactacctcaaggagtcaaagaagctaaacttgatgaatacgatatccagtatattcacccaaataaagaactttatcaattgggaattgaagagcacgatatttcaggtgctactatcaaagtttacagccctactaaaacagtggtagactgtttcaaacatcgaaataaagtcggtatcgatgttgccttggaagccctaagagaagctatacaactgaaaaaaacatcacgtaaagaacttattgaacttgccactaaatgtcgtatgagaaatataatgatgccctatatcgagtcgctgtaa

SEQ ID NO: 5607 - DNA, 453 bp, Mariprofundus ferrooxydans PV-1
atggcggccaatgcagagctttcagagaaacagactgtcgtagaggtctgcaagcggattcccaagggtacggtatgtttgctttctgcactggccatgcatgagctgacgacacaggcaccctttgaagtctggctggcgattgatcggaaagattggctgccacaggtaaaagatcttccgatccggatcgtacggttctcaggagacgcccttaagagcggcatcgaacatcgcgtgatcgatggagtttccattcctgtttataatcctgcaaagacggttgccgactgtttcaaatacagaaacaagatcggcctggatgtggccatcgaggctctgaaggatggctggaaggcaaggaaattcacaatggacgaaattcagaagtatgctgtcatttgccgcgttcagaatgtcatgcggccataccttgagacgctcatcgcatga

SEQ ID NO: 5608 - DNA, 666 bp, Methylobacterium extorquens AM1
gtgccttcgcccgcgcagcagcacgccgccgctatcgccgccatcgtcgccgacgggcggctgcacacctccgctgaattcacgtcggccggcatccatcccgtctacctcgccaaggcgctcgcggacgagcgcgttgtccagtacggccgcggaatctacttcggcagttgggaacaggcgaccgagcacgtggacttggccgcggtgtcgctctcctatcccggcggcgtcgtctgcctgggaagcgcggcccaggtccacaacttgtccaacgaggatccgcccgagatcttctacgcggtcgagaaggcgaagatccgacgcaagctgaaggtcggcccctcggtgccggtccagggcgtctactggaaggcccgcgacctcgaggtcggcatcgaggtccggacgatcatgggcgtcgacgtgcgcatcactgatccagcccggaccgtcgtcgacctcctgcgctatcgtaacagactcggggacgagccgggcacgaaggcgctgaccgactacctgcgcgaccggcatgggacggtccgcgccctgtggaaggccgcgcaggcactcgactgcgaggatcaggtcgagccgttcctccgcttcgccgaggaagtcgtcgaagccatcccgccacccggacgctccccaggagtctga

SEQ ID NO: 5609 - DNA, 564 bp, Mobiluncus mulieris ATCC 35239
gtgaaagaggacggcgtggtgttggttttggatgcgcttgcgccgaagcgcagtagtttgtatcgcggtttggctcggggtgagtgggagcgggtggcgcggggaatttacgttcctgcggggatgcccctcatgcagcctgagtggctggaagccgttacgcgccgcgcggaggccacgatttgtttaacttcggcgttggcgtattgggatttgactgacgagattcccgaccaggtgcatgtggctatctggaagggggcgcgtaaacccgcgaccagaagtccgcttgcgtggcatcattttgaccgagattctttcggcgaggagcgccgagagttagaaattcctggtagtgacgggcggatgattggaatttatggcccggagcgtagcgtggtggattgtttccgattgcgcgccctggttggttacgagactgcgactgtggctttgcatgagttgctggctcggggcggggatagggcactgttgatgcgcctggcgatgcgtttgcctcgagcacgtcgtccgctgttggatattctggaggcgctaaattaa

SEQ ID NO: 5610 - DNA, 564 bp, Mobiluncus mulieris ATCC 35243
gtgaaagaggacggcgtggtgttggttttggacgcgcttgcgccgaagcgcagtagtttgtatcgcggtttggctcggggtgagtgggagcgggtggcgcggggaatttacgttcctgcggggatgcccctcatgcagcctgagtggctggaagccgttacgcgccgcgcggaggccacgatttgtttaacttcggcgttggcgtattgggatttgactgacgagattcccgaccaggtgcatgtggctatctggaagggggcgcgtaaacccgcgaccagaagtccgcttgcgtggcatcattttgaccgagattctttcggcgaggagcgccgagagttagaaattcctggtagtgacgggcggatgattggaatttatggcccggagcgtagcgtggtggattgtttccgattgcgcgccctggttggttacgagactgcgactgtggctttgcatgagttgctggctcggggcggggatagggcactgttgatgcgcctggcgatgcgtttgcctcgagcacgtcgtccgctgttggatattctggaggcgctaaattaa

SEQ ID NO: 5611 - DNA, 564 bp, Mobiluncus mulieris FB024-16
gtgaaagaggacggagtggtgttggttttggacgcgcttgcgccgaagcgcagtagtttgtatcgcggtttggctcggggtgagtgggagcgggtggcgcggggaatttacgttcctgcggggatgcccctcatgcagcctgagtggctggaagccgttacgcgccgcgcggaggccacgatttgtttaacttcggcgttggcgtattgggatttgactgacgagattcccgaccaggtgcatgtggctatctggaagggggcgcgtaaacccgcgaccagaagtccgcttgcgtggcatcattttgaccgagattctttcggcgaggagcgccgagagttagaaattcctggtagtgacgggcggatgattggaatttatggcccggagcgtagcgtggtggattgtttccgattgcgcgccctggttggttacgagactgcgactgtggctttgcatgagttgctggctcggggcggggatagggcactgttgatgcgcctggcgatgcgtttgcctcgagcacgtcgtccgctgttggatattctggaggcgctaaattaa

SEQ ID NO: 5612 - DNA, 315 bp, Mycobacterium leprae Br4923
gtgaacgagccgcaccacgccatcctcaccgatctgctcaacacctttcggttttccgaagtgctccagcacattgacgagtatcagctgcggcagtcgatcgccggccagaaggtcactccactggcccgcgaattgtatcggaaaattgattgttatagtgaagaagacctcgtggagatcgcagccaaatctctgcgcgccactatcgcgttgcactcagccgttggtcagccacaaacatcctcagggattatcgatatcaccattcctcgaggattgtggacaccgcagataaagatccctatccgatga

SEQ ID NO: 5613 - DNA, 315 bp, Mycobacterium leprae; identical to SEQ ID NO: 5612

SEQ ID NO: 5614 - DNA, 609 bp, Mycobacterium marinum M
atgattatctgtagacgttctgtaccatattttgaggagaggagatggctggtggaggctctgacgccgcgcactgcgggccaggccggcctgtcgcgcagcgcgctctaccgcggcgcccgtgcgggtcggttggatcgcatcgctcgcggcatctacctgcccgcggatgcatcgaccgccgactgggatcagatcgaggccgcgacccgccgcccggatgcaacgatctgcctaacctccgcgctcgcccactacgacctgaccgacgccatccccgccgcgctggacgtcgcgatcccgcgagggtcaaggacacccgcgagcacgggtgcgatcgcctggcaccaattcgacagggccaccttccagatcggacgcgaacagatcgcgatccccggatcggatcagacgatcgggatctactcgcctgagcggtcgatcgccgacgcgttccggcagcgcggcgaggtcggatacgagctggcacgagacgcgctgcgggaatggctgcgtcgaggcggcaaaccagcccggctgatcgacatcgcttcccgcctaccacgggcgaagtcgccggtcctgcaggcattggagatgctcggatga

SEQ ID NO: 5615 - DNA, 582 bp, Nakamurella multipartita DSM 44233
gtgcccggatcgtcggacagagagctgccgaacacgttcaccgcggcgcaagccgagcagagcggattgtcacgtcgcggtcttgcgtcattgcagcacgcaggtgaggtcgagcggatcggccacggcctgttccggcgcacgtccgcacctctggtggacctggacctggtggagatcgcggtgaaagcacacaagccgaccctgtgcctggtctcggcgctcgcgcggcatgatctcaccgatcagatccccgccaagcacgacattgcggttccgcgcggacagtggcagccgaaggtgtcggcaccggtgcgctggcacaagtttgacccggtgaccttcgatgtgggccgcaccgagatcaccgtcgacggcgactacacgatgggcctgtacgacgccccgcgaagcatcatcgacgccttccgcatgcgcactaccctcggaccggacgtcgccaacgaggcattacgacggtggcttcgccaaggtggacaagcgaatctgctcctgcgtcacgtcaagtccttcccgcgtacccggaccgccgtgctcactgcactgcagatcctgctctga

SEQ ID NO: 5616 - DNA, 624 bp, Nitrosococcus halophilus Nc4 uid46803
atgacccaggaaacaaccgccaacaagggttccatcgacgcggcgatacacctgttcagctgccacggtggcgtgctgtgcacccgcgacgccctgcgcctcggcatccatcccaggacgctgtacgcgatgcgggatgcagggctgctcgagcgcctcagccgcggtctgtaccggctcgccgatctgccgcccctgggcaatcctgacctggtggcggtcgccctgaaggtgccgggcggcgttatctgtctgatctcggcgctggactatcacgagctcaccacccagatcccccacgaggtttacctggcgctgccgcgcggcgccgagcccccgcgcctggagcatccgccgctgcgggtcttctgggttggcggcaaggccttcaccgagggcgtggagacccacgaggtggatggcgtgcccgtgcgcatctatggggcggaaaagaccctggccgacagcttcaagtaccgcaacaagatcgggctggacaccgccatcgaagcgctgagacgctacgtgcgctgcgggcgcacccggatcgacatgctcatggcctatgcgcgcatctgccgggtggaaaaggtgatccggccctacctggaggcactgctgtga

SEQ ID NO: 5617 - DNA, 576 bp, Olsenella uli VPI, DSM 7084
atgggcatcccccgcgatgccctgcacgatgcagtcgagtccggccgcatcgagaggatcgtgcgcggagcctaccgtatggtcggctctggctcatccttcactgacgagctcgcagcgatatggaagcttaccgagccggcgaagttcactcacgagaggctgcgtgcctccgagtgggacggcatcgttgtcgggggatccaccgcatcggctcttctcgagataggcgacctccacctctcgccataccggctctacgcccccaagaggataaatacgaggaacccgtcagcgagcttcgcaaagcgcacggtgccccgaagcgacgtgatgttttcccacgacctgccggtgactcggcctgagcgcaccgtgttcgacctcgtcgtggacgacgaggacttgtctttgatcgccgacgtgttgaaggatgcatggcatgcaaaccgcgacttcgactttaaaaggctcgccggcctcctgagaagccactacggagaagcgagagcagagagcctctaccgaggccttctggaggattcgggcctgagggataaggaggggacgccataa

SEQ ID NO: 5618 - DNA, 612 bp, Chlorobium luteolum DSM 273
atgtcacaacaaagtacagttgcagataaggccaaagctcttattcttgcccagggaggcctcatccgtacccgggaagcgatcagtcttggtattcatccccggacgctttacagtcttcgtgacagtggtgagcttgaagagctttctcgagggatttaccaactcaaagggtggaagcagctcgaatatcctgatcttgtcaccgttgcactgagggttccgaatggtgtactttgcctggtttcggcactctcctttcacgagatgactacccaggttccacacagtgtatctcttgcgcttgaaaaaggtgccgaacaaccaagaatcgagtatcctccggttacggttttccggttttcaccctcttgtttcaagatcggaattgaaacgcatcagctcgatggtgtttcggtgaagatttacagtccggaaaagacgcttgtagactgcttcaaattcagaaacaggatcggaatggatatcgtgctcgaagcgctcaaactgtatcggcagagagtgcaaaagaatctgcatgcactcatgcagtatgcagaggtgtgccgtgttgcctcgatcatgaaaccatatctggaggcaacgctgtga

SEQ ID NO: 5619 - DNA, 612 bp, Pelodictyon phaeoclathratiforme BU 1
atgtcacaacaaagtagagttgcagataaggccaaagctcttattcttgcccagggaggcctcatccgtacccgggaagcgatcagtcttggtattcatccccggacgctttacactcttcgtgacagtggtgagcttgaagagctttctcgagggatttaccaactcaaagggtggaagcagctcgaatatcctgatcttgtcaccgttgcactgagggttccgaatggtatactttgcctggtttcggcactctcctttcacgaaatgaccacccaggttccacacagcgtatctcttgcgcttgaaaaaggtgccgaacaaccaagaatcgagtatcctccggttacggttttccggttttcaccctcttgtttcaaggtcggtattgaaacgcatcagctcgatggtgtcccggtgaagatctacagtccggaaaagacgcttgtagactgcttcaaatttcgtaacaggatcgggatggatatcgtgctcgaagcgctcaaactgtatcggcagagagtgcaaaagaatctgcatgcgctcatgcagtatgcagaggtgtgccgtgttgcttcagtcatgaaaccatatttggaggcaacgctgtga

SEQ ID NO: 5620 - DNA, 672 bp, Phenylobacterium zucineum HLK1
atggccctgttacaagatctcggactttgcgaacattctccgaggatttataacacccccatggaacccagaggtcaccgccaacgcgccatcgaggtcgcccgcgcgcaagggatcgctcgcggatcggacttcgacgcggccggcgtgccccggatgtatctcaagcgcctcacggaagacggcgtgctgctgcaggtcggacgcggactctatcgcctggccgactccccctccgacgcggcctcaagcctggccgaggccgtccggatccaaccccgcggcgtgatcggcctgctctcggccctgcagtaccatgacctcaccacccagacgccccacgcggtctggatgctgctcggccccaaggactgggcgcccaccagcgcgcccgtacagatccgggtgatccgcgccagcggccgcgcgcttcgcgaaggcgtcgagcgtcacgagattgaccaggtgccggtgccgatcacctcgcccgctaagacggtggtcgactgcttcaagtaccgaaacaagatcggcctcgacgtggccgtggaggggctgcgcgacctcatgcggcgtcctgatcgcagaccggccatcgacgagctttggcggttcgcggagatcgaccgggtccaaaccgtgatgcgcccctacctcgaggcgctcacgtga

SEQ ID NO: 5621 - DNA, 609 bp, Polaromonas naphthalenivorans CJ2
atgatgccgcagcccacgcagacccagcgcgttctagaactggcccgccagcacggcctgctgcgctcgcgtgaccttcaagcggtgggcgcgccccgggtgatgctgacccgcttgatggccagcggccagctggaaaaagtgggccgcggcctgtaccgcctgccccaaacacagatgtcggaggacgaaagcctggctgccattgcgatcaaggtgccgcaggccgtattttgcctgctcacggcgctgcagtttcacggcctgaccacgcagctgccgcgccaggtctggctggccatgccgcgtggcagccatgcgccgcgcatcgactatccgcccatccggatggtgcagtattcgggtcaatcgtattcccaaggcatcgaggtgttcgagcgcgaccgggtgctgctgcgggtctacagcgtggccaagacggtggtcgattgcttcaagcaccgcagcgccattggcctggacgtggcgctcgaagcgctcagagaagcaagagccagccaacgggcccgcgccgacgagctctggcgctttgccaagatttgccgcgttgccaatgtgatgcgtccctacctggaggcgattggctga

SEQ ID NO: 5622 - DNA, 204 bp, Polaromonas JS666
gtggaggtgccagtcttcaacgccgccaagacagtggccgactgcttcaagtaccgcaacaaaatcggtctggacgtggcaatggaagcactgcgtgatgggtggacacaacgcaaactgacgatggatgcgctgtggcactacgccaccattgatcgcgtagcgaacgtcatgcgcccttaccttgaaagcgcgaccgcatga

SEQ ID NO: 5623 - DNA, 621 bp, Propionibacterium freudenreichii shermanii CIRM BIA1 uid49535
atgagtagtgtctcagacctcgtcacactcgggcggatcgccgccaaccagcaaggcctcgtcaccgccacccaggcccgcgctgccggtgtcgacacccgccagatctggcgcctgagcagggccggggcactcgagcgggtgattcgcggcgtctaccgggtttgtggtgctccggcaacggacttccaggagatcaccgctacgtggctggccctgtccaatcccggacggcgcctcacagcggccggtaccaccgctgccaccctgtacggcatcggggatttcctgcgcaccgtccccgaattcatcgtggccggcgatccgtccacgacggtggaaaacgtgcgactgcgcaccgggcacgtcgaccagccgcgggtgcggacgctccacggcgtgcccaccctgtcgccggaacagaccatcgcagacctcctggcgcaacacaatgacgtgtctctggtcggcgacgccacagttgacgccctcgacaagcacctgaccacgccccaacgcgtcgcccgggccctcgccccgatggctgctgaccatgggctccccgacggtgacgggtcagagctcctcgccagcatcctcccggcagccacggccgcatga

SEQ ID NO: 5624 - DNA, 624 bp, Raphidiopsis brookii D9
atgaataaaggcaaggtagccgaaacagcttctgagcgagcggtgcgcctcatcaagaagaagggaacaactattattaggactgcacaggcactccaggttggtatccatccacgcacgctctatcagcttagagataatggggtcttagaacaagtatcacgcggcgtttaccgcctatcggagcagccgtatttctctcagccagatctggtgactgttgcactacgtatccctaagggaattatctgcttagtttccgcgctggctttccacgaactcaccacccagatccctcataccgtttcaatagcactagccaaaggggcacaatctccaagaatagattacccacctgtttctgttcatcgcttctcaggtgcgagccttaaaacggggatagaggtctatgagatcgatgaggtacctattcggatctacagtgcagaaaaaacactggcagactgctttaagttccgaaacaagctgggtatggatgtcgttcttgaggctctaaagctctacaagacacggaagaaattcaacccccggcagcttattgaatatgccagaatctgccgggttgaggcagcgatgaaaccctacctagaggtactggtatga

SEQ ID NO: 5625 - DNA, 618 bp, Rhizobium leguminosarum bv  trifolii WSM1325
atgcccagttccgacactcaacgccaaatcgcccggaccgtgctaacggagcgcggaatagcacgtttgagggaactgcgtaatgcaggtgtgacaggggccacaatgagccgaatggaacgggatggcgaggtgctgcggcttgcccgcggtctctaccaacttcctgatgcggagcttgatgtcaaccacagtatggcagaggttgccaaacgcgcgccgaaagccgttatctgcctcgtttcggccttggcattccacggcctgacggatcagcttccgagacaaatctggcttgccataggccgtaaggactgggccccgaaaccggacggtcccgctatgcgcatcgtacgtttcaccgaaagccttctcaacgaaagcgtcgaaacccatgtcatcgaaggcgttcccgtgaaggtctttggaatagccaagacaatcgccgattgctttcgctatcgcaacaagatcggcctttcgatagcgatggaggggctgcaggaggcactgcggcaacgaaggactagtcctggcgaaatcgccaaccaggccgaacgcggtggcgtcggatccgtgatccggccgtacctcgaggcgctgaccgccaatggctaa

SEQ ID NO: 5626 - DNA, 621 bp, Rhizobium leguminosarum bv  trifolii WSM1325
atgacattcactaccgcccagagacttcgagcgctcgacctcctgaaagcgcgggggatgctccggctgaaggatttcgttgccgaaggcattggaccggagacgctcgcccgtctcgttcgggaggaggcagtcgtccgcccggcacgaggcctgtatcaactcccggacactcaggctgaggcggcccatgcactcgctgaagcggctgttctggttccaaagggcgtggtctgcttgacctccgccctccaataccacgaactgacgctgcagatgccctcggctgtgtggatggcgatcgaccgcactgcctggcgccccaagatcgattatccgcctatcaagttcgtacgcttcaaggggtccgctctcaccgagggcgtcgaacggcatcgcatcgagggcgtcgaggtgccgatcacaaatccggcgcgttcgatcgtcgattgcttccgctatcgggcgaaagtcggcctcgacgttgcgatggaggggctgcgcgaggggctccgtcggcgcaagaccacaagcgacgacctctggacatatgcgaaagaggcgaggatctggtcgatcatgcgaccctatgtcgaagcgacggtggccgatggcgcgtga

SEQ ID NO: 5627 - DNA, 621 bp, Rhizobium leguminosarum bv viciae 3841
atgacattcaccaccgcccagagacttcgagcgctcgacctcctgaaagcgcgggggatgctccggctgaaggatttcattgccgaaggcattggaccggagacgctcgcccgtctcgttcgggaggaggcaatagtccgcccggcacgaggcctgtatcaactcccagacactcaggctgaggcggcccatgcactcgctgaagcggctgttctggttccaaggggcgtggtctgcttgacctcggccctccaataccacgaactgacgctgcagatgccctcggctgtgtggatggcgatcgaccgcactgcctggcgccccaagatcgactatccgcctatcaagttcgtacgcttcaaagggtccgctctcaccgagggcgtcgaacggcatcgcatcgagggcgtcgaggtgccgatcacaaatccggcgcgttcgatcgtcgattgcttccgctatcgggcgaaggtcggcctcgacgttgcgatggaggggctgcgcgaggggctccgccggcgcaagaccacaagcgacgacctctggacatatgcgaaagaggccaggatctggtcgatcatgcgaccctatgtcgaagcgacggtggccgatggcgcgtga

SEQ ID NO: 5628 - DNA, 576 bp, Agrobacterium radiobacter K84
ctgacggcgcgtgggatcgcgcgtcttgtagagctgcgcgatgctggcgtaacggccgccacgatgagccgcatggagcgggatggggaggtgctccggcttgcacggggcctttatcagctctccgacgcgccgctcgacgccaaccacagtctggccgaggccgctaaacgcctacccaagggtgttgtctgccttgtgtcggccctcgcgttccacggcctgaccgaccagcttccgaagcaggtgtggctggcgatagggcggaaggattgggctcccaaacccgacagtacgcctattcggatcgtgcgcttcaccgacagactgctcaatgaaagcgtagagacccatgtcgtcgaaggtgtgcccgtaaaggtctttgggatcgtcaaaacaatcgcggactgtttccgatatcgcaacaagatcggtctgtcggtggcgattgagggcctccaagaagtgctccgtcagcgtaaggccacccccggtgaaattgccaggcaggccgagcgtggcggtgtcgccacggtcatccggccgtatatcgaggcgctgactgccaatggctaa

SEQ ID NO: 5629 - DNA, 513 bp, Sinorhizobium fredii NGR234
atgagccgaatggaacgggatggcgaagttctgcggcttgctcgtggtctctatcaacttcccgatgccgagctcgatgccaaccatagtctcgcagagaccgccaagcgtgttccgaaagccgtcgtctgccttgtctcagctctcgcatttcacggcctcaccgatcagctgccgagacacgtgtggcttgccattggccgcaaagactgggctccgaaaccagatggcacacctattcgtatcgtgcgctttacggagagcctgctccacgatggggtcgaaacgcatctggtcgaaggcgttcctgtaaaggtctttcgagtcgccaaaacaattgccgattgcttccgctatcgcagcaagatcggtctttctgtggcgatcgagggacttcaggaagcactgcggcagcgcaaggccacgcccggcgacatcgccaaccaggccgaacgtggtggtgttggcaccgtgatccgcccctatctcgaggcactgaccgccaatggctaa

SEQ ID NO: 5630 - DNA, 645 bp, Rhodomicrobium vannielii ATCC 17100
gtgaacactcgctatccaactcaacaagatcgcgccattgctctcctcgccgagcggggtatggccaagctttccgagtttacggcaagcggcatcactgcggccaccatatcccgcatgaaagaacgcggccttatccttcagctcagccgtggcctttaccaactccccgatgctcctcttgacggaaaccactctcttgcggaagcagcgaagcgcgtgcctaaaggagtgatttgcctcgtgtcggcgcttgcctatcatgagttgaccgatacgataccgcgcctcgtttggatcgcaatcggcgctaggcagaagaagcccgtggtcaaaacgccgccgcttaatatcgtgcgctttggacagatggtcttctccaccggcatcgaggaacacatgatcgaaggcgttagagtgcgcatctatagccccgccaaaaccgtcgttgatcttttccgttaccgccagcgcgaaggcagacgctataagagtagtccaggcatcaaccccgtgctggaaggcatgcgcgaagcattgcggcagcggaaggcgacgccggccgatatcgcacgctacgccatggaagcaggggtttggagcaatctgcgcccttatcttgaagcgatgacttcacatgcctaa

SEQ ID NO: 5631 - DNA, 618 bp, Rhodopseudomonas palustris DX-1
atgccgcagacccgatcccagcgcgagatagcccgcgatctcctcgaggtgcgtgggattctgcgccttgcggaactcagggccgccggcgtgaccgccgcaaccgtcagccgtatggaaaaggatggcgaggtcacccgcctggcgcgcgggctctaccaacttgccgacgcagaactcgacgcaaaccatagccttgccgaggcggccaagcgtttccccaagggcgtgatctgccttgtctcggcgctcgcctttcatggcctcacggatcagcttcccaggaaggtgtggatggcaatcggccggaatgactggacgccgaagccgagcgatatgccgatccgtgtgctgcgattctcggacgatctgcttgccgacagcgtcgagccccacgtgatcgaaggcgtatcggtaaaggtgttcggcgtggcaaagactgtcgcggattgcttccgccatcgcggcaagatcggtcttcccgtcgcgctcgaaggcctgcaggaggctctgcgccaacgtaaagccacaccggcagagatcgcgagggcggcggatacaggtggggtcggaaccgtgatccgcccctatctggaggcgctgaccgccaatggctag

SEQ ID NO: 5632 - DNA, 663 bp, Rhodopseudomonas palustris DX-1
atgaaccatacatgcagtatgacggcttgctcacgaacgcaatcggagagagtggagctccttcttcgagagcgcgggctggttcgtgcggccgaattccgccgtgaaggcatttcgccgacgacgatttcgcggatgaaagaacggggagacatcgtccagctcagccgaggtctctatcagcttgccggggccgcgccgggggtaggtagctcgcttgctgaagcagcgaagcttgtgcccaaaggggttgtttgcctcgtgtcagcgctggcgtttcacgagctgacggacaccatcccgccgcgcatctggattgccatcgggcccaaggattggaagccgcgcgtcacgcagccgcctcttcagtttgtccggttcggcggcaaggttctcagatcgggtatcgaggagcaccggatcgagggcgtaaccgtaaaggtctatagccccgccaagacagttgtcgacctgtttcgctatcggcaaagcgaggggaggcgcttcaagcgcagtccgggtctcagtctcgcgctggaaggcatgaaagaggcgcttcgcaaacggaaagcgacgcctgcacagattgcgaagtacgccgaagaggcgggcgtttggaaggtcgttcgaccttatctcgaggcgatgacggccgatggctag

SEQ ID NO: 5633 - DNA, 690 bp, Slackia heliotrinireducens DSM 20476
atgtcgtattcgagcaacatatctgcaatcgaagagctggccgcatctgaaggcggcatcttcacgagcggccaggcggcgcgtgcgggcgtgccgcgctacgccctctcgtacgcggcaaagtccggccgcatcgagcggctacggcatggggcctatcggctctcatctctccctacgaccgcgctcgacgacctcgtcgccgcctacaagctcacctcgccagacaggctcacctacgagcgcatgggcgcaagcttcgacggggtcgccgtatgcggcgcaacggcggcgcacgccctcggaatcggcgacctggaacctgagccgtggcagatcgccgtccccaaacgcttcaacagccgaatggacggcacgaagttccgcgttatggatctcgggcgaagcgacgtcgtgtgggccgagggcgggtttcccgtaacgagggtggagcgcacgatcgccgacctcgcgatggaggccacggaggagtccctgctcgccgacgtgctcgcagacgcaatcaggcgctacggcgcgacggagctcgacatgcgccggctgcgtgccctgctcggcgacggccgcctgcgctcgctcctctcggcagccggggcctacgagggcggcccgcgcgagctggtggagctcgacggcctgggccatgcggccctgatagagaggggttga

SEQ ID NO: 5634 - DNA, 609 bp, Synechococcus sp. RS9917
atgctccccgtcctggacaggaaagaaacggccctcaagctggcccgcagccgcggcctcctacgcgccagggaggccgcggcggctggcgttgatcgttcgaccctggcgcggctgtgcgacagcggcctgctggagcggctggagcgggggctttacggcctgccggccgcggccgttcgcgagcacgttgacctggagatcgtcgctaagcgggtgccccaggcggtgttctgcctgctcacggccctgaggctgcacggtctggggacgcagcagccccgccgggtctggatcagcctgccgcggggcgtccatcgccccaccctgcagttccccccactggaggtgatccatgtgcagccggagctgcatcgcctgcaggtggaatcacggcgctccggtccgatccggctgaagatctacggggtggagaagaccctggtcgactgcttccgccatcgccgcaggctcggcatggagccggtgctcgaggccctgaaggatgcgatcagccagaggcggctgaacgtcgatgagctctggcgtcaggcgcaggcgcagcgcatgcagcgggtgatgactccgtacctggaagcactgctgtga

SEQ ID NO: 5635 - DNA, 603 bp, Syntrophobacter fumaroxidans MPOB
atggcaccgacaacgacggaacaagttcttgaccttgtggagaaagcaggggtcttccgtccaagggagctcgattcttacggtattccacgcgaatacctcgtacgactctgtcgcaagggactggtgcggcgcgttgcgcgcgggctttatactttcgtggattccgatgtgagcgagcaccttagcctggcagaagcatccaagaaaatccctcatggtgtcatctgcctactgtccgcacttcggttctacgggctgacgacgcaagccccttttgaagtctgggtcgctgtcgacgtcaaggcaaggaagcccaggagcgatggtctgccactccgcatcgtgcgcttctctggcgctgcactccgttccggcgttgaggaccagctcattcagggtgtcaaagtaagggtttacagccccgcgaaaaccgttgcggactgttttaagtaccgtaataagaccggccttgacgtggctctggaagccctgcgcgagtgctggcgcgagcgccgctgtaccatggacgacctttggcgctacgctaagatatgccgtgtttccaatgtgatgagaccctacctggagtcactgccgtga

SEQ ID NO: 5636 - DNA, 618 bp, Variovorax paradoxus S110
gtggcactgcactccgatcccaccctggaacaagccgcgctggcactcgccgagcgtcagccactgctgcgcgcgcgcgatcttgcaacgcacggcctgccgacggtggttctcagccggctcgtggctgccggcaggctcgaacgcgttgcccgcggcgtctatagccttccgggacgcgcgctcagcgagcaccggtcgctggccgaagcggcgctgcgggtgccgcgaggcgtggtgtgcctgctgtcggcgctgcgcgcccacggcattggcacccaggcgccgttcgaggtctggatggcgattccccatcactcgcccacgccgcggctggaccagcctgcgcttcgcgtggtgcgcatgtcgggggcggctctgactgaaggcgtcgatctcgtcgacaccgacggcgtgcaagtgccggtattcaatgccgccaagacggtggccgactgcttcaagtaccgcaacaagatcggcctggacgtggcactggaagcgctgcgagatggctggtcgcagcgcaagctgtcgatggatgcgctctggcactacgcaacggtgaatcgcgtggccaatgtcatgcggccctacctggaaagcgtcattgcatga

SEQ ID NO: 5637 - DNA, 624 bp, Verrucomicrobiales sp. DG1235
atggccgacactttgcaaacaaccccaaaaaaaacagaacaactcgcagaagagttcaaaaccacctcgaccctcacaagctcggagctacaggaacttggctactcgcggaccgtcataagcaaagccatccagctcggacacatcgagcgactatctagaggactctacacctctaggcacgcgcccatttcagagcacacctcactcgtccaagtcgccaaacaaactccgaatgctcgtatttgcctcctctcagctctaaaattccacgaactcacatcccaaaatccacacgaagtttggatcgcaatagaccgaaaagccagaaaaccctcctacaagagcccccccactcaagtggttcgcttttccggtcaagcctacgagacaggcatcgaaattcattccatcgagggaactgaagtagccatctactcagtctcaaagaccgtggtcgatctcttccgttatcgaaacactatcggcatcgacgtagcaatagaagctctcaaggaaggctggaaagagcggcgctttacaatcgccgagataaacaagatcgccaaaagctgcaatgcggcaaccactctctcgccctacctagaaaccgtactcggatga

SEQ ID NO: 5638 - DNA, 600 bp, Xanthomonas oryzae MAFF 311018
atggacacgaccgtcgacaagctgctggagctggtgcgcacgcggggacttctgcgcccgcacgatctggccccactgggcatcccacgggtggccctgacgcgggccgttcggcgcgggcaactggagcgcgtcgggcgcggcctgtacggcctggtggcgcgtccggtgtcggcccacggcacgctggccgaagtcgcgcgccgcgtgcccaagggcgtggtctgcctgctgtcggcgctgcgcgtccacgacctgacgacccaggccccgttcgaggtgtggctggccatcgacaacaaggccgctgccccgaagctggactacccgccgctacgtctcgtgcgcttctccgggccggcgctgagcgagggcgtcgaggaacacgttgttgatggtgtgcccgtccacgtgaccagcgtcgccaagaccgtggccgactgcttcaagtaccgcaacaagatcggcatcgacgtggcgctggaagcgctgcgcgaggcgtgggttgcccggcgcatgaccagcgacgagatctggcactacgccaagatcgaccgcgtcgccaacgtgatgcgtccctatctggagagcctggcatga

SEQ ID NO: 5639 - DNA, 606 bp, Xanthomonas oryzae pv oryzicola BLS256
atgctttccgacacccacacccagcgcgtcctcgatctggccagccagaaaggactgctgcgcgccagcaatctggacgccatcaatgcgccccgggtcgttctcacgcgcctgaccgccgctggcgttctggaaagggtcggacgcgggctgtaccgcctgccggacgcgcagggatcggaattcgagagtctcgcggccatcgccaccaaggtgccacaagccgtgttctgcctgctgactgcgctgcagttccacgaactgaccacgcaactgccgcgccagatctggatcgccatgccgcgcggcagtcacgcgccccggatcggctatccgccggtcaagatggttcagatgaccggcgacgtctacgctgcaggcatcgaggagcacctgcgcgacggcgtgaagctgcgcgtgtacggtgcggccaagacggtcgtggactgcttcaagcaccgcaacaagatcggcctggacgtggcgctggaggcgctgaaggacgtgcgcgccaaacgcaaggccactgcggacgacctgtggcgctttgctacggtctgccgcgtggccaacgtgatgcgcccctatctggaggcggtcgaatga

SEQ ID NO: 5640 - DNA, 819 bp, Xanthomonas oryzae KACC10331
atgctttccggacctaccaccacgatcaggccatgttgcggatcctctcccggacagcaaacctccagaccgccagccaggcgcgaaggccaagggtggcgcgcccggtacgcgtgcctgatcggtaatcgcatccggcgacagttcgcccagtggcgaggttcctatccatcggttgttattgacatttaccgattttatggaacaatatgccggatcatggacacgaccgtcgacaagctgctggagctggtgcgtacgcggggacttctgcgcccgcacgatctggccccactgggcatcccacgggtggccctgacgcgggccgttcggcgcgggcaactggagcgcgtcgggcgcggcctgtacggcctggtggcgcgtccggtgtcggcccacggcacgctggccgaagtcgcgcgccgcgtgcccaagggcgtggtctgcctgctgtcggcgctgcgcgtccacgacctgacgacccaggccccgttcgaggtgtggctggccatcgacaacaaggccgctgccccgaagctggactacccgccgctacgtctcgtgcgcttctccgggccggcgctgagcgagggcgtcgaggaacacgttgtcgatggtgtgcccgtccacgtgaccagcgtcgccaagaccgtggccgactgcttcaagtaccgcaacaagatcggcatcgacgtggcgctggaagcgctgcgcgaggcgtgggttgcccggcgcatgaccagcgacgagatctggcactacgccaagatcgaccgcgtcgccaacgtgatgcgtccctatctggagagcctggcatga

SEQ ID NO: 5641 - DNA, 600 bp, Xanthomonas oryzae PXO99A
atggacacgaccatcgacaagctgctggagctggtgcgcacgcggggacttctgcgcccgcacgatctggccccactgggcatcccacgggtggccctgacgcgggccgttcggcgcgggcaactggagcgcgtcgggcgcggcctgtacggcctggtggcgcgtccggtgtcggcccacggcacgctggccgaagtcgcgcgccgcgtgcccaagggcgtggtctgcctgctgtcggcgctgcgcgtccacgacctgacgacccaggccccgttcgaggtgtggctggccatcgacaacaaggccgctgccccgaagctggactacccgccgctacgtctcgtgcgcttctccgggccggcgctgagcgagggcgtcgaggaacacgttgtcgatggtgtgcccgtccacgtgaccagcgtcgccaagaccgtggccgactgcttcaagtaccgcaacaagatcggcatcgacgtggcgctggaagcgctgcgcgaggcgtgggttgcccggcgcatgaccagcgacgagatctggcactacgccaagatcgaccgcgtcgccaacgtgatgcgtccctatctggagagcctggcatga

SEQ ID NO: 5642 - DNA, 555 bp, Xylanimonas cellulosilytica DSM 15894
atgaccgtcctgacgctcgactcagcccgtgctgccggcctgcgcaaagaagaggtgtaccggatggtcgaggccggggagctcgagcggatcgggcgcggtgtgtacatcaggccggggcaggtggaccccttcctcgcgtcactggccggcgccactgctgtgaagccgatggcgacgatgtgcctgacgagcgccctcgtccaccacgggttgagcgacgagatcccgttcgacacggacgtcgcgctcccgcgaggaacccggttcccggccgggttcgagcatgtccgctggcacagcttcgatccgtcgacgttcacggccggacgtcgccgcctggcacatgacctcgagctgtgggtctactcagccgagcggacgatcgtggatgcgtaccgactggcacaccgcgaaggtgtggaccaagcccacgaggcactacgtcgctgggtgcggactcccgggaactcgcccgcatcgctcctgcgaaccgcggcgctgttcccccgaagcgtgaccacgatccgcgagaccctgcaggtgctcctgtga

SEQ ID NO: 5643 - DNA, 675 bp, Opitutaceae sp. TAV2
atgggtctccgaattcagcttgagtccttgttacgttttcataccataaataaaaaagtgaaaatgaaacgtaactcaggcacgcgactcaagaaggcaggtgaccgcgcccgcagactcgggattttccgtgcccgcgatatggtcgccgccggttatccgcgagaatacctgcgccgcctcgtcggacaagaacaggtgcgtcagctcggacgcggactttacgcctcggcggatttcgacggagaccaaaacctgacattggtcgaggcggccaagcgggtgccgcgtggagtggtttgccttgtttcgtccctgcaattccatcggatcggaacgcagtcgccgcatcaggtgtggctggctctcccgcgaggcagcaatttcccgcgcgttgacgatctgccgctccgcttctgcaagttttcggatacggcctatgccttcggagtccaggaacatgctatcccgggaggcatcgtgcggatttactcgccagccaagaccgtggccgactgcttcaaataccggcacaagtatggtctcgatgtagcggtcgaggcgctgcgtgaaggatggcacggaaagaagttcaccctgtgggaactatccgccgccgccgccgtttgccgcgtgggcagggttctgcaaccttatctggagatgctgacatga

SEQ ID NO: 5644 - DNA, 1302 bp, Acinetobacter johnsonii SH046
ttggatactatctccactaatacacaggcaatattattattaacagcacctttaattttaggtaagggtagtcaatcctttgatcttttgactaccaaagaatataacctgctagctcgttatctgtggaaaatagggaaacaaccctctgatttattatcttcagatgctaaagacttaattgaaaaatgcagtaacctaattaatcccgagcgtttaaatatcctacttaatcgaggttttttattaagtcaggtcattgagctttggcaatctcgttccatatgggtaattagtcgagcggataaagcgtatccaagattaatcaaggataaattaaaagatcagtccccacctatactttatggttttggcaatttagatttattaaatagtggtggcttagctgtaattggatcacgaaaaattgatgattcgatttataactattctaataatattggtaaattagctgctaaatttggcactaaggtcatatctggcggagcaaaaggggttgatcaagcggcaatgtatggtgcacttcatgaagggggctacgtttgtgaagtaatggctgaaaacttagagcgtgccgtgctagatgcaggaagaagaaattatctaatgtctggaaatttaattcttgtttcagcatatgatcctaaagctagttttaatattggccatgctatgcagagaaataaattaatatatgctctttctgatgcatccttagtcgttgcttcagacttcaataaaggtggaacttgggctggagcagcggagcaacttgataaattaaaatttgtccctgtttatgtaagattagataacgaatcaaaaggactaagagaattatataaaaaaggggctattccttggccaaaccctcaagatatcaattctttccgtcaaatatttgatgtaagtaatctagctaataataatttaaacttatctctgtttgatcaagaagatatagttaaagaatttaaagtaagtgatatagctcagcaaaatcttaccaatactattgatgaatctacaaagtcacacacaccatcagcaacaaacactagtgaaatagaagttcaaaaacctgcggatgaactttttgagtttgcagctaacattattttgaatctacttgatactccattaaaagattctgaaatatcacaagcacttaatatttctctagctcaaacaaaattatggctaagccgacttgtagaagaagagcgtatagaaaaaagaacaaaacctgtaacatatatagttaggcattcaaaatcctaa

SEQ ID NO: 5645 - DNA, 1302 bp, Arthrospira platensis NIES-39
atgtcaaatcatcaattatcccaggatactcagggtattttacttctgtgcgggagttttggcaagagtcgtaatcactccccgcaaccgttaagtttaagggaatataatctgctggcggcggcattgcgatcgcatcaaatgactcccgctcatctattagcacctgatggagaacagaaattatgctccctgaatcattctttagataatcaacgaattatcgaactgctacagagaggatttttactaactttatcattagaaaaatggcgcagtcaaggtctgtggattgtaagtcgtagcgatcgccattatccccagcgtttgaagcagcatttaaaatatctgtctcccccaattttatatggtgtaggtaacctggaactattgaataagggcgggttagctatagtaggttctcgtaatgttaatgaagcagtattaagctatacccaacaattagcccacatttctgcccaacaaaatatacaggtaatttctggaggtgcgagaggcatagataaatgtgggatgttatcctgtttagaagccggaggaactacgattggggttttggcaaatagtttagggaaggcatctttagaaagtgactatcggcaaagtcttgatgaggatagactagcgctaatttccccctacgatccagaagctggttttcatgtgggtaatgccatgggacgcaataaatatatttatgctttagctgattatgctgtggtaattagtgcaagttttaataagggtggcacttggagtggggcggtagaagccctaaaaaaactaccaaatatacctgtttttgtgtgccaaaatagccaaaatcaaggcaatatggaattattgaaactaggggctaaacctttcccggaaatgtctgggaagttggatttattggatatcctgaagccaggggagacggaagatgcggtagaagtggaacaaatggctttagatttcgcggtaaatttaacacctgaaaatcccgccccaactcctatatatgtagatgtaaatccgacacctacagaagcacctaatgtgagtccatccccggagttatcagaggctaaaattgatgtatctatggatatttatcaagcggttttaccaataattttaacacatctacaggagccgatagacgcgaaaaacttagcgaaattattagatgtacagtacaatcaaatacaagcctggttaaagcgagctatagaagatggtaaggtgactaaattaacgaagccggttcgctatgtgagttcagagtgtaatagataa

SEQ ID NO: 5646 - DNA, 1320 bp, Chlorobium phaeobacteroides DSM 266
atgcaaaaactctcttcgaatacaaaagccattctccttttgacagcgcccttgatcgccagtcacggcagtttgttgccagaccttttgtcgccttccgagtacaatcgtcttgcgcgtcacttgcatgacatgcagcgagaacccgctgacttgttacttcctgacgcgggcgatttgcatcgtgcatgcaagcacctcgttgacgaaaaacgcctgcaaagtttgcttgagcgaggctttttgctcagccaggttattgagcattggcaggcacgtgctatctgggtggtaagccgtgctgatgcagcatatccccgacgtctcaaggcccgattgcgggaaggggcacctgctgtgctgtatggttgcggcgatattaatttgctggaagctggtggccttgctgtggtgggttcacggcatgttgatgatgagcaaattaactacaccatggcaatcggtcaactggctgctcttgcagacaggatgattatttccggaggggcgaagggtatcgaccaggccgccatgcaaggtgctcttgaagctgacgggaaggtttgcggtattcttgctgatcgtcttgaaaggacggcaatgaatcgtgaacatcgcaatctgattatagaagagcgattggttctggtttcgccatacgacccaagtgcgggtttcaacgttggccatgccatgcagcgcaataagttgatctatgccctggccgacgcttcgctggtgataaattctgatatcaacaagggtggaacatgggctggtgcgactgaacaacttgacaaactccgtctggttcccgtctatgtgcgatcaacaggaacggcttcacgtggtattgatgccttgcgtaacaggggagctctgccttggccggagcctcatgacgtcaaggcgtttgaagctctgcttgatacatcgccatctctgattccagtcgggagagatgtttccatagggctctttccgaatggcatggttcaagattcagtgacagacacggtgcaggaaaagcctcaagtacaagttatgcaggaaatttctttacctgttctcgtgtccgggaaggcggaactcagtccggcgcagagattgttcgctacggtgcgtgaggtgatacggcaattgttgaaaaaaccgatgacagatacagagattgcagagagattagagttgtcaactcttcagacaagggtttggttgcagcttctggttgatgaaggtatcctggaaaaaaagaataaacccgtccgatatttcatcaaagagccaggcttttttgaaaatggacaccatgccacataa

SEQ ID NO: 5647 - DNA, 1281 bp, Cyanothece PCC 8801
atgctttcccctgacactcaagctattttacttctttgtgcaagttttggtcaaaatcgtcaaaccgaaccctttcctttaactcttggtgaatataatacccttgctggttggttaagagcagaaaatatgtttcctcaagacctacttaaccctaattttatcagtcgtctttctcagttaaccataggtaaattagattctaaacgattagttgcattgctacaaagagggggattattagctttgactgttgaaaaatggcttaatcaaggtttatggattattagtcgtggagatgctgactatcccctgcgattaaaacaacaattaaaatatttagctcctcctattttatatggaattgggaacaaagatttattatcaaaaggggggttagctgttgttggttctcgtaatgtggatcaagaaggattagactatacttatcacgttgtagaagcttgtgcagaacaaaatattcaagtgatttcaggaggtgcaaaaggggttgatcaagcttcgatgttaggaacgttaaaagtaggaggtacagtgattggcgtattagctaataacttacttaaagcatctgttgatggaaaatatcgtaccagtattaaagaaggaaaactaactttaatttctgcggttgatcctaatgcttcctttcatgttggtaacgctatgagacgtaataaatatatctatgctttggctaattatgggttagttattagtgctgactataacacaggtggaacatgggcaggagcaacagaagctttaaatacaattaaggatgtccctattttagtgcgaatacagggaacaatatcagaaggcaatcaacatttattaaaacaaggtgcaaaaccttttcctgaaactccttggaatcgtccgattaaagaattaattgaaactactgtatcagaatataaaagcatagaatttcgtcaaaataatactcaattgaatttatttagtcaggataatcattctgttgtttctgacaataaagatgaacttacaccgcaagatcctgatatctcttcccgtgatgatgctttgaaatcggcctcagaaagactttattatgctgttttacctatcattcttcaagaactaaaccaaccacaagatccgaaatctttagcaactaatctagatgttcaagttggtcaactaagcaaatggctaaaaaaagcagttacagataaaaaagttatcaaacagactaaaaataaccaagttatttataaatcaaataaagtataa

SEQ ID NO: 5648 - DNA, 1266 bp, Dehalogenimonas lykanthroporepellens BL DC 9 uid48131
atgaacacaatttcagaaaatacacaggctatactactgctcaccgctcctttgatagtaagccggggcgctgtgccaactaatatcctgacgcacaccgagtacaaaaaactggcaacttgcctgatgacgcttgaaaaagagccagctgacctgctgggcgagaaatcagaggaattactagatgcactgaccggcctgttcgacaagtcacgactgggaagcttgctggagcgcggatttcttctcagccaagcgaccgattattgggcggcgcggggaatctgggttatcagccgcgccgaccaggaatacccaagcagatttaaggcgaaactgaaggacaattcacctgcgatattatacggatgtggagaccctagtattctggaagggggagggctggcagtagtcggctcccgaaaggttgatgaacaactacgcgactatgcccaaaaagtcggccggctcgccgcggcaggtaatatcggcatagtgtccggcggagcaagaggtattgaccgggcatctatgaggggggctttggaatgtgaaggacgggcggttggtgttttagcggatagtttgacaaaagcgtcggttgagagagaaaaccggcaattttttattgacgaaaggctagtgctaataacacctttcaacccttcagccggtttcaatgtgggcaacgcaatgaatcgaaataagcttatctacgcactggcagatgccgcattggtggttaattcggattacaaaaccggcgggacatgggccggagcttatgagcaactgaaaaaactgaaatacgcgcgagtgttcgttcgtaacagcaaaggggaatcaaaagggctggaagaattgtcaaaattgggagccgaggaatggccggagcctgaagataaatacgacttacagaacatcttgatgaactccccgcaaaaagaacagccggtccaacccgaaatgccaatgatagcagaagaccaagctataccggaagttgccataattaccgatgaaccaaaatcaaaccagaataacccggaacccgatgaagaagtagtgactgaagatttaggaaccaggatactgaaagctctgaaaaaagacccaacaccgacaacccccaccagcctgattaagacgttaggcgtaaaaaatactgaaataaatagttgcttgaaagccttgttaaaggaaggcaaagtccagaagttaaccaaccctgtgcgttatacgataatgcctcctaaaatgatctaa

SEQ ID NO: 5649 - DNA, 1242 bp, Desulfitobacterium hafniense DCB 2
atgaataatatgttaagtcaagacagtctggctatggtgttattatgtacgacggtcggcctcagtaaagataatacggagataaggccgttaacgattaagcaatggaatcagtttctaagaagaatgttcaatgctgaaataaagaatccggcagctttatttgaggtggggaaagaggacctgaaaaagaggttaggtctgagtgacgaggaaagccagaggatccaatttcttttgagcagggcagggcaggccgtcgtcgagttggagaacttaaacaatatgggcatctttgttacgacacgtgccgaaaaaagctatccgcaaagactcaagagtgtattgaagaaagattctcccccggttttgttctattccggcgatatcgaattaactcaaatggaaggcatcggtattgtcggatcaagaaatattgatcctaaaggactggaatttaccaaagaacttgggtcaaagtcggccaaacaaggattaacggtaatttccggtggtgcaaaaggggtcgatgaagtggctcagaatgaagcgcttagacaaggcgggaaagtcatcagcatccttgctgatagtttagcgcaaaagatcaagcataaagaagcaagagaagcgattatggaacaaagacttttgctgcttacttcgtttcatccccgggcaccctttaccgtttataatgccatgcagcgcaataagtacatctatgcattatctcatatcgccgtggtagtttcatctgattacagcaagggtgggacttgggctggtgccacagagaatttaagaaataaatgggtcccgctgtttgtgaggaaagatgatattgtgccggagggcaatgaaaaattgcttaaaatgggtgcaaaccctttgtcggcaaaagatcttttctcggaatcctttaatgccaacaggctgtcttcccttgctgatcaatattatgaacaggggtcgctgttttcagtttcaaatttacttgagaaagagacggattatcaggtctccaatgattcaggtgaatcggatcatgaggaaagaatcgacctttttccagtcatttggccgtatctggagagtgcattgcagaaagcaagaaccaaagaagaactatgcacaatgttgcatatccatggaaaccaaatgaaaatctggcttgaacgggcgcttgcagagcagaaaatcaaaaaaacacgaaagccagcagggtatatcgtgcaatag

SEQ ID NO: 5650 - DNA, 1206 bp, Desulfitobacterium hafniense Y51
gtgttattatgtacgacggtcggcctcagtaaagataatacggagataaggccgttaacgattaagcaatggaatcagtttctaagaagaatgttcaatgctgaaataaagaatccggcagctttatttgaggtggggaaagaggacctgaaaaagaggttaggtctgagtgacgaggaaagccagaggatccaatttcttttgagcagggcagggcaggccgtcgtcgagttggagaacttaaacaatatgggcatctttgttacgacacgtgccgaaaaaagctatccgcaaagactcaagagtgtattgaagaaagattctcccccggttttgttctattccggcgatatcgaattaactcaaatggaaggcatcggtattgtcggatcaagaaatattgatcctaaaggactggaatttaccaaagaacttgggtcaaagtcggccaaacaaggattaacggtaatttccggtggtgcaaaaggggtcgatgaagtggctcagaatgaagcgcttagacaaggcgggaaagtcatcagcatccttgctgatagtttagcgcaaaagatcaagcataaagaagcaagagaagcgattatggaacaaagacttttgctgcttacttcgtttcatccccgggcaccctttaccgtttataatgccatgcagcgcaataagtacatctatgcattatctcatatcgccgtggtagtttcatctgattacagcaagggtgggacttgggctggtgccacagagaatttaagaaataaatgggtcccgctgtttgtgaggaaagatgatattgtgccggagggcaatgaaaaattgcttaaaatgggtgcaaaccctttgtcggcaaaagatcttttctcggaatcctttaatgccaacaggctgtcttcccttgctgatcaatattatgaacaggggtcgctgttttcagtttcaaatttacttgagaaagagacggattatcaggtctccaatgattcaggtgaatcggatcatgaggaaagaatcgacctttttccagtcatttggccgtatctggagagtgcattgcagaaagcaagaaccaaagaagaactatgcacaatgttgcatatccatggaaaccaaatgaaaatctggcttgaacgggcgcttgcagagcagaaaatcaaaaaaacacgaaagccagcagggtatatcgtgcaatag

SEQ ID NO: 5651 - DNA, 1287 bp, Desulfotalea psychrophila LSv54
atgagtaactatttaacagatgatacaaaggcaataatcctgctttgcggattctttggaaaagacagctctaccaagccattgtcgcagggagattacaacaagcttgttgattggttgatcagttctggcatgcgaccaaaagatttgctacagcaagaaaacatcgacccagcagcaaaaggatcaggaatataccaacaacggttagaggccttgctcggacgtggagttcaactaggcttcgccgttgaggagtggcagcgtaatggtatctggattattagccgaagtgatactgactacccaacacgatacaaaaatcatttgggtaagcaagctccgccattgctttttggtgttggtgatcgctcgttactaactggtggtggtctcgcgatcataggttctcgaaatgtagatgaaataggcgggaattttacacgagaggtaggtgcattatgtgctcagaataggatgcctgtcgtgtcaggtggtgcccgtggtgtagatcagttttcgatgacagcggcacttgatgccgggggcatgactattggagttcttgccgatagccttctgaaaaagagcctggaacgtactgcgcgtaaagcaattgcaaggggaaggctactactcatttctgcttgtcaccccaatgcacggttcaccgttggaaccgctatggggcgaaataagcttatttatgccatggctgattatggtctggttgtaagcgccgaacataaaaaaggcggaacttgggctggggcagatgaagagttaaaacgagaacactctattcctgtgttcgtgaggcaagggaacgatgtcccactcggcaattcaaagcttttaggcttaggtgcaattgcttggccagacaaggttgaccatcaaaatctaaggggacagcttactgagctttcgtcccaatgtgcccaaaagagtactcagaaaaatatgagcctactcgactttcaagagaggcaaaaagaaccggccaaggagctccctaaagcagagagtatcgaattaaccgagtcttccaatgttgttgaagatactgctgcaaaacactcagtcactacagtgtatgaaactgttttgcccctcatattagaaaagcttgaatcccccacaacggttgacgaactaatatcatcgctggatgtggttaaaacacaactcaatgtatggttgaaaaaagcacttgaggaaaaaagagtggttaagctgacacgtccagtaaaatatcaaaggattagttcgaaagaacagacgtaa

SEQ ID NO: 5652 - DNA, 1362 bp, Desulfotomaculum acetoxidans DSM 771
atgaaaaataatctttccgaagacagtctggctatattgctgctgtgctctaacctagcgacttacggtaaaacgggaagtttctttaaaccatttacactaaaagaatgggacagtctttcccataagataattgaatcggtaatgaaaagaccaggtgcctttttttacacgactcctgaagagtggcgggaatgtcttaatttaactcccgaaaacatacaacgcatacaaaatttgctaacagagggcgggcaactgggaattgaattagaaagactgagcagtctgggaatatgggtgacaacaagagcagaggcaagttacccggcgcgacttaaaaaagttttgaggcagaaatcacctgtagtactgttcggggcaggtgatgcgtcactttttcaatctgaaggtgttgctattgtaggttcgcgaaatgttgatgagattggttcttactttgcagagaaactggccgggcgatgtgttacagaaggtctgacagtggtttccgggggtgcccgtggggttgatatgattgcacagaattcagcccttcgctcgggaggcaaagttatttctgttctttctaacagtatggaaacaagtatcagacagagggaaaacagagaagctattgttgccgggcggcttttactgctgtcgtcaactcaccccaaagcaccttttaatgtttataatgctatggacagaaataaatatatatatgctctctcccactatgctgtggttgtatcttctgaggaaaataaaggcgggacatggactggggcaacggaaaacttgaaagcaggctgggttccgctgtttgttcgtgtagggggacaggttcctgcgggtaataatcgtttgctggagaagggcgcaattgcctttgactcggaagtcctggcagatgaggctgttatactacgtaattggttgagcgataacattcaggtaatagttaactatgaaagtagcaaaagaaatgaaaataacataagctcgcctaagaaggatcaccaattggcttttagatttgatgactcaactgtgtctcaccagatattggataatccagaacaacttttcgcaggtaatgatttatttacagtagtttggccgtacattgaaaaggtattagaaaaaagtcagaaaactgaaaaagagctggcagaaatgtttaatgtccggtctgtgcagattcaggattggctgaaaagagctgtagatgagcaaaaggtgaagaggcttataaaacctgtccgttatgtggtggcttcttatggtccaagtgggcaggagagactgccagttggtaatattgagcaggcggtggtttttgagtcttgtgagtga

SEQ ID NO: 5653 - DNA, 1203 bp, Escherichia coli 83972
atgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcccatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggtgaaggtcattatcagttcaggtaa

SEQ ID NO: 5654 - DNA, 1206 bp, Escherichia coli ABU 83972
ttgatgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcccatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggtgaaggtcattatcagttcaggtaa

SEQ ID NO: 5655 - DNA, 1203 bp, Escherichia coli B088
atgaatctttcagccaatgcacaagcgactctcctgctaaccagcgatttttctcgcgcggcggcgagtgagcataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgcggtcatagtctggcgttggcggtagataagtggcaacgcgccggtttatggatcataacccgaggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtgcgtttcaccgtcggcaatgcgatggcgcgaaataaatatatttattgccttgctgaaagcgcaatggttgtacgtgcgggaatgaccggtggaacgataaccggggcgatagaggcattaaaacatcagtggctgcctgtgcaggttaaaccaaatcaggatatgcaatcagccaattcacgattagtagaaaatggggcgtcatggagtgctgaacaggctgagaatgtgccgatcagactgtcagacgttcctgggctgatgtatgacagagcactccgtaacgctcaaccagaactgttttcgctgcatgaagatgacgcaaattacgcagtaatgcccgcgcatacgcctgtcgatttttatcaactctttgtggcggaactggcgatctttgcaaaggaatcgataagtattgaaaggctgtcgtcttgtactggtttaaccatcgaacaaattagtgtgtggctgaaccgcgcagaagaagagggaagggttatccgattgggcgaaggtcattatcagttcaggtaa

SEQ ID NO: 5656 - DNA, 1296 bp, Escherichia coli B185
atggacgctgacagttctgacagcactgttacgccaggcaggttgcccgacggtttatcctcttgcccttgcttctacctcggtaaaaaattgatgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacataagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcatgaagatgacgcaaattacgcagtaatgcccgcgtatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5657 - DNA, 1296 bp, Escherichia coli IAI39
atggacgctgacagttctgacagcactgttacgacaggcaggttgcccgacggtttatcctcttgcccttgcttctacctcggtaaaaaattgatgaatctttcagccaatgcacaagcgaccctcctgctaaccagcgatttttctcgcgcggcggcgagtgagtataaacctcttagtaatagtgaatgggggaagtttgcattatggctgaagcaccaacgtatcagtcccgccgatcttctggtgccgcaaccgcaagagaaacttacaggctggagcgatccgcgtatttctcaggagcgtattcttggcttgctggcgcgtggtcatagtttggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgccgatttgcgctatacccaacaactggcagcgaaactggcccaacaggggatttgcgttatctctggtggtgcgcgaggtattgatgaatgtgcaatggcgtcggcactggaggccgggggaactgctgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacaaagcactccgtaacgctcaaccagaattgttttcgctgcacgaagatgacgcaaattacgcagtaatgcccgcgcatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttattcgattgggcgaaggtcattatcagttcaggtaa

SEQ ID NO: 5658 - DNA, 1203 bp, Escherichia coli MS 185-1; identical to SEQ ID NO: 5653

SEQ ID NO: 5659 - DNA, 1203 bp, Escherichia coli MS 200-1
atgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgatgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgacgggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcctatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5660 - DNA, 1203 bp, Escherichia coli MS 21-1
atgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgatcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgtttttttttgctgcgggaataaagcattactgcaagcggaaggtatggcgattgttggctcgcgagatgctccgactgccgatttgcgctatacccaacaactggcagcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcaccgttttacccagaggtacgtttcaccgtcggcaatgcaatggcgcggaataaatatatttattgccttgctgaaagcgcaatggttgtacgtgcgggaatgaccggtggaacgataaccggagcgatggaggcgttaaaacatcagtggctgcctgttctggttaaaccaaatcaggatgtgcaatcagccaattcacgattagtagaaaatggggcgtcatggagtgctgaacaggctgagaatgtgacgatcagactgccagacgttcctgggctgatgtatgacaaagcactccgtaacgttcaaccagaactgttttcgctgcatgaagatgacgcaaattacgcagtaatgcccgcgcatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttattcgattgggcgaaggtcattatcagttcaggtaa

SEQ ID NO: 5661 - DNA, 1203 bp, Escherichia coli MS 45-1; identical to SEQ ID NO: 5653

SEQ ID NO: 5662 - DNA, 1203 bp, Escherichia coli MS 69-1
atgaatctttcagccaatgcacaagcaaccctcctgctaaccagcgatttttctcgcgcggcggcgagtgagtataaacctcttagtaatagtgaatgggggaagtttgcattatggctgaagcaccaacgtatcagtcccgccgatcttctggtgccgcaaccgcaagagaaacttacaggctggagcgatccgcgtatttctcaggagcgtattcttggcttgctggcgcgtggtcatagtctggcgttggcggtagataagtggcaacgcgccggattatggatcttaacccgcggagatgccgattatcccgttcgcttgaaaaaccgattgcgaacggatgctcctcccgttttatttggctgcgggaataaagcattattgcaagcggaaggtatggcgattgttggctcgcgagatgctccgactgccgatttgcgctatacccaacaactggcagcgaaactggcccaacaggggatttgcgttatctctggtggtgcgcgaggtattgatgaatgtgcaatggcgtcggcactggaggccgggggaactgccgttggcgtattagctgatagtttgttaaaaacaagcacgttagtgaaatggcgtaaagggcttatagcaggcaacctggtgttgatttcaccgttttacccagaggtacgtttcactgtcggcaatgcgatggcgcggaataaatatatttattgccttgctgaaagcgcaatggttgtacgtgcgggaatgaccggtggaacgataaccggagcgatggaggcgttaaaacatcagtggctgcctgttctggttaaaccaaatcaggatgtgcaatcagccaattcacgtttagtagaaaatggggcgtcatggagtgctgaacaggctgagaatgtgacgatcagactgccagatgttcctgggctgatgtatgacagagcactccgtaacgctcaaccagaattgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5663 - DNA, 1203 bp, Escherichia coli O103 H2 12009
atgaatctttcagccaatgcacaagcgactctcctgctaaccagcgatttttctcgcgcggcggcgagtgagcataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgcggtcatagtctggcgttggcggtagataagtggcaacgcgccggtttatggatcataacccgaggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtgcgtttcaccgtcggcaatgcgatggcgcgaaataaatatatttattgccttgctgaaagcgcaatggttgtacgtgcgggaatgaccggtggaacgataaccggggcgatagaggcattaaaacatcagtggctgcctgtgcaggttaaaccaaatcaggatatgcaatcagccaattcacgattagtagaaaatggggcgtcatggagtgctgaacaggctgagaatgtgccgatcagactgtcagacgttcctgggctgatgtatgacagagcactccgtaacgctcaaccagaactgttttcgctgcatgaaaatgacgcaaattacgcagtaatgcccgcgcatacgcctgtcgatttttatcaactctttgtggcggaactggcgatctttgcaaaggaatcgataagtattgaaaggctgtcgtcttgtactggtttaaccatcgaacaaattagtgtgtggctgaaccgcgcagaagaagagggaagggttatccgattgggcgaaggtcattatcagttcaggtaa

SEQ ID NO: 5664 - DNA, 1203 bp, Escherichia coli O150:H5 SE15
atgaatctttcagccaatgctcaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgaattcttggcttgctggcgcgtggtcatagtctggcgttggctgtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcccatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5665 - DNA, 1296 bp, Escherichia coli O157:H7 EC4076
atggacgctgacagttctaacagcactgttacgccaggcaggttgcccgacggtttatcctcttgcccttgcttctacctcggtaaaaaattgatgaatctttcagccaatgcacaagcaactctcctgctaaccagcgatttttctcgcgcggcggcgagtaagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcatgaagatgacgcaaattacgcagtaatgcccgcgtatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5666 - DNA, 1296 bp, Escherichia coli O157:H7 EC4113; identical to SEQ ID NO: 5665

SEQ ID NO: 5667 - DNA, 1296 bp, Escherichia coli O157:H7 EC4196; identical to SEQ ID NO: 5665

SEQ ID NO: 5668 - DNA, 1296 bp, Escherichia coli O157:H7 EC4401; identical to SEQ ID NO: 5665

SEQ ID NO: 5669 - DNA, 1296 bp, Escherichia coli O157:H7 EC4486; identical to SEQ ID NO: 5665

SEQ ID NO: 5670 - DNA, 1296 bp, Escherichia coli O157:H7 EC4501; identical to SEQ ID NO: 5665

SEQ ID NO: 5671 - DNA, 1296 bp, Escherichia coli O157:H7 EC508; identical to SEQ ID NO: 5665

SEQ ID NO: 5672 - DNA, 1296 bp, Escherichia coli O157:H7 EC869; identical to SEQ ID NO: 5665

SEQ ID NO: 5673 - DNA, 1296 bp, Escherichia coli O157H7 EDL933; identical to SEQ ID NO: 5665

SEQ ID NO: 5674 - DNA, 1203 bp, Escherichia coli O157:H7 TW14588
atgaatctttcagccaatgcacaagcaactctcctgctaaccagcgatttttctcgcgcggcggcgagtaagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcatgaagatgacgcaaattacgcagtaatgcccgcgtatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5675 - DNA, 1296 bp, Escherichia coli 536
atggacgctgacagttctgacagcactgttacgccaggcaggttgcccgacggtttatcctcttgcccttgcttctacctcggtaaaaaattgatgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggctattgttggctcgcgagatgctccgactgatgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgacgggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcctatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5676 - DNA, 1296 bp, Escherichia coli CFT073
atggacgctgacagttctgacagcactgttacgccaggcaggttgcccgacggtttatcctcttgcccttgcttctacctcggtaaaaaattgatgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcccatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggtgaaggtcattatcagttcaggtaa

SEQ ID NO: 5677 - DNA, 1203 bp, Escherichia coli SMS 3 5
atgaatctttcagccaatgcacaagcgaccctcctgctaaccagcgatttttctcgcgcggcggcgagtgagtataaacctcttagtaatagtgaatgggggaagtttgcattatggctgaagcaccaacgtatcagtcccgccgatcttctggtgccgcaaccgcaagagaaacttacaggctggagcgatccgcgtatttctcaggagcgtattcttggcttgctggcgcgtggtcatagtttggcgttggcggtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgccgatttgcgctatacccaacaactggcagcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtactgaacaggctgagaatgtgacgttcagactgccagacgttactgggctgatgtatgacaaagcactccgtaacgctcaaccagaattgttttcgctgcacgaagatgacgcaaattacgcagtgatgccctcgcatacccctgtcgatttttatcaactttttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5678 - DNA, 1410 bp, Kingella denitrificans ATCC 33394
atgacgccagtcctctctcccaacacccaggcgatcttgctgctgactgcgccgctcattgccggacgaggctctgcgtcatcggatctgctctcgcttggtgaatacaaacgtctcgcgcgtcatttgcgcgagatccagcgtcagcctgcggatctcctctcgccggacgcagctgagatcttgcgcgcgtgccagccggtgattgacgagggtcgcctgcagaaattgctggggcgcggattcctgctgagccaagtgatcgagcgctggcaaacgcgcgccatttgggtggtcagtcgcgccgacgccgagtatccgcgtcgcctgaagacccgccttcgtgaagatgcgccggcagtgctctacggctgtggcgacatggctttgctcgaaaccggtgggcttgccgtcgtcggatcgcggcatgtggacgacgccctcatcgactacaccatggcagttggctggctcgctgctcgggcaggcagaacgcttgtctccggtggcgccaagggcatcgatcaggccgccatgcgaggtgcgcttgagggaggtggaaaagtttgtggcgttctggcggacagtctggaaaagaccaccatgaaccgcgagcaccgcaacctgttgctggatgggcagctggtcctgatttcgccctacgacccgagcgccgggttcaatgtgggcaacgccatgcagcggaacaagctgatttatgcattggcagacacctcactggtggtcagttccgatctcaacaaaggtggcacttgggcgggtgctgtcgagcagctcgacaaactcaagttcgtcccggtcttcattcgttcgacaggcaagtcttcagccggattagatggtttgcgaaagaaaggcgcacttctctggccgaacccgcaagacgtggattcgttcgaggacgtgttcaacgtggcgatgccgacgccgacggcatccccacaggttggttttgcgctgttctcgaacgaagacccatcgtcggctgataccaagccaacgacgcctgtgtcacccgacaccgcgcccgcgccccaggccgcgagtgagtcatcggcaccggtcgacgttgttttcgatgcgcagccacccgctgaggcatcggaagaactgccgccagtcacaccagaggccgtagcgccgatagatgaggccaaggaatttccgcagccggaatcgacccctgccgaagtgctcttcgctgccgtgcgcacagcgattcagcaactcttgagtacgccgatgaaagacgccgaagtagcggccgcgttggatgtttctaacgcgcaggccaaggcatggttgcagcgtttggtcgacgaaggcgtattagaaaagcagaagaagccagcgggctacgtcgtgaaacaaaagcggctgttcgagtaa

SEQ ID NO: 5679 - DNA, 1350 bp, Lyngbya sp. CCY 8106
atgatggtgaattctactgtttctgctgatactgaagcgatattattactctgtgcaagttttggagaaaatcgacaaaccgaacctcaacccttaacgctgagagagtataatctcttggcgaaatggttgcaagaaaatcagatgcgacctcaagatttattggataaaaatattcaaatagatctgcaaaatctccataatgataaactcgatcctaaccgaattcaggctttacttgaacggggtgcaatgctcgcttttgcagtggaaaaatggacgaatcaaggagtttggattataggtcggggtgatgggaaatatcctcaatttctcaagcaaagattgaaacattctgcacctgctattctttatggtgtgggtgagatagaattactttctaaaggaggattagcagttgttggttcgcgagatattgacgatgaagcggtagaatatactcaaaaaattgctcgaatttgtgcagaagaaaaaattcaaattatttcagggggagcgaaaggagttgatcaagcgtcaatgttggggatattagaagcgggaggaacagcgatcggtgtgttagcagatagtttactcaaagctgcaactttgggcaaatatagagacagtattcgagagggtcaactaactttaatttcgacctacgatcccaacgctggtttttctgtcggtaatgcaatgggacggaataaatatatttatgctttggcaaattatgctttagttattagttcttctgtggggaaaggtggaacttgggcgggtgcaattgaagcgttaaaaaaaatgaaagaggttccgctttgggtgcgaatggaagacaatgttcccgaaggaaatcaacaattggttgagcaaggtgcaagagcgtttagactgattgagtggaatgattatctacataattttctcttaaaatcgccagaattggttttacaaaatattgaggataaaaacgagcaagaggaagaaaaacaatcagaaaatcagtctaatttagaagaaaatgtagaaacacatccggctgaaatagaggataaattgagtgataatgaatcaacttctgaagaaaacccgttagtagaagaaccaattagttctgtttctcctgctgaagaaatttatcaagcggttctacccattctattaaaacatctacaagagcaattagatgataaatctctcgctgaacgtttagatgtaaaaatcggacaactgcaagaatggttaaaaaaagcggtagcagaagataaagttaagaagctcaaaaagccagctaaaacctatgttattgctgataaaaaattacttgatttcatcaattaa

SEQ ID NO: 5680 - DNA, 1287 bp, Maribacter sp. HTCC2170
atgatttcagaacgtacaaaagccatattacttttaacctcttatttttcaaaggattcagataaaaaaaataagcctttatctctattagagtggaatagaatggtacgctggttacagtccaaaaaacttaaaccagaagaccttttaactatagatttaaataaactattaattaattggaatgatacgactattccaaaaaacagaattatagagttgttagaccgaaaaatggctttagcaattagattagagaaatggtcaaaagccggtgtttggattattaataggagtgataaattttaccctaacagtttaaaaaacaagctaaaagatagagttccgcccatattgtttggtattggggacaaaaacttattgaataagaattatatcggaattgtaggttcaagacatatttctgaaacagatattaaagtcacaaaagatatagttaagcaattatatgctcaaaattatggagttgtatcgggtggagcaagaggaatagatgaacattccatgactggtattcttgaatgtaatggttatgcattaggtgtagtagcagatagtttaataaaaaaatcttcatcgtcaatctatagaaaacatattattgacaataaacttgttttaatttctccatttaatccagaagttggatttaatgttggtaacgctatgggtagaaataaatttatttatattttatctcaagcggctattgtagtgaaatctgaaactaaaggaggaacttgggaaggcgcaaacgaaaatttaaagaataattgggcaccattatgggttgttaaaccaattgagaataaaacaaataaagggaattttgaaatagtaagaaaaggagggcgttttttgcatgaaggatttaatgtttcaaatattattaatcctaaagataaatcgataaaagctcaaggttctttattcaattataatattaaaatagaagaatctaatatagttaatgaaagtgaagttaaatctatcgtaataaagtctaaaacctctttaagccctgataatgataaaataagagttgaggaaataacattttatgacttatttatttataaatcatcatcctattttaaagataaagaattcaatcgggaagaaattttgaatcattttgaattagcatcaaaacaaatagatgattggttaaaagttgcagttaaggataaggttttactaaaaaagactcgcccagtacgctatttattgaatccaaaggctaagataaaagctcttaatgtatag

SEQ ID NO: 5681 - DNA, 1383 bp, Marinobacter aquaeolei VT8
atgctcgctgctaaaacacaggcaatcctgttactgaccgcctatttttccaggtcaacaagctcagaagcaaagcctctcacgaataaagagtgggggcgttttgccttctggttgaagaaccaggaaatggtccccgaggatctcctgacaggggacctcagtcaaaaactggcgggatggacagactccaagattacatccgaccgcattcaaaccctgctcaatcgtgggtccgccctggcaatggcgatggaaaaatggacccgctccggcttatgggtgttgacgcgctcagacagtgactaccccaaacgtcttaaagcacgcctcggtaatgatgcaccccctgtcttcttcgggtgtggcaaccgcaatctcttgaaccaaggtggcattgctgtcatcggctcccgtaagacatctgacgcggatcttcagtttagccacgatcttggagctaagtccgcaaacgatgggcgatctgtcgtatccggcggtgcaaaaggcgtcgatgaagccgccatgctgggtgcccttgaatctgaaggtacggcaattggggttctcgccaatgacctgctgcgcgccgccacctccgcaaagtacagaaagtacctgatggcgaacaatctggttctcctctcacccttttatcctgaggccggtttcaatgcgggcaatgctatgcagcgcaacaagtacatctattgcctgtcggatgcagccattgctgtgcattccggaaactcaggtggaacctggaacggggtgttagaaaacataaagcacaactgggtacccatgtggatcaagcctaccgacgacccggaggccggcaatgccacactggtgcaaaaaggtgctaaatggctacctgaaaatctcgctgaaatcgaccttgaccacttgctgcgaaccgcagattcatctgcagaacagggtgctgatttatttgctcaaaaccggacagaaaccgtgcccgaggtaactgtaaacgaacctctggctcacacgacgggccaacaagaagaaaacgaagtagcgtcgaatgaggttgtcaaagagactgctgaagacgcttccaagtcttcaccgaagcaggaacacgcaaccccctcgccggtttcgagtgaccaatgcgaagaaaaaacagctcttacgcagctttccttgtacgaccactttctcctgatgcttagaaatgaaacaggctcaccaaaaaccattgatgaattgttggaagctacacagcttcacaaaacccagcttaacgaatggttaaaacaggctgtcgcggatgacaaggtgaccaagttaaatcgcccggctcggtatcagtgggtggaagacaatcaacgcaagatgttcgaggatcagtag

SEQ ID NO: 5682 - DNA, 1281 bp, Microcoleus chthonoplastes PCC 7420
atggattaccatctgctgtcacccaatactcaagctattttattattgtgtgccagctttggacaaaatcgtcaaactgagcctaaacccttaaccctgagcgagtataatacggttgcaacttggttgctggaagaacatttgaatccagcggatttgcttaattccactctgaaaaatcgcttatctcaaattaccattaacaagcttgattctcagcggttaattgcgttacttgagcgcggtgttatgctcagtttagcggtggaaaagtggacgaatcaggggttatggatattgggacgaggtgacgcagattatcctcaatgtttgaagcagagattgaaacataatgcacccgcgattctctatggaattggtaagagagaattgctttctcaagctgggttggctatcgttggttctcgtgaagttgatcaagaaggacttaattataccgaaagagttgtccagatatgcgctgaacaaggaatcaatgtgatttctggtggggcgcgtggagtagatcaagcttcaatgttaggtatattagcagcaggtgggaatgctgtgggtgtacttgctgatagtttaacgaaggcggctgtggcgagtaagtatcgtgctggaattaaagaaggtagactgacattagtgtctgcgtatgaccccgatgctagtttcagcgcgggtaatgctatggggcgaaacaagtatatttatgcgttagcggattatgcgttagtgattagttctgctgttggtaaaggtggaacctgggcgggggcgactgaagtgttgagaaaggtacaagatgtcccggtttttgtgcggatgcagggaactgtacctgaaggaaatcagaaattgctggaaaagggaggaatcgtttttccagaaatcccttggaataagccattgcgtacacttttagatgcagctatagctgaggttgaagaaagcaaagttgatggggaagtaatagagtctgagaaatcctcagccggagatgatttaggcggggataaaacgatttatattaatttacccgctaaagatatttatgaagcggttttaccttttatcctcaaccagttagagcaacctcaagatgcgaaatctctggctgaatcgttgcaggtacgaaaaggacagatggaggattggttaaaacgagcggtgcaagaggggaaagtgattaagcagaagaatccggtgatgtatgtagtgaataaagaatttaatttattggctttgctggaaaaggatgattctggataa

SEQ ID NO: 5683 - DNA, 1374 bp, Nitrococcus mobilis Nb-231
atgctgaccgcccatacacaggctgttttactgctgacagcgcatttccccggaacacaagccggggatagcagtcccctcaccaatacagagtgggctgaatttgcctgttggctcaaggatcacgaccagcgtccggaagacttgcttgcagcggattttgctgggtacctggatggttggtcgcacaagaagatcacactagaacgccttgactcactgctggctcggggctccgccttggctatggcgctggaaaaatggcagcgggcgggtatttgggtgattacccggtccgatattaattacccaaaattactgaagaaaaaactgggccagaaggcgccgcctgtattctttgggagtggcaacagcaggctgctcaaccaagcggggatcgctatggttggctcacgccggagcactgagcaggatctgcggtacagccgtgaattgggtgcatgttgtgccggcgctgcctatgccgtggtatccggtggcgcgcagggcgtggacgagtcggccatgttgggtgcgctagatgtcgatggtacagctgtgggcatactggccaaggaattgctgcgttcggccaattccaccaagtaccgtagacacttgatagcgggtaacctggcgctggtttcgccctttaaccccgaggccagcttcaatgcaggtaatgccatgcagcgcaataagtatatttactgtatggcccaagccgccatttccgtgcactccggcaccagcggcggcacgtggaacggcgtgcgagaaaacctcaagcatggttgggtgccgatgtggattaagcctacgcaagaccccgaggcaggcaatgcactactggtgaaagaggggggccactggttgctggataagccgtccgagatcgattttgccgggctcgttcagcctgctagcgtccccaagccttcgggcgagctgatgtcgttggcacaatcggcggtgcctgctaacggcgatcgcctggaggccgccaacatcagcctgcaagcagccagcgagttacccgaaaacgatgccctcgcagtaaagtgtggcgcctccagccagacgcaatcggcaaccggcgctggtctgaaagtgccagatccatggcagtgggccttggaggctgccagcctgcccctgtacgagtatttcctacgcatcctcaagtaccaagccgccgccccaaaaaccatcgaggagctgcaggtactgcctcagcttgctaaggttcacaaggcgcaattgcaggcctgggtgaaaaaggctgcaaaggacgggcatatcgacgaggtgtcattggagggtaaaaccgtctgctatcaatggaatgaaagtagaaacttgaatttgctttga

SEQ ID NO: 5684 - DNA, 1410 bp, Nitrosomonas europaea
atgacgtcagtcctctcacccaacacccaggcgatcctgctgctgactgcgccgctcatcgccggacgaggcactgcgtcatcggatctgctctcgccaggtgaatacaaacgtctcgcgcgtcatttgcgcgagattcagcgtcagcctgcggatctgctctcgccggacgccgctgagatcctgcgtgcgtgccaaccagtgattgacgagggccgcctgcagaaattgctggggcgcggattcctgctgagccaagtgatcgagcgctggcaggcacgcgccatctgggtcgtcagccgcgccgacgcagagtatccccgccgtctgaaggcccgcttgcgcgaagacgcccctgcggtgctctacggctgtggcgacatggctttgcttgaaaccggcgggcttgccgtggtcggatcgcgccatgtggacgatgccctcatcgactacaccatgacagttggccggctcgctgctcgggcaggtcgaacacttgtctccggtggtgccaagggcatcgatcaggcggccatgcgtggcgccttggaggctggaggcaaggtctgtggcgttctatcggatagcctggaaaagaccaccatgaaccgcgagcaccgcaacctgctgctcgatggtcaactggtgctgatttcgccctacgacccgagtgccggcttcaatgtcggccacgccatgcagcggaacaagctgatctatgcattggcagacacctcactagtggtcagctccgacctcaacaaaggcggcacttgggcgggcgctgtcgaacagctcgacaaactcaagtttgtccctgtcttcattcgatcgacgggcgagtcttccgccggattggatggtttacgaaagaaaggcgcacttgcctggccgaacccgcaagacgtggattcgttcaaggacgtgttcaacgtagcgatgccgactccgacggcatccccacaggttggttttgcgctgttttcaaacgaagaaccaacgtcggttgacgccaagccaacggtgcccgtgccacccgacaccgcgccagcgccccaggccgaaagtgagccatcggcaccggtcgacgttgtttccgatgcgcagccacctgcaccagcattggaagagcagccgtcagtcacgccagaggccataccgccgatagacgatgccatggaatctgctcagccggaatcgagcccagccgaagtgctcttcgctgccgtgcgcgctgcgattcagcaactcttgagcgcgccgatgaaggacgccgacgtggcggccgcgctggacgtttccaacgcgcaggccaaagcgtggttgcagcgcctagtcgacgaaggcgtattggaaaagcaaaagaagcctgcgggctacatcgtcaagcaaaagcggctgttcgagtaa

SEQ ID NO: 5685 - DNA, 1248 bp, Nostoc sp
atgttaaatcatgttttgccaccggatactcaagcaattttgctcttgtgtgctagctttgggcaaagtcgccaagttgaaccacaacccttaaccttaagtgagtataattctttagctgaatggttgctgcaacaggaaatgcgtccagcacatttactcgaatcaacagtaaaagaacaattaaaacaacttcatatcagtaaacttgaccctgagaggctgttagctttattagcacggggcgcaatgctaagtttagccgtagaaaaatggacaagtcgcggattatggatacttggacgtagtgacgcacagtatcctaaactactgaaacagcgtctaaaacattcagcaccagcaattctttatggcgttggcaagattgaacttttgtcacagggaggactagcaattgtcggttcccgtgacgtagatgaagagttacttgcttatacgcgaaaagttgcagaaactagcgctttagacggaatgcaggtaatttccggtgcagcccgtggtgtagaccaagaggctatgttaagtattttgaatgctggaggcacatctgttggtgtactggcggatagtttgaccaaagccgcagtcaatagcaagtatcgctccagtcttaaagaaggtagactagcgctaatttctagttatgatcctgacgctggtttcaatactggtaatgcaatggggcgcaacaagtacatttatgctctagctgattacgcccttgtagttaattcttctttcggtcaaggaggtacttgggctggtgcggtagaggctctttctcgactcaaagaaataccagtctttgtgcgaatggctccaaccgcatcagaaggtaatcggcaattacataatcagggagcaaaaccttttccacctgaaccttggaatggttctttaaataaactattagcaaaagctagttctctggttgaatcgattgataccaatatcatccagcttcctccagaaaaatcccaggatacacaaagccacgagttatcatcaaccccgcaaaacatctatgaagctgttttacctttcattcttggtcatttacagcaaccaaaggatgcaaaaactttggcacaatgtttagaagtccaaccatctcaaatgcaagaatggttgaaaaaagcagtacaagaagggaaagtgagaaaaactaataggccagtggcttatatagctaatcaacttgtcactcaactttctttattgtcataa

SEQ ID NO: 5686 - DNA, 1260 bp, Oscillochloris trichoides DG6
atgacagtaactgcacatctgctcacccccgatacacaggcaattcttctcttaacgggaagtctcggtcaggtgcgtggacgtgatgttcagcccctttcggcgagtgaatatcatcaggtagcacagatccttcatcgccatcagttgcgtccggctgatctgctcgaaggatctggtctttcctgcctacgcgatgcggaaccactgcaattcgacagtgatcggattgcgcgtttgttaagccggggcgctgcgttagggctgatcatcgaaacatggacgaaccgtggcctatgggtgattagccggagcgatccgcagtatccgcagcgattacggctgcgcctaggcaagagtgcgccgccaatcttgtatggcgtcggcaaccagaaattactcgacacaggtggcttagccattgttggttcacgtgagattgacgatgcggcggtcgcctttacccgtactctggcaacacgatgtgcacgtgatgctgtgcaggtggtttctggtggcgcacgcggcgttgatagtgaagcgatgatgaccgcattggaagcaggtggtaccgctatcggggtacttgccgagagcctagttaaagctgcggtggccgggaaataccgttcggcgcttcgggcagggcagataaccctgataactgcttatgacccagaggctggttttagtgtcggcaatgcaatggggcgcaataagcagatctatgccctgagtgactatgcgctggttgtgagcgcatcgttggagcagggcggtacatggagtggcgctgtcgaaaatctcgcccagcagtgggtaccgctctttgtacgagcaactcagccaatgctccccggcaatcagcgcctgatcgagcgtggtggtacggcgttcactgatctgatcctcgcgtcgggaacatcaatccggctatggttagaacagcagattgaaagtcatttagagcctatcaccaacaaacagttacaaagtaatgatgagccagatcaacagactaaacctaacaacaaggaatctgacctgtttcttgttatctggccctatcttgaggaagcactccaaatcgaacgaactgatcgcgagttggcagcgcacttcgcaatcgaattgacacaggtacgtgcctggttacagcgtgccatcgaagaccgtatggtcaagaaattgagtaagccggtgcgctatgtggctgtgcatagaacagcgcaagctacgatgctgcctctcttcccctga

SEQ ID NO: 5687 - DNA, 1320 bp, Pelodictyon phaeoclathratiforme BU 1
atgcaacaactctcttcgaatacaaaagccattcttctgctgacggctcccttgattgctggtcacggcagctcatcgcctgaccttctgtcgccgggtgagtacaatcgtctggctcgttatgtgcacgacatacatcacgaacctgccgatctgttgcttccgggagcagaaaatctgcatcgttcatgccagcatattgttgaggaaaaacgtatgcaaacccttcttgagcgtggctttttgctcagccaggttgttgagcagtggcaggcacgtgctctctgggtggtcagccgcgctgatgctgcgtatccccgacgcatgaaggcacgattgcgggaaggtgcacctgcagtgctttatggttgcggcgatatccatctgttggaaactggtggccttgccgtggtgggatcacggcaagtggatgaggagctgattaactatacaatgtcgatcggccaactctctgctcgtgcaggcaggacgattatttccggaggtgcgaagggtatcgatcaggccgccatgcggggcgctcttgaagctggcgggaaggtctgcggggttcttgctgatcgtctggaaagaacggcaatgcaacgtgaaaatcgcaatctgattgtagagggtcgcctggttctggtttcaccctacgatccaagtgcgggtttcaatgtcggcaatgccatgcaacgcaacaagttaatctatgccttgtccgatgcttcgctggtggtaaattctgatagtaataaaggcggaacttgggcgggtgcgattgaacagcttgagaaactacggctggttccagtctatgttcgatcaacgggaagcgcttcaactggtatcgatgccttgcgtgacaggggagctctgccttggccggagcctcatgacgtcgaggcgtttgaagctgtacttgacacatcgccatctctgattccagttgagagagaggcttccatcgggctcttctcgaacggcatggttcaagattcagtgacagagacggcgcaaaaaaagcctcaagtacaaattatggaggatatatctttacctcttcacatgtctgaagaggcggaactcagtccggcgcagagattgttcgctacggtacgagaggcgatacggcaattgttaaaaaaaccgatgacagatacagagattgcagagatattagagttgtcacctcttcaaacaagggtttggttgcagcgtctggttgatgaaggcctcttggaaaaaaagaataaacccgtccgatattgcataaaagagtctggattttttgaaaacgtaccccatgccacttaa

SEQ ID NO: 5688 - DNA, 1422 bp, Photorhabdus luminescens
atgaatttatcgccaacagcacaagccacattattgctcactagttatttttccaaggcgagcagtgatgatgtcaaacccctcactaatgctgaatggggtaggtttgcgttatggctgaaagaaaaatccacaacaccagcagatttgttggtatctgagcctaaatcaatattaagcacctggcaggattcccgcatcagcacagaacgcattatacagttactgaatcgtggccacagcctggcgttagccgttgaaaaatggcatcgagcaggtctttgggtagttacccgctctgatcctgaatatcccaagcgcttaaaacagcaattgaaaaccgactctccgcctgtgctatttggttgcggtaataaagctttactgaatgttggtggtttagcggttattggctcacgtgaggccaacaatgcggacttgtcttataccgagctggtcggttcaagagcggcatcagagggcattgcgattgtatccggtggtgcccgtggtgtggatgagacggctatggtgggagcaatgcttggtggcggcaacgttattggggtactggcagatagcctattgaaagccgctaccagcgcaaaatggcgcaagggtttgatgaatggcagtgtaatgctgatttcgcccttttaccccgaggctggcttcagcactggaaacgctatggcccgaaacaaatatatctattgcttggcagacagctcgctggtaattcactcggggaaaaaaggcggcacactaagcggggcagaagaaaacctgaaaaagtgttgggtgccattatgggtaaaaccaacgaatgacagtagcgcggcaaatactgatttagttgcgaagggagggcattggtgtgaggcagatgttcacaaccttaaggtttctgatttgttctccgtagaaaactctactgcttcgcagaaagaagctgaacaggttgatctatttttcatgccagcacagtcagaattatttgcgaaacctgcatcggaatttgatctagaggtagcggaaaatcgaataattgttgctcactcaatcgaacaagatgaaatccagggttcaatcgatcacgaagcagaagcagaagcagcagcagcagcagcagaagcagaagcagaagcagaagcagaagcagaagcagaagcagaagcagaagcagaagcagaagcagaaaaaactgtaatgcaggctgtggatttttatcaattgtttattactgagctccatcgattgacagtaagccctattacacttgatacccttatcgagaacactggtctgcataaatctcaattgaaggaatggttaaaacgagctattgatgagggacaagtgaaaaaactcggtcgtcctgttcgttatcaaatagaaaagaaaaatcaaaaagttgtttaa

SEQ ID NO: 5689 - DNA, 1371 bp, Polaromonas naphthalenivorans CJ2
atgcctgttctttctcccaatacgcaggctatcctgctgctcacggctccattgatcgctggacgtggagcgccatcttcagaacttttatcacctggcgagtacaagcgctttgctcgccatctgtgggatatgcagcgtcagcccgccgatctgctgttgccagatgcgccggatctgctccgggcctgtgcgcctgtcattgaagaaagccgtctgcagcgtttgctgggacgcggttttcttttgagtcaggccatagagcgttggcaagctcgcgccatctgggtcgtcagccgtgccgatgcaaattaccctcggcgcttgaaggagcggttacgggaaaatgcaccggccatcctgtacggttgcggggaaatcggcttactggatgctggcggacttgcggtcgtcggatcgcgccatgtggatgaggcgctgatcgagtacacgatgaccgtgggtcgaatcgctgcccgcgcacgcaggacaatcgtttcaggcggtgccaagggaattgatcaagcggccatgcggggcgcgctggaggccggcgggaaggtttgcggcgttctggccgatagcctggaaaagaccgtgatgaatcgcgagcatcgcaatctgctgatggagggtcaactggtgctggtctcgccctatgacccgagtgctggcttcaatgtcgggcatgccatgcagcgcaataagctgatttacgcgctcgccgatgctgcgttggttgtgagttctgaccttaacaagggcggaacctgggctggtgcggtagaacaactcgacaagctgcggttagtgcctgtctatgtccggtctacaggcgaggcgtcggaggggcttgaggcgttgcgcaaaaaaggggctgtgacttggccagatcccctggatgcagattcatttcaaaccgtgtttgaggcgatcacgccagtgagtgaaacacaggtcagtgcagagttgttctcaagcggtgagccgcctgtgtctgcacccgctgcgatggctgtattccctgacgctcagcctttgttgtctgccatcgctatagcaaaagatcagtcggtcacagaggtcgcgtcacaaacgctagaggcggtgccagcttcggaggctagacagcagagcgacaaggtcatacaggtggagtccagtctgggccgtgccttgttttcaacggtgcgtgaagtgatgcagcggcttttaatcacgccaatgaaagaggccgaggttggcagtgcgttggaagtttccacgatgcaagccaaagcgtggctgcagcgccttgttgatgaaggggtcttggaaaagcaaaagaaacccgctgcttacaaggtcaaggaatcccgtttgtttgattga

SEQ ID NO: 5690 - DNA, 1350 bp, Providencia stuartii ATCC 25827
atgaatgtatctagctcattgtcaccaacagcgcaagcgactttattgctaactagctatttttccaaggcgagtagtgaagccgtcaagccgctcactaatacggagtgggggcggtttgcgttatggttgaaagaaaaatcaacgacaccagcagaccttttagtctctgatccgaaggcactactcagtgggtggcacgatgctcgtattagtacagaacggattgtggagctattgaaccgtgggcatagccttgctcttgccatagagaaatggcaacgggcgggtttgtgggtggttacgcgttctgatcctgaatacccaaaacgtttaaaacagcggttaaaaacagattctccccccgtgttatttggttgtgggaataaagcgttattgaatatggggggattagccgttattggttcacgtaatgcaagtgtgtctgatctcacttatacagaccaaattggtgctaaagcagcatccgataatgtcgcgattatttcaggggcagcacgtggtgtcgatgaaacggcaatgttaggcgctatgcggcaaggtggcgtaattattggtgtggtggcggataatttactaaaagccgcaacgagtagtaaatggcgtaaagggctaatggaggggcatgcggtattagtatcacctttttatccagaagcgggttttagcaccggtaatgcgatggcacgcaataagtatatttactgtttagcagatagcgctcttgtgatccattcaggtaaaaaagggggcacgttaagtggtgctgaagaaaatctaaaaaaaatgtgggtgcctctatgggtcaagccgacaattgacaaaagtgctgctaatgctgatttggtcgctaaaggcgcgcgctggttaacggatgatgtgcaacattctaatattgcagaactcattagaaatgacgtcaatagtgttgagcaggtaaaagaagaacagcctgatcttttttcatctgccgttcctgaacaaccagaattatttgcagagcctaatccaatattagaagccaacctgccagagatagagaacaatgtatcaagtggtgtggagcaaacagacagtttggccgtttcaaagcagtctatagagattgaggagctgcgttcaacccctgtagatttttatcaattattcacaatggaacttcaagggttggctaaagaaccaatttcacttgatgaacttattgcaaagacggaattacacaaatcacaattaaatgagtggttgaagcgcgcagaaaaagatggcttagtaaaaaaactcaaacggccagtccgttatcaagcggtaattgagaaagagcagggctaa

SEQ ID NO: 5691 - DNA, 1449 bp, Pseudomonas aeruginosa 39016
gtggctgctacgcaagagcggcagtggcgcggtttggccgatggccctctcgcagacggggcacgacgaatgacgccagtcctttcacccaacacccaggcgatcctgctgttgacggcgccgctcattgccggacgaggcactgcatcaccagatctgctctcgcccggtgagtacaaacgactcgcccgtcacttgcgtgagatccagcatcagccggccgatcttctctcgtcgggcgcggctgaaatcctgcgtgcgtgtcagcctgtgatcgatgagagccgtctgcagcgattgttggggcgcggatttctgttgagccaagtgatcgagcgctggcaagctcgtgccatttgggtggtcagccgtgccgatgccgagtatccgcgtcggctgaaggctcgcctgcgagaagatgcaccagctgtcctctatggctgtggtgacatgggcttgctggaaaccggtgggcttgccgtcgtcgggtctcgccatgtggacgatgagttgattgactacaccatgtcggttggacgactggctgcccgtgctaatagagcgcttgtgtcaggcggcgccaaaggtatcgatcaagccgccatgcgtggtgcacttgaagcgggtggcaaggtctgcggcgtactggcagacagcctcgaaaagaccaccatgaaccgcgagcaccgcaacctgctgcttgatggccaactggtgctgatctccccctacgatccaagcgccgggttcaacgtcggcaatgccatgcagcgcaacaagctgatttatgccttggcggatgcctcgctggtggtgagttccgacctcaacaagggcggcacttgggcgggggccatcgagcagctcgacaaactcaaattcgtccccgtctttgtccgttcgacgggcgaatcgtctgccggcttggacgctctgcgaaagaaaggcgcgctgccttggccgaatccgcaagacgttgatacgttcgctgaagtgttcaacgtgcagatgccgacggtcaccgattctccacaggttggcttatcgctgcttgacggatcaccggctgccgtcaccacggcacctataccgccagatgccgcttcgttacctacgaccgagagcgagccagctgtttctaatgcgcagccttccgcagcgacatccgatgaactgccaatagccacttcggaagcattggcgccagcgggcgagaccaaggagtcaccgcagccggaatcgatcccggccgacgtgctcttcgcagcagtgcgtgtagcgattcagcagctcttgaacgcaccgatgaaagatgccgaagtggctaccgctctggacgtctccaacacgcaggccaaggtatggttgcagaggctggtcgatgaagggctgatcgagaaacagaagaagcccgcgggctacatcctgaagcagaaacgactgctctag

SEQ ID NO: 5692 - DNA, 1368 bp, Pseudomonas syringae pv B728a
atgataaataccaatactcagtcgatcctcctactaacgtcttatttttcaaaatctgtaggtggtgccaaaccgctatctccgacggaatggggacgatttgcccaatggctaaacgcgcagggcaagacgcctgcagacttagtgactgctgagccacatgctgtgcttgagggctggcatgatgaaaaaataccattgctgcgcattgagcagttgctcgagcgaggccatgcgctggccttggctttggagaagtggagccgggctggattgtgggtgctgacacgatcagatgctgactatcctaaggcgctcaagcatcacttacgtaacagcgcgccaccgatactcttcggttgtggaaatccgcgactgctgaatcaacgtggaattggtgttgtcggcgcacgtaaggcggatgatgccgaccttgcatacgccacgtctttaggtaaacgcatcgcgatggccggcatgaccgtagtctcgggtggcgctcggggcgtcgatgaagctgcgatgcagggcggattgaacgaagaaggaactgtaattggcattatggctgatagccttttgtcggcagcgctagccagcaaatggcggaatgggttgatgagcaacaacctggtactggtttcaccattttttcccgaggccggattcaacgccggcaatgcaatggctaggaacaaatacatttactgcctgagtcaggctgcagtggtcgttcgctccgaaaccagaggcggaacctggaacggtgccatcgaaaacttgaaaaaagcttgggtgcccctgtgggttaagcgagatacgaacccggaatccggaaattacgcgttggtatcacaaggtgcgcaatggctggaatcagcagcgaagcatgtggatgtgcatacgctgagtgcccaagctaagccagagtctgacccagagatggtgccggagttagcaccaactgaccaagatgcttctatctctgaagaagaccccgtcagatcgccccccccccgagacgaggcgccacaccaactttcccgagatgatggtaggagtagtcagaatgctaattctgcttcgactcacgccacaactattggcgacctgagtttttatcaattttttctaaggaagatggcactccgggatagtccaggaaccgctgaggagctaagcgagcaatggggtatctcaaagaaacagctcactgaatggctcaagcagtcagtcgatgaaagacacgttcaaaagctgaaaaaccctgttcgcttccagtcgttggatgtcggaaaattcgagggcagcatcgggaagaacttagacccttcatccgatgggcaactggggttcaagctggattga

SEQ ID NO: 5693 - DNA, 1320 bp, Roseiflexus castenholzii DSM 13941
atggtcgaacacgaactgacgcctgatacgcaggcgatcctgttgctctgcggaacattcggcagacgcgggtcgagcgtcgcaccgctgagtgcagcggagtatcatgccctggcgctctggttgcatgcgcagcagatgcgtccaggtgatctgttgcacccggaaggggttgcgtgcatccaatcgatgccaggcgctccggtagtccaggaacggctgctggcgctgctggcgcgcggtggagcgctggcgcttacagtcgaaggctggagcaacaaaggtctgtgggtgatgagcagaagcgatcccgactatccgcagcggttgcgggcgcgtttggaacgcattgcaccaccgttgctctacggcgctggcaaccgtcgtctgctccaaaacggcggactggcaatcgttggatcacgccgcgttaccgaagatgcaatcgcctttacctgcgatattgcccgcaggtgcgccatacagggcataccggtcatctctggcgccgcgcggggggtggacagcgaagcgatgcaggcagcgcttgcagcagatggcgctgcggtcggcgtgcttgcggatagcctgctcagagcggcagtatccgggaagtatcgtcaggcgttgcggaacggcaacctggcgctggtcactgcatatgatcccgaagcgggtttttctgttggcaacgccatggggcgcaataagtacatctatacgttgagcgattatggattggtggtgagtgcttcattaggcgaaggcggaacatgggacggcgccatcgaatgtctgaaaaagcagtgggttccgctctttgtctggtcgagcgacaaagcgggaccgggcaatcaacgcctgtgcgagatgggcgctatctcgctgagtcaggagttgttgtcgaagtatgcatcgctgcaccatctcttcaatgatctatccagagcatcggttccaacacccctactgcgagagagcgaagcgatcaatgagcattccgccagaatgtcgcctggcaaggggatgaacacgactgctggcaacgagcgcagcgtccatgatacttcatcgctcgatcaggcaacgctggcgttgatgcctgtcgatacgaatggcgcagcaccggccatcgatttgtttccgattgtctggccccatctcgtccaggcgctgcgagttgcacagaccgagcgcgagattgcgcagcactgcggcatcgagccgcagcaggcacgtgcctggctgcaacgcgctgtccaggaaggtctggcggtgaagttgacccgcccgatacgctacgtgttgcacaaaccatag

SEQ ID NO: 5694 - DNA, 1314 bp, Shewanella baltica OS155
atgaatttatcgccaacggctcaagcaacattactacttacttgttatttttccaaagcgagtaacgaaaatgctaaaccccttacaaatgctgaatggggccgttttgcgttatggctaaaagaaaaatctacaagcccggctgatttgttgggagcagatccttacgctttactcagtggttggcatgatgatcgcgttagtgcagagcggattatgcaattgctcaatcgcggccacagtctagccttagcagtagaaaaatggcagagggctggcctctgggtggttacacgttctgatcctgaatatccaaaacgcttaaaacaacggttgaagaccgcttcccctcctgtactgtttggttgtggtaataaggcattactgaacgagggtggtttggccgtaattggttctcgaaatgccagcgatgacgatttgttttttactcagcaagttggtgctaaagctgcgagtgaaggtgtcgcgattgtttccggtggcgctcgtggggttgatgaaacggctatgctaggagcaatgcagcaaggtggatttgtaataggtattatggcagacagcttattgaaagcggcgacgagtgctaagtggcgcaaaggcttaatggataataatgctgtgctgatttcgccattttatccggaagccggatttaatgctggtaatgccatggcgcgcaataaatatatttactgcttagctgacagctcccttgttattcattctggtaaaaaaggtggaacacttaacggagcagaagaaaacctgaaaaaggcatgggtaccgctgtggattaaaccaaccacagataaggacgcggccaatgctgatttggtggttaaagggggccaatggttagagaccgaacttcaaagtttggtggttgctgatttgatgaaaaatgaaggcaaccagatgagccctcctaaagaaatacaggcagatttattttcaatgccggcagagtctggattgtttactgagcctgagccagaaaaggttgattcttatactgagcacgatattgcacatgctgaacaacaagcagataaagagagtctctctgcgcacattgttgaaatagaaccagcatcaaaccctatcgatttttaccaattgttcattgcagagcttaataggcttgctaaagatgctgtctctgtcgatgaactaattgaaggcacagggctgcacaagtcgcagctaaatgagtggttgaaacgcgctgaggaagacggtttagtgaataagcttaatcggcccgtacgttatcaattcgaaaacaaaaaataa

SEQ ID NO: 5695 - DNA, 1050 bp, Shigella dysenteriae 1617
gtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggaattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcatgaagatgacgcaaattacgcagtaatgcccgcgtatacgcctgtcgatttttatcaactctttgtggcggaactggcgatccttgcaaaggaatcgatacgtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5696 - DNA, 1296 bp, Shigella dysenteriae
atggacgctgacagttctgacagcactgttacgccaggcaggttgcccgacggtttatcctcttgcccttgcttctacctcggtaaaaaattgatgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgctgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggaattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcatgaagatgacgcaaattacgcagtaatgcccgcgtatacgcctgtcgatttttatcaactctttgtggcggaactggcgatccttgcaaaggaatcgatacgtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5697 - DNA, 1389 bp, Teredinibacter turnerae T7901
atgaatgtacctcatttttcttcagctgatggggctttatcggctgaaagctctttatcccccacagcgcaagcgaccttgctgctaaccagctatttttcaaaagccagtagcgaaagcgcaaaaccgctgactaacgcggaatgggggcggtttgccttgtggttaaaggaaaaatccaccacaccagcagacctgttggtaaccgacccgaaagccttgctgcaaggttggcatgatgcgcgtatcggtgcggagcgaattattgctttgctgaaccgtggccacagcctcgcactggccatggaaaaatggcagcgggctggcctctgggtggtgacccgctctgatccagaatatcccaaacgcttaaagcagaggctaaaaactgattcccccccagtgctgtttggttgtggtaacaaagccttgttgaatgccggaggcttggcggttattggctcgcgcaatgccagtgaggctgatttggcttttaccgagcaagtgggtgcgaaagcagcaaaagagggtattgccattgtctctggtggtgctcggggtgtcgatgaaacggcaatgctgggtgctatgaaacaaggtggtgtggtgatcggcgtgatggccgatagcctgctaaaatcagcgaccagcattaagtggcgtaaaggcttgatggatgatcatgccgtgttggtatcgcctttttatcccgaggcaggattcagtgctggaaatgccatggcccgcaacaaatacatctattgcctggctgacagctcattggtgattcactcgggcaaaaagggcggtacgctcagcggagcagaagaaaatctgaaaaaggcatgggtgccgctgtgggttaagcagacaacggacaaagatgcggccaatgccgatttggtcaccaaaggtggtcgttggttggaggctgatactcaagctttcaggattgcgcaattaatgtgtaatgacggtgggcgtgcgaatcaggtgcaggaacaaatgggcgatctcttttccacgcctgcacagcccaagttttttgctgagactgagtctgaccctgagattgaacctgaccataaaaaggaagttgttgagtcagaaatcgagagtgccgttaacgaaaatcaggcatacaatgttgtaaattcagagcagactgccgaaagtgaagctgcctcatcaggctctgtcgatttctatcagctgtttgtctccgaactacaatatttggctaaaaagccagtaaccgctgaagcgctgattgaaagcacacagcttcacaagtctcaattaactgaatggctaaagcgtgccgaagaagagggtttactcggcaagctcaatcgtcccgtacgctatcaagttaagaacaagaaatag

SEQ ID NO: 5698 - DNA, 1548 bp, Trichodesmium erythraeum IMS101
atgcttaatcatgttttatcttcagatgcacaagtgactttattattatgtgctagttttggtcaaaatagaaatatacagccacaacctttaactctaattgagtataatatagttgctaattttttaattaaaaatcaagttagaccaggatatttactaagtaaaaatggattagatatactaccaaaaattaatgataaaaaattaaactatgagcggttagtggctctattggaaagaggtggaattttagctattactctggaaaagtgggtgaaccaaggtttatgggtacttacaagaagtgaccaaaattatcctataaaatggaaacagaatctgcaatatttggctcctgtaattatttatggtgtaggaaatatagaattattggaaaagggtggattagctatagtgggttctcgtgatattaatgaagaagaagttgaatatacaaaaaaagttggaaaagtttgtgcgtctgaaggtattaatgtaatttctgggggtgcaaaagggatagatcaagaggcaatgttaggaactttagagtttggtggtactgctgttggagttttggcaaatagtttaaataaagcgtctgtttctagaaaatatcgtgacagtattagggctgataaactaactttaatttctacttatgaccctgatgcgggatttagtgttggtaatgctatgggtcggaataaatatatttatgctttatctgattatgctttagttgtaagtagtagtttcaataagggtggtacttgggctggggctacagaggtgttgaagaaatataagaaaatacctgtatttgtgaaagttcaaggaaaggtaaaagagggaaataaagctcttttggataaaggagcaaggtcttttccttttgatccatgggatggtaatttaaaggattttttggtgggttcaaaatgcgatttaaagttgtctgaaaatatttcgttgatagaattagaaactccagttaatatatctgcaaaaactgctaatttaaatgttgaaactaagtctaatttatctatttatgaaggaactaatccaagtatttatgagaaagttttacctattatactgaaaaatttaattcggccacaaaaggcaaaatctttaagtaaaatattagatgtgagagttggtcagttacgtaattggttaagtcaagcctgtgatgaagaaaaaatagttaaagatgaaaaaacagcaatatatagaattgttgctgaaactaaacaatatcaaaattatcaaatttcaacagaggaattaaatgtttatgaaatggtgttgccaattctactagataatttaaataaaccacaaaaaattcaagatttagctaaaattttaaatgtaaataaaagccaattagaagattggttaaaaatagctaaaacagaaggaaaaataatgttagaaaagaattctaatgtttatgtgatttaccaagatatcaaacagttatctctttttgatagagtggaagatgaagatgatgaggaagggttagattggtaa

SEQ ID NO: 5699 - DNA, 1329 bp, Vibrio furnissii CIP 102972
atgaatttatcgccaatagcacaggcaacattgttgctgacgagttatttttcgaaagcaaacactgaggatgtaaagcctctctccaatgcagaatggggacgttttgctttgtggttgaaagataaatcaattacgccagctgatttattggtttcagaccctaggcctttgctgaatgggtggcgcgatactcgagttagcatagaacgtatcgaatctttgttaagcagaggccacagcctggctttggcggttgaaaaatggcaacgtgcaggtctttggttagtgacccgatctgatcctgattatcccaagcgtttgaagcttaggttaaaaaatgattctcccccagttttatttggttgtggtaataagtcattacttaattttggtggcttggctgtaattggctcaagaaatgcgagcgttgctgatcttgcttttactgaacaattaggtgtaaaagccgcctcagaaggcattgctatcgtatctggtggtgcaagaggtgtagatgaggcggctatgcagggcgctatgcttcgtggtggttcagtgattggtgtgatggctgatagcctgctcaaagcggcaaccagcgccaaatggcgtaagggcttgctcgaaaacaacgttgtacttgtgtctccattttatccagaggcgggcttcaatgctggtaatgcaatggctcgcaataagtacatctattgtatggcttcaagttcgttagtgattcactcaggaaagaaaggtggtaccttaaatggtgcagaggaaaacctcaagaaaggttgggtacctttgtgggttaaaccaaccaatgataccaatgctgcaaatgcggatttggtggagaaaggcggcgcttggattgaatctgatctttccatgcttcaaatagcctcaatgctacaaccaaataagcagaattcgttggtatctacgcctacgcagcacaatctcttcaccactccagacctgcctgggaaatttgatgagctagaaacagaagagaaaactgaaaatgagacagcttctaattcaatgatggatgtcaacaatgatgaagtcgctcaaacatcggaaaaagaacaatcagaagatgttaatgaatcgatagcgccacaccctgttgatttttataatatctttttgggtgagctctatcgattagccagctctccaatcacgctcgaagaactcatcgagcagacagagcttcataaatcacaactcaatgattggctgaaaagagcaagtgaagaatgtgtagtgaagaagctgagtaagccagtgcgctatcaggtaatcaataacaactaa

SEQ ID NO: 5700 - DNA, 1203 bp, Escherichia coli E22 (EPEC); identical to SEQ ID NO: 5663

SEQ ID NO: 5701 - DNA, 1203 bp, Escherichia coli M605
atgaatctttcagccaatgctcaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgaattcttggcttgctggcgcgtggtcatagtctggcgttggctgtagataagtggcaacgcgccggtttatggatcttaacccgcggagatgccgattatcccgttcgcttgaaaaaccgattgcgaacggatgcacctcccgttttatttggctgcgggaataaagcattactgcaagcggaaggtatggcgattgttggctcgcgagatgctccgactgacgatttgcgctatacccaacaactggccgcgaaactggcccaacaggggatttgcgttatctctggtggtgcgcgaggtattgatgaatgtgcaatggcctcggctctggaggtcgggggaactgccgttggcgtattagctgatagcttgttaaaaacgagtacgttagtgaaatggcgtgaagggcttatggcaggcaacctggtgttgatttcgccgttttacccagaggtacgtttcaccgtcggcaatgcgatggcgcggaataaatatatttattgccttgctgaaagcgcaatggttgtacgtgcgggaatgaccggtggaacgataaccggggcgatggaggcattaaaacatcagtggctgcccatgcaggttaaaccaaatcaggatatgcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctgcacgaagatgacgcaaattacgcagtaatgcccgcgcatacccctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5702 - DNA, 1203 bp, Escherichia coli M718
atgaatctttcagccaatgcacaagcaactctcctgctaaccagcgatttttctcgcgcggcggcgagtgagtataaacctcttagtaatagtgaatgggggaagtttgcattatggctgaagcaccaacgtatcagtcccgccgagcttctggtgccgcaaccgcaagagaaacttacaggctggagcgatccgcgtatttctcaggagcgtattcttggcttgctggcgcgtggtcatagtctggcgttggcggtagataagtggcaacgcgccggtttatggatcttaacccgcggagatgccgattatcccgttcgcttgaaaaaccgattgcgaacggatgcacctcccgttttatttggctgtgggaataaagcattactgcaagcggaaggtatggcgattgttggctcgcgagatgctccgactgacgatttgcgctatacccaacaactggcagcgaaactggcccaacaggggatttgcgttatctctggtggtgcgcgaggtattgatgaatgtgcaatggcgtcggcactggaggccgggggaactgccgttggcgtattagctgatagcttgttaaaaacgagtacgttagtgaaatggcgtgaagggcttatagcaggcaacctggtgttgatttcgccgttttacccagaggtacgtttcaccgtcggcaatgcgatggcgcgaaataaatatatttattgccttgctgaaagcgcaatggttgtacgtgcgggaatgaccggtggaacgataaccggggcgatggaggcattaaaacatcagtggctgcctgtgcaggttaaaccaaatcaggataagcaatcagccaattcacgattagtagaaaatggggcgtcatggagtgctgaacaggctgagaatgtgacgatcagactgccagacgttcctgggctgatgtatgacagagcactccgtaacgctcaaccagaactgttttcgctacatgaagatgacgcaaattacgcagtaatgcccgcgtatacgcctgtcgatttttatcaactctttgtggcggaactggcgatccttgcaaaggaatcgataagtattgaaaggctggcgtcttgtactggtttaaccatcgaacaaattagtgtgtggctgaaccgcgcagaagaagagggaagggttatccgattgggcgaaggtcattatcagttcaggtaa

SEQ ID NO: 5703 - DNA, 1203 bp, Escherichia coli O111:NM B171 (EPEC2); identical to SEQ ID NO: 5663

SEQ ID NO: 5704 - DNA, 1203 bp, Escherichia coli O139:H28 F11 (ETEC); identical to SEQ ID NO: 5659

SEQ ID NO: 5705 - DNA, 1296 bp, Escherichia coli O157:H7 EC4042; identical to SEQ ID NO: 5665

SEQ ID NO: 5706 - DNA, 1296 bp, Escherichia coli O157:H7 EC4045; identical to SEQ ID NO: 5665

SEQ ID NO: 5707 - DNA, 1296 bp, Escherichia coli O157:H7 EC4206; identical to SEQ ID NO: 5665

SEQ ID NO: 5708 - DNA, 1062 bp, Acidovorax avenae citrulli AAC00-1
atgatcgaactcaccagtggtgacatcctgaaggacgactcggatgccattgtgaacacggtgaactgtgtcggcatcatgggccgcggcattgcgctgcagttcaagaacgcttggcccgagaacttcaaggcctacaaggcggcctgcgaccgcgaggaggtgcagccggggcgcatgttcatctacgacacagagcaactggccgcgccgcgctacatcgtcaacttcccgaccaagcgccactggaagggcaagagccgcatgcaggacatcgacgccggcctggaggcgctggtgcgcgacgttgctcgcctgggcatccgctcaatagccatcccgccgctgggcagtggcttgggcgggctggagtgggacgaggtgcgccctcgcatcgaggccgccatgcaggcgctgcccgatgtgcgtgtccgcatatacgaacccaagggcgccccggcggcggacaagatgcagcacagccgcgaggtgccccgcatgacggccggtcgggcggcgctcgtcgagttgatgaaccgctatgtacaaggtttgctagacccgactatttcgctgctggaagtgcacaagctgatgtacttcatgcaagaggcgggcgaaccgctgcgcctcagctacgtgaaggcaccgtatggcccgtacgcggagaaccttcgccatgtgctgcagaagatcgaggggcacatggtggcggggtacgccgatggtggcgatgaccccaccaagccattgaccgtggtgcccggagccgttgaggaggccggggctttcctgggtgagcatgtggatacccgcgcgcgtttcgaccgcgttggtgatctggttgaggggttcgagacgccgttcgggctggagcttctggcgaccgtacattgggtggcatcccacacggtcgcaggtgggggcgttgaagacgttgtccgggagacgcatgcctggaacgaccggaagaagcagttcaccccgcggcagatcggtattgcattgaacgtgctcgatgccaagggctggcttcctgccgcagaacaggtgggtgcatga

SEQ ID NO: 5709 - DNA, 864 bp, Actinosynnema mirum DSM 43827
gtgatcaagaatggggtgggtgacctcctgactgccgacgtcgaagcgctcgtcaacacggtgaattacgtcggcgtgatgggcaaggggttggtactgcagttcaagcgccgctacccggagagcttcgagagctacgcgcgcgtgcaaggacggcgcggtgaagctcggccggatgcacgtggtggagctcaacgcgatcaccggaccggaatacgtggtcaacttccccaccaaggggcactggaaagcgaactccaagctctccgacatcgaaaccgggctcgacgacctggtccgggtcatcaaggagcggtcgataaagtcgatcgccatccccccgctcggcgccgggaacggcggcctcccctggtcggacgtcgaaccgctgatccgcgcgaagctcgccgaactgcccgaggtcagcgttctcctcttcacaccgtcgaacgccgaccggcatctaacgcccgaaccggtgaagatgacctgaggacgttccaccctggtcgaactgcttccggcccacacggtgcagcgccaagcagcggaaccccaggaagaccggaccggggcatcacactgggaactgcagaagttgatgcacttcgctcagctcaccaccccggagttgaagctcgaattcgcccagggctattacgggccgtacagcgaaaaggtccggcatctcatccagggcatggaagggactttcgtcgagggctgtggcgacggttcgaaacccgtccgagaactcaccccgatccaccccgcggaaaccggaaggaccgggagctcatcgagggcctcgaaggcgctcactcgatcgaactgctcgcgagcacccactgggtcgcccagcgg

SEQ ID NO: 5710 - DNA, 1026 bp, Aliivibrio salmonicida LFI1238
atgatagtttatgtaaaaggcgaccttctaaatgatgatgcagaagcacttgttaatgcagtgaatactgttggtgtcatggggaaaggtctagcttatcaattcaaagaaaaatttcacgagaactttcttatctatagagatgtttgtaaaaaagaattactttctgtggggaaggttttactggttgaaactgatgaaggtagtataccaaactatattattaattttccgactaaagcccattggcgagggaaatcgaagattgaatatatagaagaagggctaaatgatcttattaaagtagtaaaagaaaaccagattaattctgtggcacttcctgctcttgggagtgggttaggggggctaccttggagtcaggtagagcgggtaatgctggataaattaagtaatatagaaaatattgaatggcgtatatatgctcctaataacacgccaaacttgaggaagaaattgccattaactgaagggcgtagcattcttatctatacacttaattattacttgagaatgactaaaaaacaacaacttacagaacttgaaattcattgtttaatgtatttacttcaatgtaatggtctatctttaactggtattaaattcaatgaatttagggaagtaccattctctgatgttcttcatgtggcattaagtaaaatggatggtgattttctttatatttcaggagttaataagccaatccaaagctctttcattactctagaaagtaaaattgtcgtagaggctaaaaaactgttacaaaagaaagtagaaaaaataaaaaaaatttctgatgtaatggagttaatttctggatatgaatctaaggatggaatggcaataataagtacagctttgtgggttgctaatgagaacaaaaatgctaacgttgatcttgctaatacaacattagatattatatctaataattttaactcgtctaatggcgtagttaagggagcttttgttcgtttatatgaagaaaaatggctcccattgaattaa

SEQ ID NO: 5711 - DNA, 1089 bp, Alkalilimnicola ehrlichei MLHE-1
atgattgagtacacccgaggcaaccttctggacgccgatgtggaggcgttggtcaataccgtcaacaccgtgggtgtgatgggcaagggggtcgccctgatgttcaaagaggccttccccgagaactttcgtgcctaccaggcggcgtgcaagaaccgggaggtggtgccgggtcgtatgttcgtgcacgaacggagtgcactgctcgggccgcgttggatcatcaatttccccactaagcagcattggcgcggtaagacgcggatggagtggatcgactccggcctgcgggacctcgaacgggtgatccgcgtgaatgggattcggtccatcgcgcttccgccgctggggtgcggcaatggtgggctgccatgggcacaggtgcggccccggatcgagtcggcgctgcgcgacctgcaggacgtgcgggtggtggtcttcgagccgacccgtcaataccaaaatgtggccaagcgctccggggtggagaagctgacaccggcccgtgccttgattgccgagttggtgcgtcggtattgggtgctggggatggagtgctccttgctggaggtgcagaagctggcctggctaatcgagcggcgcatcatcgaccacggcctggagaacccactggatctgcaattcaaggctcttcgctatgggccgtattcggatcggttgcgccacctgctcaatgggcttgatggcagctatctgcgcagtgacaaacgcatcaacgacgcgggccctgaagaagtggtctggttcgatgaggcgcggcgcgacaagctgggcatttacctgcgcagcgcggaggtccgcccctatcttggagtgctgcaggaggtcgacgaccttatcgatggctttcagtcccccctcggtctcgaggtgctggccaccctggattggcttatctggcaggagggtgtcgcgcccacaatagcggacgttaaagaagggctgcggcgctggccagacgacattgccggtcagcgcaagctacggctgttttcggatcagctcattgagttggcgttggcgcgtttgaccagccggactccggatcttcaggtcatcgccacgtga

SEQ ID NO: 5712 - DNA, 1056 bp, Arthrospira maxima CS-328
atgattcactttaagcaaggcaacctattgacagaaaaggctgatgccctggtgaacaccgttaactgtgtcggtgtcatggggaaggggattgctttgcaatttaagcaggcgttcccggaaaatttccgagcctataaaacagcttgtgatgctaagagaatccatccggggcagatgtttgtagttgctacggataagctattccccaaatacatcattaatttccccactaagcgccactggaagggaaaatctaaaatagaagatatcaaagcgggattaattgcactggttgaggaagtcaaacggttagaaattacctcgatcgcaattcctcctctgggatgcggaaatgggggcttagattgggcggcagttaagcctctcatcgttcaatcttttgcggaagttcccgatattgaggtgatgatttttgaaccgactggcgcaccggtggcggaccaaataccggtggctacctctacccctaaaatgaccatcgggcgtgctttattgattcgcttgctggaattgtacgggattcctgggtatcgcttaactaagctggaaattcaaaaactcgcctattttttgcaagtagctggcgaaccgttaagactgcgctacgtcaaacatcaattcggaccttatgcagacaatcttaatcatgttttgcaaaagattgaaggtcattacattcgcggatatggcgatcgcactgaaacttcggcaatgtatgtcttagaaaaggggcgtgacgctgccgatcgctttttatcagcacatcccgatacgggcgcgcgccggcaacgagtcagcgatttaattgaaggatttgagaccccttacgggctggaaatgttggcaacccttcactgggtggccacggaagatccgcaagctgccatcgattgcgatcgcgctattgaaaaagtacaggaatggagcgatcgcaagcgccatctatttaaacctaaccatctgcgaatagcttgggaacgccttcacactcagaactggtttaatatcaatagcgatgccgaaaccccataa

SEQ ID NO: 5713 - DNA, 1056 bp, Arthrospira maxima CS-328
atgattcactttaagcaaggcaacctattgacagaaaaggctgatgcccttgtgaacaccgttaactgtgtcggtgtcatggggaaggggattgctttgcaatttaagcaggcgttcccggaaaatttccgagcctataaaacagcttgtgatgctaagagaatccatccggggcagatgtttgtagttgctacggataagctattccccaaatacatcattaatttccccactaagcgccactggaagggaaaatctaaaatagaagatatcaaagcgggattaattgcactggttgaggaagtcaaacggttagaaattacctcgatcgcaattcctcctctgggatgcggaaatgggggcttagattgggcggcagttaagcctctcatcgttcaatcttttgcggaagttcccgatattgaggtgatgatttttgaaccgactggcgcaccggtggcggaccaaataccggtggctacctctacccctaaaatgaccatcgggcgtgctttattgattcgcttgctggaattgtacgggattcctgggtatcgcttaactaagctggaaattcaaaaactcgcctattttttgcaagtagctggcgaaccgttaagactgcgctacgtcaaacatcaattcggaccttatgcagacaatcttaatcatgttttgcaaaagattgaaggtcattacattcgcggatatggcgatcgcactgaaacttcggcaatgtatgtcttagaaaagggtcgtgacgctgccgatcgctttttatcagcacatcccgatacgggcgcgcgccggcaacgagtcagcgatttaattgaaggatttgagaccccttacgggctggaaatgttggcaacccttcactgggtggccacggaagatccgcaagctgccatcgattgcgatcgcgctattgaaaaagtacaggaatggagcgatcgcaagcgccatctatttaaacctaaccatctgcgaatagcttgggaacgccttgacactcagaactggtttgatatcaatagcgatgacgaaatccaataa

SEQ ID NO: 5714 - DNA, 426 bp, Arthrospira platensis NIES-39
atgattcagtttaagcaaggcaacctattgaccgaaacgactgaggccctggtgaacaccgttaactgtgtcggtgtcatgggtaaggggattgctttgcaatttaagcaggcatttccggaaaatttccgagcctataaaacagcttgtgatgctaagaaaatccatcccgggcagatgttcgtagttgctacccatgagctatttccaaaatacatcattaatttccccactaagcgccactggaagggaaaatctaaaatagaagatattgaatcgggattaattgcactggttgaggaagtcaagcggttagaaattcgcgcttatcgcgattcctcctctgggatgcggaaatgggggcttagattggacggaagtcaagcctctcatcgttcaagcttttgcggaagttccggatattga

SEQ ID NO: 5715 - DNA, 426 bp, Arthrospira platensis Paraca; identical to SEQ ID NO: 5714

SEQ ID NO: 5716 - DNA, 1080 bp, Aurantimonas manganoxydans SI85-9A1
atgattagatttgtttcaggcaatctactcaactcgggtgctgaagccctcgtcaacacggtcaacactgtgggcgtgatgggaaaaggcattgccctcatgttcaaggaggcgttcccggctaattttcgggcttatgctgcagcctgcaagaacgaagaaatcaaggtcggccagatcttcgttacagagcgaaccgactgggtcggcggaccacgctggatcgtcaatttccccaccaaaaagcattggcgaaacccgtcgaaaatcgagtggatcgatcaaggattggaagatctcaagcggttcgtgattgcgaacggcgtacggtcgattgctctgccgccactcggcagcggaaacgggggcttggactggcgggaagtgaggccgcgtatcgagcaggctctgggtgatttgattgatgttgatgtgatcgtctacgagccgactgatgtctatcagaacgtcgccaaacgagagggcgtcgagaaactcactcctgcgcgtgctctggttgcagagttggtgcgtcggtattggatcttaggcatcgaatgcacaatgctggaaatccagaaactgacctacttgcttgatcgaaatgtgaaagcgactggggtagatagtccgttgaagctagcctacaaggcggagcggtatggcccctatgcgcagaacctgcaacacctgctgaacagtttggacggtagctacctgcactgcgagcggcggattgctgatgctggacccttggatattgtatggtttgaggacagtaagcgcgaccacgttgcagcctacttgaagtcggcagacgctcgtccctatctggcagccctacacgcaacatcggacaccattgatggcttcgagtcccccttgggtatggagctgctagggacgatcgattggctcctcgatcacggggctgaggccaacgttcctgcggtgcgggaaggtcttcgcaactgggcgggcgggatcgaagctggcgagcgtaagcagcgtctgttcgatgaccggatgcttcagctcgcccttgagaggctaaccggacggatagccgaggaagcctaa

SEQ ID NO: 5717 - DNA, 1026 bp, Bacillus thuringiensis IBL200
ttgattaaattaacaacaggaaatttgttagaagctgatgcacaagctttggtgaataccgttaatacagttggtgtaatgggaaaaggtatcgcccttcaatttaagcaagcattccctgataattttaaagcttatcagaaggcatgtaaaattaatcaagttcagcctgggaaaatgtttatatataaaacacacctcttaggatcaccagaatatattataaactttccaactaaaaggcattggaagaataaatcaagaattgaagatattaagagtgggcttatttctttaagaaatgaaattattaattataatataaaatcgatcgccctaccccctcttggatgtggtaatgggggcttagattggagtgaagtaaagcctttaattataaagtcattagaggatttaaatgctacaatttatctatatgaaccttctggtcacccagatccaaatagcatgaaaataggtacgactaagccgaaaatgacaaaagcaagagctcttttactattattaatggagcaatacagagctccaggatatcacctttcgctcctcgaaatacagaaattagcttattttttacaagagtgtggagagcctcttcgtctaaattttgtgaaatatatatatggtccatatgcggaaaatttaaatcacgttttaattcgtttagaaggacattatattcgtggttacggtgatcgaaattctaaatctgatattaatctgtttgaagatgcaatattagaagctaaagagtttatctctcatgataaagaatctttaacaagacttgaagaggtgaaaaatttaattgaaggattcgaaaccccttatggcatagagcttttagctactgtacattggtctataaagtatggaaataattcaataatggatttcgaagagattatcaattatatccaaagttggaatgaacgtaaaaaacatgtatttaaaaataatcatattaaaaagacaatgcaacatctagagatatttatgcaatag

SEQ ID NO: 5718 - DNA, 1032 bp, Beggiatoa sp. PS
atgattgagtatacgtctggagatattttacgtgccgatgcccaagccattgtgaatactgttaattgcgttggcgttatggggcgtggaatcgccttacaatttaaaaaagcttggccagataatttcaaagtatatgctgaagcctgtaagaacaaacaaatacaaccagggaagatgtttgtctttgatactcagcggctgactaatccacactatattataaactttccaaccaaacgccactggcgcgatgctagccgaatggaagatattgaatctggtcttgaggcattgatagaaaccatacgcgaaaatcagattcagtctattgctattccccctctaggttgcggattaggagggctcgattgggaacaggttaaatcacgtattgaaccagcactctctgctttgccagaagtccatgtcattgtgcttgaacctaaaggtgcgccagagaatgacaaaatggtacgtaatcaaccagtacccaaaatgacagcggggcgagccgttttaattgaattaattcagcgttatcttggaggtttgttagaccccaccgtctcattattggaagtacataaactactttatttcatgcaggaggctggtgaaccgttgcgtttaaagtataaaaaagcccattatggtccttatgctgaaaatcttcgccatgtgttaaatgcaattgaagggcattttatcttggggtatgccgatggcggtgacactccagagaaacccttgcaattagtgccatatgccattgataaagctaatgtttatcttaataagcatcaagaaacccgtgaaagattcagtaaagtatctgacttagtagaaggattcgagtcaccatttggcttagagctactttcctccgttcattggttaataaagtacgagaaacttaataggttagaggaggtagtacaggcaactcatgcttggaatgaacgtaaacagcagtttagccttagacaaattaagttagcattgacttgttatatcgtaaaaattggttag

SEQ ID NO: 5719 - DNA, 1050 bp, Brachyspira hyodysenteriae WA1
atgattatatataaaacaggtaacatattagaaacggattcacaatgcattgttaatactgttaattgtgaaggctatatgggtaagggtctagcttaccaatttaaaaaagcttatcctgaaaatgaaaaagcatatataaaagcctgtaaaacaggccagcttgccataggaaaagtttttttatttgaagaagatggtaaaataattgcaaattttccaacaaaagataaatggagacttccttcaaaaatggaatatattaaattaggtttatcagatttgattaataaaataatagtaaaacaaatatattctattgcaattccacctttaggttctggaaatggtggacttaattgggaagatgtaagaaaagaaatagagtcatctttttatgatttatcagaagaaattgaagtaattgtttatgaacctgctggaaatatacaaactaatttaaaacctaaaaaagctcctaaattatcattgtcccattatgtagttagtaaaatagagtctttattaaaatattacaatgttaaagataaaacatatattagacttcagaaaagttgttatttttttaatcacttttatggaaaggattattttgattttaaagcatataaatatggtccttattctcatgatatagagattgtaaataaaaaaattaatgaatatacactttattatgatataaaagattataatgttttatgcaatgagatttataaaacaataataagtaaaaaaatagaaaatgaattaaataatattgaaaatgctattaaattatcatctgaatatgttaataacatagaatcaaatagtgaattagaatgtttaacaactataatggtattaataaaagattacaactatactatagaagaagatataataaatggttttaaaaattgggagttttcaaaagaaaagtcaagaaaatttaaggaaaaagatatattaaattctattaattatttattaaatacaaatataatatcaaaaggattattaggatattgtttaatttctaattaa

SEQ ID NO: 5720 - DNA, 1062 bp, Candidatus Accumulibacter phosphatis clade IIA UW 1
atgatcgaatacgccagcggtgacatcctgaagtgcgcgacggatgcgctcgtcaatacggtcaactgtgtcggcgtgatgggccgtggcatcgcgttgcagttcaagcacgcctacccggagaacttcagggcctatgccgcggcttgccggcgcggtgaggtgcagccaggccggatgttcgtgttcgagacggggcaactcaccgcgccgtgctacatcatcaactttccaaccaagcgccactggcgtggcaagagccgcatcgaggacatcgaggccggcttggtcgcgctggtcgaggtgatccgtgcccggcgcattcgctcgatcgccattcccccgctgggtagcggcctgggtgggctggactgggtcgaggtcaggccgcgcatcgaagcagcgctcgcggggcttgccgatgtgcgggtgatgatcctcgaacccaggggtgcgccgacttccgaggccatggtgcacagccgcgaagtgcccggcatgaccgccggacgtgcagcgctggtggagttgatgcaccgttatcttggtggtctgctcgacccctttgtcaccctgctggaggtgcataagctgatgtacttcatgcaggaagcgggcgaaccgctgaaattgaagtacgtcaaggctccttacggaccctacgccgagaacctgcggcatgtgctgcacttgatcgagggtcacctgatcgctggctacgccgacggcggtgacgcgccggacaagcccctgaccctggttccgggcgcggtcgaggacgcatcgagctttctcgcgcaacatcccgagacacgcgagcgtttcaacagagtggcggcgctggtggatggcttcgagtcgtctttcggactggagctgttgtccacggtgcattgggtgatgaagcacgagagcgttacgaccctcgatgacttggtcgaagctgtctatgcctggaactctcgcaaacggcggttcacgcgtcgccagatcggcattgccgcaggtgtgctggcgaagacggggtggacgcctcccgtcgatgcacaggtctgtgcatga

SEQ ID NO: 5721 - DNA, 1050 bp, Cyanothece sp. PCC 7822
atgattgaattcaagcaaggcaacttactagaagcggatacagaagctctcgttaacaccgttaatacagttggtgttatgggtaaaggaattgccttgcaatttaaacaggcatatcctgaaaacttccgcgcttacaaaaaagcctgtgatgctcaacaagtcaaaccggggcagatgtttatttttgttgctaatagcttatttaaccctaaatatattattaattttcccacaaaaacccactggcgaggaaaatctaaactagaagacattgaaactggattaaaagctttaatagaagaagtcaaacaacttgagatcaaatctatcgccgttcctcctcttggttgtggtaatggtgggttagattgggctgaggttaaaccgatgattgtcggtgcttttgcccaactaccagaggtaaaagtcattatttttgaaccaataggcactcctgtatctgataaaatgcaagtcaatactgctaaacctgagatgactcgcgctcgtgctttattgattcgattgttagaactctacaacattcctggttatagcctgactaaattagaaattcaaaaacttgcctattttctccaagaagccggagaacctttaaaactgcggtacgttaaagatcaatttggaccttatgccgataacctaaaccatgttttgcaacgtttagatgggcattatattaggggttatggagatagaagtcaaaagtctcaaatgtatgttttacctgaaggaagtgaagcagcacaccagtttttagaacaagatcccgatgctaatatccggctcgaaagagttagtaatcttatatttggctttgaaactccctacggaatggagatgttagcaacagttcactgggtagcaatccaagaagatactcaagccgccatagatccagaatgcgctatttgtagagtacagcagtggagtgaacgcaaacgtaacatctttaaaccgaatcatcttcgtaaagcttgggaacgcctacaccaacaaaactggttaagtaatagcaacgactaa

SEQ ID NO: 5722 - DNA, 1047 bp, Dermacoccus sp. Ellin185
atgatcacggatgcttcaggcgacctgctcaaggctccggtggacgcgctcgtcaacaccgtgaacaccgtcggcgtgatgggcaagggtatcgccctccagttcaagagggcctttccgcagatgtacgccgcctatcgagctgacgccgatcgcgggctcatcatgcccgggcgcatgcatgtctgggataccgggcagatgctgcccccccgctacatcatcaacttccccaccaagcggcattggaagacgccatctcgtctggatgacatcgaagcgggcctacaggatctcgtccgcgtcgtacaggaacgagagatcggatccctcgccgttccccctctcggctgcggcaacggggggttggactgggccgtggtgcgcccactcatcgtggaggcgttcgccgcagcgcccggggtcgacgtgcgcctgttcgcgcccgaagggccccctgccgctgcaaccatggtggcacgcgctgcaaggccgcagatgaccccggggcgtgcggcgctcgtcgagatggtgcgggcctatacagggcaggccttttccgcgcccgggctcatcgaggtccagaaactcatgtacttcctgcaagaggacggccagccgcttcaactgaggttcaaggcccaccactacgggccgtatgcagataacctgcgccatgttctgagcttggtcgaaggccatttcctgatgggcttcggtgacggcagcgcacgggtgcagcaatcggaaccccttcgcgtcgtcgagggtgccgccgcggaggcggagaacgtcctggcgggaagtgagtacctcagttccatcgagcgcgtactggccacggtcgagggtttcgaaagcccctatggcttggaactgctggccaccacgcactggctcatgacgcgcgagcacgcgacatcggtgggcgatctggtgtcgcatgtcgcagcgtggtcagatcgcaagaggcgcatgttctcggaccaggatctcgcagcagcacgcacgcatctggtggagcgcggatgggcacaggcagcctga

SEQ ID NO: 5723 - DNA, 1041 bp, Desulfovibrio sp. 3 1 syn3
atgctgaaatatacaaatggcgacatcttcgcttctgacgcaatggctctagtgaatacggtcaatactgaaggaataatgggcaaagggttagcgcttcaatttaaaaggcgctttcctgaaaattttctagcttatgccgctgcttgcaagcgcaacgaagtcaaaataggcaaaatgtttatagtaccctacaatggccttgaaggtcttaaatatctcatcaattttcccaccaaagtctcatggcgaaataaaagcaaaattgaagatattgtttctggtttacaggctctcaaaaaagaaatagtgtcccttggaataacaagtgttgccattccaccgttgggctgcggccttggtggactctcttggaacattgttaagcgcgaaatagacatgacattttcagactttgatgcagcagatattatagtttttgcacctcttaagggcaaaaatccatcacctgtcgtcagcactaggacaaagatgacaaatgcaaaagcgcttttccttcgttgctttgaaaaatatatgaatcttgtcccttctgttgaaattacctttgttgaagctcacaagcttggctatttgctccaatgcgcttgcggagctgatctgcgcctagactttaaagcttggaaatatggtccgtgggctcgtaacatgggacatattcttggcgacatggagggcatctggattgacggttttggcgatggaacacgaaaggcatttgaaacattttccttactacctgcagcaaaggttgcgaaaaatactgttctgccagataactacgaagctgcgcttgaaaaaattgacaagatatttatgggctttgaaaacccacttgggctcgagttgctagccacagtccattggcttattgttcatgaccatgttgaacccgaacaggaaaagattatagatgcactagcaaaatggaaagataatcaagaaggatggggagatcgaaaattaaaatactttccaccacgattaattgaactggctttaaagcgtgtctcacaatag

SEQ ID NO: 5724 - DNA, 1050 bp, Dickeya zeae Ech1591
atgattgaatacagacagggcgacatcctccaggcagagactgaggctatcatcaataccgtcaactgcgtcggcgtaatggggcgaggcattgcattgcaattcaaaaacgcctacccggataacttcaaagcttatgctgcatcctgtaaagcaaaacaagttgttccaggcaaaatgttcgtctttgagaccgggcagttaacaaaccctcgttatatcattaactttccgaccaaacgccactggaaagggaaaagtcgtcttgaagatattgccgccgggttggacgatttggtcgccgttatccggcaacatgatattcgctccattgccattcccccattggggagtggcttaggcggtctggactggcaagatgttaagcccctgattgagtctgccgttcaaccgcttgagtccgtacaaattgcgatttacgatcccaacggtgcaccgtcctcggaacgtatggtacataaaacagaagtgccaaagatgacagcagggcgagccgcgctggttgaactgatgcagcgttatcttaatgggttgttagatccgttcatctctttgctggaattacataagctgatgtatttcatgcaagaatccggggaaccattacgccttaagtaccagaaagcgcattatgggccttatgcggaaaacctacggcatgtgcttaacgcgattgaagggcatatgatctctgggtattcagatggcggtgatatgcctgataagcaactctcgctggttcccggagtggcagaagaagcaaaagcgtttcttgagcaacaagaagagacttaccgccgctttcagaaagtctcggatttggtggaaggttttgagtcgccttttggtctggaactcctttcgacggttcactggacaatgcaacatgaatcgctgacgtcccctgaagatgttactgattttatctatgcctggaatgaaagaaagcggcagttcacaccacgccagatatctttagcggtagatacgttgcatcgcaaggggtggttaacctctaccgctgcttag

SEQ ID NO: 5725 - DNA, 1068 bp, Edwardsiella ictaluri 93 146
atgatcacatatacacaaggcaatttactggacgcgcccgtggaagcactggtgaatacggtgaataccgtcggtgtcatgggtaaaggcatcgcgctgatgtttaaagagcgcttccccgacaatatgaaagcctatgccgacgcctgcaaacaaaagcaggtgatgaccggcaagatgtttattaccgaaaccggcgagctgatggggccacgctggatcgtcaacttccctaccaagcagcactggcgcgccgactcccgcatggcgtggatcgaagacggtttgcaggacttgcgccgctttttgatcgaagaaaacgtgcagtccatcgccattcccccgctgggcgcgggcaacggcggcctgaactggccggatgtccgggcgcggattgaatctgcgctgggcgaccttcaggacacggaaatcctgatttatgagcctaccgaaaaataccagaacgtcgccaagagcagcggcgtaaaaaagctcacccccgccagagcgatgatcgctgaactggtgcgccgctactgggtgctgggtatggagtgcagcctgctggaaatccagaagctggcatggctgctacaacgcgccattgaacagcaccagcaggaggacgtgctaaaactgcggtttgaggcgcactattacggcccctatgctcctaacctgaaccatctgcttaacgcgctggacggtacctatctgaaagccgaaaagcgtatcccggacagccagccactggatgtgatctggtttaacgatcgggaaaaagaacacatcaacctctggctgaacagcgaagccaaagcgtggttgccagcgcttgagcaggtcagccagttgattgacggttttgaatcgccgtttggtctggagctgttggcgaccgttgactggttgttgacccggggacaatgccagccgacgctggactcggtgaaagaggggttgcatcagtggcctgcgggagaaccttgggccagccgtaagataaagctgtttgacgataagaatctgcaattcgccattaaccgcgtgatggagtttcattgctga

SEQ ID NO: 5726 - DNA, 1068 bp, Edwardsiella tarda EIB202
atgatcacatatacacaaggcaatttactggacgcgcctgtggaagcactggtgaatacggtgaataccgtcggtgtcatgggtaaaggcatcgcgctgatgtttaaagagcgcttccccgacaatatgaaagcctatgcccacgcctgcaaacaaaagcaggtgatgaccggcaagatgtttattaccgaaaccggcgagctgatggggccacgctggatcgtcaacttccctaccaagcagcactggcgcgccgactcccgcatggcgtggatcgaagacggtttgcaggacttgcgccgctttttgatcgaaaagaaagtgcggtccatcgccattcccccgctgggcgcgggcaacggcggcctgaactggccggacgtccgggcgcggattgaatctacgctgggcgaccttcaggacacggaaatcctgatttatgagcctaccgaaaaataccagaatgtcgccaagagcagcggtgtaaaaaagctcacgcccgccagagcgatgatcgctgaactggtgcgccgctactgggtgctgggtatggagtgcagcctgctggaaatccagaagctggcatggctgctacaacgcgccattgaacagcaccagcaggaggacgtgttaaaactgcggtttgaggcgcactattacggcccctatgctcctaacctgaaccatctgcttaacgcgctggacggtacctatctgaaagccgagaaacgtatcccggacagccagccactggatgtgatctggtttaacgatcgggaaaaagaacacatcaacctatggctgaacagcgaagccaaagcgtggttgccagcgcttgagcaggtcagccagttgattgacggttttgaatcgccgtttggtctggagctgttggcgaccgttgactggttgttgacccggggacaatgccagccgacgctggactcggtgaaagaggggttgcatcagtggcctgcgggagaaccttgggccagccgtaagataaagctgtttgacgataagaatctgcaattcgccattaaccgcgtgatggagtttcattgctga

SEQ ID NO: 5727 - DNA, 1017 bp, Edwardsiella tarda FL6-60
gtgaatacggtgaataccgtcggtgtcatgggtaaaggcatcgcgctgatgtttaaagagcgcttccccgacaatatgaaagcctatgcccacgcctgcaaacaaaagcaggtgatgaccggcaagatgtttattaccgaaaccggcgagttgatggggccgcgctggatcgtcaacttccctaccaagcagcactggcgcgccgactctcgcatggcgtggatcgaggacggcttgcaggacctgcgccgctttttgatcgaaaagaaagtgcggtccatcgccattcccccgctgggcgcgggcaacggcggcctgaactggccggacgtccgggcgcggattgaatctgcgctgggcgaccttcaggacacggaaatcctgatttatgagcctaccgaaaaataccagaacgtcgccaagagcagcggtgtaaaaaagctcactcccgccagagcgatgatcgctgaactggtgcgccgctactgggtgctgggcatggagtgcagcctgctggaaatccagaagctggcgtggctgctacaacgcgccattgaactgcaccagcaggaggacgtgctaaaactgcggtttgaggcgcactattacggcccctatgctcctaacctgaaccatctgcttaacgcgctggacggtacctatctgaaagccgaaaagcgtatcccggacagccagccactggatgtgatctggtttaacgatcgggaaaaagaacacatcaacctatggctgaacagcgaagccaaagcgtggttgccagcgcttgagcaggtcagccagttgattgacggttttgaatcgccgtttggtctggagctgttggcgaccgttgactggttgttgacccggggacaatgccagcccacgctggactccgtgaaagaggggttgcatcagtggcctgcgggagaaccttgggccagccgtaagataaagctgtttgacgataagaatctgcaattcgccattaaccgcgtgatggagtttcattgctga

SEQ ID NO: 5728 - DNA, 1084 bp, Enhydrobacter aerosaccus SK60
atgattacatacacccaaggcaatttactcgaagcggatacccaagtattggttaacaccgtcaatacggtcggtgtgatgggcaaaggtatcgcattaatgtttaaacaacaatttcccgaaaatttcaaacgctatgctaaagcgtgcaaatcaggtgatgtgcaagtcggtaaaatgtttgtggttgatattgataccccacccacacaacattctcagccccaacttaagcaaagatggatagtaaactttccgaccaaacagcattggcgagccaaatcacaaatcgaatggatacaagcaggattgcaagatttgcgacaatggttaattgataatcgtatcgaatcgatagccattcccccattgggagcgggtaatggcggactgccttggcaacaggtaaagccactgattgaacaagccttgggcgatttgccaaatattgatattcaaatctttgaaccatcagatagttattatagcgttgcgactgccacaacgactgacactcttacccatgccagagccttattatatcaagtggttgaccgctattgggtgcttggtatggaatgtagcttgcttgaagtgcataaactgatgtggtttttgcaacgagccattgaacgccatcgtttagccaatcccttacagttatcatttatgccccattattatggtacttatgccccaaatctacgtcatttacttaacaatctagatggtagctatttattggctgaaaagcgtctgccagactgcaaaccattggatgttatttggacaaatcaaactaaacaagctgaagttgagcaatatttgcaaacatcaatgtcagattttttacccgttttgacagaagttgataatgtgatagcaggatttgagtcgccgtttggcttggagttactatctacggtggattggctaatctatcaagaacaatatcctgctacggcggaaggtattaagcaaggcatggcaaattggcaagcaggggaaatctgggcaaaacgtaaattggaattattcaatgaccagcatattgatattgcattacaacatttgaaaactattt

SEQ ID NO: 5729 - DNA, 1029 bp, Escherichia coli 0127 H6 E2348 69
gtggaagctctggtgaatacggttaataccgtcggtgtcatggggaaaggcatcgcgttgatgtttaaagagcgcttccccgaaaatatgaaagtctatgccctcgcctgcaaacaaaagcaggtgatcaccggcaaaatgttcattaccgaaaccggggaactgatgggaccgcgctggattgttaattttccgaccaaacagcactggcgcgctgattcccgcatggagtggattgaagatggcttgcaggacttacgccgctttttgattgaagagaacgtgcagtccatcgccattccaccactgggcgcaggcaacggtggtttgaactggccggacgttcgggcgcagattgaatctgcccttggcgaccttcaggacgttgatatcctgatttaccaaccgactgaaaaataccagaacgttgccaaaagcactggcgtaaaaaagctcactcccgccagagccgccatcgctgaactggtgcgtcgctactgggtattggggatggagtgcagcctactggaaatccagaaactggcctggctgttacaacgcgccattgagcagcatcaacaggacgatatcctcaaactgcggtttgaagctcactattatggcccctatgcgcccaatctgaaccatctgcttaatgcgctggacggcacctatcttaaagccgagaaacgcatcccggacagccaaccgctggatgtgatctggtttaacgatcagaaaaaagaacacgttaatgcgtatctgaacaacgaagccagagagtggctacctgcgctggagcaggtcagccagttaattgacggctttgaatcgccgtttggtctggagttgctggcaaccgtagactggttgctgagccgtggcgaatgtcaaccaacgctggactccgttaaggaagggctgcaccagtggcctgcgggcgaacgctgggccagccgtaagttgaggctgtttgataataataatctgcaatttgccattaaccgcgtaatggagttccattgctga

SEQ ID NO: 5730 - DNA, 1068 bp, Escherichia sp. 4 1 40B
atgatcacatatacacaaggcaatttactggacgcaccggtggaagctctggtgaatacggttaataccgtcggtgtcatggggaaaggcatcgcgttgatgtttaaagagcgcttccccgaaaatatgaaagtctatgccctcgcctgcaaacaaaagcaggtgatcaccggcaaaatgttcattaccgaaaccggggaactgatgggaccgcgctggattgttaattttccgaccaaacagcactggcgcgctgattcccgcatggagtggattgaagatggcttgcaggacttacgccgctttttgattgaagagaatgtgcagtccatcgccattccaccactgggcgcaggcaacggtggtttgaactggccggacgttcgggcgcagattgaatctgcccttggcgaccttcaggacgttgatatcctgatttaccaaccgactgaaaaataccagaacgttgccaaaagcactggcgtaaaaaagctcactcccgccagagccgccatcgctgaactggtgcgtcgctactgggtattggggatggagtgcagcctactggaaatccagaaactggcctggctgttacaacgcgccattgagcagcatcaacaggacgatatcctcaaactgcggtttgaagctcactattatggcccctatgcgcccaatctgaaccatctgcttaatgcgctggacggcacctatcttaaagccgagaaacgcatcccggacagccaaccgctggatgcgatctggtttaacgatcagaaaaaagaacacgttaatgcgtatctgaacaacgaagccagagagtggctacctgcgctggagcaggtcagccagttaattgacggctttgaatcgccgtttggtctggagttgctggcaaccgtagactggttgctgagccgtggcgaatgtcaaccaacgctggattccgttaaggaagggctgcaccagtggcctgcgggcgaacgctgggccagccgtaagttgaggctgtttgataataataatctgcaatttgccattaaccgcgtaatggagttccattgctga

SEQ ID NO: 5731 - DNA, 1098 bp, Eubacterium saburreum DSM 3986
atggaagtaaagattggagatatatttgaaagtaaatgctcggttatagttaatactgtaaactgtgttggagttatgggaaaaggtattgcaaaagaatttaaaaagagatatcctgatatgttttcagattatgtaaaaagatgtaacttagggcaagttcgaaccggaaaaccttatgtttttgaagagaaatccggtataaaaattcttaattttccgacaaaggagcattggagatcaccttctaaattgtcctatattgtagacggacttgactggtttgtacaaaactataatagattaaatatcagcagtatagcttttccacctttggggtgcggaaatggaggtcttgactgggatgtggtaggacctataatgtatcataagctgaaaaatctgccaatagaaatagaaatatatgcaccatttggaataaacagaaatgaaactatcaaagattttttatcacagagagtagtggaagaagattttacaggagtaagtaatttaaagataaatcacaaatggtttttgattttggaggcaattaaagaaattaacagcaatagatattcgttaaaagttggcaggacaatatatcaaaagatatgttatgttattaccagaaatggtgtaaatacaggctttaagtttactaaagggagctatggaccgtattctgttgatgctaagaattccattatacgtttagcgaattcaaatcttattacagaacgggtatgtggaagaatggtattattaaaagtagcagacgaaatattagtagataaagatgacttttctgataaagaatggaatgcaatgaaaaagacagtagatttattcggtagggttaaaagtactgaacaagctgaaattatgtctacagttttattttcttatgataaattaagtgatgctaaaagtaagattagtgataaagatgtatatgattatgtcatgagttggaaaccgcattgggaaaaggaaaaaagctatgaggtcagtgatacaatacataatcttgcaatgcttgcatttatctcaatagagcatagcaatttattattatatccgacaatatcccggtaa

SEQ ID NO: 5732 - DNA, 1056 bp, Geobacter lovleyi SZ
atgattgaatacaaaaccggtaacatactggccgaggatgttgaggcagtggtgaacaccgtaaactgcgtcggtatcatgggacgggggattgccctgcagtttaagaacacctatccggacaacttcaaggcctatgctgcggcctgcaagctgaatgaagtgcaaccggggcggatgtttgtgtatgaaaccggtcgtctcaccaatccacgttttgttatcaattttccaaccaaacgacattggaaggccaagagtcgaatagaagatatagatgcaggtctggtggccttggttgaagagatcagaatacgcaagatcagctctattgccataccaccgttgggcgccggtcttggcggattggactggaagcaggtgcgtccccgtattgaagccgctttgcaaggggttgaggggctgcgggtggtcatctttgaaccggctcctgataaggctgatgagcgtgcgaaccgctccagcgatgttccgaagatgacaccaggccgggctgcactggtggggctgatgcaccgctatctggcagggctgttggaccccttcattaccctgctggaggtacacaagttgatgtactttatgcaggcagcacaggaaccgctacgactgaattacaccaaggctccttatggtccctatgccgaaaacctgcggcatgtcttgcgggctgtagagggacatctggtctcgggctacgctgatggcggtgatgcgccggataaacagttggagttggtaccgggtgccctggtggatgcgcaaacattcctgcaagaacagccggatacggttaaccggatgaaccgtgtctttgaactggtagaagggtttgaaaccccctttggcctggagctgttggcaacggtgcattgggtggtaagccaggagcaagcctgttcactggaggaagtcacagcgcgggtttatggttggaatgaccgtaagcgtcagtttaccccacggcaaatagctctggctgtgttcatgctatcgaaaaaaggctggataccgtcattggcaggtagcgcatga

SEQ ID NO: 5733 - DNA, 1038 bp, Gloeobacter violaceus
gtggtcgaacttacaaagggtgatattctgtcggcggatgcggaggccctcatcaatacggtcaactgtgtcggcgtgatggggcgtggggtggccttacaattccgcaaggcatacccggaaaatttcaaggcgtatgagtcggcctgcaagcgcaaagaagtgagactgggcgaggtgtttgtgcacgatttgcacagtttcatcaatccccgctacatcatcaacttccccaccaaagatcattggaaaggatcaagtaggctgtcctatatcgaatcgggtctccgttccttgatcggggaagtagaaaagcttgggattcgttcgcttgccctgcccccgctaggttgcgggttgggcggattggattggcgggaggtgcgtccccttatagaagcagctttcgctcaggtgccctgggtgcacgtcctacttttcgaaccggtgggtgcgccctctcctgccacaatgcccaagtcgaataaaaagccttccatgtccccgggcaaggcggttttgctcggattgatggatcggtacctagccgcgttgatggacccgtttgtcacgctactggaactccacaaacttatgtactttatgcaggaagcgggagaagcgctcagattgaattacaccaaagggacttacgggccttatgcggagaacctacgccatgtgctcaacgcaatagacgggcattacatcagtggctatggagacggcgaagactcccccacaaagcaaatagagccgaacgcggaggcggtcgggatggctttggcgtttcttgaggagtgcccgcaaactcgcgagcgcttcgagcgggtgattgatctcattgagggttttgagacctcctacggcatggagttgctgtccacggtccactgggttgctaagacggaaggggcaggtactccggaaaaagccgtacaatttacccatgcgtggaatgaccgcaaaaggactttcgagcccaggcatatccgagtggcttgggatattttggatgataaagggtggctgttttga

SEQ ID NO: 5734 - DNA, 1056 bp, Gluconacetobacter diazotrophicus PAl 5, DSM 5601
atgactatcgagtataaatcaggtgatatgtttgacgagcccgccgaggctatcgtcaacacggtcaactgtgtgggcgtgatgggcaaaggcgtcgcactggaattcaagcgtcggtggcctgacaactttcgcgcttacaaacgcctttgcgatgccggaaagctatcgccaggggaaatgttcattttccaaataggcgatcttttgcagaaaggtgatcgtcagtttttgatcaatttccccacgaagcagcattggaaagcaaaatccaaaatcgagtatgtcgagcatgggcttgagaattttatgcaccaagtgcgtgagctgggcatcaaatccgtggtgatgcctccactcggttgtggcaacggtggccttgattggaacgaggtccgtccgcttatcgaagaaaaactttcctcgttgcctgatgtaaaatttatcgtgttcgctccgtccactggagtttgtcaggttacggaacaggaaaacgttcctagcggccttacaattccgcgtgcaactatgatggttgctctgggagagttagagaaatacttcggcggacattttacgaggctgactgcccagaagcttgtgtattttatgcaagttttaggatcggactttggtttgacttatagcaaggcaaaatttgggccatactctgagcagctgcatggtattttcaaagtcatggagagaaagcagtatatctccggatatgagggggatgatcacgaggtggtcgtcacaccgtcgacgtttgccgcttctgatgatttcctaaagtcgaacgaggtcgacgtttcacctctggtgcaaaaactctctttgctcgtagaaggctatgaaagcccctacggcatggaactgctatcgagcgttcactatttggccatcactgagggcattactacgcaaccggaaatgtccgaggctctcgagtcatggaatgaccataaacgcgagagcttcccgcgaactgccgtgacaacggcacttggcaggctaattgaggacgaatgcttagagatcgttgcaaacgtttga

SEQ ID NO: 5735 - DNA, 1068 bp, Klebsiella pneumoniae 342
atgatgacatatacacaaggcaatttactggacgcgcccgtggaagcactggtgaatacggtgaataccgtcggtgtcatgggtaaaggcatcgcgctgatgttcaaagagcgcttccccgacaatatgaaagcctatgccctcgcctgcaaacaaaagcaggtcatgaccggcaagatgtttattaccgaaaccggcgaactaatggggccgcgctggatcgtcaacttccccaccaagcaacactggcgcgccgactcccgcatggagtggattgaagacggcttgcaggacttacgtcgctttttgatcgaagagaacgtgcggtccatcgctattcccccgctgggtgcgggcaacggcggactgaactggccggacgtccggacgcgaattgaatctgcgctgggcgaccttcaggacacagaaatcctgatttatgagcccaccgaaaaataccagaatgtcgccaagagcaccggtgtaaaaaagctcacccccgccagagcgatgatcgctgaactggtgcgccgctactgggtgctgggcatggagtgcagcctgctggaaattcagaagctggcatggctgttacaacgcgccattgaacagcatcagcaggaagacgtgctaaaactacggtttgaggcgcactattacggcccgtatgcccccaacctgaaccatctgcttaacgcgctggatggcacttatctgaaagccgagaaacgcatcccggacagccaaccgctggacgtgatctggtttaacgatcgggaaaaagaacacgtcaacctctggcttaacagcgaagccaaagagtggttaccggcgcttgagcaggtcagccagttgattgacggttttgaatcgccgtttggtctggagctgctggcgaccgttgactggctgctgactcggggagaatgccagcccacgctggattcagtgaaagaggggctacaccagtggcctgccggggaacgctgggccaaccgcaagatgaagctctttgacgataaaaatctgcaattcgccataaaccgcgtgatggagttccattgctga

SEQ ID NO: 5736 - DNA, 1032 bp, Leptotrichia goodfellowii F0264
atggaaataagacagggaaatatatttgaaagtgagacacaggctttaataaatcctgtaaatactcaggggataatggggaagggtctggcttatcaatttaaaattaaatatccgaataattttcagaattatgaacaaaaatgtttaattaaagaagtagatgttggaaaagatttaatttatactgaagaaaaagacaagataataataaattttcctacgaagaaaaattggaaagaaaaatcaaaaattgaatacattgaaatcggattgaaaaagttagaagagttattggaaaaattgagaataaaaagtgtatctattcctccaatcggagcaggaaatgggaaattggactggaaattagtaaaaaacgagatcgaaaaatttgaaaaaagagtttccaaaagtacaaatgttattatttatgaacctgctattagtgagtcaaaactaagtaaaggacactatttaattgcatatactttagtgaaagctgaagaaaaaggaataaaaaaggagataaccgatttagttttgcaaaaattaatttatttaggagatagaaataattattttaaatttaaagaggaatctgaaggtcctttttcaaaattaataagtatacaatatcagaagttgaaagaatattccaaattaaataataaaaaacttgttgaaattgaaaaagaattactgaaagaagaaataacaaaaaatttacaaaaagaaaaagaaaatatagaaaatgctatacagatttatattaatatgaaaaatttctattcaatttcagtaaaagaagaaatagaaaataaagtagagctattatcaactgttatttatattttaaaaaacaaaaaagacgatgaaataagtaataataatatttatgaagaaatgaaaagttggaataaaagaaaagataaaaagtattcactggaagatatcgggcaaatgtttgattttttagaaaaagaaaaaattttaaaaaaagatatttttaataaatatattatgaaatattag

SEQ ID NO: 5737 - DNA, 1065 bp, Lyngbya sp. CCY 8106
atgattgaattcaaggaaggcaacctgatcaaagagaatatcgaagccttggtcaatacagtaaattgtgttggcgtgatggggaaaggtattgctttgcaattcaaacaggcatttcccgaaaactttaagcaatacaaaaaaggctgtgaggctaaagaaattcaacccggaaaaatgtttaccacctctacaggcaagctgtttccccggtatattattaactttccaaccaaacgtcactggaaaggaaaatcaaaaatagaagatattgcatctggattaaaagctttagttgaagaagttcaacaacttaaaattaaatcaatcgctattcctcctctcggatgcggtaacggtggcttagattgggtgcaggtaaaacccatgatagttaatgcttttgctgaatttacagacgttaaaatagttatatttgaacccggaagcgcacctgtagccgataaaattcaagtcgctacaaaaaaaacaaaaatgactcttgctcgcgccttatttattcgtttgctagaactgtatgcaattccaggttatcaattaacaaaactggaaattcagaaacttgcttattttcttcaagaagctcaagaacccttaaaactgaattatgagaaacatctctatggtccttatgcagataatctgaatcatgttctacaagctttagatggtcattttattcgtggatatggagatcgaagtcagcgttcacaaatgtatgttttgccggaaggaagcaaagcagcgcatagttatttagaaaagcatcccgaagcgaataatcgtttagcgaaagttagtaatttaattactggttttgaaacaccttacggaatggaaatgctagccacaattcactgggtagttaccagagaagatccgcaagcagcagaagattgtgaaagagcgatcgcattagtgcaacaatggaatgaaagaaaacgcaaactatttaaacctagtcacctacgcaaagcatgggaacgacttcagcagcaaaattggtttcttgatgtctctacaaacaacaaacaacaacagtag

SEQ ID NO: 5738 - DNA, 1044 bp, Marinobacter sp. ELB17
atgatcgaatacaaaaccggcgacatcctgcgtgaggacgccgacgccattatcaataccgtaaattgtgtcggtgtgatggggcgtggaattgcgctgcagttcaagaaagccttcccagacaacttcaaggcctacgccgccgcgtgtaaaaatcgtcaggttgagccaggacgtatgtttgtcttcgagactgggcaactgacggcgccacgctacatagtcaacttccccaccaaacgccactggcggggtgccagccgtctggaagacatcgacgccggactcaaggctctggtcgacacgatccaccagtatcagattcaatctattgctatcccccctctgggaagcggccttgggggtctggactggtcggaagtaaagccgcgcattgagtcagcactaagaccgctcggcgatgtgcgggtgattgtctatgagcccaagggcgcaccgcctgcacaaaagatggtgcagaaccgtaaggtgcctgagatgaccgccggaagggccgctctggtagaactggtaaatcgttatcttggtggcctgctggacccatccgtcacgctgttggaggtgcataaactgatgtacttcatgcaagaggcaggcgagccactgcggctaaaatatcaaaaagcgggctatggcccgtatgcggagaacctgcgccatgtattgaacgcggtagaagggcaccttctgtctggctatgccgatggcggcgatgcgccagacaaaccgttgcaactggtgcccggtgcggtggacgatgccagccgttttctcctgcaacacccggacaccctgtctcggtttgataaagtggcgcagcttgttgagggttttgaatcgccctttggtctggagctgctatccactgtgcactgggtcatcaagaaagagtcagcttctacacgggaacaggccatccgccaggtgtatgactggaatgatcgcaaacatcagttctcagagcgtcagattgagttggctgcccgggtattagaaacgaagggatggacagaagccgtctag

SEQ ID NO: 5739 - DNA, 1155 bp, Micromonospora aurantiaca ATCC 27029
atgtcttctttgcctagcaaggacggagacctcgttcagttgaagcggggggatctcctgaactctaaagctcacgccctagtcaacaccgtaaactgcgtgggcatcatgggaaagggcatagcgctcgcgttcaagaagcgttaccccaacatgttccgggactacgtcagacgatgcgatcagggcctcgtgcaacttgggaagccgtacgcatatcaagacgaagagaagttgattatcaacttccccaccaagcagcactggcgatctgtaagcaggctagaggacatcgaacatggccttgagcacctgcgcagcaatctatccaagtggggcgtgcgctcgattgctgtcccaccgctaggctgcggaaatggtcagctcgaatggtcagttgtgggtccaaccctgtaccgccacttgagcacgtttggcatcccggttgaactctacgtcccccacgatgtcgaacccgatcaggcgcaactcgctctattcaacccgcaggcgtcacctccaagtggagtggcgtcggcacatgaggcccgatatgtggatcctgcaacgattgcccttgtcgaaatcctgcatcggatcgagcaagagccgttccactggcctgttggtcggatcatgttccaaaaactggcttacttcgccactgcagccggcctacctaccggcctagattaccaagctgctagctacggcccgtacgccgccgacttgaagagagttgttggaaggctccagaacaacggcctagtgaaagagcagcagaatgggcgggccttcgaggtgaaggtgggcccgacctttaccgatgcacgagcatcggctataggtgaactggacggatgggaagaccgcatatcgcgtgtggtggaccttatatcgcggttcaaccctagccgggccgaagtagccgcctcggtccattacgcagcagatgctttacggaataagcttgggcggactcccacagctgaggaggtggtggatgcagtcctgaagtggaaggtgcgtcgtcagcctccaatccgtcgggaagatgttgagcaggcggtcgtacaattggccatccaacgctggattgaggtcgagccggatgattcgattgcagacgctgcgaacgagttggtaggcgtgtag

SEQ ID NO: 5740 - DNA, 1059 bp, Mycobacterium bovis
atgatcacgtacggctctggcgacctccttcgggctgacaccgaagcgctcgtcaacaccgtcaactgtgttggggtgatgggcaagggaattgcgctgcagttcaaacgccgctaccccgagatgttcaccgcctacgaaaaggcgtgcaaacgcggcgaagttaccatcggcaagatgttcgtcgtcgacaccggacagctcgacggaccgaaacacatcatcaacttccccaccaagaaacactggcgtgcaccgtcgaagctggcctatatcgacgccggcctcattgatctcatccgcgtgatccgtgaactcaacattgcttctgtggcagttcccccgctgggggtgggcaacggaggtctggattgggaagatgtcgagcaacggctcgtatcagcattccagcagctgcccgacgttgacgccgtgatctaccccccatcaggtggatctcgcgccatcgagggcgtcgaaggacttcggatgacctgggggcgcgccgtcatactcgaagcgatgcggcgatatctccagcagcgccgcgcgatggagccgtgggaagaccctgcagggatctcgcatctggagattcagaagctcatgtacttcgccaacgaggccgatcccgatcttgcgctagatttcacgcccggccgatacgggccatacagcgaacgtgtccgtcacttactgcaaggaatggagggcgcattcacagtcggcctgggtgacggcaccgcaagagttcttgcgaaccaaccgatctcgttgactactaagggaactgacgccataacggactatctggccaccgatgcggcagctgaccgggtgagcgccgcagtcgacacggtgttgcgcgtcatcgaaggctttgaaggcccatacggggttgagctgctcgccagtacgcattgggtggccacacgtgagggcgccaaggaaccagccacggcagcggccgcggtccgaaagtggacaaaacgcaagggtcggatctacagcgacgatcgcatcggtgttgccctcgaccgcattcttatgactgcctga

SEQ ID NO: 5741 - DNA, 1059 bp, Mycobacterium bovis BCG Pasteur 1173P2; identical to SEQ ID NO: 5740

SEQ ID NO: 5742 - DNA, 1059 bp, Mycobacterium bovis BCG Tokyo 172; identical to SEQ ID NO: 5740

SEQ ID NO: 5743 - DNA, 1059 bp, Mycobacterium tuberculosis 210; identical to SEQ ID NO: 5740

SEQ ID NO: 5744 - DNA, 1059 bp, Mycobacterium tuberculosis 98-R604 INH-RIF-EM; identical to SEQ ID NO: 5740

SEQ ID NO: 5745 - DNA, 1059 bp, Mycobacterium tuberculosis CDC1551; identical to SEQ ID NO: 5740

SEQ ID NO: 5746 - DNA, 1059 bp, Mycobacterium tuberculosis F11; identical to SEQ ID NO: 5740

SEQ ID NO: 5747 - DNA, 1059 bp, Mycobacterium tuberculosis H37Ra; identical to SEQ ID NO: 5740

SEQ ID NO: 5748 - DNA, 1059 bp, Mycobacterium tuberculosis H37Rv; identical to SEQ ID NO: 5740

SEQ ID NO: 5749 - DNA, 1059 bp, Mycobacterium tuberculosis KZN 1435; identical to SEQ ID NO: 5740

SEQ ID NO: 5750 - DNA, 1059 bp, Mycobacterium tuberculosis KZN 4207; identical to SEQ ID NO: 5740

SEQ ID NO: 5751 - DNA, 1059 bp, Mycobacterium tuberculosis KZN R506; identical to SEQ ID NO: 5740

SEQ ID NO: 5752 - DNA, 1059 bp, Mycobacterium tuberculosis KZN V2475; identical to SEQ ID NO: 5740

SEQ ID NO: 5753 - DNA, 1059 bp, Mycobacterium tuberculosis SUMu001; identical to SEQ ID NO: 5740

SEQ ID NO: 5754 - DNA, 1059 bp, Mycobacterium tuberculosis SUMu002; identical to SEQ ID NO: 5740

SEQ ID NO: 5755 - DNA, 1059 bp, Mycobacterium tuberculosis SUMu003; identical to SEQ ID NO: 5740

SEQ ID NO: 5756 - DNA, 1059 bp, Mycobacterium tuberculosis SUMu004; identical to SEQ ID NO: 5740

SEQ ID NO: 5757 - DNA, 1059 bp, Mycobacterium tuberculosis SUMu005; identical to SEQ ID NO: 5740

SEQ ID NO: 5758 - DNA, 1059 bp, Mycobacterium tuberculosis SUMu006
atgatcacgtacggctctggcgacctccttcgggctgacaccgaagcgctcgtcaacaccgtcaactgtgttggggtgatgggcaagggaattgcgctgcagttcaaacgccgctaccccgagatgttcaccgcctacgaaaaggcgtgcaaacgcggcgaagttaccatcggcaagatgttcgtcgtcgacaccggacagctcgacggaccgaaacacatcatcaacttccccaccaagaaacactggcgtgcaccgtcgaagctggcctatatcgacgccggcctcattgatctcatccgcgtgatccgtgaactcaacattgcttctgtggcagttcccccgctgggggtgggcaacggaggtctggattgggaagatgtcgagcaacggctcgtatcagcattccagcagctgcccgacgttgacgccgtgatctaccccccatcaggtggatctcgcgccatcgagggcgtcgaaggacttcggatgacctgggggcgcgccgtcatactcgaagcgatgcggcgatatctccagcagcgccgcgcgatggagccgtgggaagaccctgcagggatctcgcatctggagattcagaagctcatgtacttcgccaacgaggccgatcccgatcttgcgctagatttcacgcccggccgatacgggccatacagcgaacgtgtccgtcacttactgcaaggaatggagggcgcattcacagtcggcctgggtgacggcaccgcaagagttcttgcgaaccaaccgatctcgttgactactaagggaactgacgccataacggactatctggccaccgatgcggcagctgaccgggtgagcgccgcagtcgacacggtgttgcgcgtcatcgaaggctttgaaggcccatacggggttgagctgctcgccagtacgcattgggtggccacacgtgagggcgccaaggaaccagccacggcagcggccgcggtccgaaagtggacaaaacgcaagggtcggatgtacagcgacgatcgcatcggtgttgccctcgaccgcattcttatgactgcctga

SEQ ID NO: 5759 - DNA, 1059 bp, Mycobacterium tuberculosis SUMu007; identical to SEQ ID NO: 5740

SEQ ID NO: 5760 - DNA, 1059 bp, Mycobacterium tuberculosis SUMu008; identical to SEQ ID NO: 5740

SEQ ID NO: 5761 - DNA, 1059 bp, Mycobacterium tuberculosis SUMu009; identical to SEQ ID NO: 5740

SEQ ID NO: 5762 - DNA, 1059 bp, Mycobacterium tuberculosis SUMu010; identical to SEQ ID NO: 5740

SEQ ID NO: 5763 - DNA, 1059 bp, Mycobacterium tuberculosis SUMu011; identical to SEQ ID NO: 5740

SEQ ID NO: 5764 - DNA, 1059 bp, Mycobacterium tuberculosis SUMu012; identical to SEQ ID NO: 5740

SEQ ID NO: 5765 - DNA, 1062 bp, Nitrosococcus halophilus Nc4 uid46803
atgatcgagtataccaaaggtaatctgctgaaagccgatgtggaagccctggtcaacaccgtcaatacggtcggcataatgggtaaaggtattgctttgatgttcaaagaagccttcaaggataactttgatgcctatgccgcggcttgcaaagccggtgaagtcaaaatcgggcagatgttcacgactgaaaccggcaacctgatgggaccgcagtggatcatcaatttccccaccaaaaaacactggcgcaataaaacaaagctggcatggattgaggaaggcctagaggatctgcgtcgcaccattatcaaatacgggattgactctattgccatcccccccctgggttgcggcaatggcggcttggattggcgcgaggtaagaccactcattgaaaagtgcttggtagatctgaatggtattcatattctggtctatgaacccactcagaaatatcagaatgttgccaaacgcaagggtgtacaaacattgacccctgcgcgtgccctgatagccgaactcgtccggcgctattgggtgctgggcattgaatgcagcctgctcgaaatccaaaaattagcatggttcctggaacgtcgtctggaagaaagcggattagataatccactccagcttgattttaaagccaatcgttatggcccctatgctgaccggctgcgccacttgttggatgccctggatggtagttatctgcgctgcgacaagcgattggccgatgccaaacccgaggatacgatcgctttcaatgatacccaaaaagaatatgtggcaacctacctgaaaagtaaagccaaggcctatctgccggcgctggaggcaacgacaaaactgattgatggcttcgagtcgccactcggtatggagctactggctaccgtcgattggttgttagtccgcgagcactgcaaacccgaagtagaggatgttaaacgaggcattgcccattggcccgctagccgaagtgccgcacttaggaaacaacgcatatttgatgatcgtttaatcagcttggcactcgaacgcctagccgcctactga

SEQ ID NO: 5766 - DNA, 1059 bp, Nitrosomonas europaea
atgattgaatatacatctggagatatccttcgttgtgaagccgatgcactggtaaacactgtcaattgcgtcggagtaatgggacgaggtatcgctttacagttcaagaatatgtacccggctaactttaaggcctatgaagcggcctgtaagcgcgaggaggtacaacccgggcgtatgttcgtttttgaaacgaaacagcttacaccgccacgccttatcataaatttccccaccaaacgccactggcgcggcaagagccggatcgaagatattgaagcaggtcttgtagatctggttaatgtcatccgcgataaaaacatccgttctattgccatcccacccttgggagcaggtttagggggattggattggaaagaagtgcgcccgcgtatcgagcacgcgcttggtgaattagagggtgtgcaagtgatcgtgtatgaacctaacggtgcacccgccagcgacaaaatggcccatgtgcgagaggtacccaaaatgacatctgggcgtgctgctttggtagaacttatgcagcgttacctcagtggcttgcttgatcccttcgtcaccctgctggaagtccacaagctgatgtacttcatgcaagaagccggtgagccgctgcgccttgattacatcaaacatcactatggcccctacgcaaagaatctgcgtcatgtattgaatgcaattgaaggccacttgatcgctggttacgctgacggtggtgacgcacccgataaacccctatcccttgttcccggggcagtggccgaagctaagagttttctcgatcagcacgagatcagccgtgcccgtttcgagcgcgtaacgcgcttggttgaaggctttgagtccccatatggtctggagctgctggctacggtgcactgggtgatacatcgcgaaggcgctacacaaagcgacagtgtgaagcgccaaatctatcagtggaatgaccgtaagcggcagtttacgcagcgccagcttgttattgctgaggagcggttacgttctcagggatggctgtcacctgaaactacttttacttactga

SEQ ID NO: 5767 - DNA, 1050 bp, Oscillatoria sp. PCC 6506
atgatagaactcacgcaaggcaacctcttagacgcagatgcagaagccctcgttaatacggttaattgtgttggcattatgggcaaaggaattgctttacaatttaaacaagcatttcccgaaaacttccgccaatacgcacaagcttgccgtagtagtaaagtgcagccaggacaaatgtttatagtctctactggcaacttatttaatccgcgttacattattaatttcccgacaaaacgccattggaaaggcaattcacggatagaagatatagagattggacttaaagcactgatcgcagaaattaagcgattaaatattaagtctattgctattccgcccttgggttgtggaaacggtggtttatcttggacacaggtaaaacccttaattgaatcagcttttatttacttgccaaatgtaaaagttttgctgtttgcaccacagaatactcctgaagttgatagaatgcgggtagctacagaaaaccccaaaatgactcgcgcccgtgccttgtatattcgcttgctagaattatatcggcttcctggttatcggttaacaatgctagaaattcaaaaattagcatattttcttcaagttgcaggagaatcgctaaagttgcaatatacgagggacaaatacggcccttatgctaataatctccatcatgtctttcaaacattagaaggacattatatcagaggttatggagatcgaagccaagaggcgcaagtttatgtattaccagaagggaaaaaagcggcagaaacctttttagaaaataaccctgatgctaatgctagattagagcgtgttagtaggttaattgaaggctttgaaactccttatggcatggaattattagcaacagttcactgggttactcaggaagatcaggaagcagtagaagatgtggagaaagcgatctctcttgtaaaagaatggagtattcgtaagcgcgatctctttaaacctcaacatatccgcaaagcatggcagcgtcttcgtgaggaaaactggttatttcatatcaagttcgattaa

SEQ ID NO: 5768 - DNA, 1038 bp, Parvibaculum lavamentivorans DS-1
atggggcatgccgtgatcgagtttagaactggcgacattctggacgcggatgtggaagcgctcgtgaatacagttaactgtgtgggtatcatggggcgcggtattgcgcttcagttcaagaatgcttttcccgaaaatttcaaagcttataaggctgcatgtgattgtcaggaagtgcagcccggcaaaatgtttgtatttgaaactcacaagtttactggccctaggtttgtcatcaattttccgaccaagcgtcattggcgtggcaaaagccgtatggaagacattgactccgggctcaaggcactcgtaggagaaatccgccaacgtggcattcgatcaattgctgttccgccgttggggagtgggctcggtggtttggtttgggctgacgtgcgtccacgaattaaggcagctttacaagatattgaagggctcaaagtgattgtttttgagcctagtgctgcagttgttacgacgaagtcccgggaaataccaaaaatgacagcagggcgtgctgctcttgttgtgttgatgtatcggtatctgggagggctgatggaccctttcgtaacgctgcttgaaatccacaagcttctgtattttatgcaagaagccggtgaatctttgcgtttgaagtatgcgaaagcaccatatggtccttacgcagaaaatttacgacatgtgctcagtgcagtggaggggcatctggtgtccggctatgcagatggcggtgacacgccagataaacaaatcgaattagtgcccggtgcggtccaagatgccgaggcttatcttgatcacaacacggatactattagtcgttttgatcgtgttgggaaacttgttgagggatttgaaacaccgttcggactcgaacttctggcgactgttcattgggttgttacgcgcgaaaatgcttcctctgctgaagaagccgctgaaaaagtatacgcatggagtgatcgtaagaaacgcttcacgcctcgtcagatagctatcgcttttgatacgctacgctcgaagggctgggcttga

SEQ ID NO: 5769 - DNA, 1068 bp, Pectobacterium carotovorum PC1
atgatcacatttacacaaggcaacttactggatgcgcccgtggaagcactggtgaatacggttaataccgtcggtgtcatgggtaagggtatcgcgctgatgttcaaagaacgctttcccgccaatatgaaagcctacgccctcgcctgcaaacagaagcaggtgatgaccggcaaaatgtttattaccgaaaccggcgaactgatggggccgcgctggattgtcaacttccctaccaaacagcactggcgagccgactcgcgtatggcgtggatcgaagacggtttgcaggacttacgccgctttttgatcgagaaacaggtgcagtccatcgccattccgccactgggcgcgggcaacggtggcctcaactggccggacgtccgggcgcatattgaatctgcgctaggcgatcttcaggacattaatatcctgatttatgagcccaccgaaaaatacctgaacgtcgccaaaagcaccggcgtaaaaaagctcacccctgccagagcgatgatcgctgaactggtgcgccgctactgggtgctgggaatagaatgcagcctgctggaaatccagaaactggcatggcttttacaacgcgcgattgaactgcaccggcaggacgatgtgctaaaactgcggttcgatgctcactattacggcccctacgcaccgaacctgagtcatctgcttaatgcgctggacggcacctatctgaaagccgagaaacgaattccagacagtcagccgctggacgtgatctggtttaacgatcgggagaaagatcgcatcgaagcctatttgaatagtgaagccaaagagtggctccccgcgctgaaacaagtcagtcagctaattgacggctttgaatctccattcggtatggaactactggcgaccgtagactggctgttggcccggggggaatgccagcccacgctggattccgttaaagaagggctgagccagtggcctgcgggtgaacgctgggccagccgcaagatgaagttattcgatgataataatctgcaattcgccattaaccgcgtaatggagttccatcgctga

SEQ ID NO: 5770 - DNA, 1050 bp, Pedobacter sp. BAL39
atgatctataaagtaggcaatttactggaagcaacaacacaagccctggttaatactgtaaacacagtaggtgtcatgggcaagggaatcgccttgcagtttaaagagcgttttccccagaattacaaattgtatgctgatgcttgtaagaaagggttggttgaggtaggtaaaatgcttgtggtgaccgaacgtacattagaaggtgaaaaaatcatcattaactttcctactaagcagcagtggtttaaaaaatcgcagtacagttttatcgaagagggcctaaaggcacttgttcaggaaatcaaagatcgggacattaaaagtattgcaataccacctttaggatgtggtaacggaggccttaaatgggaaaaaatccggccgatgatggatcggtacctttctgatcttcaaggggtagagattgtggtctttgaacctaatgatgctgttaaagaaattttgcagaatgagcaaactaagaaagaagttagtttaactccaggaagagccatgttattatacgcattgtttcgctatgaaaggttgggtgaagttgcgagtatatttgctgcgaataaattggcgtatttcttacaagaaagtggagagaaattaaaactgcagtttaccgcctatacttatggtccttatgcacaggcagtagaaaaggtattatattccatgaatggtaaatacttatccggcctggaacagatgcaggcaaagccgtttgaaccattaaagttaaattgggagagattgacagaagtcgaacattatatcaaaacttctctttccgatgaccagaggcaacgaattgaaggcctctttcgggtgattgatggtttcgaatccacactatctcttgaaatactttcgtctatccattatttgttgtcacaggaccctaaattatcaaagcaagaacttcttttaaaaatccaggcgtggaacgaaagaaagaaacaagtaatcaaagaagagtatattgggattgctttagaacatctggataactatagcagacaacttaaatttgcttag

SEQ ID NO: 5771 - DNA, 1053 bp, Prevotella timonensis CRIS 5C-B1
atgataagctataccacaggaaatctttttgacagtcatgcacaggcattggttaataccgttaacacacaaggtgtaatgggaaagggtatcgccttgcagtttaaggaacggtaccctaataattataagtcttatcgtcaagcctgcaaagaccaaaaagtagtgattggaaaaatgtttattactgaagaaagggagatggacggtaataaacgacttattatcaattttccaacgaagcaacattggagaaactcctctcaatactcttatatttcatcaggacttcaagatttacgtcaggagataatagacagagatattgcttctatagctatacctgctttgggaagttgcaatgggggattggattggaataacgtaaaacgtatgatagaagaatatctgcacgatttagattgtcagataatgatatacgaacccaatgcacttatcatagacagaatgaaaaaggagaaagccaaactcacacctgcccgcgccatgttgcttagcgtattatgtgatatggttttagaagatggtactccttctgagttcgcagcagagaaaattgcattttttcttcaagagtttggagccaaggatgcctttcgtcttcaatttcaaaaaggatattatggaccttattcgggtaaggtaaaatatgtgttgcattatctcaacggaagctacatcatgggtatggaaacaatgaacaacaagccttttgatgatttttggctgacaggcgatgcggcaaatgtggttagtgagtatttgcacaaaaaagaaaatcagcgttggcttggcatcgctgaacgaacaaaagagtttctgcgcggattttactctaactatatgttagaactcctagctactattgcatatctttcaaaaacggataagacgttattgaatgcaaaaactgaagaagaaaaaatagaaacaataggacgtgatttagcccaatggagtaatcgcaagggcaagatgtttcataaggacaaatatattggcatggcacttcagcatttaagggataagtga

SEQ ID NO: 5772 - DNA, 1089 bp, Pseudomonas entomophila L48
atgattcgctttacgcaaggtaacctgctggaggccaaggccgaagcgctggttaacacagtcaacaccgttggggtgatgggtaaaggcattgcgctgatgttcaaagagcgctttgtagagaactatcgcctgtatgcggctgcctgcaaagcggacgaagttgtcactggaaagatgttcatcaccgaggttcgtgagctggacggcccgcgctgggttgtgaactttccgaccaagcgtcattggcgttctccatcacagcttgcctggatcacagatggccttcatgacttgcggagcttcattcttgccaatgacgtgagttccatagcaatccctccactgggggcgggtaatggcgggttgccttgggctgctgtgcgcgaacagattgaagtggtgctgggggatctggatgctgacgtgctcgtatttgagcccacgagcaagtatcaaaatgtctcgaagcgcacaggggtcgagaagcttacccctgccagagcgctcatagccgagctggtgcgtcgttattgggtacttggtatggagtgcagcttgctggagatccagaagctggcgtggttcctggagcgctcaatcgagcgcttcactcctgatgacaacccgctcaacctgcagttcagtgctcacaagtacggtccttacactaaccgactggagcatctactgaataatctcgatggtagttatctccattgtgacaagcgtatcggtgatgctggccccttggatgtgatctggttcgatgaggggcggaaggctttcgttgatacttacttgcacagtgaggctaaggtccatttacctgcgttggagtttacggctgagctgattgatggctttgagtctccatttggtatggagcttctggccacggttgactggatgcttcatcgggatggggtggcaccaacggtcgatgctattcgggaagggttgcaaaattggtcaggtgggaaggaagcagctgcccgtaagaatgccctcttcgatgacgactctttggcaactgcactaaaaaagctctcggttttccaggctcaaggcgtagtgcaagtacattga

SEQ ID NO: 5773 - DNA, 1083 bp, Pseudomonas mendocina ymp
atgattagatttacacaaggcaatttgctggaggccaaggtcgatgccttggtcaataccgtcaacactgtcggcgtgatgggcaaaggtattgccctgatgttcaaggagcgctttgctgagaactaccggctatacgcggcagcctgcaaagccaaacaggttgaaactggcaagatgtttgttaccccggtgcaggaactggatggtccgcgctggatcgtcaacttccccaccaagcggcattggaaggctccttccaagatggaatgggtcgttgaggggttgactgatctgcgtacctttatcctcgataatcatatcgagtcgattgccgtacctccgctgggggccggtaatggggggctggaatggatggctgtacgcgagcagatcgaggctgttctgggcgacctgcatgctgagattttggtgtttgaacccacttcgcagtatcagaacgttgccaagcgctcaggggtagagaagttgacgccggcccgtgccttgatcgccgagttggtaaggcgctactgggtattgggtatggaatgcagctttctggaagtgcagaagctggcctggtttctggagcgcggtatcgagcgattttcgcctgcagacaatccactgaaccttcagtttgttgcccataaatacgggccctatgccaaccgtcttgagcatttgctgaacaatctggatggcagctatctgcatgccgaaaaacgtatcagcgattcggacccgcttgatgtcatctggtttgatgacgagcgtaaggcctatttgcaggcttacttaaacactgagtcaaagccctatcttgaggccttggaacgtacagcagaccttatcgacggctttgagtcgccctttggtatggagcttttggcgaccgtagattggctgttggccaaggagcatgttgaggctacggtgccggctgtacggcaagcgctaaggaagtggggcggtgggccaggtgctgctacacgcaaggatcgcttgtttgatgatcgtgcgttggccattgccttggagcgcctgacgcagtcgggttttagtgctgtagcggcttga

SEQ ID NO: 5774 - DNA, 1038 bp, Rhodopseudomonas palustris TIE 1
atggcgatcaggctagtgacgggcaacctactggagcggcgcgtcgacgcgatcgtcaacacggtcaacactgtcggcgtgatgggcaaaggaattgccctgcagttcaagcgcaaatggccggcgaatgccaaagcctacgaagcggcctgcaagcgcggcgaagtcgttcccggtaagatgttcgtgttcgacaatggcggcctcatcgcaccaaagttcatcatcaatttcccaaccaaacggcactggcgacaaccgtcgcgaatggcagacatcgaagctggactggtcgatttaatcgtccagatccggcacctgcagattcgatcaattgcgctccccccgctcggctgtggaaatggtggtctcgactgggaccaagtgcgcccaaaaatcgaggcagccttccgagagttgccggacgtagacgtcgagcttttcgcacccgcagaggcagctggcgttcgccaactcgagccggaagcacagaagccgcggatgactcccggccgtgctgcgattctgaaactactctcaatataccgcgaaatgcgctatccgctaagtcagatcgagattcaaaagctcgtctatttcctggcaagcgccggccaggcaatgggtagtctgacgttcaagaaacacatttatggcccctacgcacccgagctgcgccacgtcctgacgaagatggatggtgcatatctacatggggtcggcgatggctctaagccttccgagataacggtggtcggtgaggcacttcgagaggcggaagctttcctcaactcccaccaggactttgaaaccgtgcgacgcgtcgagcagattgcgcggctgatcgacgggttcgaaacaccttacggcatggagttgctcgccacggtgcattggaccgcgaacgagacaaaaacgacagatctaaaccggatcgtcgaagctgttcatagctggaacgagcgtaaacgccagattatgctgcccgcgaacatcaagtcggctcgtgaccggttggtgactgaacagtggctgtaa

SEQ ID NO: 5775 - DNA, 1065 bp, Roseiflexus sp. RS-1
atgatcgaatacgtaaccggaaacatcctcgaagccgaggttgaggccctggtaaactccgtcaactgcgttggagtgatggggcgcggcgttgcgctgcaattcaagaaggactggcctgaaaacttcaaggcttatgccgctgcctgtcgtcggcaggaggttcagcccggcagaatgttcgtcttcgagaccgggaatcttttcccacgctacatcatcaacttccccaccaagcggcactggcgcgggaaggcgcgcattgaggatatcgaggcggggttgagcgctcttgttgaggaaatccagcgtcgcggcatacgctcggtggctttgccgcccctgggctgcgggttgggcggtctggagtggtctgaggtgcgcgcacgcattgaagagacgctggcgggactcgtcgacgttcgcatcctcgtcttcgaaccgactgaggtacagccgctgccacgaagcatgcgccggggtccggttccctctatgacgcccggacgtgcagcaatggtcgtcttgatggaacgttacctggtcggcttgctcgatccgttcatttccctgcttgaggtgcacaaactgatgtacttcctgcaggaagccggtgagccgctccgcctgcggttcacgaagggtccatacggaccctgcgccgaaaatcttcgccacgtcctcagtgcagtcgagggctactatatttcgggcttcggaaatggcggcgaccaaccggacaaggtgctggaactggtacccggcgccatcgacgatgcccgacgagttttggatcagcagccagagatgcgcgaacgcttcgagcgggtcggtcgcctcgtggaaggcttcgaatcgccttttggactggaactgctcgccaccgtgcattgggttgccactcgtgagcgcccggcgacagaggaagaactcatcgaacatgtctatgcatgggcggagaggaaacggcaattcagccgggatcaaattctgctcgcagccagagttctggcggagaaggggtggatcgagggagtgttggcagaaacggtaggaggttcgtga

SEQ ID NO: 5776 - DNA, 1038 bp, Roseovarius nubinhibens ISM
atgaccattacattcaaacgcggtgatctgttctccgagcctgtcgaggctttggtcaacacagtgaactgtgttggcgtgatggggaagggagtcgcgctggagttcaaaaagcgctggccagcaaacttcaaggcctacaggaaactatgtgagaacaaagagctgataccgggtcgaatgttcatcttcgacacgaaggaactctttccatcggaaggcccccgatatcttgtcaactttccaactaaggcacattggcgctcgaagtcaaaaatctcttatgtggaagatgggttggatgctcttcgaggagagataaccacgcacggtatcaagtctattgctatccctcctcttgggtgtggcaatggtggcctcgactggtccgacgtgaaaccgctaattctatcgaagctgtcggacttagaagacgttgaaatcgtggtttttcctccgaaagattcaatggatgaacctgagcatcttcattccaacttacccatgacttatgcgcgggccatgctgttgaggggcttgagcgacctggagagatattttgacggttcgttcgatagagtttcgttgcagaaaatcgcgtatttcctgcaagcctttggtgttgattttaagctgaagttcgcccgaaatctctatggaccctactctgaaaacttaaagaaggcttacgttgccctcgagaaccacggaatgatcagtggttttctgacgggagatcgccaagctcatgtgacccccagcggctgcgccgtagctgatgagttcttgagtgaatctgatcatggcagcgaacaaatcattgatcgtttgagtaaactcattcaaggctacgaaagcccgtatgggcttgaactgctttcctctgttcattggctggcacatcatgaagggcactacccagtcgaaaagatcatcgacgaaatgatgagttggaacgaaaacaagagaaacaccttcggtgaggacgcaattcgtgccgcctatggtcgcctcaaggaagatggattgttaaattaa

SEQ ID NO: 5777 - DNA, 1116 bp, Ruminococcus flavefaciens FD-1
atgaagatattgataggtaatttgttcgacagtaaggcacaaacacttgtaaatacagtgaattgtgttggcgttatgggaaaaggtatagctcttgaatttaaaaagcgttatccgttgatgttcgatgaatactcaaataaatgtaaattgaaagaggttaaacccggaacaccatatctatatcaggatattaccggagtatcagttctgaattttccaaccaaggataactggagatctccgtcaaagctgtcatacatcgttgatggacttgattggtttgtaagaaattatgagcagcttggaataagatcaatagcttttccacctcttggatgtggcaatggcggtcttacctgggaacttgtgggtccgattatgtacaacaaattgagtacattgccgatagatatagaaatatatgcaccattcggaacaaaagctgaacacgtttcggtttcatatctatgtgacaattacaaagaatacaatgcagatgttgagggaatgaagaacgcgtctgttcgtcattcatggtatctgatacttgaagttataaaatcactcaatactaacaggtattctcttcatgtaggaagggtcatttttcagaagatctgttacattctgacgcgtttgggagtcgatactgggttcgtatttacccaaggaagctacggcccatattctgatgatataaagagagctacagttgccctttcaaacgctaacatgatatacgaaaaaaactttggtaatatgatagaagttacggttgataatagttttaagctccattcagcagagtattccgagacagaacttgatgcagtcaataagacggttgatttattcagcagagtaaaaaacactgaacaggtcgaaatgatcgcaactgttatttatgcttttgatcaattgatgaaagataatcattatgtatcagacgaagaagtatataagtatgtaatggaatggaagaaaaggtggaaagattcaaagcagaaagaagtgtgcaatacaatcattaaccttgctatgcttggatggataaatattgatttcagtaataaactcagtatattaaccgagggagactatgaattgaattaa

SEQ ID NO: 5778 - DNA, 1041 bp, Shewanella putrefaciens CN-32
atgattgaaattactcatggtgatattttacgtgctgatacagaagcaatcgtaaatacagttaactgtgttggcgttatgggccgtggtatcgcgttgcagtttaagaaagcttggcctgataactttaaagcttacgcagcagcttgtaacagtaaaaatgtgcaacctggcaaaatgtttatctttgaaactgggcaacttgcaaatcctcgctttatcattaatttcccgacaaaacgtcattggaagggagcaagccggatagaagacatcgagtcaggtcttgttgctcttgttgcggatatacaaaggttagggattaaatctattgctatccctccattaggagctggtttaggtggattagattggctggtggtgcgagataaaatcgaagcggcaatgcaaccattaactgatgttcaaatattgctttatgagcctgcaggcgctccgcaaaacgatagaatagcaaagcaaaaagaagtgccgaagatgacggcaggcagagctgtgttaatcgaattaatgcagcgctacctgaaaggtttactcgatccgaccgtgtcactactggaagtgcataagctgctgtatttcatgcaagaagccggtgagccattacgtttgaaatatgaaaaggcgcattatgggccttatgctcagaatttacgtcatgtacttaatgctattgaagggcacttcatatctggctatgcggacggtggtgataagccagagaaagaacttcgactcgtccctggagctgtcaaagaagcacaagagttcttggagcaacatccagatacgcgtgaaagatttacaaaagtatctgagctagtagaaggatttgaatcgccactaggcttagagcttcttgcaacggttcactggctaaacaagtatgagcatgtaagaagcactgatcaagtcattgaaagtgttcactcttggaatacgagaaagcagctgtttacggctagacaaatcactatcgctgaaaaagtgcttgctagacaaaattggctgagtgcttga

SEQ ID NO: 5779 - DNA, 1038 bp, Stigmatella aurantiaca DW4/3-1
atgacgatcgagagcggaaaaggaaacctgctgacagccgaagtagacgccctcgtcaacacggtgaataccgagggggtcatgggcaaaggactggcccttcagttcaagaaagcattccccgagaacttcgtatcgtacgaacgggcctgcaaggcgggtgaggtcgtgcccggccgcatgcacatcgtccaccggctcgcatcccctcgcttcatcatcaacttccccacgaagaagcactggcggaatccgtccaagcttgagtacgtgcgtgatggccttcgcgatctcgtgacgcatgttcgcaagctcggcatccagtcgatcgccatcccaccgctcggttgtggaaacggtgggctcgactgggcggacgtgaagccgctgatcgtgcagtccttcgaagctctgcacgacgtgcgtgtcgtcctcttcgagcccgcagatgccccctcggcggacaagatcatcgaccgtcgcgaaacgcctgtgatgacaccggcgcgaggggcgatcctcgccctgatgggccgctacattgaaaccggttacaactaccggctgtcgctcgtcgaggtgcagaaactcgcctactttctccaggacgcgggtgagccactgcgtcttgagtatcgcgcgcaccactacgggccctacgccgacaacctgcgcaaggcgctgcggaatatcgaagggcactacacgcgtggcatgggtgacggtaagaacagtccggagacgccactggagttacttcccaacaccgtgacctccgcgcgggagttcctcaagacgcgtcccgagacactcgcccgcttggagcgcgtcgttcagctcatcgatggctttgaaacccctttcgggatggaactgcttgggacggtccactgggtgatgcgccatgaggccaattcaggcgacgtggagggcgtcatcgcgaaggttcatgcgtggagcgagcgcaagcggtcgcagatgaaggacggtcacatccgcgcggcgtggacgcgtcttcacgcgcagggatgggcataa

SEQ ID NO: 5780 - DNA, 1047 bp, Synechocystis sp. PCC6803
atgtttgaatgtaaaagtggcaacatcctaacagaagataccgaagccctggtcaacaccgtcaactgtgtgggcgtgatgggccgtgggatcgcgctacagttcaagaaagccttcccagagaacttcaaagcctatgcccaggcttgtaaagaggaaaaagttaagcccggcgaaatgtttgtctttcaaaccggacaactggtaaaccctcgctttatcatcaactttccaaccaaacgtcactggcgtacccatagccgtatagatgatattgaaaacggactaaaagcccttaaatgtactatacagaaatacaagattcgctctatcgccattccccccttaggttgtgggttggggggccttgattgggctgaagttaaaacccgcattgaagtaatcctcaagcctcttgataacgtacagattatcctctatgaaccccatggtgaactatcccaagcaaaaacggtacagagtcttcgtgcgccaaagatgacccctggtagagctgtgttagttgagttggtcagccgatatctccaaggtttgttagatccctttatcactctgctagaaatacacaagctaatgtattttatgcaagagtcaggggaattcctgcaactcaggtatgcaaaagcgccctacggcccttacgccgaaaacctgcgccatgtcctgaatgttattgaaggacatctcatcaccggatatgcagatgggggtgatcaacccaataaacccatagccctactgcccaatgcaattgagaaagcaactacattcctacaggattatccagaaacccatactaggtttgagaaagtgaccgatttagtggaaggatttgagtctcctttcggtttagaactactgtcaaccgtgcactggatagtcaagaatgaaccagtcaattctttgtctgatgttattgatcgcacctacgcatggaaccagcgtaagcaacaattcacccaaagacaaatcgagctagcagtcaatgttttgaacaaaaagggctggattaatcgtccttattaa

SEQ ID NO: 5781 - DNA, 1113 bp, Syntrophothermus lipocalidus DSM 12680 uid49527
atggttaaggtagttgtgggcgatatatttgagtcccaagcgcagacgttggtcaatacggtcaactgtgttggagtaatgggcaaaggcatagcgttggagttcaagaaacgttttcccgaaatgtttgcagactaccaagcaagatgtgcccgcaatgaggttcgcgtgggctacccatatctatacaagtctttagtacctccttgggttcttaactttccgacgaaacgccactggcgctctctttcgagggtgaaggatatcaccaaggggctcgattatcttgtacaacactacagggagtggggtattacttcgttagcagtgccacctcttggatgtgggcagggtgggcttgagtggcgggtcatggggcctatactgtatggcgctctgagcaggatggatattccagttgagctttacgtaccggcgggcacccctgattggcaacttgatgccgatttcttgggcagtttgtcgagtccaactcgcggcaggaatcggtctgaggaaacgatggagttcaacccagcgtggctggtattggtcgaaattctgaagcgactggaggaagagccttatcactggccaatagggcgtgttacatttcaaaaaatagtatatgtttcgacccgggaaggaataccaaccggtttgcagtttgggcgcagcagttatggacctttttcacctgggctgaaagcactgatgaccaggttggttaatatggggcttatttgtgaaaagccgctgggacgcatgattgaagtgagggtaggcccggcctacaaggacgtcagaactaagtatcaggctcaaatagaacaatggggtggtgtcatagatcggattgtcagccttttcatgaggatgaagaccaatcaagccgaaatagtggccacggtactttatgtaaacagcgagcttatggagcgtacgggggaaaaacccactgaacgcgatgttttgaatgaggtgatgctctggaaacagcgccggaggccccctctagacgaaaacgaggtagcggttgctatacgaaatctagcagcccttggatgggctcaggtcagggcgagtatgaacttgcggctctatggtgaatga

SEQ ID NO: 5782 - DNA, 1056 bp, Thauera sp. MZ1T
atgatcaagctcacgcaaggtgatctgctgaagcaggacgatgtcgacgccatcgtgaacacggtgaactgtgtcggcgtgatgggcaagggcatcgcgctgcaattcaagaacaagtggccggacaattttgctgagtacgcggcagcttgcaaggcggggcaagtgcgtccgggccgaatgttcatccacgactcaggcggcctagtcaagccgaactacatcatcaacttcccgaccaaggaccattggcgcggcgcctctaggatggcgttcatccgcgacggtttgatcgacctagtgacgcaggtgcggcgcctcggcattcggtcaattgccatcccgccgctaggttgcgggaacggtgggctagactggacccaagtgcggcctttgatcgaagcttcattcgaagcgcttcccgatgttgaagtgcgactcttcgaacctgggggtgcgcccaatccaaagacgatggaagttcggaccaagcgtccccgcatgacgcccggccgggcagcaatcgtcaaggtcttgagcacgtacggtgagctgaactacgggctatccaagatcgaggttcagaagcttgcgtactttctgcaggaggccggcgagccgctgcagcttcagtttgtgaagcaccactacggtccgtactccgacacgctacgccacgcgctgaacacgatggaagggcacttcattcgcggcctgggcgatggtgttgtcgaagccgaaatcgagcccacggaagacgcacttgccgaagccgaggcgttcatcgcaaacgaaggccattcggcgctctcagcccgtgttgagcgcgtggggcggcttatcgatggctaccaatcgtcgtatggcatggaactgttggcctcggttcactgggtcgcggcacacgagcccggcgtacgctcggtcgatgaagcgattacggcggtgcacggctggaacgatcggaagaagctgctcatgcagcccgatcacgttaagtttgcttggcatcggcttgctgaggaaggctggctttcgtctagcgcttttccgtag

SEQ ID NO: 5783 - DNA, 1083 bp, Thermus aquaticus Y51MC23
atgctccgcttcgtgcgaggcaaccttctagaggccccggtagaagccctggtgaacacggtgaacaccgtgggggtcatgggcaagggggtggccttgcagttcaaacgggctttcccagacaactaccaggcctacgtgaaagcctgcgagcggggccaggtccagattggccgcatcttcgtttatgaccggggccccctagcccagccccgctacatcttcaacttccccaccaagaagcactggcgccacccttcccgtatggaatacgtagaggagggcctcaaggaccttgtatgccggatccaggagcttcgggtccgctctatcgctctgccccctttgggggccgggaacggaggcctgccttggcccgaggtcaaacaacgtattcaggaggccctcgaggcccttgagggcgtggaggtttgggtttacgagccagtggaaaaccctaaagctcactccatcgtccctctgaaaaccaagccccgcctcacccccgcacgggccgccctgctcaagctcttcgggctatacggagcgttgggggagcctttgggccgcctcgaggctcagaagctggcctactttctgcaagaagctggcctggatctaaagcttgacttcgcctgcaagcagtttggcccctacgccgagcccctgaatcacgtgctggcccgtctcgagggccactatatccagggtttcggagatcgtacggggatctcccaaatacgccttaaaccccaggccttggacgaggccgtcctcttcctcgccgactaccccaaggccgacgaagccgctacccgggcggcggactgggtcaagggatttgaaaccccttacggcctagaactcctggccacggttcactgggccgtacgccacgaaggagcccgggactgggctagcctacaaaaacggctccaagcctggaatcctcgcaaggctaccttccccaagacccaccttcaggtggccctagatgccctcctaaagcggggtgccctccgcccagaggagtggcaggaccgcccccccaagttgcccgccaacgtggcccaagaggcctag

SEQ ID NO: 5784 - DNA, 996 bp, Thiobacillus denitrificans ATCC 25259
gtggatgccatcgtcaacacggtgaattgtgttggcgtgatgggcaaaggcattgcgctccagttcaagaacaagtggccggcgaattacagcgcctacgaagcggcgtgcaaagccaaacaagttcgtccgggaaccatgtttgtcttcgactccggcggcttggtcaaacccaactacatcatcaacttcccaaccaaggaccattggcgcggcaagtcacgagttgagttcattcgtgatgggctggttgatctggttgcacaagtcaaacggcttggcattcgctccattgccattccaccgcttggttgcggcaacggcgggctggaatgggatgaagtgcgcccgcttatcgaacaggcatttgccgttctgccagacgtggaagtgcgactattcgcgcctgctggcgcgcctgatccgaagagcatggaagtgaaaacctcacgtccaaagatgacggcgggtcgcgcagctatcctcaaggtactcgatacctatcgttctctggaatacggtttgtctcgtatcgaagtgcagaagcttgcttacttcctgcaagaggctggcgagagcctcagtctgtcattcgtcaagaatcaatatggaccctattccgatcaactgcgccacgcgctgaaccggatggagggccacttcatacgtggccttggcgatggcgttgtggatgctgaaatcgaaccgctggaagacgcacttgccgaggcagagcagtacgtcagtgcaagcgggcacgctgctttggcccggcacgttgagcgtgtcgcgaatctgatcgagggttttcagacgccatacggaatggaattactggctacggttcattgggttgcaacccatgaaccgaccgcgcattcattcgatcaggtagtcagcgccgtacatgcctggaatgagcgcaaggcaaggatcatgcagcctgcgcatgtgcgggctgcatggagtcggctagacgctcaagggtggctataa

SEQ ID NO: 5785 - DNA, 1080 bp, Zymomonas mobilis
atgattatcttcacgcaaggcaacctactagaagctaaagtcgaggctcttgttaataccgttaacaccgtcggtgtgatgggtaagggtattgcgctcatgtttaaagagcgcttccacgagaactttcgcctgtattctgctgcgtgtaaggctaaggaagttcaaatcggtaagatgttcgttactccagtctatgaactaggggaaacacgctggattgtgaactttccgactaaacagcattggcgtaatccgtcacgaatagaatggattataaaaggcttacaggatctacggcgtgtcctgctcgaaaagaatataaaatctattgctattcctcctttgggtgctggcaatggcgggctttcatggaaagatgttcgtggacagatcgagttggccttaagtgatctcgatattgatatttttgtgtttgagccgactagccaataccaaaacgtggctaagaggacaggcgtagaaaaactaacgcctgcgcgcgccttaatagctgaattagtccgtcgatactgggtaatgggtatagaatgcagtttgcttgaaattcaaaagctggcttggtttcttcagagagctattgaacagtattctccagataataatccactgaatttagattttcagccacataaatatggtccttatactcatcagctaaaccacttgttgaatagtttagatggcagctatcttcactctgataaacgtatcagcgatagcgacccgctggatgtcattttatttgttaataagcgcaaagacgatttacaggcttatttgaaaagtgaggccaagccttataggcaagcgttagaatctgccgccatgctcattgatggttttgagtccccctttgggatggaactgctggctacagttgactggctgctaactcgcgaaaatatagaacctaatgtgccagctttacgtaagggattgcgttcttggcgaggtggtgaagatgcggccttgcgtaaagatcgaatttttaatgaccgatctttggggattgcgcttgatcgcttaactaaaacctctacgcttgcaatagcgtag

SEQ ID NO: 5786 - DNA, 1056 bp, Arthrospira sp. PCC 8005
atgattcactttaagcaaggcaacctattgacagaaaaggctgatgccctggtgaacaccgttaactgtgtcggtgtcatggggaaggggattgctttgcaatttaagcaggcgttcccggaaaatttccgagcctataaaacagcttgtgatgctaagagaatccatccggggcagatgtttgtagttgctacggataagctattccccaaatacatcattaatttccccactaagcgccactggaagggaaaatctaaaatagaagatatcaaagcgggattaattgcactggttgaggaagtcaaacggttagaaattacctcgatcgcaattcctcctctgggatgcggaaatgggggcttagattgggcggcagttaagcctctcatcgttcaatcttttgcggaagttcccgatattgaggtgatgatttttgaaccgactggcgcaccggtggcggaccaaataccggtggctacctctacccctaaaatgaccatcgggcgtgctttattgattcgcttgctggaattgtacgggattcctgggtatcgcttaactaagctggaaattcaaaaactcgcctattttttgcaagtagctggcgaaccgttaagactgcgctacgtcaaacatcaattcggaccttatgcagacaatcttaatcatgttttgcaaaagattgaaggtcattacattcgcggatatggcgatcgcactgaaacttcggcaatgtatgtcttagaaaagggtcgtgacgctgccgatcgctttttatcagcacatcccgatacgggcgcgcgcctgcaacgagtcagcgatttaattgaaggatttgagaccccttacgggctggaaatgttggcaacccttcactgggtggccacggaagatccgcaagctgccatcgattgcgatcgcgctattgaaaaagtacaggaatggagcgatcgcaagcgccatctatttaaacctaaccatctgcgaatagcttgggaacgccttgacactcagaactggtttgatatcaatagcgatgacgaaatccaataa

SEQ ID NO: 5787 - DNA, 1056 bp, Arthrospira sp. PCC 8005
atgattcactttaagcaaggcaacctattgacagaaaaggctgatgccctggtgaacaccgttaactgtgtcggtgtcatggggaaggggattgctttgcaatttaagcaggcgttcccggaaaatttccgagcctataaaacagcttgtgatgctaagagaatccatccggggcagatgtttgtagttgctacggataagctattccccaaatacatcattaatttccccactaagcgccactggaagggaaaatctaaaatagaagatatcaaagcgggattaattgcactggttgaggaagtcaaacggttagaaattacctcgatcgcaattcctcctctgggatgcggaaatgggggcttagattgggcggcagttaagcctctcatcgttcaatcttttgcggaagttcccgatattgaggtgatgatttttgaaccgactggcgcaccggtggcggaccaaataccggtggctacctctacccctaaaatgaccatcgggcgtgctttattgattcgcttgctggaattgtacgggattcctgggtatcgcttaactaagctggaaattcaaaaactcgcctattttttgcaagtagctggcgaaccgttaagactgcgctacgtcaaacatcaattcggaccttatgcagacaatcttaatcatgttttgcaaaagattgaaggtcattacattcgcggatatggcgatcgcactgaaacttcggcaatgtatgtcttagaaaagggtcgtgacgctgccgatcgctttttatcagcacatcccgatacgggcgcgcgcctgcaacgagtcagcgatttaattgaaggatttgagaccccttacgggctggaaatgttggcaacccttcactgggtggccacggaagatccgcaagctgccatcgattgcgatcgcgctattgaaaaagtacaggaatggagcgatcgcaagcgccatctatttaaacctaaccatctgcgaatagcttgggaacgccttcacactcagaactggtttaatatcaatagcgatgccgaaaccccataa

SEQ ID NO: 5788 - DNA, 1035 bp, Desulfonatronospira thiodismutans ASO3-1
atgatagagcatgtccaaggaaatattttgaacgcccagacagaagctctggtcaatacagtgaactgtgtaggcgttatgggcaaaggaattgctttgcaattcaagaaagcctttcctgaaaacttcaagacatatagaaatgcttgccagcgaggagaagtcaagcctggtcgtatgtttgtttttgataccgggcaagagcttccaagatacataatcaactttcccactaagcgtcattggcgagacaaaagcagatatgaagatatagaagctggtttgcaagccttggtcaaagaaataacggctcgaaatataagctctattgccgttcctcctttaggatcgggcctgggtgggctggattgggcaaagataaagccgatgatcgaaagagcattcagtgacctccccaatgtacagattcagttgtttaagcctgaaggatcgccccaggcttcagaaatgccagtaggctctgacaggccgcatctgacaacggccagggccttgtttatcaaactgatgcagcaatataagcgttttgcatacaggcttacccttttggagatacagaagttggcctatcttcttcaagagtctgggctgaacctgaggctttcctatgtcaggcattactatggaccatacgcacataatttgaacaaggtcctggagatattggaaggccattatatttcaggatatggagacacccaaaagcctgatgtggagatcaaactgttgcctgatgcaattgatgctgctgatgtactcctgagcaaacatctagaagcttataaacatctcaacagggttgccgaccttgttgatggctttgaaacaccttatggtatggagatgttatcgtcggtacattggctggcagttcacgaacggctggccgttgatcaacaaagcgctatatcagccatggctggatggaatgaacgaaaaaagtgtttgttcaagccagagcacatttgtattgcctgggaccggcttcaagaagagggctggataacctattga

SEQ ID NO: 5789 - DNA, 1092 bp, Methylobacter tundripaludum SV96
atgattacatttacacaaggcaatttgctggaagctccagtagaagcactggttaatacagtcaatacagttggcgtgatgggtaaaggcatcgcactgatgtttaaggaacgttttgctgagaacttccatttgtatgcaatggcttgcaaggccaagcaggtgcagactggcagtatgtttgtgacagaagtgcatgaactaggtgatggcccgcgctggattatcaattttcccaccaagcagcattggcgcgcgtcatcacgtatggagtggattatcgatgggctgcaagatttacgccgatttcttgtcgaacagcatgttaaatcggttgctatcccgcctctgggcgcgggcaacggtggcttggaatgggccgccgtgcggatgcaaatcgagagggctttgggcaatcttgatgttgagattctggtatttgagcctacccagaaataccaaaatgtcgccaaacgcaccggtgtggaaaagttgactcctgcccgtgctttgatcgccgaattggtacgctgctattgggtgctgggcatggaatgcagtttgctggagatacaaaagctggcgtggtttctggaacgagctatagagcaattttctccaggagacaatccgttaaacttgcaatttgttgcgcacaaatacggcccttacgctaatcggttaagccacttactgaacaacttggatggtagttatctgcattgtgataagcgtatcagtgacaccgatccgctcgatgtgatctggtttgatgatgaacgcaaggcttacttgcagacttacttgaaaacagaggcaaaggcttatataccagcgcttgagtatacgaccgcattgatcgacggttttgaatcgccattcggtatggagctattagccaccgtggactggcttcttagtaaagaaaacgtcgcgcctacggttgaggctatatatgaaggcttgaaacgctggccagccggcgcagcggagcgaaaatctcgtcttttcgataggcatactattggtattgcattggaacgcttgatccatccgcccattccgcaacggcctgaggtggtggatgtttga

SEQ ID NO: 5790 - DNA, 1059 bp, Mycobacterium tuberculosis 02 1987; identical to SEQ ID NO: 5740

SEQ ID NO: 5791 - DNA, 1059 bp, Mycobacterium tuberculosis 94 M4241A; identical to SEQ ID NO: 5740

SEQ ID NO: 5792 - DNA, 1059 bp, Mycobacterium tuberculosis C; identical to SEQ ID NO: 5740

SEQ ID NO: 5793 - DNA, 1059 bp, Mycobacterium tuberculosis CPHL A; identical to SEQ ID NO: 5740

SEQ ID NO: 5794 - DNA, 1059 bp, Mycobacterium tuberculosis EAS054
atgatcacgtacggctctggcgacctccttcgggctgacaccgaagcgctcgtcaacaccgtcaactgtgttggggtgatgggcaagggaattgcgctgcagttcaaacgccgctaccctgagatgttcaccgcctacgaaaaggcgtgcaaacgcggcgaagttaccatcggcaagatgttcgtcgtcgacaccggacagctcgacggaccgaaacacatcatcaacttccccaccaagaaacactggcgtgcaccgtcgaagctggcctatatcgacgccggcctcattgatctcatccgcgtgatccgtgaactcaacattgcttctgtggcagttcccccgctgggggtgggcaacggaggtctggattgggaagatgtcgagcaacggctcgtatcagcattccagcagctgcccgacgttgacgccgtgatctaccccccatcaggtggatctcgcgccatcgagggcgtcgaaggacttcggatgacctgggggcgcgccgtcatactcgaagcgatgcggcgatatctccagcagcgccgcgcgatggagccgtgggaagaccctgcagggatctcgcatctggagattcagaagctcatgtacttcgccaacgaggccgatcccgatcttgcgctagatttcacgcccggccgatacgggccatacagcgaacgtgtccgtcacttactgcaaggaatggagggcgcattcacagtcggcctgggtgacggcaccgcaagagttcttgcgaaccaaccgatctcgttgactactaagggaactgacgccataacggactatctggccaccgatgcggcagctgaccgggtgagcgccgcagtcgacacggtgttgcgcgtcatcgaaggctttgaaggcccatacggggttgagctgctcgccagtacgcattgggtggccacacgtgagggcgccaaggaaccagccacggcagcggccgcggtccgaaagtggacaaaacgcaagggtcggatctacagcgacgatcgcatcggtgttgccctcgaccgcattcttatgactgcctga

SEQ ID NO: 5795 - DNA, 1059 bp, Mycobacterium tuberculosis GM 1503; identical to SEQ ID NO: 5740

SEQ ID NO: 5796 - DNA, 1059 bp, Mycobacterium tuberculosis Haarlem; identical to SEQ ID NO: 5740

SEQ ID NO: 5797 - DNA, 1059 bp, Mycobacterium tuberculosis K85; identical to SEQ ID NO: 5740

SEQ ID NO: 5798 - DNA, 1059 bp, Mycobacterium tuberculosis KZN 4207 (DS); identical to SEQ ID NO: 5740

SEQ ID NO: 5799 - DNA, 1059 bp, Mycobacterium tuberculosis T17; identical to SEQ ID NO: 5794

SEQ ID NO: 5800 - DNA, 366 bp, Mycobacterium tuberculosis T85
atgatcacgtacggctctggcgacctccttcgggctgacaccgaagcgctcgtcaacaccgtcaactgtgttggggtgatgggcaagggaattgcgctgcagttcaaacgccgctaccccgagatgttcaccgcctacgaaaaggcgtgcaaacgcggcgaagttaccatcggcaagatgttcgtcgtcgacaccggacagctcgacggaccgaaacacatcatcaacttccccaccaagaaacactggcgtgcaccgtcgaagctggcctatatcgacgccggcctcattgatctcatccgcgtgatccgtgaactcaacattgcttctgtggcagttcccccgctgggggtgggcaacggaagg

SEQ ID NO: 5801 - DNA, 728 bp, Mycobacterium tuberculosis T92
atgatcacgtacggctctggcgacctccttcgggctgacaccgaagcgctcgtcaacaccgtcaactgtgttggggtgatgggcaagggaattgcgctgcagttcaaacgccgctaccctgagatgttcaccgcctacgaaaaggcgtgcaaacgcggcgaagttaccatcggcaagatgttcgtcgtcgacaccggacagctcgacggaccgaaacacatcatcaacttccccaccaagaaacactggcgtgcaccgtcgaagctggcctatatcgacgccggcctcattgatctcatccgtgtgatccgtgaactcaacattgcttctgtggcagttcccccgctgggggtgggcaacggaggtctggattgggaagatgtcgagcaacggctcgtatcagcattccagcagctgcccgacgttgacgccgtgatctaccccccatcaggtggatctcgcgccatcgagggcgtcgaaggacttcggatgacctgggggcgcgccgtcatactcgaagcgatgcggcgatatctccagcagcgccgcgcgatggagccgtgggaagaccctgcagggatctcgcatctggagattcagaagctcatgtacttcgccaacgaggccgatcccgatcttgcgctagatttcacgcccggccgatacgggccatacagcgaacgtgtccgtcacttactgcaaggaatggagggcgcattcacagtcgg

SEQ ID NO: 5802 - DNA, 1047 bp, Providencia rustigianii DSM 4541
gtgaaagtgattgaaataactcgaggtgatcttttacgtgctgatgtagaagccatcataaatacggtcaactgtgttggagttatggggcgaggtattgcattacagtttaaaaaagcctggcctgataactttaaggcttatgctgatgcttgtaagaaaaaacaagttcagcctggaaagatgtttatctttactacacaagaattagctaaccctcgctttattattaactttcccactaaacgtcactggcgtggagctagccttattgaagatatcgactcaggcttatctgcactggtaaaagatattcgaaagctgggtattaaatcaattgcgattcctccactaggagcgggtttaggtggtttagattggactattgttcgtcaaaaaattgaaacggcgatggaacctttagatgatgttcatgtgctgatttatgagccctcagaagacgtaggaaatgtcagagttgctcagcaacaagaaataccaaagatgaccactggtcgtgctgtattgattgagttaatccaacgatatttaaaaggttctcttgacccatccatatctttattggaggttcataaattattgtattttatgcaggaagcaggtgagccattacgattaaaatatcaaaaagcacattatggtccttatgcggaaaatttacgtcatgtattaaatattattgagggacattttatttctggctatgttgatggtggggatatacccaataaagaacttcacttgatttctggctcggttgaaatggcacaaaaatttttacagcagtatccagagactcgtgaaagatttgaaagagtctctgctcttgttgaggggtttgaatctcctcaaggattggagctgctagcaacagtacattggctgcataaatatgaacaagcaaaaacaactcaggaattacttgccgctttggatgaatggaatgaaagaaagcaaataatgacggaaagacaggtacaaattgccaaagaggtactgagtactaaaaactggctggtagaataa

SEQ ID NO: 5803 - DNA, 402 bp, Acidovorax delafieldii 2AN
atgaacacactcaaccgcatcagacgctccgtcgccaaccgcagcgacgatgtgctgctgcgcggcgaattcgaccagttcggcagtgccgcacaggtgggccgtgcactgcgcgagctggtgctggacggcacgctggtgcgcctgggcctgggcgtttacgccaaggccaagccgagtgtgctgaccggcaagccaattccggtacggccgctggaagttctggctccgcaggcactgaacaagctgggcgtgaccgtcatggccagccgcctgacccgggaatacaacgccgggcaaagcacccaggtgccagcaggcatcaccctcaacgtcggccgccgtcgcatcgcccgcaagctgggcttcaacggcaaggcgatccagtacgaacacgcatga

SEQ ID NO: 5804 - DNA, 402 bp, Acidovorax sp. JS42
atgaacacactcaaccgcatcaaacgctccgtcgccaaccgcagcgacgacgtgctcctgcgcagcgagttcgatcagttcggcagtgctgcgcaggtgggccgcgctctgcgcgagctgctgatgaacggcacactggtgcgcttgggcctcggcgtctacgccaaggccaagccgagtgtgctgaccggcaagcccatcccggtacggccgctggaggttctggccccggaggcgctgaacaagctgggggtggccgtcatggccagccgcctgacccaggagtacaacgccgggcgcagcacccaggtgcccgcgggcatcgtcttcaacgtcggacggcgccgcatcgcgcgtaagctcggtttcaacggcaaagcgatccagtacgaacacgcatga

SEQ ID NO: 5805 - DNA, 441 bp, Burkholderia pseudomallei 1106a
atgatcctgcgagacaaattgagaaaagcgctcggccggaaaaaggctaatgtcttcctgcgggccgacttcgagaaactgggaagcgatgctcaactgagccgggcgctacgcaatctggtcgacgaaggcgccgtggtaaaaattggggtaggcgtctacgccaaggccaagcgaagcgcgctgagcggaaagccgattccggtcgagccggtcgagttcctggcaccggaggcactgaagaagctcggtgtaaaggtctatccgagtcgccggacggcagaatataacgcgggccagacgacacagattccagcgggggtggtaatcaacaccggaaatcggcgtatttcccgcaagctgggcttcggacaaaagaccatcgaatatgaaaacaattacaaccgaccaacgggagttgatcgacgccctgctcgctga

SEQ ID NO: 5806 - DNA, 441 bp, Burkholderia pseudomallei 14; identical to SEQ ID NO: 5805

SEQ ID NO: 5807 - DNA, 441 bp, Burkholderia pseudomallei 9; identical to SEQ ID NO: 5805

SEQ ID NO: 5808 - DNA, 441 bp, Burkholderia pseudomallei B7210; identical to SEQ ID NO: 5805

SEQ ID NO: 5809 - DNA, 306 bp, Burkholderia pseudomallei Pakistan 9
gtggtaaaaattggggtaggcgtctacgccaaggccaagcgaagcgcgctgagcggaaagccgattccggtcgagccggtcgagttcctggcaccggaggcactgaagaagctcggtgtaaaggtctatccgagtcgccggacggcagaatataacgcgggccagacgacacagattccagcgggggtggtaatcaacaccggaaatcggcgtatttcccgcaagctgggcttcggacaaaagaccatcgaatatgaaaacaattacaaccgaccaacgggagttgatcgacgccctgctcgctga

SEQ ID NO: 5810 - DNA, 423 bp, Chlorobium limicola DSM 245
atgaagtcccgattgaatatgagagaacggatgatacgctccataacgatgaggcggggtgagattatcatgcgttcagattttaccctcatgggaagccaaagccagatcagtcgattgctggctgactttgtcagtgaggggcgtcttgtgcgtcttggatacggtatttttgccaaagccagaatcagttcgataagcggtaaagcggttccgcgggaacctcttgaagttcttgcacaagaggcgttcaggcgtctgatgatcgaggcaaaacccggaaaagcacaaaaagagtatgcttccggtcagagtacacaggtgcctgtacaggctgttttcgataccggtcaacggcgaatcagccgaaagttaacggtaggtaatcgaaaggtgagatatgagaacgattacagcgcatga

SEQ ID NO: 5811 - DNA, 426 bp, delta proteobacterium sp. MLMS-1
atgagccgactcagcgttaaagaaaggatggtccgttccatcgccctgcgtaaaggtgaggtgatcctgcgcgctgatttcgaatccatgggcagtcccagccagatcagccgggcgctcaaggagttgatcgaggcgggcaagatcgttcgcctgggttatggcgtctacgccaaagcgcgcccaagtacgctctcgggcaagcccgtgccgcgagtgtctctggaagagttggcgcaggaggcgctggagaagctgggggtgcccgtgcaactggggcgtgcccaagcggcctatgctgagggcaagaccacgcagatcccggtgcgcacgacgttcaatacgggccgccgccgcatctcccgcaagatcaccgttggcaatagcactgtgcgctatgaaaacaattacagcgcgcgaacatga

SEQ ID NO: 5812 - DNA, 414 bp, Desulfatibacillum alkenivorans AK 01
gtgccggtaaaaaacaccttagagagcaagataacctaccgcgtgaagcgtagtaagacgcctgtttttgtgcgtgatgattttaaggatattggcggctacgatcaggtcggacgcattttgagggggcttgtgaaaaagggggttctagttagtctgggttacggggcctacgcccgctctaaaagatcaagcgttagcggcgctgttgttccggagaagcccctgccggaacttgcaaaagagcttctgaaaaaactcggcgttaaggtggtcccatcatccgccgagagggcttataattcagggaaaacaacccaagttccaaccgggcgtgtgattggcgtcaaaggcaggattgtgcggcgtattggctataatggaaggtatatctcttttgaaaaagtcagttga

SEQ ID NO: 5813 - DNA, 396 bp, Escherichia coli 83972
atgactacaaaagaccgtattcagtcccgactgaaccgttcaaaacgttatgtgttcacccgggatgatttcagggatatcgctggctatgatcaggttggcagagctcttcgtacactggtaaacgaaggtaagttgatgaaagtgggctatggtgtttacaccaaagcccgtcgtaacatcatcactgggaaaatcatgcccgcagcgcctgggggctctgctgcagtaattacagaggccctggagcgcctgaatatcagataccgtctggcaggagcaacggaatgctacaataaaggtcagtccacacaaattcctgtatctctggggataaaaacaccttctcgatttaaaagaatgttaatagtagggaaaagtaaaatcaatgcctga

SEQ ID NO: 5814 - DNA, 396 bp, Escherichia coli ABU 83972; identical to SEQ ID NO: 5813

SEQ ID NO: 5815 - DNA, 396 bp, Escherichia coli FVEC1302
atgactacaaaagaccgtattcagtcccaactgaaccgttcaaaacgttatgtgttcacccgggatgatttcagggatatcgctggctatgatcaggttggcagagctcttcgtacactggtaaacgaaggtaagttgatgaaagtgggctatggtgtttacaccaaagcccgtcgtaacatcatcactgggaaaatcatgcccgcagcgcctgggggctctgctgcagtaattacagaggccctggagcgcctgaatatcagataccgtctggcaggagcaacggaatgctacaataaaggtcagtccacacaaattcctgtatctctggggataaaaacaccttctcgatttaaaagaatgttaatagtagggaaaagtaaaatcaatgcctga

SEQ ID NO: 5816 - DNA, 396 bp, Escherichia coli FVEC1412; identical to SEQ ID NO: 5815

SEQ ID NO: 5817 - DNA, 465 bp, Escherichia coli MS 119-7
atgtcgtatgtttgctatctaaaatgtcgtatttttgctactctttatgcaatgactcaggaggcgaatatgacgataaaagcacgcattcagtcacgactgaaacgttctaaacgttacgtattcactcgtgacgactttaaagatattgcaggctacgatcaggttggtcgggtattgcgcgatcttgtcagggaagggcaactgttgaaggttggttatggcgtgtataccaaagcacggcggaacggtattacaggcaaggtaatgccagcggctcccggaggctcttcagcggtgattgtcgaaacgctggaacgcctgaaagtacgctatcgttttgctggcgcaacgcaggcatacaatagcggtacttctacgcagatcccagcttcacccgagataaaaaccccccggcgttttaaacgcgtattatctgtagggaacagcagattaaatggatga

SEQ ID NO: 5818 - DNA, 396 bp, Escherichia coli MS 198-1; identical to SEQ ID NO: 5815

SEQ ID NO: 5819 - DNA, 396 bp, Escherichia coli MS 45-1; identical to SEQ ID NO: 5813

SEQ ID NO: 5820 - DNA, 396 bp, Escherichia coli MS 69-1
atgactacaaaagaccgtattcagtcccgactgaaccgttcaaaacgttatgtgttcacccgggatgatttcagggatatcgctggctatgatcaggttggcagagctcttcgtacactggtaaacgaaggtaagttgatgaaagtgggctatggtgtttacaccaaagcccgtcgtaacatcatcactgggaaaatcatgcccgcagcgcctgggggctctgctgcagtaattacagaggccctggagcgcctgaatatcagataccgtctggcaggagcaacggaatgctacaataaaggtcagtccacacaaattcctgtatctctggggataaaaacaccttctcgatttaaaagagtgttaatagtagggaaaagtaaaatcaatgcctga

SEQ ID NO: 5821 - DNA, 465 bp, Escherichia coli MS 69-1
atgtcgtatgtttgctatctaaaatgtcgtatttttgctactctttatgcaatgactcaggaggcgaatatgacgataaaagcacgcattcagtcacgactgaaacgttctaaacgttacgtattcactcgtgacgactttaaagatattgcaggctacgatcaggttggtcgggtattgcgcgagcttgtcagggaagggcaactgttgaaggttggttatggcgtgtataccaaagcacggcggaacggtattacaggcaaggtaatgccagcggctcccggaggctcttcagcggtgattgtcgaaacgctggaacgcctgaaagtacgctatcgttttgctggcgcaacgcaggcatacaatagcggtacttctacgcagatcccagcttcacccgagataaaaaccccccggcgttttaaacgcgtattatctgtagggaacagcagattaaatggatga

SEQ ID NO: 5822 - DNA, 396 bp, Escherichia coli UMN026; identical to SEQ ID NO: 5815

SEQ ID NO: 5823 - DNA, 396 bp, Escherichia coli CFT073; identical to SEQ ID NO: 5820

SEQ ID NO: 5824 - DNA, 396 bp, Escherichia coli W
atgacgataaaagcacgcattcagtcacgactgaaacgttctaaacgttacgtattcactcgtgacgactttaaagatattgcaggctacgatcaggttggtcgggtattgcgcgagcttgtcagggaagggcaactgttgaaggttggttatggcgtgtataccaaagcacggcggaacggtattacaggcaaggtaatgccagcggctcccggaggctcttcagcggtgattgtcgaaacgctggaacgcctgaaagtacgctatcgttttgctggcgcaacgcaggcatacaatagcggtacttctacgcagatcccagcttcacccgagataaaaaccccccggcgttttaaacgcgtattatctgtagggaacagcagattaaatggatga

SEQ ID NO: 5825 - DNA, 396 bp, Escherichia coli W, ATCC 9739; identical to SEQ ID NO: 5824

SEQ ID NO: 5826 - DNA, 396 bp, Escherichia sp. 1 1 43; identical to SEQ ID NO: 5813

SEQ ID NO: 5827 - DNA, 354 bp, Legionella drancourtii LLAP12
ttgcgtcaggatcttatagatttgggttcctatcgtcaggtaagccgtgtttttaagaagctaattgataccaataagattgttaaaattggagctggtatttatgctaaagcctctttttctgaaacgctcaataaaccccttgctcaaggtacttttggccaagtctgtaaagaagctttaacaagaaaaggggttcaatgggagccaggtacagcggaacaagagtataatgctggcttatcaacccaagtcccagctcgtactgttgttcgtttaaaaagccgtttcaggggtactttatccgacggtagaagaaaactgattatagagaaacaaattaatgccagataa

SEQ ID NO: 5828 - DNA, 453 bp, Legionella pneumophila Corby
atgaaccggaaaagccattacaacaatacttttcgtgatgaattaagaaaaaagattgatcatatcaccagccgtgtattttcgcggggggatttaatacaagatcattctaatcaagttcaattaagattaaatcgtgcgctgcgtacttttatggacgagggcattatcattaaaattgctcacggtttatttgccaaagctgagcctatgagtatccctggtagaaagatacaagctgtactaacagagccctttgaaacagttgtaacagaggcgctagataaattaggaattaaatgggaattaggaagtgctatccgcgattataatgcggggaaaactacccaggtgcctgctgtttttagtgttcgattaaaaagtcgatatcgtggttctattcatgcagagggtagaaaactgatttttgaaggtggtatcaatgccaggtga

SEQ ID NO: 5829 - DNA, 429 bp, Legionella pneumophila Lens
atgacagtaaaatataaagacagcctagaatacaaagcacttcaacgtattaagaaaatacgtagtaatgtcgtgctgcgccaagatcttatagatctcggctcctatcgtcaggttagtcgtgtttttaagaaactgatggatgacaataagttggttaaaattggagctggtgtttatgcaaaagcatatttatcagaaatgctcaatgtacccattattcaaggtggttttgagcaagcttgtaaagaagctttaactaagaaaggtattgaatgggaacttagtacagcagctcaagagtataatgcagggcgtacaacacaagttcctgtgcgtacttctgttcgattaaaaagtcgctatcgaggcacgttgtcttttggcaaaagaaaattaattgcggagaaacaaattaatgctcgatag

SEQ ID NO: 5830 - DNA, 453 bp, Legionella pneumophila Paris
atgaaccggaaaagtcattacaacaatacttttcgtgatgaattaagaaaaaagattgatcatatcaccagccgtgtattttcgcggggggatttaatacaagatcattccaatcaagctcaattaagattaaatcgagcactgcgtacttttatggacgagggtattatcattaaaattgcacacggtttatttgctaaagctgagcctatgagtatccctggtagaaagatgcaagctgtactaacagagccatttgaaacagtcgcaacagaggcgctagataaattaggaattaaatgggaattaggaagtgctatccgcgattataatgcggggaaaactacccaggtgccagctgtttttagtgtgcgattaaaaagtcgatatcgtggttctattcatgcagagggtagaaaattgatttttgaaggtggtatcaatgccaggtga

SEQ ID NO: 5831 - DNA, 408 bp, Methylovorus SIP3 4
atgaagctatctattaaagacaggattaacaagagcattaaggcttcaaaagctaatgtatttgttcgttctgattttaagaagtttggtgggtatgatcaggtaggcagagctttaaaagaagtaattgaagctggaaatttagtaaaaatgggttatggggtttactctaaggctgaaaaatcagccctttcaggtaaacctattcctattgccactattaccgaagcaggtttaatggttatgaacaaattaggtgtaaaagcagatgttggttattttgcaagattatatcgtgatggtaaaactactcaaattccaatgaaagaagtaatagcagttgagaaacctattactagaaaaatctattttggaaagagagtattagaatatgaaaagtataaatga

SEQ ID NO: 5832 - DNA, 417 bp, Chlorobium luteolum DSM 273
atgaaaagctttcgaacaacactactctcccaagttcgctcgcgcattgatcgcaagcgcaatgctgtcgtgctgcgtcaggactttcgggatctcggccagtacgatcaggttggccgctgcttgcttcgtctcgtcaaagaggggcggcttatcaaaataggtcaagggatttatgtccgcgctgctgtatcgccgcttgatgaacagccagcccttcccaaaagcctcaatagtctggccgttgaggcgatgcaaaaaatgggcatccccacaggtcctacggcagcggaacgcgattacaacgagggcaaaagcacgcaagttccaacgggacgcactatcggcgtttgcaagcgtgttcgtcgccacattggatacaacgggtacacgatgaagtttgagcatgtcacgtaa

SEQ ID NO: 5833 - DNA, 417 bp, Pelodictyon phaeoclathratiforme BU 1
atgaaaaagttacaagagacactgctcttcaagatgagcagccgcatcaggcgcaagcgcaatgacgttcttgtgcgacaagattttcttgatcttggaggctatgatcaggttggccgctgcctgcttcggttggttaaagagggaacacttatcaaaattggccaaggcatttatgtgcgtgcgactctctcaccgattgatgcccgtccctccttgcccaaaagccttaacagtctggtactggaggcactgaagaagctggatattcctacaggcccaacagcaatggaaatcaagtacaatgcgggcaacacgactcaggttccaacaggtcgcgtgatcggtgtgcgaaaacgtgttcgtcgccgtattggattcagcgggtatagcatgaggtttgaacatgccgattaa

SEQ ID NO: 5834 - DNA, 405 bp, Photobacterium sp. SKA34
atgactacagctgatcgtatttatcaaaagataaaacgttcaagacgttatgtttttgaacgtaaaaactttgaaggtgtggcttgttatgatcaagtcggtcgcgctttgaaacaattagtaaaccaaggcgaattaatgaaaatcggctatggtctttacaccaaatcacgaatgaatagtttaacgggtaagccaatgccaactcatccaggtgggacggacgcacttatgcgagaaatccttaagatgaaaggcgtagactttgagatagatagcctgtctcttcaaaacatatcgggtgaaagtactcaaattccttcatccattaattactcatggaactcaaaacagtttaatcgaaaactggtcgtgggtagccgtgtcatacactcgccaaattaa

SEQ ID NO: 5835 - DNA, 396 bp, Photorhabdus asymbiotica
atgaccataaaagctcgtattcagtcacggctgaaacgctcaaagcgttatgttttcactcgtgacaatttcaaagatcttgctggctacgatcaaattggcagagcactgcgtgaactggtgaaggaagggcaactgctgaaagtaggttatggcgtctacaccaaagcgcggcaaaatgcgattaccggtaagctgatgcctgctgctcccggaggttctgttgcggtaatgattgaggcgttggaacgtctgaaagtggattaccgtctggcaggagcaacaagtgcttacaacagtggtaaatctacccagatccccgcgtcacttgaaatcaaaacctcaccacgttttaagagaacattgtcagtagggagcagcaaactaaatggatga

SEQ ID NO: 5836 - DNA, 396 bp, Photorhabdus luminescens
atgattattaaagagcgtattcaggcgcgtttgaagcgatcaaaacgttatgtgttcattcgtgacgactttaaagatattgctggttacgatcaggtaggaaggatactgcgcggtttggtcaaagaaggtcaattgctgaaagtgggatacggtgtttacaccaaggctcggaaaaatagcgttactgggaaaataatgcctgcttctccgggaggctctgatgcggttattcttgaagcgttagagcgtttaaaggtgaaataccatttggatggagcttctgctgcctatactgacggtaaatcaacacagattcccgcttatacccaaattaaaaccacattccgttttaaacgggtgttatcggtggggaatagccggttaaatggatga

SEQ ID NO: 5837 - DNA, 399 bp, Pseudoalteromonas haloplanktis TAC125
atgacaatagcaagtaaagtaacaacaagaataaaccgctcaaagcgttatgtttttgatcgtgctgattttgcagatattgctggttacgaccaagttggccgggtattaaaaaagctggttgataatggtcatttattgcgtattggttatgggctttacactaaagcgagagaaaatcgcattacgggtaagttaatgccggcatctcctgcgggagctgatggtgttatattagaagcgattgaaaagctaggtgttgactacaaatttgatgagttttcacaacgtagtatcaatggtgaaagcttgcaaattccagcgtctctgaaaataattacaaataatcgctttaaacgcaaaattgtcgtaaataatagtgctattaatgctaattga

SEQ ID NO: 5838 - DNA, 435 bp, Rhodospirillum centenum SW
atgcgcaagcccaggacagcgaagcaacagcttgcggaactggtgacccgctcgaacgacgacgtgttcctgccgcgggacttcaccagggccagccccgactccgccgagtacgataccgtgctccgcgccgcccgtgcgcttgtccgcgagggcatgctggttcgtctcggctatggcgtctacgccaggacccgccagagtccgatcaccggcaaaccgatgctcactgcaccggggggcctggagggggccgtcagacaggcgctcgacaagctcaaggtcgtctggcagcccgggcaggccgctcaggactacaattccggtcgcagcacgcagatccctgtgaacgcctcgttccgcgtggcaaaccgattctcccgcaagatatcgttccggggcaaggaggtcgtttttgagcgatccgaggtatga

SEQ ID NO: 5839 - DNA, 411 bp, Shewanella baltica OS155
atggcagctgttgacagtatctttcaaaaaataaagcgttctagacgctacgttttcgaacgcaaagactttgacggcattgctagctatgaccagattggcagatcgcttaaccagttaatggatagaggcgagataatgaagcttggctatggcttatacactaaagcgcgagtaaatagcctgacaggacgtttaatgccgacctgtccaggtggtagcgatgcacttatgcgtgaaatattgaaaatgaaagacatcgatttcgagatagataatctgtccttacaaagtctttccggtaaaaacacccaaattccctcatcagttcattactcatgggatcaaaaacagttcaatcgaaaattggttgttggtaacagactgttgacgccagcaagtagaccatga

SEQ ID NO: 5840 - DNA, 411 bp, Shewanella sp. ANA-3
atggccgctgttgacagtatctttcaaaagataaagcgttctagacgctacgttttcgaacgcaaagactttgacggcattgctagctatgaccaaattggccgatcgcttaatcagttaatggatagaggcgagataatgaagcttggctatggcttatacacgaaagcgcgagtaaacagcctgacaggacgtttaatgccgtcgtgtccaggtggtagcgatgcacttatgcgtgaaatattaaaaatgaaagacatcgatttcgagatagataatctgtccttacaaagtctttccggtaaaaacacccaaatcccctcatccgttcattactcatgggatcaaaaacagttcaatcgcaaattggttgttggtaacagactattaacgccagcaagtagaccatga

SEQ ID NO: 5841 - DNA, 438 bp, Synechocystis sp. PCC6803
atgcgaagacgcagacctaccaggcgaagggtttcttcgcgaattgtcacacaaagcattgctgaccaaattgctaatagtcagcaacaggtatttatgcgtcaagattttgaggatttgggtaattatgagcaggtagggcgatcgctacgcagtttaatacaacaaaatcagctaattcggattggccagggtttatacgccaaggcccagatttctcctctcagtggcaaaccagttcccagacttggtatcaaagaattggccaaagaggccctacaacgtcttgaggtggaaacatttccttcgagctatgaaaagcagtacaacgacggaaaaacgactcaagttcccactggtcgtgtaattggtgttaagggaagagtacaaaggcgcattggttacaacggcaaatacgttaagtttgagcatgtctag

SEQ ID NO: 5842 - DNA, 432 bp, Verminephrobacter eiseniae EF01-2
atgccacgcacaaggttgtcctccatgccttcgatgactctccaggaaaggatcgaatcgagcctctcccgctcggaggccaaggtgttcctgcgcaaggaattcgaccgcttcggcggctacgaccaagtggggcgcgccctgcgcggcatcatcgccaagggcctgctggtcaaggcggggtatggcatctacgtcaaggccaagaagtcgagcatcacgggcaacccggtgccagtcgctccactgatcgaggtcggcgccgcagcgctggccaagctcggggggcaggcccagccgagctcggctgcggccacctacatggccggccgctccacccagatgcccatgggcgacgcgctctgcgtcggcagttcacgcgtgcgccgcaagatcggctttgcaagcaaaacggtgaggttcgagcgttga

SEQ ID NO: 5843 - DNA, 453 bp, Vibrio harveyi ATCC BAA-1116
atgtacacggtcagttatactgctgttattgtacgtaaggaggttcaaatgacagcagcagaccgcatttatcaaaagataaagcgttcaagacgttatgtatttgaacgcaaagactttgatggatttgcaagttacgaccaaataggtcgggccctgaggcagcttgtgcagcaaggtgagttaatgaagcttggctatggcttgtataccaaagcaagaatcaatagcctcactggcaagcccatgccgactaatccgggagggaccgatgcccttatgcgagaaattcttaaaatgaaaggcgttgattttgagatggatagtctatcgctgcaaagtctttcaggcacgagtacccaaattccatcttctattcagtattcatgggacccaaaacagtttaatcgcaaactggtggtcggtagccgtgtgctgaacttaccaagttag

SEQ ID NO: 5844 - DNA, 405 bp, Vibrio tapetis CECT4600; CIP104856; B1090 plasmid pVT1
atgactgcggcagatcgtatttatcagaatataaagcgttcaagacgctatgtctttgaacgcaaagactttgatgggtttgccagttatgatcaagtaggtagagcattgaggcaattagtaaagcaaggtgaactaatgaagcttggctatggtttgtataccaaagcaagggttaatagccttacaggaagacccatgcctaccaaccctggtggtagcgatgcccttatccgggaaatattaaaaatgaagggcgttgactttgagatggatagtttgtctctacagagcttttcaggtgaaagcacacaagtaccatcatccgttcattattcatggaatcctaagcagtttaatcgcaagctggtagtaggtaatcgagtactgaattctccgagttaa

SEQ ID NO: 5845 - DNA, 453 bp, Vibrio vulnificus CMCP6
atgtgcacggtcagctatactgcggttattgtacgtaaggaggttcaaatgacagcagtagaccgcatttatcaaaagataaagcgttcaagacgttatgtatttgaacgcaaagactttgacggatttgcaagttacgaccaaataggtcgggcattgaggcagcttgtacagcaaggggagctaatgaagcttggctatggtttgtataccaaagcaagaatcaatagcctcactggtaagcctatgcctaccaatccaggtggtaccgatgctcttgtgcgtgaaattcttaaaatgaaaggcgttgattttgaaatggatagtctatcgcaacaaagtctttcaggtgcgagtacccaaattccatcctctgttcactattcatggaacccaaaacagtttaatcgcaaactggtggttggtagccgtgtgctgaacttgccaagttag

SEQ ID NO: 5846 - DNA, 405 bp, Vibrio vulnificus M06-24/O
atgacagcagtagaccgcatttgtcaaaagataaagcgttcaagacgttatgtatttgaacgcaaagactttgacggatttgcaagttacgaccaaataggtcgggcattgaggcagcttgtacagcaaggggagctaatgaagcttggctatggtttgtataccaaagcaagaatcaatagcctcactggtaagcctatgcctaccaagccaggtggcaccgatgctcttgtgcgtgaaattcttaaaatgaaaggcgttgattttgaaatggatagtctatcgcaacaaagtctttcaggtgcgagtacccaaattccatcctctgttcactattcatggaacccaaaacagtttaatcgcaaactggtggttggtagccgtgtgttgaacttgccaagttag

SEQ ID NO: 5847 - DNA, 405 bp, Vibrionales sp. SWAT-3
atgacagctgttgaacgcgtttatcaaaagataaagcgctcaagacgttatgtttttgagcgcaaagactttgatggttttgctagctacgaccaaatcggtcgagcgttaaggcagttagttaagcaaggtgagttaattaaacttggctacggtctatacacaaaagcaagaatgaatagtctaaccggcagacccatgcccacaaaccctggcggaagcgatgccctgatgcgtgaaattttaaagatgaaaggtgtcgattttgaaatggacaaactgtctttacaaagcctatctggtaaaagcacccaaatcccatcctccattcaatactcgtggaaccataaacagtttaatcgcaagttagctgtcggtaaccgagtcttaaactcaccgagttaa

SEQ ID NO: 5848 - DNA, 399 bp, Yersinia aldovae ATCC 35236
atgatgactatcaaagaacgtattcaaacgagattaaaacgttctaaacgttacgtgtttactcgtgatgatttcaaagatattgctgattacgatcagattggtcgcgtgttgcgtaatctagtgaaagaaggattattgcttagggtggggtatggactgtacaccaaagcgcgtaagaactcgatcactggtaagatcatgcctgcctctcctggcggttctgacgcagttattcttgagtcacttgaccgtttgaatgttgattacacattggatgccagcacgactaagtatataaaaggtgaaacaacgcaagtacctgcttacactcaagtcaagacgtcgcctcgcttcaaacgtgcattgtccgttgggaatagcagattgaatggataa

SEQ ID NO: 5849 - DNA, 408 bp, Yersinia enterocolitica 8081
atgattttgaagcaaaaactgttgcgctccatcgccaaccggaaaggtattgttgtactgcgttcggagctggaacacttgggtagcaaatcgcaagttagcaaggcattgtcggaactcgttaaagagggcgtattaattcgggttagccttggcgtgtatgcaaaaactcgatttaaccgatttgcggggaaaaggacggtagccgcaccatttgaaactgttgtggaagaaacattcaaaaaactcaacgtgaaagtcactcagggcaaggccttagaggattataacgcgggaagaacgacacagatcccaatgcagctccaagtcagaactccaggaaggaaaatatccagaaacatcactgtttcgggtaaaaatgtaaaatatgaaaaaacttacggatga

SEQ ID NO: 5850 - DNA, 396 bp, Escherichia coli H591
atgacgataaaagcacgcattcagtcacgactgaaacgttctaaacgttacgtattcactcgtgacgactttaaagatattgcaggctacgatcaggttggtcgggtattgcgcgatcttgtcagggaagggcaactgttgaaggttggttatggcgtgtataccaaagcacggcggaacggtattacaggcaaggtaatgccagcggctcccggaggctcttcagcggtgattgtcgaaacgctggaacgcctgaaagtacgctatcgttttgctggcgcaacgcaggcatacaatagcggtacttctacgcagatcccagcttcacccgagataaaaaccccccggcgttttaaacgcgtattatctgtagggaacagcagattaaatggatga

SEQ ID NO: 5851 - DNA, 771 bp, Nitrobacter hamburgensis X14
atgacggctgacgggaacattcgcgccgttgtcgatgcgcttgccctgccgcccggcgcgcgggtcgatgcccgcgtgccgaagaagatgctggtcgaacagggcgcgccgacacccgcagacaagcgggccattcaggaggggatcgacgagttgcaatggttcgccgcctgcaagccggcgaccatcggcgtgccggcgttttcggacgacacgcgggaatatctggaaatcgctgtcataggctgcgccttccggccagcggcaaaggccggacggctgatcgagctgatccaccgcgcgatcccctatccggttctgcttatcaccagcgacgcaagcggcgtggcggtatcggcggcgcataagcgcaaggcccagaatgaggctggccgcaccgtgatcgaccgtatcgtcgccgcaaccggcttgcagccgggcgcgggcgatggcgcacagcttgcgttcctgcaaagcgtgccgttggcgcagcagcctcgctcggacctgtatgccctttatgccggctggcttgcccgcattgaggcgttgaacgccgcccggttgaccggcgcgttcgtggcgagcgacgatagtgtcaccattgaccaacgccgcgaagcgctcgacgcacatacgcgccttgcgaaggaaatcgaaaccctgcgcggcaaggcgaggcgcgaaaagcagctcaaccgccgggtggatatgaacatggcgattcagcgcctcgaagctgacctcgcttcctacaagaaaagcctttga

SEQ ID NO: 5852 - DNA, 762 bp, Syntrophomonas wolfei Goettingen
atgcttaaaaccttgatggaaatattcaacctgccccctaaagcccgtatgcaaagacgtatgcctaaaaatacattttatcgcaatgctgaattaagcaaaagagacattaaaacctttgttaatgagatccagttagtacaagtcgtagcaatactcaacagtgattccctgcgggttgctccgttcgtaaacgaagaatacaacattagtgatatcgcttatttattggtagaattaaagaataagggccaggagggaaaggtagcccatattattcataccgctattccttatccactgcttattattttctgctaccggcagcaggttcgtttcagcaccgccctgaaaaggttaaacaaaaacgatccaacatctattgtattgggtgatattaacatttccccctgggtagaccctatttacccgctgccggtacaaaaggcttttttggacagtctggccttaaagacattgcctttcgataatttataccggctttacctggctctcgacaaccgcatctaccttaccggggtgattgatttgattggagtatatccttcacccgaagttgatgtaaatgaggtccaagaaatgctggataagatagataaactggaaaaaaccattaacaccctgaacaccgctatgaaacgggttacttctttcgcccacaaaatgcaacatcatgtacagattcaacagctccagcagcagctggatgctttaataactcaattaagcgaggtgtgctaa

SEQ ID NO: 5853 - DNA, 765 bp, Pelobacter propionicus DSM 2379
atgattcctgatgatttcattggtgcattggggctccccgatagcgcgctggtaaaccagcgagtgccgaaaaagatgctggtggagaatggcgcgccgaccgccgccgacaagcgccgaatcaacgacggcattgaggaaattcactggctggcggcgctgaaaccgaacaccatcggcgtgccggaatattgtgacgacgttcaggagtatctggaaattgccgtgttgtctgtcgtactgcggcctgatgccaaagctggccgtctggctgaattgttccatcgcgctataccatacccgctgtttcttatcttggtgcagggggatcaaatcgtcctctcactgacgcataaacgccgggcgcagaatgaggcggataaatttgttctggatggcgatagcgttgaggtggctgtttcaggtaatcctttcctgtcaacagcagtgggtaggcagtttctggatgcactggcgctgagtcatcagccgagagccagtctattacagctgtatcagggatggattgatacccttgtcgcactacaagcgtcactgataagcgggacattctgtcaagccatctctaaagaggcggcaattgcccgactggaggcagtgaagaagtgctgcgatttggaggccaggataacttcattgaggaatgctgccgcgaaggagaaacagatggggcggcgggtggagttgaatttggaaattaaggaattacgtgcattggttgaaatcgcaaggaaagccttatga

SEQ ID NO: 5854 - DNA, 780 bp, Acidovorax avenae citrulli AAC00-1
gtgagcgacgccgtgaacgctctgcacgatgccatcgtggcttctctggccctgccggcgagttgccgcgtggaccagcgcgtgcccaagaagatgctggcggagcacggcggtgctactgcggccgaccgccggctgttgacggacggcatcgaagaggcccactggctagccgccatcaagcctgcgacgacggccattccgacgtggcgggacgaggtgcgggagtatctggagctcgccgtgctgagcatggcggcgcgccccacctacgcccaaccggctcagttgcagcgcctggccgagctcgtgcatcgggccgtgccctacctggtgctcctgatcgtcagcacaccggatgcggtggccatgagcctctcgcacaagcgcacggcgcagaacgaggctggacgagtggtcttggacggcgatgtcgtgagtttccagttcagcgacgaattgccggacgggctgctggatgccctggcgcttgggcagcagccccagcaagacctgaaggctctctaccaaggctggatggacaccctgttggccgcccaggtggcacgggtgacagggcacttcagtatggaccccacaaccgaccaggccgccatgcggcggatcgccttgatcgaacaccagcaactggaggcagaggccgcccgcttgcgggccctggctggcaaagaaagccagatcgccaagcgcgtcgatcagaacctggccttgcagcggctgcaggccgagctggctgcggtgcgtgcccggcttcaatga

SEQ ID NO: 5855 - DNA, 726 bp, Clostridium thermocellum ATCC 27405
atgggtgattatagtttcttaaacatccctgatagctgctttatcggtagcactatatataaaaagctgttttatgaaaatgccaatttgtcttccagcgataagtatttgttttcagatatcatagataagatagtatggctttattgtcttaaaccagaaacaattaacgtacaggcatatatggatgaagtgcgagaatatccggaaattgaagttatagaagtaattgtaaacaaagattatggccttaacagaatagccgagattattatgaggactattccttaccctatgctgctgattttcaagcatgaagataaaatacggttctatgtggctcaccagaggacaagccaaagtgacagcagcaagaataccattgacgaatttatctctactgactggttaaggaatgatagtgctttattcgctaagcttgatataaagcaaatgaggtttacaaacctatatacgctttatagtgatatagttgacgctatcagtatttataacctatcagccattatgccgacagatgacaccataacaggtgacaaggcaagagaactctcggcaaagatagaagatatagagcaaagaattgcaaatctgcggtctaaactcaagaaggaaacccagtttaaccgcagaatggagctaaatatagagattaagagattagaacagagtaaaaataaattgcttggaggcgataacgaatga

SEQ ID NO: 5856 - DNA, 804 bp, Delftia acidovorans SPH-1
atgacaatggcaacatcacgcgcgcttcttgatgctttacaactgcccgacagcgcacgggtagaccagcgggttcccaagaagctgttgctggagaacggtgcgcccacggcatccgacaagcgcctgatcacggacgccattgaagaaatccagtggcttgccgcactcaagcccaacaccattggcgtacccagctaccgggacgcgcagcgtgaatacctggaagtcaccgtgcttggcttgaccctgcgtggcaccgtcaagcccgccagtctcgctcgccttgccgaattgatgcatcgggccgtgccgtatcccgtgttgctgcttgtgcaaggccaggcactgaccctctcgctggcgcacaaacgctgggcgcagaacgaggcaggtaaggtcgtgctcgacggcgaccccgtgttggcctcgctgccccacgcaaccgaagataccgccgcagtggaagacgcaatagcccccgaaatcgagcgcgccttcgtgcagtccctgtcgattgcacgccaaccccagaccacgctgcatgccctttatcagggttggatggagcgcgtgtgggccttgcaggcggcacggctgacgggaacctaccaggctgacacaaccccggaacaagcggctgcccgctggcaggcgctggctgattgtgagcggctggagaacgagatcggccgcctgcgagcgcaagccaccaaggaaaaacaactggcgcgccaggtagaactgaacctgacgctcaagcgcatccaggccgaactggccgctgcgcgccgacaactttga

SEQ ID NO: 5857 - DNA, 753 bp, Natranaerobius thermophilus JW NM WN LF
atgaaggagatattatctgaaaatatgaaagttcctgattcgtgcgaagttaacaagccaatatataagaaactattttacgaaaatgcttatttagggaaaaaagatcaggaattattatctaaaaacatagaaaagataacctggctctattcatttaagcctgacacaataaatattttaccgtataatgataaagaaagagaatatgaagaaattgctgtgattgaagtactcctaagagaacagagccatataaagcggattgctgaaatcattcaattaacaataccttatccattgattattatctttaattatggccaaaagatacttttcaatgtagctcataaaagagtgaatatgtctgatgagagccgaaatacttatgaagagttgatatttactgattgggttgacttagcaagtctaaataaaaatgacaagaaattcattaagagccttgatataacaaagttctcatttactaacttttattggttctattctgattttgttgataggataaacattttcaatgtttcattatatgctgatgaatatttactagaacatgatgctaatgatctcaagcaaattcatgatgagattaaggatctagagcaaaggatatctcagctccagagtgacttaaaaaaagaagatcattttaataagaaggtgaaaatgaatgtagagataaaaaagttaaaagaagagaagaaaaacttaattgataagctaaacagctaa

SEQ ID NO: 5858 - DNA, 759 bp, Pelodictyon phaeoclathratiforme BU 1
atgaagagtcaagcgctgatcgcagcatttgacctgcccgaaagcagcctggtgaaccagcgggtacccaggaagctgctgcttgaaaacggtgcacccacttccgccgacaaacgctctatcaatgaggggattgaagagctgatctggattgcggcactcaagccggtcactgtcggggttcctgagttccgggacgaaagccatgaatatctggaaattgccgttttgctgcttaccttgcgtgacggagccaaaaccacgcggctggtggaactggtgcatcgggcgattccttatcctgttctgcttttgacccagcagggtgcaccgttatcgctctctgttgctcacaagaggtggtcgcagagtgaggctggcaaaacagtgcttgagggcgatattgtttccgttgcatggtcgcgtgaagttgatgcggatattatggccgatttccgtaactcgctcgcacttggtagtcaaccacgcaccaatctccatgctctctatcagggttggctggactcaatggtggccctcaatgctgcaagagttacggggaattttacccttgccgaaaacgccgaatatgctgctgcccgccgtgatgctttgcgggagtgcggtgtgttgcaggaagagatcggtcgtctgcgcactctggcggcaaaagagaggcagataccccggcaggtggaactgaacctggaactcaagcggattgatgcagaactggcaacaacaaaacaaaaattatga

SEQ ID NO: 5859 - DNA, 759 bp, Acidimicrobium ferrooxidans DSM 10331
atgaacgctgacgcgatcctggccgccctcgaccttcccgcgagttgccgcgtggaccggcgcgtgcccaagacgctgctccttgaaaacggcgcgcccacgggcgccgacaagcggcagatcaacgagagcatcgaggagttggtctgggttgcggcgctcaagcccgcgaccatcggcgtggccgaatatcgggacgccatacgcgagtacctggaaatcgccgtgcttcgcttgaccctgcgcgccggggccaaggtgcagcgcctggtggagctggtgcatcgggccgtgccctatccgttgctgctgatcaccgaactcggcgcgcaggccgacctttccgccgcccacaagcgttgggcgcagaacgaggcgggcaagacggtgctcgacggcgagttggttgtcgcggaactgagtcccgagcgcgacgccgggccctggcccgccttttccgccgcgttggcgctggggcggcaaccgagaaccgccctttacgccctctatcagggctggatggataccctgctcgcgctcaaggcggcccgcgtgacgggcgtcttcgtccttgcctctgatgccgatcacgccgccgcgcggcaggaggcgttgcgcgaatgcgcccgactggacgccgagatcgcccgcctgggcactgctgccgccagggagaaacagatgtcccggcgggtggaactgaacctggaactcaagcgcgccgaagcggcccgcgcggccgctcgcgaaagactataa

SEQ ID NO: 5860 - DNA, 507 bp, Maricaulis maris MCS10
ttgcccgacgtcgttgattcagctacgcgcagccggatgatggcgggtatcaaggcaaaaaacaccaaaccggagatgctcgtccgccggggcttgcacgcgatggggattcggtatcgcctgcacgacaagcggcttcccgggaagcctgacctcgttctcccgaaataccgttccgtgatcttcgtgcatggctgtttctggcacggccacgactgcccggcgttcaaatggccaaagacccgcgagaaattctggcgagagaagatttcaaccaaccggaagcgcgacgaaaaacagatatcagatctcgtgcggagcggatggcgtgtttccgtggtgtgggagtgtgcgcttcgtagcaaaacgcctgataaggttgaaacgatactgaaactgttggcaagttggatcgaacaacgcgaaattgcagctgaaaagtcagatgacccaacccctttcgaagtatttcctggcagcggcgacaaagatgctcgctgtcgttga

SEQ ID NO: 5861 - DNA, 504 bp, Halorhodospira halophila SL1
gtgagcgacaggctctctccggaacatcgcagccgggtaatgagccgggtgcgcgggcacgacacgaagcccgagctcgtcctgcgccgcgcgctccatgcgcggggcttccgatacagactccatgtacgcgacctccccggatgccccgatctcgttttccctcggtattcggcggtggtgttcgttcacggatgtttctggcatgggcatgactgccaccttttccgcatgccctcaacccgcgaggagttctgggaaaaaaagatcggacgcaatcgggaacgcgaccggaaaaatcgggccgaactgcttgatcgcgggtggcgcgtcttggaagtttgggaatgcgcgatgagagggaaggatcgtcttccatccggtgaaatgcttgaaagggtggagacatggctgaccggccgtacagttacccatgagatccgcggtcttggggggcggcacccgggggcgaacgacgacagtatttatggggagcaggcgtag

SEQ ID NO: 5862 - DNA, 435 bp, Rhodobacter sphaeroides ATCC 17029
atgatgaccgacagcctgacgccggacgcaaggtcccggaacatggcaaagatccgcggcagggacaccggccctgagatgcgtgttcgcagcgctgcccacgggttggggctgcggtttcgtctttaccgcaggggtctgcccggcactccggatctcgtcttcccgagccgccgtgttgcgcttttcgttcatggctgcttctggcaccggcatcccggatgtcgcttcgcctatacgccgaagtcccgggtcgatttctgggaggcgaagtttgagggcaatgtctcgcgcgatctgcgcaagaacgaagacctcgaagcggcaggttggaagtcggtaacaatctgggaatgcgagacccgcgagccggacaagctgtcagagatcattcgcgatagggtcgtgcagcttcccgtgctgccaccagattga

SEQ ID NO: 5863 - DNA, 465 bp, Acidiphilium cryptum JF-5
gtgcctgatattgtcgaccggcagacgcgcagccggatgatggcgggtatccggtcggccaatacccgaccggagcggatgatccgcagtgccctccatgtacgtggctttcgttaccggctgcatccgcgtgccctgccgggccgtcccgacatcgtcctgccccgctatcgcgccgctatcttcgttcatggctgcttctggcatggccacgactgcgggctgttccggctgcccggcacccgcccggaattctgggccgagaagatccggcggaaccggcagagagatgccgctgtcatgaacgagctggtcgccactggctggcgtgtcctcacgatctgggaatgtgcgatcaggcgcaggcgcggcatggtgccggaacctgtcattgacgaagccgtctcgtggctgagatccggagatggaaacctggaaattcgggggaacaatggcgctgactga

SEQ ID NO: 5864 - DNA, 474 bp, Serratia proteamaculans 568
atggctgacgtacactccccctcaatcagaagcaagaacatgagggcgatacgtaatcaaaatacagccattgagaaattgttatcccgggttctggatgaagctgggataacttaccgtacccaagcttctgatctccctggtaaacctgacttcgttattgatgattataaagccataattttcgtccacggctgcttctggcatcatcatgattgttacctgttcaaagtgcccgcgacaaggaccgagttttggttaaaaaagatcgattcaaatgtcaggcgggataatgacgtcacccgactactgacagaacaaggctggcgtgaattgatcatctgggagtgttctctgaaaggccgaataaagctttcagctaatgcattatcagaaaggattgaggagtggctatgcgcaagtgatactcatgctgtgatcgattctaaaggtattcatcaattaaataattag

SEQ ID NO: 5865 - DNA, 477 bp, Pseudomonas putida GB 1
atggttgatgtccataccccggaagcccgctctcgcaacatgcgggctatccgaaacaaggatacaaagccggagctgctgatacggaaagctctgcatgcccgtggtttccgctaccgtctcggaggtgccggtcttcctgggcatcctgatatcgtcttgcctaaatacagaacagccatcttcattcatggctgtttctggcatggccacaattgcaagtatttcaagcttccggcgacacgcaccgagttctgggctggtaaaatccgaagcaaccaggagagagatcagcgctccacttcactgttagtggagcagggctggagtgtcttaactgtctgggagtgttcgctcaagccatcagggccaggggttgaagcggtcctgcatgaaatagagggtgtgctcgcgcaaagcttgaatgttagggtgtctcaactcttggttatttctgggctgacttcaaagatgtaa

SEQ ID NO: 5866 - DNA, 465 bp, Geobacter lovleyi SZ
atgactgatattgttgacaaggaaacccggagccggatgatgtcaggtatccgggggaaaaacacaaaacccgaattccacataagaagccttctccaccgaaacggtttccgattccgtctccacaccaaagacctccccggaaaacccgatatcgtatttccccgctatcgcgcagtaatcttcataaacggatgtttctggcacggacatgactgccacttgtttaagctcccgggcacccgaacggatttctggaaaaccaaaatagcccgtaataaggagaacgatagccgtgctatgggcttgcttgctgaatccgattggcgggttgctaccgtctgggaatgcgcccttcgcggcaaatttcgcatgaacgacaccgttatcactgagcgacttgctggatggattcggtcagcagaaatcaagctggaacttcgcggaatccaaccagaagtataa

SEQ ID NO: 5867 - DNA, 375 bp, Pseudomonas syringae pv B728a
atgagttcattgccggttgccaagggatggctacgtaggggcgcaaaggcgcttgtatcgttcacctggccggtcttgctgaccattgttttggctgtgattttcatgacagccatcgtacatttctttggagatattgagcagttcagggaatggcaaaaagcgcactacaactacatgctggcctggcggctgtcgctttatgcggcgatagggctcggctggtacaggctaaggcgcacccttaaacagcgagcatcagacacaaacctattcccctcgggacttcgtcgctgcgaggtcatggccatcttcgtcattctccttttcgagcttcggcgcgccgccactgtagcgggagttgacttgccatga

SEQ ID NO: 5868 - DNA, 360 bp, Burkholderia xenovorans LB400
atgagcccgatgcacgccagttggctgcgtccgcgctggctgttcagccggcgcgcggtgaaaaccttgctgtggcttgtgctggtcgtggccgccgcggtgggggccaacgtcgccggcatctacttggtcggcagtgttgcggcctgggagcattggctggcggcgtccgcagggtatttcttcatctggcggctgtgcctgtacggcgcgacggtctatggatgggtctggatgcgccgtcggctgctggcccgcgaagacaacgcgcaggcgcgacgtcggctgatccgcgccgaggtcgccggcgtcgtcgccatcgtggcgctcgaagccagcctgttgatgcaggccgcttga

SEQ ID NO: 5869 - DNA, 357 bp, Cupriavidus metallidurans CH34 uid250
atgagcgcggcgcgcatgacttggcgccccttgcgctggctgttcagccggcgcgcggcgaaggcgctgctgtggacggtgctgatcgttgccgccgcggtcgcggccaacatcgccggcatctacctggtcggcagcgttgccggctgggagcggtggctcgccgccgctgcgggttacttattcgtgtggcggctgtgtctatacggggcgacggtgtacgggtggatctggatgcgccgccggctgctggtacgtgaggacgacgcccaggcgcggcaccgcctggtgcgcaccgagatcgcaggcgtcgtcgccatcgtggcgctggaagccagcctgttgatgcagggctga

SEQ ID NO: 5870 - DNA, 360 bp, Acidovorax sp. JS42
atgagcgcaatgcgcatgacctggcgccccttgcgctggctgttcagccggcgcgcggcgaaagcactgctgtgggcggtggtgatcgtcgccgctgcggtgggggccaacgtcgccggcatctacctggtcgggagcgtggccggctgggagcggtggctcgcggccgcatcgggctacttcttcgtgtggcggttgtgcctgtacggggcgacggcctatggctgggtctggatgcggcgccggctgctggtacgtgaggacgacgcccaggcgcggcgccgcctggtgcgcaccgaggtcgcgggcgtcgtcgccatcgtggcgctggaagccagcctgctgatgcaggccggttga

SEQ ID NO: 5871 - DNA, 372 bp, Acidovorax sp. JS42
atgaaccaggcgcgcatgacttggcgccccctgcgctggctgttcagccggcgcgcggcgaaaaccctgctgtggtttgtgctggccgttgccgccgctgtgggggtcaacgtcgcgggcatctacctggtcggcagtgtttcggcctgggagcggtggctggcggcctcggcagggtatttcttcatctggcggctgggcgtgtatggggcaacggcctacggatggctctggatgcgccgccgggtgctggcccgcgaagaccaaagcgggacagatgggcaggcgcggcgcaggctgatccgcgccgagatcgccggcgtcgccgccatcgtcgcgctggaggccggcctgctgacccaggccgcttga

SEQ ID NO: 5872 - DNA, 354 bp, Acidovorax sp. JS42
atgagccggctcgcctggctgcggctgccatggctgttcaaccgccgcgtcggcgtggcgctgctgtggaccttgctggtggtcgcagccgcggtggcggtgaacatcgccggcatccacgtggtcggcggcgtcgagggctggcagcactggctgcaggcgcacgccggccacttcttcgtgtggcgtctgtgcctctacggagcgacggcttacggctggtggtggatgcgtcggcgcctgttgcggcgggagccgtcccgcgagacgcatcagcgcctgctgcgcacggagatcgcggccgtcatcgccgtggtcgcgctggaagccagccagctgctgcggcacggctga

SEQ ID NO: 5873 - DNA, 354 bp, Methylibium petroleiphilum PM1
atgagccggctggcctggctgcggctgccatggctgttcaaccgccgcatcggcgtggcgctgctgtggaccttgctggtggtcgctgccgcggtggcggtgaacatcgccggcatccacctggtcggcggcgtcgagggctggcagcactggctgcaggcgcacgccggccacttcttcgtgtggcgtctgtgcctctacggagcgacggcttacggctggtggtggatgcgtcggcgcctgttgcggcgggagccgtcccgcgagacgcatcagcgcctgctgcgcacggagatcgcggccgtcatcgccgtggtcgcgctggaagccagccagctgctgcggcacggctga

SEQ ID NO: 5874 - DNA, 360 bp, Parvibaculum lavamentivorans DS-1
atgagtccgcgcgcgaactggctgggccggctgttcagccggcacgcggtgaaggcgctgctatggacggtggtgatcatcgcggctgccgtgggggccaacgtcgtcggcatctacctggtcggcagcgttgacggctgggagcagtggctggccgccactgcgggctacttcctggtgtggcggctgtgcctgtacggcgcgacagcctatggatgggtctggatgcgccgccggttgctggcgcgcgaggcccagaacggcgcggatgggcaggcacggcgccgcctggtgcgcagcgagatcgctggcgtcatcgcaatcgtagcgctggaagccagcctgctgatgcagggctga

SEQ ID NO: 5875 - DNA, 372 bp, Serratia proteamaculans 568
atgactggaacagaaaataaaggtatgtcgccccgcaggggcggccggctcggttaccgggcaaagcgtgtcctgcagatgctgggcatgctcgtggttgccatggtgatagctctggggatggccgattggggcgtcaatcatccaggacaaagcgctgtgctgcatgactgggtgcacagcacccgttatggttggctgagctggcgcctggtcctttacgccgtacttacctggggtggctggaaaatctggcacgcgccgggctgcaaaccggaataccggcaacccctcaaacgcatggccatcgcgtgcgcggtatttgccctggcatgtgaatacagtctctttggcggagggctgacgttatga

SEQ ID NO: 5876 - DNA, 372 bp, Delftia acidovorans SPH-1
atgaacccgacgcgcgccagttggctgcgcccgcgctggctgctgaatcggcgcgcggcgaaggcattgctgtggacggtggtgctcgtcgccgctgccgtgggcgccaacatcgtcggcatttttctcgtcggcagcattgacaactgggagcgctggctgacggccacggcgggctacttcctggtgtggcggctgtgcctgtatggcgcaaccgcctacggctgggtctggatgcgtcgccggctgctggcgcgtgaggcccaacgcggggcggataggcaggcgcggcggcgactgctgcgcagcgagatcgctggcgtcgccgccattgtggcgctggaagccagcctgttgctgcaggccgcttga

SEQ ID NO: 5877 - DNA, 354 bp, Thauera sp. MZ1T
atgagccggctggcctggctgcggctgccatggctgttcaaccgccgcgtcggcgtggcgctgctgtggaccttgctggtggccgccgccgcggtggcggtgaacatcgccggcatccacgtggtcggcggcgtcgagggctggcagcactggctgcaggcgcacgccggccacttcttcgtgtggcggctgtgcctctacggagcgacggcttacggctggtggtggatgcgtcggcgcctgttgcggcgggagccgtcccgcgagacgcatcagcgcctgctgcgcacggcgatcgcggccgtgatcgccgtggtcgcgctggaagtcagccaactgttgcggcacggctga

SEQ ID NO: 5878 - DNA, 345 bp, Thioalkalivibrio HL EbGR7
atgaggatcggactgccgaagtggctgttcaaccggcaactcggacgcacgctgggatggattgcgctgatcgtgttcgtcgccgtggccgtcaacctcgtcggcattcgcctcgtcggtgacgcgcacacctggagccggtggctggacgagcatgccggttacttcctcgtttggcggctgtgcctgtatggcgcgacggcctacgggtggatatggatgcgtcgccgcctccgggaacgcgacacatcccgcgaagcgcatcagcgcctgctgcgcgcggaggtcggcgccgtcgccgccatcgtgctgctcgaaatcagcgtgctgctgcgacaaccgtag

SEQ ID NO: 5879 - DNA, 357 bp, Azotobacter vinelandii DJ
atggatctgcaaccccgcaaaaaacccaatttgctccgggagctggccgtcgccctggttctcacggtcggcctggtgatcgccggcgtgctgctcggcagcctcgccatccagctcttcggcggcgtcgagcagtggctgacctggcgggccgacaactacctgggcctgctggcctggaggctctgcctgtacgccggcatcgccaccgcctggatcgggctcaggcggcgcttgccccttcccgagcccggccccgcacgcaaccgcctgcgccgcatcgagggcctgatcgtgctgctggccgcgatcgtcgaactcatcaaggcgccggtgaactggatggaggttctatga

SEQ ID NO: 5880 - DNA, 354 bp, Ralstonia pickettii 12D
atgaccagccgggcctggctgcggccggcatggctgctcggccgccgcgtcggcatcgtgctgctgtgggtgctgctggtggcgggcatcgcggtcggcgtgaacgtcgtcggcctgcacgtcgtcggcagcatcgacggctgggagcagtggctgcgcgagcactcgggccacttcctcgtctggcggctgctgctctacgcggcgacggcctgcggctggtggtggatgcgtcggcgcctgcgcgaacgcgagccgtcggccgaggcgcaccagcgcctgctgcgcgtcgagatcgcggccgtcgccaccctcgtgctgctcgaaggcagccagctactgcgcaatggctga

SEQ ID NO: 5881 - DNA, 351 bp, Dickeya zeae Ech1591
atgaagtttgcctggctgcaatcacaccgtctgttcagttggcgtacacccagagtccttctatggattgtttcattgctggttatcaccgtcacagccaacgtcctgggcatccacttcgttggcagcattgctggctgggaacactggctggccgatacagctggctatttcctgttgtggcgtctgtgtctgtacggtgccaccgtttatggctggctgtggatgcgccgccgcctgctcctgcgcgaaacccgtaccgatgaccggcgcagacttattcgcgccgaagttttcggtgtcggcgcgttactggtgctggaattcagcctgttggtgcagtacgtatag

SEQ ID NO: 5882 - DNA, 393 bp, Methanosarcina barkeri fusaro
atgaatcttgatcttgaagctgcacgaacttctcaagaaatcatgaaaaatacaatgggcaaacaaagtaaaagtgtagaaaatctcgttacaaagactttaggcgttttgcaggaaaacggaatttatgcttgtatgttatttctttgttcccgcagtaatactgagaaagaaattgcaaaaattataagaagcgagcttctgaaaatgactgattttgtggaaaaaatttcactaaatagtgataattctaaagagattccagataaagagattttagagttccttacaaataatatttgtaatgacattgatatgctttttttcactaaacagctttgggagcagacattaatctacacccgatacggagcaaaggcgagggaggactaa

SEQ ID NO: 5883 - DNA, 417 bp, Roseiflexus sp. RS-1
atgaccaacacgacttcgatcaatcttgactacctggctgcaaaatatgcacagaccatcatccagaagacgaaggacaagaaggcttctgacatcgaaaacacgatcactaaagcgctaggtgtgcttcaggaagacggggtctatgcctgctttctctacttgctcgccagagagaaggagaacggtgctgttgtcgttgatgaaatgctcaatctgttaagtagtctaccgttcggttggcagaagccaacgaataatagcgagatactacccttcatcagtgaacaggtgacgaaagacctggatcgcctgttgctggcgcgtgaggtgctggaacagatgctgatctatgcacgctatggtgcaaaagcgcgtgacaaggggggaagcgaggcgccaggagaatcatcatga

SEQ ID NO: 5884 - DNA, 390 bp, Roseiflexus castenholzii DSM 13941
atgagcaatagcaccgaacgcaacctggaccggctggcggcggagtacgcgcagaatatcatcaagcgcacgaaggataaaaaagccagcgatatcgacaacaccatcaccaaagcactgggcgtcctgcaagaaaacggcgtctatgcctgctttctttacctgttggcgcgcgagaaagagaacggcagcgtggtggtagaagagatgctcaacgtgctcaacgggctaggctttgggtggggtaaacctgccgataaacgtcctgaaaaggtgttggctcacgtgagcgacaaagtcacggctgatctcgagcgcctgctgctcgccaaagagacgctcgaacagatgctgatctacgcccgctacggcgccaaagcacgagaatag

SEQ ID NO: 5885 - DNA, 393 bp, Thermotoga RQ2
atgcaagagaaaattagtaaaaatattgatcaaatctgtgcaaggtacagcatcgatatcgtcaatgagatgaagagcgaatgcgattcaaaggagattcaaagccttgtaactaaggcactgggtgttcttcaacaacaaggtctttatgccttcggactgttctgtaaagcagaaaataaagcagagggaatcctcaaaaaggccatagaaatgctacgtgaaataggtattatgaagaattcaaatgaagaagatctttcgagcataagtaacctctcagagagaatacacgatttgatgttcgcaatcgagatcgttgagaaaaccttgatatacgcaagataccacgctaaggctttggtgaaagaatctagcagtcatagtgagtga

SEQ ID NO: 5886 - DNA, 375 bp, Chlorobium limicola DSM 245
atgacacaactcaatcttgaccaactggctgcccggtacgcacaaaaaatcgtggaaaaaggtaaagccgatattgaaaaccctgttacgaaagctctgggagttttgcaggaacagggcgtttatgcttgcattttgtacctgcttgcaaataaacatgataacattttgaagccattgtaccagttggtgggtgaattaccgggttttcgaggaaatgagaaaatgcctgatgaaaagatcgattcaaaagagatgctaaaattttacggcgactgcgtttgtagtgacctggatacactgcttctcgtcaaagagttgtacgaacaaaccctaatttacgcccgctacggggcaaaggcggcggggaaataa

SEQ ID NO: 5887 - DNA, 414 bp, Prosthecochloris aestuarii DSM 271
atgagtgaaaagacagcaatactgaaccttgactatctggcggctaaacatgcccagcaacttgttgaagatcacagcgatatagaaaatacggtgaccaaagcactgggtgttcttcaggaacacggagtttatgcctgttttctttatctgcttgcaaaggaaaaagagggaaacaaaggaaaaaacactgccgggcatatgatcaagttacttcaggaaagcaaacttgtacctgaagataatgatcttaaaaaaccaatagaaatacttcagtacgccaatgaacatatttcatctgccaaactgaaaaaactcctgctgatcaaggatctgctcgaactcatgcttatctacagccgataccatgcaaacgccatggaaccgacaaacagtagggaggaaaacacatga

SEQ ID NO: 5888 - DNA, 372 bp, Chloroflexus aggregans DSM 9485
atgagtgacgctcagatgaagaacctggacatccaatgcgccgagttgggacgcgagttagcaacaatttctggcatggaagagaaaatcatcaacgctgcccttgcagttcttgaagaacaaggtccgtatgccatgtttctctacttgaatgcccggcacagcaacgtagccgataagatcagcgacaaatccctcaagtttttacgaggcatctttaacgcccggctcaataatgcgaaggatgtcctggaggctaccaagcacctggcggatagcctggacgatcttctctttgcccgtgatctgctgcgcacggcgctctcctacgcccgttaccatctcaaagccaagggagataaaacaccatga

SEQ ID NO: 5889 - DNA, 390 bp, Chloroflexus aggregans DSM 9485
atgagcaatagcacccaacgcaacctggattggctggcggcgaagtacgcgcagaacatcatcaagcacacgcaggataaaaaagccggcgatgttgacaacaccatcaccaaagcactgggcgtcctgcaagaaaacggcgtctatgcctgcttcctctacctgttggcgcgcgagaaagagaacggcagcgtggtggtagaagagatgctcaacgtgctcaacgagctaggctttggatggggtaaacctgccaataaccgtcctgaagcggtgttggctcacgtgagcgaaaaagtcacgaccgatctggagcgcctgctgctcgccaaagagacgctcgaacagatgctgatctacgcccgctacggcgctaaagcacgagaatag

SEQ ID NO: 5890 - DNA, 933 bp, Anabaena variabilis ATCC 29413
atggttaaacaaatcagcctcaacttagatggcattgttaaggaaataactaatgtcaatccagcttttgcccgtcatgagacatttcatccacgttatgggtggataaaaaaagggtttgatatggctcaagttaatcccaaaatctttttacaagaggatgcacctgtaagattaggtgttgggaaaaacatggtaagcgctattcgctactggtgcaatgcttttaaggtattagagaatgatgaaccgtcagagtttggtaatcttctattaggagaagatggctgggatatctttttagaagatcctgcaacactgtggcttttacactggaacttgctaaaaccaagttgtaatgcagctgcttggtattttacttttaatatttttagagaaaacgaattttcacaagatgatttatttaatgctttgtgtacttacagagatagtattgcaccacgtattgctgaatcatcgttaaagaaagatgtatcctgtattttgcgaatgtatgtagaacaggcaaatactaaggtaggtataacagaagaaagtttagactgtccttttactcaactaggaatcattcataccgcaggagattcacggcattttacttttcgagttggttataaaggaaacttaccagcagaaatattagttgctgcctgtcttgagtatgccagctttgtaggacgtgagcagagaactatttctatttcccgtctagtttacgatatcggcagtcctggaatgattttcaaactttcagaaagtgctgtgtgtgatgccattgaacaagttgctaggtggtcaacctcgatttcactttctgattcatcagggctaattcaattttcctttacatccgagccagaagctttagcaaaggatattttagataagtactataaacacagggttagttag

SEQ ID NO: 5891 - DNA, 957 bp, Shewanella frigidimarina NCIMB 400
atgaaagctaagtttacaggtcatgacactttccctctgcgctatggatggctattcaaggcagttaatcatttgaattcaaatggtaaattctcaagttctgatgaagacagcattcgtcaatcgatagttgaacttggtgttggtaaaaatatggttaaagctattcagtattgggctgaagcttctaacgtgatccattctgaacgatcaaataattcatttactcatgctgtgtcacaaaatggcgaatatctttttggtggtgaaagcttagaggatggaagagatccttatttagaattgcctggttcaatttggttagttcatttctggttaaattttaatgttgaacatttgacggcttaccgttacttttttaattttgcaaatgtgcaacattttgaaaaaacaaagctaatcgctgattgttttgaagatgcgaaaaaactggttgatagtgaactaggtaatatatctactatcaagaaagacattgactgctttttgaatacctatagtaaaaagctcaaagctactccatcgaaaaaaagtatcaacatagatgaagaccattttatttcgcctttgtctgaattaaatttgatacaagataacggcggcggtttttacattagcaatctatctgaacgtcctgaactacctatcgaaatatttacttatgccctgcttgagttttttaaaactgaaactgttgattctaaagtcagcactgtcgatttcgactcattattgagtaaaccctgttcacccggtcgtatattccgtttgtctgaatctgggcttggtcaaaaactcgatgaagttcagaactttacagacaaaaacatttcgtgggtcgattcattaggattaaggcaagtcaacgtttctgattatgcaaagaccaacagcactctctatttgaatcaatattatggcactaaaaatgactga

SEQ ID NO: 5892 - DNA, 924 bp, Polaromonas naphthalenivorans CJ2
atgatggggaaaaacacaatacaagctcggacttcagcctatttttcaggacatgagacttttcctctaagacagatgtggcttaaaaaggccttcgaagagtcggttggtcacatcattcctaagagcgcgttcgctggcgagaatgccatcgctgcttttggcgtgggtaaaaatatggtggctgcgattcggcattgggcattggcgtgcgacgtcatgcgcgatgacgaccctactggctataccgtcactaaaaatgctattgccatatttgacgatgcgggcttggacccctattcggaagatctcaatacggcgtggtatgcgcattggtggctcgcgggcaaaggtaaccgtgcgacaacatggcattggctcttcaatcacgtgaccttaccagttttttcacgagaagaattagaagcaccgctcgccgaattcgcgcgtaggcttgatccgaagcgcaagctctctcctgctacgctttcaagggacatcgaaacttgcattcgaggctatgcccctcgttttgcgggagggtcgcccgaagattacgctgagtccatgcttggcgagctcggcttaatttacgaagaacaccgcgggcattttgcgtttagacgcggcccaaaaacgactctcagcgacgggatgtttacgtacgctctgctcgatttttgggagtctacagcgccgggtctgagttcgttggcatttgaatccatcgcgtatggcgaaggctctcctggacgggtcttcaagctcgatgaagactcagtggctgaacgtctcttcaacttggacgacctcaccaaaggtgctctgtcgtggacggacaccgccggtcttcgtcaggtccatcgaaaaacggaaaagctctccggtctcagtgaaaagatgattgcaaaagcatatgactga

SEQ ID NO: 5893 - DNA, 936 bp, Methylibium petroleiphilum PM1
atgattccaataattcccggtctgaaaccacagttctccggccatgagaccttccctctgaggcagctttggctgcacaaggcggtgcgcgcggtcgaggagaacggcgcggcctcctcacccttcggcgatgaagaggcgatcgtccgcttcggggtgggcaagaacatggtcacctcgatccgcttttgggcgacggcctgccgcgccatcagggaagagggcgacggctacgcgccgaccgggctcggtgccgacatcttcgggctcgatggcttcgacccgtactgcgagcaagccgcgacgccgtggctcatgcattggtttctcgcgagcacctacgacaagacaactacgtggtacttcctcttcaaccacgtcactcagcaggtattcgagcgcgaggccgtggtcgccgcactgcttggcgggttcagtgagctgacgcaggcagtgccaactctcaagcgcatttcgccggcgactctgaagcgggacgtcgagtgctgcatacgtagctacgtaccgcggctaggaagcgaatcgcccgaggagatgagcgagccgctgcttggtgagcttggcctcattcagcagaacgccaagggtacgttcgagttccggcgaggcccaaagcgatcgttgccggacggcatcttcgcctatgcgcttcttgagtactggaagcgtcaagccgccgggtcggtcatggcgttcgatcgcgtcgcccacgactacggttcaccggggcgggttttcaaactggacgaaggtgcggtagccgaccgcctgatggcgctcgaagcgctgaccgacggcgacatccaatggaccgagcaggcaggaatcaggcaggtcacgcgcacggggcgggcgctcgcgaacatcgacgaagcgatgacaaaggtgctgagggcggcgtatgggaggcgctaa

SEQ ID NO: 5894 - DNA, 897 bp, Flavobacterium johnsoniae UW101
atgtcagaattattgactagtccatacaataaacttaccttatctggtcatgaaacttttcactgcaggcaattgtggttaaagaaaggttatgattttgtaaataacgggaacaaatttaccgacgttgaagcagtagttttacttggtgtaggtaagaatatggttgcttcaatatatttttggatgaaggcattttcgttgattgatggagaaggtaaacttacaagtttggcacattatattttttcttcagaaggcaaagatccttttctagaagatgaagcgaccttgtggcttcttcattatcatttggtgaatcagggtttttcctcgatctatgatttgatttttaattatctgcgaagagagaaaatagagtttacaaaagaaaactttttattatttgtacaaagaaaggcaaatgaaataggttttactcaatttaataagaagactgctgggacagattttgatgtattaacgaaaatgtatatcagaacaaccgatcaagtgaaggataaggaagacactttttcaggattattggcagacctaaatctaatacaggaagaaaaaaaacaaacatcattatattccatcccgaatgagagtagaaacaatctgcctgaggaaattatcctatatacaattttggataaacaggattttcaaaactcggtaagtttaaatatgctttttcaggacaggaatcaggctggatctgtttttggcataaccaaaaatgcattgatggaaaaattggaatctttagctaataatccaaaatataaaaaatacggtgtgacgttaagtgatcatgccggcattaaggaactacagtttgtttcaaaacctgataaatttgaaatactaaatcattattatggcaattaa

SEQ ID NO: 5895 - DNA, 939 bp, Sphingomonas wittichii RW1
atgctgacctctgcccgtccccattatcgcttttccgggcatgaaagctttgcctgtcgctatgcgtggctgcccaaggcctaccgcgcactgcgcaacgatccgttgatcttcagtgacgaaccgcgcgccatggtcgagctggggcttggcaaaaacatggtgcgctcgctgcgtttctgggtggaagtcgcgggtttggcggaagctgatgccgagcgcggccgcgggctccgaacaacggcgtttggcgatgccttgcttggcgaagagggtgccgatcgctatctggaggatcgacgtacgctctggttgctccactggaagctgagctcgcgcgatgagggcgcgctgttcgcctgggactttctattcagtcgctggccttatcccgagctgacgcgcacggaggcgcttggcgctttcatgcgggaatccgaaaagcttggccacgaccattcgcaggtcaccttggggcagcacctggacgtttttctccatagctatctgggcgcgcggtccggaaagacggctcttgaagattcgctcgatggcccgctggtcgagcttgaacttcttcaacctgtcggtgagcgcaagggcgagggaggccgcttcgagccggtctacagcttccggcgggagcccaagggcgaaatcacggccgcgttattcgactattgcgtcatcgatttctggcaacgtaaccacccgggtgagaatagcctgacactgcgcgacatcgcgatggcaccgggctcccctgggcaggtcttcaagctgcccgaagatgacgtgcgcgcacgcctggaaagccgggatcatggttatccggccccctatacctatcagccgtcggcagttcagggtctcctgttccgcacgtctgcgacggtctcacttgaacaagtctatgcccaggagctggctgatgcctaa

SEQ ID NO: 5896 - DNA, 561 bp, Alteromonas macleodii  Deep ecotype
atgactgctatgcagagctttgaaaaatcaaagcttatttttgatattgaacgagatgctaaagtcatatgtgataaagaagtaaaggaaagcactattaaaaaagatgtagattgcttccttcatacttacgcaagtaagtcgttagcgaaaggtaaaaaaaatttcgttataggtgaagagcactttgcttcaccgttgattgagctaggccttatacgtgatttaggaaagggcaactattcatcaattttagacgagcggccaaccctgcctaccgaaattttctcatttgcgctgttacgttttgtcttcgaaattaaagcttcagaaacagctggttttgatgcgttgttatctgatcagtgttctccaggtaaaatatttaggctttcagaaaggggcctcggcgtacagttagacaacgcggtaaagcagtatcctaatttgcttgaagagacagatacgcagggaatgcgacaggtgagggttttaaaaacgttcgatgaaaacgaaaccttccaatttatcttggatgattattacagaggctcgaaatga

SEQ ID NO: 5897 - DNA, 924 bp, Thauera sp. MZ1T
atgacgaccgctgccatctcccccggatacacacctcacttctccggacacgagaccttcacactgaggcaaatgtggctcaagaaggtcttcgatcagagaacgaaagctaacaggatcaagaaatcggtcttcaccgacgacgagtcgatcgcgcgctttggcgtcggtaagaacatggtcggctcaatgcggcattgggccctcgccaccaatttgataagcgaaggcggcccggacgattatgtcgtgtcgcaaagagctcaatggatgttttccaacgacggtttcgatccctattcggagaatccgaacactgcttggttcgttcattggcaacttgcaggattggccacgcgctcgacgacttggttctggcttttcaacaaggtaacagcgccgacattcacgaagacggaccttgaaaagcccttggctgactttgcgttcaaattcaatatcaaacgtggcatctccgcctcgacccttgcccgcgacatcgacacgtgcgtccgcagctatgctcctaggtcagggggcagttcgccggaagatttcgccgagcccatgctcggagaactaggcttgatttccgaagaaactaagggggtcttcacctttcggcgcggcccgaagcccacgctcagcaacggactcttcatctacgcattgatcgattattgggagctgctcgatccctctgcgagctcaatgggattcgagtccgtagtctatggtgagggttctcctggacgagtcttcaaactcgacgaggagtccgttgcggaacgcctcttctctcttgaggaagacaccgcgggcgccctttcttggaccgacacctctggtcttcggcaagtgcttcgaaagagctggaacagttcagcgttccaagactcgatgctgaaaaaggcctacgaatga

SEQ ID NO: 5898 - DNA, 897 bp, Methylobacterium nodulans ORS 2060
atgaaccagacgctgaagcccatcaggatggagttcgggcgccacgaaaccttcaccatccggcacggctggctcgggaaggggcttgaacgtctcggctcgcccgaggggttcgctgcggatacagcgactgcggacaaactcgggctcggaagccgcatggtacgttctctggcgtactggcttgaggcatccgggcttgcagacgtcgttatggaggggcggtcccggcgcctgaatatgtccgacatcggtcgcgtcatcgacgcgaacgatgcgtacgtggaatacccggggacgctctggtttttgcagcttgcgatcgcgagccgcgacggctcggcgccggcttggttcttcaatgactatctcgaacgcagcttcgagcgcgcggcctgcgtcgaggcgtttctgaggtacgcaaagcagcgggcgaccaagacgccgacgctacagtccactcagcgcgatgtcgcaaacgtccttgcgagctacgcctacaacccaaccgaggctcaggatcctgaggacggaacaatttgtccgctcattgaactgcgccttgtaacctaccatcgcgacacgcgacgcttcgagaaggtcaggccggttgatccggtgcctattgaggctgtcctcgctgcagcgtcatcgtgcagcaatggcgaggaaaccttgtccgtgatggacctcgcttctcgcaggcacggccctggacgcttgttcggtctcagtccggagatgattgaccgcgccgcgcaggagggcgcccgcatctacgcaaaatccggggtcacttacgtcctacttggcgccgagcgccgcctcagtgtgccgaacaggccgccggcttggtggctggagcggcattaccgccggattgagaggcaggcatga

SEQ ID NO: 5899 - DNA, 1119 bp, Actinosynnema mirum DSM 43827
atggcagacacaaggctcgcggcagcagcacactccagcttcgcgcgccatgaaaccttcgcaccgcgcttcggctggttgcacaaggcgtacatgcgggtgaaagacaaccctggcaccttcatcgccgaggacgcgcccgtcgagctcggcgtgggcaaaaacatggtcaacgccatgcgctactggtccaaaacgttcaagctcacccgcgaacacctaagcgaggacggcaagaccaaggcccacatcgcctccccgacctgggaagcgcgctggctgctcgacgaagacggtgccgatccctacctcgaggatccgggaagcctctggttgctgcactggtggctggtgtcctcgcggccaggcgccaagtgctgggcaccgacctggtacaccgcgttccacctcgcgccattctcccggttctcggtagtcgagatgacccaggtcgtcatgcgccacgtgaacttctcgttccccgaaggtcctgtcgaggcgtccgtcaccaaggacgtggattgcctcaccaagatgtacgcacgcaccccggccgagcagcccgcagcgcggaccaccgacacgaagaccggggccaagtccaactttgaagacctgctggcctgcccgttccgcgaactcgacctgctcacgcccgtgggtagccgcggaaaccagcagtggcagttcaccaccggcacccgtaactcgcttcccgcgagcgtgctcgtatacgcctgcctggactacgcggctcgcgacaccagcagctccggatctatctctctggcccggctcgccaacgagccgggcggaccaggcagggcgttccgcgtccgggaacctgaaattgtcgcggcgctggacaaggtcgccgccgagcgcgcggacgtcagccgagtcgacgcggtcggccagcgcagcatgtccttcagtggtgacccgttcgtcttggcctgggacgtgcttgacgagcagtacggatacgtcacccaccgtccaggcttcccgacccgtcgggagtgggaccagaaatacccgatgctcgcgaaggtcgcgatggccgagtcgcagcagcagaagcaccagccgcttgccctcatggaggagatcgcgtga

SEQ ID NO: 5900 - DNA, 306 bp, Mesoplasma florum L1
atggaaaaattttgcccattagaatacacattaaattttattaaatcaaagtgagttatattaatcatacgagaactttcatttggaacttgtcgctttaatgaattggaaaaaagaatagcaggcattagtcaaaaggtattaacatcaaacttgaggtttttagaagaaaataaacttgtagaaagaacagtttaccctgttgttccaccaaaggttgaatacagtttaacagatttaggtaaaagcttaaaaccaatactagatcaaatgagtgattgaggagtcaaaaattatggaaaataa

SEQ ID NO: 5901 - DNA, 483 bp, Burkholderia 383
atgtggaatgctagggttcgcgcccgggtcccacaagaacgcacagggttgtgccccagtcacatcgatgttcctgccaccatgccccgaccgagcgacaacgactgccaggcgacccgccagatcctcgaccggatcggcgacaaatggagcctctacatcatcgcgacgctgagcgacggctcgcggcgcttcaacgagctgaaacgcgagatcgacgggatttcgcagcgcatgctgacgctgacgttgcgcgggctggagcgcgacgggctggttacgcggacggtattcccgacgattccgccgcgcgtcgactacgcgctcacgccgctcggcgcaacgctgctggagcccgtgatggcgctcgtcatgtgggcggagaagaacaagcagccgatcgcccaagcgcgcgagcgtttcgacgacgcggctgatgcggcgccggagccgggcgtgggcgtcgtatatcgcagccgatag

SEQ ID NO: 5902 - DNA, 453 bp, Rhodopseudomonas palustris BisB18
gtgactgcaaaaaccgcacaagaaggcactgttttgaaactcgagcacagcgatttgcctgggcacagcgatgtaaccgccccgcaagcgtcgattcacaacgattgtcgcggcgttgccacggtgctgtcgcgggtcggcgacaaatggagcgtgctggtgatcatgatgctgggcgagcggccgctgcgcttcaacgaactcaagcgcatgattggcggcatctcgcaacggatgctgacgctgaccttgcgcgggctggagcgcgatggcctcgtgacccgcacggtgtttccgaccgtgccgccgcgcgtcgactacgaactcaccgagctcggccgcggcctcagcgcgccggtgaaggaactcgggcaatgggccaagcagcatctgcccgacatcgaaggcgcgcgggagagcttcgatcgccgccgttcggccgagcaggcgtag

SEQ ID NO: 5903 - DNA, 369 bp, Paracoccus denitrificans PD1222
atgcatgatccgaacagtttcggttgcagggccttcaccgccgtcctgcaaaggatcggcgacaaatggagcttgctgatcgtctcggtcctggccgaagggccgaagcggttcaacgaattgcggcgcgagatccccagcatttcccagcgcatgctgacgctgaccctgcgcgggctggaacgcgacgggctggtgtcgcgcacggtgacgcccagcatcccgccccgcgtcgattacgaactgaccgagcttggccaatcgctgcgcaagccggtctgcgcccttgcggaatgggcgatggcgaatatcgacgcgatccataccgcccagtcgcgcttcgaccgggcgaatggcgaaaaggtctag

SEQ ID NO: 5904 - DNA, 375 bp, Sphingomonas wittichii RW1
atggatatgacctcctccgtcctggcgcatggcgaatgcatgcgggtcagcgggctgctcgcgcggatcggcgaccgctggaccctgcccgtcatcgtcaccctccatgacggaccgctgcgcttcaaccaggtccgccgcgcggtcggcggcatctcgcagcagatgctgacccgcaccctcaggacgctcgaacgcgacggcatggtcgggcggacggtccaccccacggttccgccgcaggtcgaatatgcgctgaccccgctcggccgctcgctcgccgccgaagggttgcggctgggcggctgggtgcgcgaccatatcgccgagatcgacggccatcgcagcgccttcgatcggcgccaggagggctga

SEQ ID NO: 5905 - DNA, 408 bp, Methylobacterium extorquens PA1
ttggaacccgggcacatcgagggaaccgacgcaccgccgcggcccgagcattccgggcaggattgccgcctcgtcggcacggtgctcgcgcggatcggcgacaagtggagtgtcctcgtcgtcatgatgctgggcgacggtccgcggcgcttcaacgagctgaagcggatgatcggcggcatctcgcagcggatgctcaccttcaccctgcgcgggctggagcgggacggcctcgtgacgcgcacgatcttcccgacgatcccgccgcgggtcgattacgagctgaccgaactcgggcgctcgctgcgggagccgatccaggcgctcggcgcctgggccttcgcccacctgccggagattcaggaagctcgcgcccgcttcgaccgccgcagcggcgaaggggcctga

SEQ ID NO: 5906 - DNA, 408 bp, Methylobacterium populi BJ001
ttggaacccgggcacatcgagggaactgaggcggcgccgaagcacgcgcattccggccaggattgccggctcgtcggcacggtgctcgcgcggatcggcgacaagtggagcgtcctcgtcgtcatgatgctggcggacggcccgcggcgcttcaacgagctgaagcggatgatcggcggcatctcgcagcggatgctcaccttcaccctgcgcgggcttgagcgcgacggcctcgtgacccgcacgatcttcccgacgatcccgccgcgggtcgattacgagctgaccgaactcgggcggtcgctgcgggagccgattcaggcgctcggtgcctgggccttcgcccacctgccggagattcaggaggcccgtgcccggttcgatcgccgcgagggtgagaaaccctga

SEQ ID NO: 5907 - DNA, 393 bp, Gluconacetobacter diazotrophicus PAl 5 JGI
ttgatacgcgggaacatgcatgtaaccggggaggcacccgatccgggccagggaaactgccgcaagatcagtccggtcctggcgcgcctgggcgacaaatggagcgtgctgatcgtcatgcaactgggcaacgggccgcgccggttcaatgaaatccgccgcatggtcgacggcatttcccagcgcatgctgaccctgaccctgcgcgggctggagcgcgacggcatggtaacgcgcacggtctatccgaccatcccgccccgcgtggactacgaactgacgccgctgggccggtcgctgcgcgaaccggtgcaggcgctggggacctgggcgatggccaacctggacaagatcgagatggcgcaacgggaattcgatagccggaaagcgtga

SEQ ID NO: 5908 - DNA, 408 bp, Methylocella silvestris BL2
ttggaacccagtcacgcgcatgttccctcgcaatgcgggcgcgtcgcgccgatccttgcgcggatcggcgacaaatggagcatcctcgtcatcatgattttgggcgacggcccgatgcgcttcaatgaattgcggcggcgcatcggcggcgtctcgcaaaggatgctgacctttacgcttcgcgggctggagcgcgacggatatttgacccgcacagtttttccgaccgttccgccgcgcgtcgattatgagttgaccccgctgggccagtcattgcgcgcgccggtgcaggcgctcggaaactgggcgcagcaacatctcgtaacgatcgaagacgcccggctccgtttcgacgaagccgccaagcgcgagccccccgccccgccacccttgaggttttctccgtga

SEQ ID NO: 5909 - DNA, 408 bp, Methylobacterium chloromethanicum CM4
ttggaacccgggcacatcgagggaaccgacgcaccgccgcggcccgagcattccgggcaggattgccgcctcgtcggcacggtgctcgcgcggatcggcgacaagtggagcgtcctcgtcgtcatgatgctgggcgacggtccgcggcgcttcaacgagctgaagcggatgatcggcggcatctcgcagcggatgctcaccttcaccctgcgcgggctggagcgggacggcctcgtgacgcgcacgatcttcccgacgatcccgccgcgggtcgattacgagctgaccgaactcgggcgctcgctgcgggagccgatccaggcgctcggcgcctgggccttcgcccacctgccggagattcaggaggcccgcgcccgcttcgaccgccgcggcggtgaaggggcctga

SEQ ID NO: 5910 - DNA, 480 bp, Agrobacterium vitis S4
atggtaactgccaatcgggcgcaaggaggcacagacttggaactcgggcacatcaatgtaaccacatccgaaccgacagccgcgccggaggtttccatggcagcggtcaaccagcgcagcagctgcgaggcggtcaacagcgtgttgacccgcatcggcgacaaatggagcgtgttgatcgtgatgatgctggccaatggcccacagcgtttcaatgagttgaagcggcggatcggcagcatttcccagcgcatgctgacattgaccctgcgtggactggagcgcgatgggctggtgaagcgcaccgtgtttcccaccattccgccccgggtggattacgaattgaccgatctcggccaatcgctgcgccagccgatcgaggcgcttggccactgggccttcgacaattatgcttgtattgccaaggcccgcgacagtttcgacaaggcggcaaagaagcaaggcgtcaggaagccctga

SEQ ID NO: 5911 - DNA, 399 bp, Catenulispora acidiphila DSM 44928
atggcggaggcaaggctggaaatgccggcgacctgtcaggaggtgggcccggaggggcagttcgtccgcggcgtgctcgaccgcatcggcgacaagtggagcctgatgatcatcggcagcctgaaccgcggcccacgccgcttcggcgccctccaggcggcgatcggcggcatctcgcagcggatgctgacgctgaacctgcgccagttggagcgcgacgggctgatctcgcgcacggtctacgccgaggtgccgccgcgggttgagtacgagctcacggagctggggcacgggttgctggtgccggtgctggagctggtgaactgggccggggaccacgccgaggtgatcgagaagcatcgggcggcttatgacgcggggggtggggcggtggggtga

SEQ ID NO: 5912 - DNA, 885 bp, Thermobifida fusca YX
atgcaactcggcatgatcggcctcggcaagatgggcggcaacatggccgcacggctgcgcgacaaggggcacgaggtcatcggctacgacgtcaaccccgagctgcgcgacgtggactccatcgccgaactcgtggaacgactgtccgccccgcggaccgtgtggctgatggtgccggccggggagcccacccggaacacgatccgggagctcgccgacctcctcgacgagggcgacctcgtcatcgaaggcggcaactcccactaccgggacgaccgcgtgcacgccgacgaactcgcccgccgcggcatcgaataccttgatgcgggagtcagcggcggaatctggggacgcgaaaacggctacggcatcatggtcggcggcagcgccgagaacgtggcccgcgccaagccgatcttcgacgccctcacccccgaggccgggagcgggttcgtccacgccggggaaatcggtgccgggcacttcgtcaagatggtccacaacggcatcgaatacggcatgatgcaggccttcgccgaaggctacgagctcatggccgcctctgggatcgtcaaagacgtccccggcacgctcgccagttggcgccaaggcaccgtggtgcgctcctggctgctggacctgctggtccgcgccctggaagaagaccccgagctggagcagttgcgcggatacgctgaagactccggtgaaggacgctggaccgtgcaagccgccgttgaccacgcggtgcccgccccagttatcaccgccgccctgtacgcccggttcgcctcccggcaggaggacagcccggcgatgaaagtcatcgccgcactccgcaaccagttcggcgggcacgcggtcgtcaagaagaacaccgactag

SEQ ID NO: 5913 - DNA, 894 bp, Mycobacterium MCS
atgcaactgggtctggtggggctcggcaagatgggcttcaacatgcgggaacgccttcgcgaaggcggacacgaagtcgtcggcttcgatccccggcccgaggtgaccgacgtcccgtcgctcgccgcgctggccgacgcgctggccccgcccagggtggtgtgggtgatggtgccgtccggtccggtcacgcacgacacgatcgtgtcgctcgccgaggtgctgggtgagggcgacctggtgatcgacggcggcaactcccgcttcaccgaggacgctccgcacgcagagctgttgaaagccaagggaatcggcttcatcgacgcgggtgtgtccggcggtgtctgggggctggcggaggggtatggcctgatggtcggcggcgacgacgccgacatcgagcgggtcatgccgatcttcgacaccctgcgccccccgggtgaccgggcggacgggttcgtccacgcgggacccgtcggcgcgggtcatttcgccaagatggtgcacaacggcgtcgagtacgcgttgatgaccgcctacggcgagggttatgagttgttggccgccgaggagttgatccgcgatccgcaggcggtgtaccaggcctggacgaacggcacggtggtccggtcatggctgcagcagctgctcgccaaggccctccgggaggatcccggcctggccgagatctccggctacaccgaggattccggcgaaggccggtggacggtcgaggaggcgatccgcctccgcgtgccggtgccgtccatcgcggcatcgctgttcgcgcggttcgaatcgcgccaggaggactcccccaccatgaaggcagtctcggcgttgcggaaccagttcggcgggcacgccgtccagaggatcagcaagtcggggtag

SEQ ID NO: 5914 - DNA, 885 bp, Arthrobacter FB24
gtgcacatcggactaatcggccttggaaaaatgggtttcaacatgcgcgagcggctgcgcaagggcggccttgaagtcaccggcttcgatcgcaaccctgacgtcacggacgtcgccacagtggacgaactcatcgcggctgttccggctccccgcgtcatctgggtcatggttccggcgggcgagatcactgacgccgtcatcaccgagctgggttccaagctcgacgccggcgacctggtgattgacggcggcaactcccgcttcaccgaagaccagaaacacggcgccgcgctggctgaaaagggcatccgcttcgcggactgcggggtgtcaggcggtgtgtggggcctacagaacggctacggcctgatggccggtggcgatgccgccgatattgaacgggccatgcccgcttttgacgccctccgccccgagggtgaccgggcggacagcttcgtccacgttggcggaatcggcgcggggcactacgcgaaaatggtgcacaacggcatcgagtacgggcttatgcaggcctacgcagagggctacgaactgctggctgccaaggacatcgtcacggacctgccggggactttccgcgcctggcagaaaggaacggtagtgcgttcctggctgctggacctcatggtcaaggcgctggacgaagatccgggcctggcctcgatcgacgactacgtcgaagattccggggaaggacgctggaccgttgaagaggcaatcgccaatgcggttcccgcgccggccatcacagcggctttgttcgcccgcttctcgtcccgcgaagacaactcgccggccatgaagatggtgtccgcgctgcgccaccagttcggcgggcacgccacccgtccggccaagtag

SEQ ID NO: 5915 - DNA, 906 bp, Nocardioides JS614
atgcacatcggactcgtcggcctcggcaagatgggcggcaacatgcgcacccggctgcgcgatgccggccacacggtggtgggcttcgaccgcaaccccgatctcgccgacgtcgacagcctcgaggcgatggtcgaacagctgccctcccccaaggtggtctgggtgatggttcccgccggcgacccgacacgggagacgatccgccggctgggcgagctgctcgacgagggtgacctggtcgtcgacggcggcaacagcaagtggaccgacgaccaggagaacgccgacctcctcgcccagcggggcgtcggcttcgtcgactgcggagtctcgggcggcgtgtggggcgcgaagttcggctacgccctgatgtgcggcggctccgacgaggacgtcgcgaaggtgcagcccgcgttcgacgcgctcaagccggacgagggcggcttcgtgcacgcaggcaagaaggtcggcgcgggccacttcgcgaagatggtccacaacggcatcgagtacgccatgatgcagagctacgccgagggctgggagctgctggagaaggtcgacctggtcgacaacgtgaccgaggtgttcgactcctggcgctccggtaccgtcatccggtcctggctcctcgacctcctggtcaccgccctcgaggaggacgggcacctcgaccagatcaccggctacgccgacgactcgggtgagggcaggtggacggtgcaggccgcgatcgacaacgcggtcccgatgcacgtgatcgctgcgtccctcttcgcccgcttcacctcccgccaggacgacagcccggcgatgaaggcggtcgccgcgatgcgcaaccagttcggcgggcacgccgtacacacggagccgccggtcggcggcgacgccaaccccggctag

SEQ ID NO: 5916 - DNA, 894 bp, Mycobacterium KMS; identical to SEQ ID NO: 5913

SEQ ID NO: 5917 - DNA, 894 bp, Mycobacterium vanbaalenii PYR-1
atgcagttgggtctgatcggtctcggcaagatgggtttcaacatgcgtgcccggctgcgcgacggtggtcacgacgtggtggggttcgatccgagacccgaggtctcggacgtggcctcgctcgcggatctcgcggcgcggctgagcgctccccgcgtggtgtgggtgatggtgccgtccgggaccgtgaccgacagcacgatctccgagttggccggtgtgctcagcccgggcgatctggttatcgacggcggcaactcccgctacaccgaagacggcaggcacgcgaatctgttggcggagaagggaatcgcgttcatcgatgccggtgtttcgggtggcatctgggggctgacggaaggttacgggctgatggtcggcggcagtgacgccgacgtggcgcgcgcgatgccgatcttcgagacgctgcgcccaccaggacctctcgaggacggattcgtccacgtcgggccggtcggagccggacatttcgccaagatggtgcacaacggcatcgaatatgcgctgatgaccgcctacgccgagggctacgagatgttggccgccgaagacctggtgaaagacccccaagcggtgtaccaggcctggaccaacgggacggtggtgcggtcctggctgcagcagctgttggcgaaggctctcaaggaagatccgagcttgtccgatatcagcggctacacggaggattccggtgaagggcggtggaccgtcgaagaggcgatccggttacgggtcccggtgccgggcatcgcggcctcgctgttcgcgcgcttcctgtcccggcaggacgagtctccgacgatgaaagctgttgcggctcttcgtaatcaattcggcggccacgccgtcaagcgggttagtgaatcaggctga

SEQ ID NO: 5918 - DNA, 894 bp, Mycobacterium JLS
atgcaactgggtctggtggggctcggcaagatgggcttcaacatgcgggaacgccttcgcgaaggcggacacgaagtcgtcggcttcgatccccggcccgaggtgaccgacgtcccgtcgctcgccgcgctggccgacgcgctggccgcgcccagggtggtgtgggtgatggtgccgtccggtccggtcacgcacgacacgatcgtgtcgctcgccgaggtgctgggtgagggcgacctggtgatcgacggcggcaactcccgcttcaccgaggacgctccgcacgcagagctgttgaaagccaagggaatcggcttcatcgacgcgggcgtgtccggcggtgtctgggggctggcggaggggtatggcctgatggtcggcggcgacgacgccgacatcgaacgggtcatgccgatcttcgacaccctgcgccccccgggtgaccgggcggacggattcgtccacgcgggacccgtcggtgcgggtcatttcgccaagatggtgcacaacggtgtcgagtacgcgttgatgaccgcctacggcgagggttatgagttgttggccgccgaggagttgatccgcgatccgcaggcggtgtaccaggcctggacgaacggcacggtggtccggtcatggctgcagcagctgctcgccaaggccctccgggaggatcccggcctggccgagatctccggctacaccgaggattccggcgaaggccggtggacggtcgaggaggcgatccgcctccgcgtgccggtgccgtccatcgcggcatcgctgttcgcgcggtttgaatcgcgccaggaggactcccccaccatgaaggccgtctcggcgttgcggaaccagttcggcgggcacgccgtccagaggatcagcaagtcggggtag

SEQ ID NO: 5919 - DNA, 894 bp, Mycobacterium gilvum PYR-GCK
atgcagctgggtctgatcggtctcggcaagatgggtttcaacatgcgcgcgcggttgcgcgacggcggccacgatgtcgtggggtacgacccgcgacccgaggtgtcggatgtggagtccctcgaggagttggcgcaacgactggacgccccgcgagtggtgtgggtgatggtgccctcgggcacggtgaccgatagcacgatcaccgagctcgctgaggttctctccgagggcgacctcgtgatcgacggcggcaactcccgctacaccgaggaccagccacacgcgaaaatgttggcgcagaaaggaatcggattcgtcgacgccggtgtgtccggtggtatctggggtctgaccgagggctacgggctgatggtcggaggcagcgacgccgacatcgcccgcgccatgccgatcttcgacacgctgcgcccgccgggtccgcaggaggacgggttcgtccacgtcggtcccgtgggagccgggcacttcgccaagatggtgcacaacggcatcgagtacgcgctgatgaccgcgtacgccgaaggctacgaactgctggccgccgaagaactcgtgaaagatccccaggctgtctatcaggcctggaccaatggcacggtggtgcggtcctggctgcagcaactgctggccaaggctctcaaagaagatcccgatctcagcgagatcagcggctacaccgaggattccggcgaaggacgctggacggtggaggaagcgatccggctgcgggtgccggttccggggatcgccgcgtcgctgttcgcccggttcctgtcccgccaggacgaatccccgaccatgcgggcggtggccgcgttgcggaaccagttcggtggccatgccgtcaaacgcgtcagtgaatcaggctga

SEQ ID NO: 5920 - DNA, 873 bp, Salinispora tropica CNB-440
atgcagctcggcctggtagggctcggccgcatgggcggcaacatgcgtgagcggctgcgcgccgctgggcatgaggtgatcgggtacgacaaccaggccgagctgagcgacgtcgcgagcctggcggagatggcgaagaagctggacgcgccccgcgcagtgtgggtcatggtccctgccgccgtcaccgacgagaccatcaccaagctggcggaggtgctcgacaccggcgacatcatcgttgacggcggaaactcgcggttcagcgacgatgccccgcgcgccgagcggctgaacgagcgcggcattgggtacgtcgatgccggggtttccgggggcgtttggggccgacagaacgggtacgccctcatggtcggcggtgccaaggaacacgttgaccgactgatgccgatcttcgaggcgctcaagccggccggagaattcggcttcgtgcacgccgggccggtcggtgccggacactacgccaagatggtgcacaacggcgtcgagtacggtctcatgcacgcctacgccgagggctacgaactgctcgccaagtccgagctggtcaccgatgtccccggcgtcttcaagtcgtggcgggagggcacggtcgtccgctcctggctgctcgacctcctcgaccgtgctctcgacgaggacccgaagctggccgagctgagcccctacacggaggacaccggcgagggtcggtggaccgtggacgaggcggtccgactcgctgttccgatgaacgtcatcgccgccgcgctcttcgcccgtttcgcctcccgccaggacgactcgcccgcgatgaaggccgtcgccgcgctgcgccagcagttcggcgggcacgccgttcgcaagcgctga

SEQ ID NO: 5921 - DNA, 873 bp, Salinispora arenicola CNS-205
atgcagctcggtctggtagggctcggccggatgggcggcaacatgcgcgaacggctgcgcgccgccgggcacgaggtgatcggctacgacaaccgtcccgaactgagcgacgtcgcgaacctgggagagttggcggagaagctggacgcgccccgcgcggtgtgggtcatggtgcccgttggcgtcaccgacgacaccatcgccaaggtcgctgacgttctcggcaccggcgacatcatcatcgacggcggaaactcgcggttcagcgacgacgcgccccgcgccgagcggctggacgagcgtggtatcgggtacgtcgacgtcggggtgtccggcggtgtctggggccggcagaacgggtacggcctcatggtcggcggcgccaaggaccacgtcgaccggctgatgccgatcttcgaggcgctcaagccggccggggagttcggctttgtgcacgccgggccggtcggcgccggacattacgccaagatggtgcacaacggcgtcgagtacggcctcatgcacgcctacgccgagggctacgaactgctcaccaagtccgagctggtcaccgatgtccccggtgtcgtcaaatcctggcgtgagggcacggttgtccggtcctggctgctcgacctgctcgaccgcgcgctcgacgaggacccagagctggccgagttgagcgactacacggaggacacgggcgagggccggtggaccgtggacgaggcggtccggctcgccgtcccgatgaacgtcatcgccgcggcgctcttcgcccgcttcgcctcccgccaggacgaatcacccgccatgaaggccgtcgccgcgctgcgtcagcagttcggtgggcacgccgtccgcaagcgctga

SEQ ID NO: 5922 - DNA, 885 bp, Arthrobacter chlorophenolicus A6
gtgcacatcggactgatcggccttggcaaaatgggattcaacatgcgcgagcggctgcgcaatggcggcatcgaggtcacgggttatgaccggaaccccgacgtgaccgatgtggctacggtcgatgatctcctggccgcagtgcctgcaccgcggctgatctgggtgatggttcccgccggcgcagtcacggatgctgtcatcaccgaactcgcaggcaagctggaccagggcgacttggtgattgacggtggaaactcccgcttcaccgaggaccagaaacatggtgaactcctcgcaggaaagggcattcgtttcgtggactgcggtgtttccggcggcgtctggggcctgcagaacggctatgggctgatggccggcggcgacgctgcggatgtggacctggccctgccggtcttcgatgccctgcgtccggaaggtgaccgcgcggacagcttcgtccacgtgggcggcgtcggcgcgggccattacgccaagatggtccacaacggcatcgagtacggcctgatgcaggcatacgccgaggggtaccagctgctcgcttccaaggacatcatcagcgaccttcccggtactttccgggcctggcagaaaggtacggttgtccgctcgtggctgctcgacctgctggtcaaggccctggaagaggatcccggcctgcagaatatcgatgactacgtggaggactccggcgaaggccgctggaccgttgaggaagcaatcgccaatgccatcccggctcccgcgatcaccgcagcgcttttcgcccgttttgagtcccgtgaggacagctcacctgccatgaagatggtgtccgcactccggcatcagtttggcgggcacgccacccgtcccgccaagtag

SEQ ID NO: 5923 - DNA, 915 bp, Actinosynnema mirum DSM 43827
gtgcagctcggaatcgtcggcctcggcaaaatgggcttcaacatgcgcgagcgggtccgccgcgctggtcacgaggtcgtcggctacgaccgcaacccggacgtcagcgacaccacgtcgctcgccgacctcgcggccaagctgaccggccccagggtggtctgggtgatggtccccgccggggagatcaccaggaacaccgtcgccgagctgagcgaggtgctcagcgagggcgacctcgtcatcgacggcggcaactcgcggttcaccgacgacgccctcaacgccgccaagctggccgagaagggcatcggctacctcgactgcggcgtgtccggcggcgtctggggcctggagaacggctacggcctgatggtcggcggcgacgcggccgacgtcgagcgcgccatgccgatcttcgacgcgctgcgccccgaggggccgcgcgaggagggcttcgcgcacgcgggcaagctcggcgcgggccacttcgccaagatggtgcacaacggcatcgagtacggcctgatgcaggcgtacgccgagggcttcgagctcctggaggcctcggagctggtcgagaacgtgcccgccaccatcaaggcgtggcagcgcggcaccgtcgtccgctcctggctgctcgacctgctggtcaacgccctggactcggacccggagctggacgacctgcgcggctacgtcgaggactccggcgagggccggtggaccgtcgaggaggcgatcaaccacgcggtgcccgcgccggtgatctccgccgcgctgttcgcccgcttcgcgtcgcgccagtccgactcgcccgccatgcgcgcggtggcggcgctgcggaaccagttcggcgggcacgccgtgcagtccgcgggcccgtcctccggctccggcagcacgcagggctga

SEQ ID NO: 5924 - DNA, 894 bp, Beutenbergia cavernae DSM 12333
atgcacatcggactcgtcgggatcggtcggatgggcgcgaacatgcaggagcgcctgcgcgagcacggccacgaggtgacgggctacgaccaggacccgggcgtgtccgacgtcgccagcctggagcagctggtggccgcgctcccagcaccgcgggtggtgtgggtgatggtgccggcgggcgagatcacgcacgcggtgatcggcgacctccgaggcctcctcgccgccggtgacctcgtgatcgacggcggcaactccaacttccgcgaggacaaggtgcacgccgacgacctcgcgggtcacggcatccgctacctcgacgtcggcgtctccggtggtgtctggggccgcgagaacgggtacgggctcatggtcggcggagcaccggacgacgtcgccgaggtgatgccggtcttcgacgcgctccgcccggagggcgatcgtgacgagggcttcgtccacgtggggccggtgggcgcggggcactacgcgaagatggtgcacaacggcatcgagtacggcctcatgcagtcctacgccgagggctacgagatcctggcggcgcgggacgacctcgtggccgacgtcggcggggtgttcaaggcgtggcagcgcggcacggtggtgcggtcctggctcctcgagctcatggtgcgcgcgctggagcaggacccggacctggagcagatctccggctggacggcggactccggcgagggccggtggacggtgcaggaggcggtggagcacgccgtcccggcgccggtgatcagcgcggccctgttcgcccggttcgcgtcccggcaggaggactcgccggcgatgaaggccgtcgcggcgttgcggcagcagttcggcgggcacgccacgaagcccgccgcggacggctga

SEQ ID NO: 5925 - DNA, 981 bp, Kytococcus sedentarius DSM 20547
atgcaactcggactcgtcggcctcggcaagatgggcggcaacatgaagacccggctcgagcgggccggtcacgaggtggtcggcttcgacctggacccgcagctgcgggacgtcgacagcctgcaggccttggtggaggccctggagggcccgcgcgtggtctgggtgatggtgccgcacggcaagcccacccggaacaccatcgaggagctggccaagcacctccagcccggtgacctcgtgatcgagggcggcaactcgccctaccaggacgactttgtccacgacgagctgctgtccgccaagggcatcgggtacgtcgactgcggtgtctccggtggcatctggggcctggacaacggctacggcctgatgtgcggtgggcgtccggagcacgtcgagaaagccatgccgatcttcgacgccctgcgccccgaggggccgcgggaggagggcttcgtccacgccggtgaggtgggtgcgggccactactcgaagatggtgcacaacggcatcgagtacggcctcatggcggcctacgccgaggggtacgagctgctcatggccaaggagatcgtcaaggacgtcccgggggccttcaaggcctggagccgcggcacggtcgtgcgctcctggctgctggacctgctggtggacgccctggagcagaacccgggcctgaaggacgtctccggctacaccaccgactccggggagggccgctggacggtcatcgagggggtcgagaacgcggtgccgatgccggtgatctctgcagcgctgttctcccgcttcacctcgcgccaggagaactctccggcgatgcaggccgtcgccgccctgcgcggtggtttcggcgggcacgaggtcatgaccttcggcgacgagccctgggaccgtcccaagcaggtccaccaggcggcggagcccgcggacacccagggcgaggccaccccgggagccgtcgacgacgaggcgtga

SEQ ID NO: 5926 - DNA, 879 bp, Catenulispora acidiphila DSM 44928
atggagatcggtcttgtgggcctgggcaagatgggcggcaacatgcgcgagcgcatccgccaggccgggcacaccgtcgtcgggtacgaccgcgaccccaagctggccgacgtcggttcgctgaaggagctcgtccagacgctggcggcgccgcgcgtgatctggatcatggtccccgccggcgaggccaccgacgccacggtcaacgagctggccgatctgctgcacaccggcgacatggtcatcgacggcggcaactcgcgctggaccgaggacatcaagcacgccgaactcctcaaggcccagggtgtcgccttcgtcgacgccggcgtctcgggcggcgtctggggcctgcagaacggctacgccctgatggtcggcggcgacgaggccgacatcgcccgcgtgcagccggtcttcgacgccctcaagccggccggcgacagcggcttcgtgcacgccggcggggtcggcgcgggccacttctcgaagatggtccacaacggcatcgagtacggcatcatgcagtcctacgccgagggctgggagctgctggaggccgctccgaacgtgaccaacgtgcgcgaggtcttccgctcctggcaggagggcaccgtcatccgctcctggctgctggacctgctggtccgcgccctggacgacgacgagcacctggcgggcatccgcggctacgccgacgactccggcgagggccgctggaccgtggaggccggtatcgacatggccgtgccgaccccggcgatcaccgcctcgctgtacgcgcgcttcacctcgcgccaggaggactccccgcagatgaaggcgatcgccgcgctgcgcaaccagttcggcggccacgccgtgaagaaggagagttag

SEQ ID NO: 5927 - DNA, 894 bp, Saccharomonospora viridis DSM 43017
atggcacagcttggtctcatcggcctgggcaagatgggcttcaacatgcgggaacgcctgcgggaagccggccaccgggtggtggggtacgaccgtaacgccgaggtgagcgacgtcgcgtcgttggccgacctggtggccgcgctggaggcgccccgggtggtgtgggtgatggtcccggccggcgcggcgacgcggcagaccatcaccgagctcgccgagttgctcgacgagggtgatctggtgatcgagggcgggaactcccgctacaccgaggacgctgaacacgccgagctgctcggccgccgggggatcggctacctcgacgtcggtgtctccggcggggtgtggggcaaggagaacggttacggcctgatggtcggtggttccacggccgatgtggaacgcgcgatgccgtttttcgacgcgcttcgcccggaggggcctcgcgaggaaagcttcgtccacgcgggcggggtcggtgccgggcattacgcgaagatggtgcacaacggcatcgagtacggactcatgcaggcgtacgccgaaggtttcgaactgctcgaggcctccggggtcgtgcaggacgtccccggagtgctcaaggcgtggcagcgtgggacggtcgtgcggtcctggctgttggagttgctggtcgaggcgttggagaacgaccctgagctggcggaactcgaagcctacgtcgaggactccggtgaggggcggtggacgctggaggaggccatcgacaacgccgtacccgcacccgtgatctcggcggcgctgttcgcgcggttcgcctctcgacaggagaattcgcccgcgatgcgtgcggtcgcggcgctgcggaagcagttcggcgggcacacggtgaagacgaaggtcactgattag

SEQ ID NO: 5928 - DNA, 906 bp, Nakamurella multipartita DSM 44233
atgcagctcggtctcatcggtcttggcaagatgggcgccaacatggccgaacggcttcgccgggatggtcatcaggtggtcggattcgatcgcagcccgcaggccccgcgggacgtcgactcgctcgagggcctggtcgcggcgctgaccacgaccccgcgggtggtgtgggtgatggtgccctccggtgagccgacccgggccaccgtcgccgccctcggtgagctgctctcgccgggggacatcatcatcgacggcggcaactccgagtacgtcgacgacaaggcccatgccgccgcgctcgcgcccaagggaatccggtacctggactgcggcgtctccggcggggtctggggcatcaccgagggctacgccctgatggtcggcggcgacgccgacgcggtggccgtcgcgcagcccatcttcgactcgctcaagccgccgaccgggggcttcgtgcatgccggaccggtcgggtccgggcacttcgtcaagatgatccacaacgggatcgagtacgggatcatgcaggcctacggcgagggctacgagctgatgaaggcggtcgactgggtgaccaacccggacgaggtgatggcctcctggcagaacggcacggtcatccggtcctggctgctggacctgctggtccgggccttggacgcggacccggggctgagccagatccgcggctacgcccaggactccggcgagggccggtggaccatcgaggcggcgatcgagaacgcggtgccgatgccggtgatcaccgccgcgctgttcgcccgcttcgcctcgcggcagacggactcgccgacgatgaaggtggtcgccgcgctgcgcaaccagttcggtgggcatccggtcggcaccgagggttccgacgcctcggtcccgatcgcctga

SEQ ID NO: 5929 - DNA, 381 bp, Escherichia coli BL21 (DE3)
atgagtcaggttagcctgtcacaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttggcggtgcgggatgaacgtgcggcataa

SEQ ID NO: 5930 - DNA, 414 bp, Ralstonia solanacearum
gtggaagccacaacagcgcaggcagtcgaattgccccggagaccggaacacggcacaccgccgcccgagtcgtgccgcctggtgctggagatcctgagccgcatcggcgacaagtggacggtcatggtcatcggcacgctggcggacgggccgatgcgcttcaacgcgatcctgcgcgccatcagcggcatttcccaccggatgctgacgctgaccctgcgcggcctcgagcaggacgggctggtcaagcgcacggcctacgcgacgattccgccgaaggtcgaatacgaactcaccgaactgggcctgtcgctgatcgaaccgctgcgcgcgctcggtgactgggccgtccggaaccgacccgccatcgcggcggcacgggcgcactttgcgtccttgacggcaacgcagtag

SEQ ID NO: 5931 - DNA, 429 bp, Pseudomonas syringae tomato DC3000
atgagtgagtctgcctcgcatccacagtctgaaacggtcgagtccatgctggcgttcgttcgtcaggggcaagtgctggccaacgattgcccttcaaggattgtgctcaaccacgtttgcagccgttggggcgtgctagtgctggtggttttgcgcggtggcatgcatcgcttcagcgaggtacggcgcaagatcggcggggtcagcgagaaaatgctcgcgcaaaccctgcaacacctggaacaggacggtttcgtcagtcgcaagtcgctgcccgtggtgccgccgcacgtgcagtaccggctcacgccgatgggcgaagaagtcgccttgcaggtcgaaaccctggcgacctggatcgagaccaatctgccacgcatcatgcaggcccgcgaagcctccaacactgcacagaccacgcctgcgtga

SEQ ID NO: 5932 - DNA, 465 bp, Pseudomonas syringae pv B728a
atgagcgaatccgcctcgcaatcaagtgccccgcgatcaagcgttacgccgcaaggcttccagtctgaagcggtcgagacgctattggcgctggttcgtcagggccaggtgctggccactgactgtccttcgcgggtggtgctcaatcacgtctgcagccgttggggcgtgctggtgctggtggtgttgcggggcggcatgcatcgcttcagtgaagtacgccgcaagattgggggggtgagcgagaaaatgctcgcgcagacgctccagcatctggagcatgacggttttgtcagtcgcaagtcgttgcccgtggtgccaccgcatgtgcaatatcggctcaccccgatgggcgaagaggtcgccttgcaggttgaaaccctcgttacctggatcgagaccaatctgccgcgcatcatgcaggcccgcgaggcgtcgaacacactgcagaccacgcccgaatga

SEQ ID NO: 5933 - DNA, 495 bp, Rhodopseudomonas palustris HaA2
atgtccaggtcacctgcaaggaaccttcacccgctgccaccggctcccgagccggcgtccgacgcggccgtcctcaccgagcgcttcagcgcctggcaggcgcaggggctggacgcctcgcgctgcccggtgcgcaacgtgctcgaccatctcggcagcaaatggagcacgctgttgctgatcgcattggccgaaaagcctgtgcgattcaatgcgctactgcgaacagttccagacatttcgaggcggatgctgacgcagacgctgcggcatctggagcgcgacggcctggttgcccgacaggtattcccgaccaagccgccgagtgtcgagtatcggctgtccgccgcaggtcgctcggtgctgacgccgctcacggcgctggtcggctgggcggagagccattttgccgagatcgaacaggcgcgggcacgcttcgacgcggcagaggcgacagcgccggtgtcgagcggcgagactgcgtatcccctctag

SEQ ID NO: 5934 - DNA, 387 bp, Rhodoferax ferrireducens T118
atggcagtacacaaatcaaaagttgattgggccgagcgttgcccgatccgggacgtgctggaacgcatgggtgaccgctggagcatgctggtgctgttcacacttggcgaccaccagagcctgcgcttcagtgtgctcaaaaccaccattggcgatatttcgcagcgtatgttgtcgcagaccctgcgtcgcctggagcaggacggcctggtgctgcgcaccgcccatgccacggtgccgccccgggtggactatgagttgaccgcgttggggcaatcattcctgctgccgatgcgcaatctgctgcattgggccgagcagaaccaccagcaggtgcgtgatgcgcgcgtcgcctacgtgccgccgccccggcatgaagcgttgtga

SEQ ID NO: 5935 - DNA, 366 bp, Paracoccus denitrificans PD1222
atgaaaaaatccgatgccgccggcaggggcgatctgatggcggcggaatgcccctcgcgcgatgtgctgcggcggctgaccgggcgctggggcatgctggtgctgcgcgtgctggccgaggggccgcaccgcttttccgcgttgcgcaagcgcatcggcggcgtcagcgagcggatgctggcgcagacgcttcaggggttggaggcggacggcatggtgctgcgccgcgatttccagaccgtgccgccgcatgtggaatatgcgctgacgccgctggggcacgaggcggcgctgcgggtcggcgcgctgttgggctggatcgaggatgcgctgccccagatcgcgcgcggctggacgcgggcctga

SEQ ID NO: 5936 - DNA, 348 bp, Nocardioides JS614
gtgccgttcgtccgcgacctccagctcgacaccgactgccccgacacccgcctgctcgtcgagcacgtgaccagcaagtggggcgtgctcgtgctgctcacgctcgacgaccggacgctgcgctggagcgagctcaagcgcgagatcgccggggtcagcgagaagatgttgatccagaccctccaggtgctcgaggccgacgggctggtacggcgtaccgcgctgccggtggtgccgccgcacgtggagtactccctcaccgacgacgggcgcgccgccgctgcgcacctggcgccgctggtgcgctgggcccaggcccgggtcggcccccgggtggcggtcagctga

SEQ ID NO: 5937 - DNA, 480 bp, Acidovorax avenae citrulli AAC00-1
atgaacctgcgtgccaccatcccccattccccggaagcaggctcggggccgtcgcgcccgccgcctccagcctccggcgtcgaggcgtccctccccctggccgaactgatgcgccggggcgatgtgctgtcgccggactgcccggcgcgggagatcctgcagcacgtcacgagccgctggggcgtgctggtgctggtggcgctcgacgacggcacactgcggttcagcgagctgcggcgcaaggtgggcggcgtgagcgagcgcatgctggcgcagacgctgcaggtgctggagcgggatggtttcgtggagcgccgggcctatcccgtcgttccgccgcacgtcgagtaccgcctgacgcctctggggcgcaaggtcggcctgcatgtgcaggccctggccgactggatcggcgggcacctgcctgagatcctggcggcacgggggcaggccgcggccgctgccgtcgcaggcggctga

SEQ ID NO: 5938 - DNA, 423 bp, Polaromonas naphthalenivorans CJ2
atgaacgacgttgaccttcacgcaggtgaaatcgccaccctcgccgaccagttgcgccggggatcgttgttttccgtggaatgcccctccagagaggtgctcaagcatgtgaccagccgctggggcgtactggtgctggtcgctctgggcggcggcacgcatcgtttcagcgacctgcgccgcaaggtggggggcgtgagcgaaaaaatgctggcccagaccctgcaatgcctggagagtgatggttttgtggatcgaaagtcttatccggtggtgccgccccatgtcgaatacagcctcacgccgcttggcgaggaagtggctcgccaggtcgaagcgctggcggactggattgaaggcaacctgccgcgcatcatggatgcgcgccgcctgcaggcgcgcagccccttcagcaagccctga

SEQ ID NO: 5939 - DNA, 387 bp, Enterobacter sp. 638
atgaaatcaacccttccgacgctcagcgagcaaatgcgcgacggcaatctttttgccgagcagtgtccatcccgcgatgtgctcaagcatgtcaccagccgttggggcgtgctgattctggtggcgttgcggcaggggacgcaccggttcagcgatctgcgccgtaaaatgggcggcgtcagcgagaaaatgctggcgcagtcgttacaggcgctagagcaggatgggtttgtgaatcgcgtctcttatccggtggtgcctccgcacgtcgagtacagcctgacaccccttggcatagaggtgagcgagaaagtggccgcgctggcagactggattgaggtgaacaccccgcaagtacttactaaccgggacgaacgcgcagcataa

SEQ ID NO: 5940 - DNA, 435 bp, Bradyrhizobium BTAi1
atgaagggaactacctcggccacagcgccgtcggacgtgcccgcaccggccgggggcgtgcgcgcctggaaggagaagttcgtctcgatcgaggactgcccgatccgcaccgtcatcaaccagatcggcgacaaatggagcgtgctgatcctcgccgtgctcggcacacgcccgcaccgcttcggcgagttgcgacgcgagatcgatgacatctcgcaacgcatgctgacgcagaccctgcgcgacctgcagcgcgacggcctgatcgcccgccgcgtcatcccaaccgtgccgccgagcgtcgaatacagcgtcactgcgctcgggcagagcctgctcgagccgatgtcgcgcctgatcggctgggccgagcagcatcaggccgagatcaagcggtcgcggcagcgctttgacgcgagcgttgcgccggattga

SEQ ID NO: 5941 - DNA, 405 bp, Sinorhizobium medicae WSM419
atgaacaaagcgacggctgcggtgaagggcgagcgggtggcagtcatctgcggcgtacccttcgatatcgacaattgtccggtgcgtgacgtgatggacaatatcggcggcaagtggaattcgctgatgatcctgtcgctcgccgacggcccgttgcggttctcgcaactcagacggctgattccagacatatcgcaacggatgctgacgcagacgctacgcgatcttcagcgcgacggttatctgaaccgcaccgtctatccgacgcagcccccgagcgtggaatacagccttaccgatctcggccactcgtttctgcccgttttaaaagtttttgtcgactggtcgctcgagaatcacgacgcgatccgaaaggcgcgtacggcgttcgacgcgccggcatga

SEQ ID NO: 5942 - DNA, 414 bp, Marinomonas MWYL1
atggaaaataatttacaaacttcacagaacggcatgtcgcgcttatttgataaaggcgatgtgttttcggacaaatgcccttcacgtgatattttgaaacatgtcaccagtcgttggggggttttggtgttgttcgcactgaaggacggtgaaacacagcgctttagtgagttgcgtcgtaagatatcaggcgtcagtgaaaaaatgctggcgcaaactcttcaagccttggaattagatggctttgtgttacgtacttcttatcctgtggtaccgcctcatgtggaatatagtctgacggatttagggctagaagtgtccgttcgagtggctagtttggctgattggattgaagacaatattaccgatattttggctatacaatcacaacgaaatgaagagttagcgtcttaa

SEQ ID NO: 5943 - DNA, 402 bp, Yersinia pseudotuberculosis IP 31758
gtgacaaaactacaaaatatgaatggcaacatttcatttccggaacaactcaggcgcggtgaactgcttaatgtcgattgcccgtcaagagagatactcaagcgagtgaccagccgctggggggtgttggtcttgatcgctttgagtaatgaaacactgcgttttagtgcattgagacgaaagattggtggagtcagtgagaaaatgttggcacaaacgctccagcatcttgaagaagatggttttattgacaggactgcttatccggtagtgccacctcacgtggaatacagcctcactccgttaggaaaagagatccaagagcaggtggaagggctgacggtgtggttggagacaaacttgcatcggattatggaacaacggcagcagcggtcagtatga

SEQ ID NO: 5944 - DNA, 366 bp, Xanthobacter autotrophicus Py2
atggatcagccctatgatgtctatcaggatcgctgccccacccgcatggttctggaccggctggcggacaaatgggcgctgctgatcctcgaccggctgcgggatggcccggtgcggttcaaccatctgcggcgcgacattgccggcatctcgcagaaggtgctgtcgcagaccttgaagaagctggagcgggacggcctcatctcgcggcaggtgttccccaccgtgccggtgacggtggaatatgccctcaccggcctcggccgcaccctcaccgacaccgtcgcagcgctcgcccactgggccgaggccaacatggatgccgtgctcgcagcccagaaggcctatgattccatcgtgcggtga

SEQ ID NO: 5945 - DNA, 381 bp, Escherichia coli HS
atgagtcaggttagcctgtcgcaacaactgaaagagggtaatctctttgcggaacagtgcccgtcgcgcgaggtgttgaaacacgtcaccagccgttggggggtattgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatacagcctcacgccgctgggcgagcaggtgagcgaaaaggttgctgcactggcggactggattgagttgaatttgcccgaggtgttggcggtgcgggatgaacgtgcggcataa

SEQ ID NO: 5946 - DNA, 381 bp, Escherichia coli E24377A; identical to SEQ ID NO: 5945

SEQ ID NO: 5947 - DNA, 447 bp, Frankia EAN1pec
atggttagtaaccaggtcagcggcctgtccagcggccagctcagccacgagatcggccacgaggtcagcgaccagttcggcgggctgcgggccctcttcgcggacggcttctttccccgcggctgtccgacccggacagtcctcgaccacgtcacgagccggtgggggatcctcgtcctgctcacgctggccgggcggaccctgcgctggggggagctgcgcagagccatcgagggcgtgagcgagaagatgctcgcccagacgctgcgcaccctcgagcaggacgggctcgtccaccgtgaggctctcctggtcatcccgccacacgtggagtacagcctcaccggtctcggagacgacctggtcacccgcctggcccccctcgtggcctggatcgcccggcacgccgacgagatcgtcacccgcgcgacgccgtccacaccgtga

SEQ ID NO: 5948 - DNA, 402 bp, Yersinia pestis Angola
gtgacaaaactacaaaatatgaatggcaacatttcatttccggaacaactcaggcgcggtgaactgcttaatgtcgattgcccgtcaagagagatactcaagcgggtgactagccgctggggggtgttggtcttgatcgctttgagtaatgaaacactgcgttttagtgcattgagacgaaagattggtggggtcagtgagaaaatgttggcacaaacgctccagcatcttgaagaagatggttttattgacaggactgcttatccggtagtgccacctcacgtggaatacagcctcactccgttaggaaaagagatccaagagcaggtggaagggctgacggtgtggctggagacaaacttgcatcggattatggaacaacggcagcagcggtcagtatga

SEQ ID NO: 5949 - DNA, 492 bp, Methylobacterium extorquens PA1
ttgggacaaggtgacagcgacggaaccgccctccggccgggtcaaaccgaactggcacggagatttgccgtctggcagtccagtttcgcggagatttcgtcatgtccggtccgcgatgtgctggatcgggtcggtgacaagtggtcgatgctgatcttgatcgcattggccgcagggccgggccggttcagcgcggttgcccgcatgatccccgacatctccaagcgtatgctgacgcagacgtttcgcgacctcgaacgggatggcctcatcgcacggacggtgttcccgacgaagccgccgagtgtcgagtaccggctgacgccgttgggaagcgcgctccttgatccgctcgcccacctcgtcggctgggccgagcagaaccatgcggccattcaagaggcgcggaagcgtttcgaggccggctctgttcaagacgggaaacaggacgcgttcgcgtcccggtcttcggccgacgtctcggccgattga

SEQ ID NO: 5950 - DNA, 381 bp, Escherichia coli C ATCC 8739; identical to SEQ ID NO: 5929

SEQ ID NO: 5951 - DNA, 408 bp, Yersinia pseudotuberculosis YPIII
gtgagagtgacaaaactacaaaatatgaatggcaacatttcatttccggaacaactcaggcgcggtgaactgcttaatgtcgattgcccgtcaagagagatactcaagcgagtgaccagccgctggggggtgttggtcttgatcgctttgagtaatgaaacactgcgttttagtgcattgagacgaaagattggtggggtcagtgagaaaatgttggcacaaacgctccagcatcttgaagaagatggttttattgacaggactgcttatccggtagtgccacctcacgtggaatacagcctcactccgttaggaaaagagatccaagagcaggtggaagggctgacggtgtggttggagacaaacttgcatcggattatggaacaacggcagcagcggtcagtatga

SEQ ID NO: 5952 - DNA, 435 bp, Xylella fastidiosa M12
atgaacatgtttgcttctatcgcttcctcagcccctccacctggatgggaaaatctcccgttcgacgcgaccaaatgcccagtgcgcgatgtactggatcatataggcgataagtggtcactcctgattttattaactctagtgcccggaccaacacgtttcagcgctatccagcgtgccgtacctgacatctccaaacggatgctcacgcaaactctacggcatcttgagcgtaatggaatgattggccgcacagtctatccaaccaaaccaccaagagtaaagtatgcgctcacacctctaggcgaaagtctgttggtacctgtgatgcatttacttaaatgggcaagcacgcactatgacgaagtgctcagtgcacgcgaccgtttcgatcacgcgcaacaaggtggcttggcaatagcctgccggatttaa

SEQ ID NO: 5953 - DNA, 381 bp, Escherichia coli SMS 3 5
atgagtcaggttagcctgtcgcaacaactgaaagagggtaacctcttcgccgaacagtgcccgtcgcgcgaggtgttgaaacacgtcaccagccgttggggggtgttgattctggtggcgctacgcgaaggtactcatcgctttagcgacctgcggcgcaaaatgggcggggtgagtgaaaagatgcttgcgcagtcgttacaggcattagaacaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttagcggtgcgggatgaacgtgcggcataa

SEQ ID NO: 5954 - DNA, 441 bp, Leptothrix cholodnii SP 6
atgaccgatcgcacctcatccgaagtcgccgcgctccccttgtcggcgctggtgcgccggggcgagctgttttcgcccgattgcccgtcgcgtgacgtgctcaagcacgtcaccagccgctggggcgtgctgctgctggtggcgctgatgggcggcacgcaccgcttcagcgacctgcgccgcaaggtcggcggcgtgagcgagaagatgctggcgcagacgctgcgctggctcgaagcggatggcttcgtgctgcgtgtgtcgcacgacaccgtgccgccgcatgtcgaatacagcctgacgccgctgggcctggcggtgggtcagcgcgtggcggcgctggccgactggatcgagctcaatctgcccgacatcctggatgcgcagcggctgcaggtaggcgcgtcagcagcggccgcaggccgaccacctggccgatga

SEQ ID NO: 5955 - DNA, 435 bp, Methylobacterium radiotolerans JCM 2831
ttgggaccaggttacgcgaaggagaccgcgctgccgcccgcccgcgccgagctggcggccaagtacgcggtgtggcaggccggcaccctcgatccggcggcgtgcccggtccgggacgtgctggatcgggtgggcgacaagtggtcgatgctactcctgatcgccctggccgacgggccgctccggttcagcgccctgctccgcacgctgcccgacatctccaagcggatgctgacgcagacgctccgggatctcgagcgagacggattcgtggcacggacggtgttcccgacgaagccgcccagcgtcgagtaccggctcacggacctcggggtcgccctgctcgagccgctggcgcgcctcgtccgatgggccgaggagagccacggcgcgatccaggcggcgcggacccggttcgacgccgcgccttcctag

SEQ ID NO: 5956 - DNA, 408 bp, Methylobacterium radiotolerans JCM 2831
atgagcgacgtgagcgggctggccggcaagttcgacagctggcagcgcatgagcttcgatccggcccgctgtccggtccgggacgtgctcgatcacctcggcgacaaatggacgaccttgatcgtgatcgcgctggccggcggcccccggcgtttcggagagctgaaccgatccatcccggatatctcgaagcggatgttgacgcagtgtctgcggaacctggagcgcgatgggctcatcacccgccacgtgttcccgaccagtcccccgagcgtcgaatatcggttggcggatctggggcgctcgctgctagcccccctgcaagcgttggtcgaatgggctgaagctagtcatcaaagcgttcgcgatgcccgtcttcgattcgatggtgttccttcaaatacctaa

SEQ ID NO: 5957 - DNA, 435 bp, Xylella fastidiosa M23
atgaatatgtttgcttctatcgcttcctcagcccctccacctggatgggaaaatctcccgttcgacgcgacaaaatgccaagtgcgcgatgtactggatcatataggcgataagtggtcgctcctgattttattaactctagtgcccggaccaacacgtttcagcgctatccagcgtgccgtacctgacatctccaaacggatgctcacgcaaactctacggcatcttgagcgtaatggaatgattggtcgcacagtctatccaaccaaaccaccaagagtagagtatgcgctcgcacctctaggcgaaagtctgttggtacctgtgatgcatttacttaaatgggcaagcacacaccatgacgaagtgcgcagtgcacgcgaccgtttcgatcacgcgcaacaaggtggcctggcaatagccagccggatttaa

SEQ ID NO: 5958 - DNA, 363 bp, Xanthomonas oryzae PXO99A
gtgcgcgatgtgctcgaccaaatcggtgacaagtggaccctgctgatcctgctgacgctgatccccggcccgtcccgtttcagcgccatccagcgcgcggtaccggacatctccaagcgcatgctcacccagaccctgcgcaaccttgagcgcaacggcatgatcacccgcaaggtctacgccaccaaaccgccgagcgtggaatatgcgctctccaagctgggcatcgcgctgctcggtccggtctcgcagctactcaactgggcgggtgaacaccacgccgacatccgcgccgcccgcgaacgcttcgatcgcgcgcagcagacggtggtcacgctggatcgtgatgaagcgatggcatag

SEQ ID NO: 5959 - DNA, 381 bp, Shigella boydii CDC 3083 94
atgagtcaggttagcctgtcgcaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggcggggtgagcgaaaagatgcttgcgcagtcgttacaggcgttagaacaggatggttttcttaaccgtatcgcgtatccggtggtgccaccgcatgtggaatatagcctcacgccgctgggcgagcaggtgagcgaaaaggttgctgcactggcggactggattgagttgaatttgcccgaggtgttggcggtgcgggatgaacgtgcggcataa

SEQ ID NO: 5960 - DNA, 513 bp, Rhodopseudomonas palustris TIE 1
gtgacaaggtcacctggagagaacctgtcggtcgcggcgcatcgcgcgaccctgaccgaccgctacgccgcctggcgggagcagggtttcgacgccaaccgctgcccggtacgcaacgtgctcgaccatctcggcagcaaatggagcacgctgctgttgatcgcgctggctgaaaagccaatgagattcaacgcgctgctgcgggatgttccagacatttcgaagcggatgctgacgcagacgctgcgcgacctggagcgcgacgggctggtcgcgcggcaggtgtttccgaccaaaccgcccagcgtcgaataccgcctgtcggcgtccggcgagtccgtgctcgcaccgctgacggcgttggtcgcctgggccgagcagcactttcccgaaatcgagcgtgcccgggcccggttcgactcggcggcgcgggacggcgagccccaggttccaggcgattccgcaaggccggaaagcccgctggcgcttgctccgcttccggtcaggggataa

SEQ ID NO: 5961 - DNA, 402 bp, Geobacter bemidjiensis Bem
atgattgaatccgaagtcgtcactctgtcggaccagttgcgccgcggagagctgctctccacacagtgcccgtcccgggagatcctgaagcatgtcaccagccaatggggagttctcgtgctggtcgcactgatggaagggacgcaccgcttcagcgagctgcggcgcaaagtgggaggagtgagtgaaaagatgcttgcgcagaccctccaatatctggagagggatggattcgtcgaccggatttcctatccggttgtgccgcctcacgttgaatactcgctgaccccgctgggaagggccataggagagaaggtagaggccctggcagactggatcgaaagcaacctgccggccatcatggtgcttaagcggacagtgcacccgggagcggacaggtag

SEQ ID NO: 5962 - DNA, 474 bp, Methylobacterium sp. 4-46
gtgagcgcccgggccgacctcgcgcgggccttcgcgggctggcggcgcgccgcccaagatcccgcctcccaagatcccgcctcccaagatcccgcctcccaagatcccgcttccccggaccccgcctcctgcccggtgcgggacgtgctcgaccgcgtcggcgacaagtggacgagcctgatcctgatcgcgctcgccgaagggccgcgccgcttcggcgcgctcggccgcgcggtgccggacatctccaagcgcatgctgacccagaccctgcgccacctggagcgggacggtctcgcgacgcggaccgtcttcccgacgaagccgccgagcgtcgagtaccggctcacgccgctgggggaatcgctgctggagccgctcgccgggctggtcgcctgggccgaggagcgccacgcggcgatccgcgccgcccgcgcgcgcttcgacgcgggcgacgatgcgggggcgggctga

SEQ ID NO: 5963 - DNA, 381 bp, Escherichia coli O157 H7 EC4115
atgagtcaggttagcctgtcgcaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggcggggtgagcgaaaagatgcttgcgcagtcgttacaggcgttagaacaggatggttttcttaaccgtatcgcgtatccggtggtgccgccgcatgttgaatacagcctcacgccgctgggcgagcaggtgagcgaaaaggttgctgcactggcggactggattgagttgaatttgcccgaggtgttggcggtgcgggatgaacgtgcggcataa

SEQ ID NO: 5964 - DNA, 417 bp, Rhizobium leguminosarum bv  trifolii WSM2304
atgagcggcgcggtcgtcagtctgaaaaacaggatgccgggggcgcggcgcgagatcgatcttgccggccttgatttttccaactgcccggtcagggacatgatgcagcagatcggcggaaaatggtcgacgctgctgctcgaagtgctggcggcggagccccgtcggttcggcgagctcaggcggatgctgcccgatatttcccagcgcatgctgacacagacgctgcgcgacctgcagagggacggttatatcgctcgcgaggtcttcccgaccaaaccgccgagcgtcgaatattccatgaccgaactcggccgctcgctctacctgccgctgtcgcaactgttgaactgggcggaagccaaccatgatgccgtccgcgccgcccgttcgcgtttcgattctgccgatagctag

SEQ ID NO: 5965 - DNA, 408 bp, Rhizobium leguminosarum bv  trifolii WSM2304
atgaacaagattgtaggcaagatcgacggcgaacaggtgatcgtcgtcatggggcaggtgtttacgcggtctgactgtccggtccgcgacgtgctcgacaatatcggcggcaaatggaacacgctgatgatccttgctcttgcggaagggccgatgcgcttctccgccttgcgccggctgatccccgacatttcacagcgcatgctgacgcagacgctgcgcgacctgcaacgcgacggttatatcgaccggacggtgtttcccacccaaccgccaagcgtcgaatatcggctgacgtcgctggggcaatccttcctcggcctcgtgaagcaactggccggctggtccgctgaaaaccacgccgccattcgtacggcacggaccgcctacgacgccagagaactttga

SEQ ID NO: 5966 - DNA, 492 bp, Methylobacterium chloromethanicum CM4
ttgggacaaggtgacagcgacggaaccgcccttcggccgggtcagatcgaactggcacggaggtttgccgtctggcagtccagttttacggagatcgcgtcatgtccggtccgcgatgtgctggatcgggtcggcgacaagtggtcgatgctgatcttgatcgcattggccgcagggccgggccggttcagcgcggttgcccgcatgatccccgacatctccaagcggatgctgacgcagacgtttcgcgacctcgaacgggacggcctcattgcacggacggtgttcccgacgaagccgccgagtgtcgagtaccggctgacgccgttgggaagcgcgctccttgatccgctcgctcacctcgtcggctgggccgagcagaatcacgcggccattcaagaggcgcggaagcgtttcgaggccggctctgttccagacgggaaaccggacgcgttcgcgccccggtcttcggccgatctctcggccgattga

SEQ ID NO: 5967 - DNA, 378 bp, Arthrobacter chlorophenolicus A6
atggacgcaacactgcagcccgttccccttccgcccagtttctccgacggcgtgttcccggccgggtgccccagccggacgctgctggaccatgtcaccagcaagtggggcgttttgatcctcaccgcactctcggaggggtcgcagcgctggagcgaactgcggcgaagggcggagggcatcagcgagaagatgctggcccagaccctgaaaactttggagcgggacgggctggtgagccgggatgcgcagcctgttatcccgccgagggtggactacagcctgacagagaggggctacgaactcagcgcactgctggtgccgctggtggcgtggacctttgataatgccgaggagatcatcaacggcagggcctga

SEQ ID NO: 5968 - DNA, 435 bp, Anaeromyxobacter dehalogenans 2CP 1
atggcgaggacgggcaggggcggacggctggccgaggcgctgcgatcgcaggcgggacggggagatctgcacgcgcccgcctgcccgtcgcgcggcgtgctcgatcacgtgaccagccggtggggcgtgctcgtcctcgtctcgctcctcgagggcacgcaccggttcagcgcgctgcgccgcaaggtcgccggggtgagcgagaagatgctctcgcagacgctccaggccctggagcacgacggcttcgtgcggagggaggtccaccccgtcatcccgccgcgcgtcgactacagcctgacctcgctcggccgcgaggtggccgggcacgtggaggcgctgacggactggatcgaggacagcctcccccggatcctggcggcgcgggaggagccgaagagccggcccgccccggccggacgcgcccgggcttga

SEQ ID NO: 5969 - DNA, 411 bp, Agrobacterium vitis S4
atgaacgatgccacgcagcgggctccctcggaggcaatgacgaggggggtaagcaaaagcaagcgggcggaagacaattgcccggtgcgctcggtgatttcccatgtcggcgacaaatggtcgacgctcattctaggttcgcttgccgagaaaccctatcgcttcggtgagcttcgacgcctggtaccggacatttctcagcgtatgctgacccagaccctgagggacctgcaacgcgatggttatgtgcaccggcaggttttccccaccaaaccgcccagcgttgaatatggcctgacggagatgggcgagcagctggtattttcactcaaatatctcgtggaatttgccatcgacaatcatgcccgcgtggtcgaggcccgcgctcggttcgataggcagaatgtttga

SEQ ID NO: 5970 - DNA, 387 bp, Actinosynnema mirum DSM 43827
gtggacggcatggcgacgacgggtgacgtgtacgaccgcaactgcccctcccggcagatcgccagccacgccacgagccagtggggcgggctggtcctcggcaagctcctggagggcaagctgcggttcagcgagctgcgcagggcggtcgtgggcgtcagcgagaagatgctggcccagaccctgcaggcgctggagcgcgacggcctggtgctgcgcgaggtccacccggtcatccccccgcacgtcgactactccctcaccccggcgggcgcgcagctcgccgcgcgggtgcgcggcctctacgactggatcgaggacaacctccccgacctgtgcgccgccagggacgcctacgacgccaagcgcgcggggaccaccgtgtga

SEQ ID NO: 5971 - DNA, 417 bp, Rhizobium leguminosarum bv  trifolii WSM1325
atgagcggtgcagtcctcagtttgaagaacaggatgccggggacgcggcgcgagatcgatcttgccggcctcgatttcggcaactgcccggtcagggacatgatgcagcagatcggcggcaaatggtcgacgctgctcctcgatgtgctggcggatcggccctatcggttcggcgagctgcggcggatgatccctgatatttcgcagcgcatgctgacgcagacgctgcgcgacctgcagagggacggttacatccaccgcgaggtgttcccgaccaagccgccgagtgtggaatattcgatgaccgaactcggccgctcgctttaccagacgctggcgcaactgttgaactgggcggaagcaaaccatgatgccgttcgcgccgcccgttctcagttcgattctcacaacagctag

SEQ ID NO: 5972 - DNA, 435 bp, Pectobacterium carotovorum PC1
gtgagtcaatctaaaacgcctatcgatttattgccgccccttctgccaactggtgatgtcttcgctgaaaaatgtccctctcgccaaatacttaatcacgttaccagccgttggggcgtactgattctgattgcattacttgatgatacgcatcgttttagtcaactgcgtcgacggattggcggcgtgagcgagcgtatgctggcgcagaccctgcaatggctggaaagtgatggctttgtcctgcgaacggcctatccggttgtcccaccacatgttgagtatagcctcaccccattaggcaaagaggttggtgtgcgggtaaaagagctggcgatatgggtcgaagggaatctggacgagattatggcggcgcagcaatcaagtgaacagcggtcagataaacaaccgtcaggtaaactgcgcgcctcttga

SEQ ID NO: 5973 - DNA, 375 bp, Chitinophaga pinensis DSM 2588
atgacaaaagaagattggaaaaaatattcggaagcagatagcgaatgcgctgtcaggaacgtcctggaccgcctgggtgacaaatggtcaatgttagtgatcattgtgctgggagtagaaggcacattgcggtttaacaaactgcatagttttataggggatatctcacagaaaatgctgaccgttaccctcaaatcattggaagctgacggactgatcaccagaacggtttttccggagataccgccacgggtagagtatgcactcacagaaagaggcgcaagcctgttaccacatatggaagcactggccgaatgggccgccacacatatggaagggatctacgcatcccgggaaaaatatgtacgatcgtaa

SEQ ID NO: 5974 - DNA, 462 bp, Catenulispora acidiphila DSM 44928
atgagtacgcgcgtcgtgacacccggagtcgtgacccccgaagcggaagagcgcgccctcggcatggcctacgacgtcgtctatgacgtcctgcaggcgccgtgtccgtcgcgtcaggcgctcgagcacgtgaccggccgctggggtgcgctgatcatgatggctctgcgggaagggccggtccggttcaacgagctgcgccgccgcgtcgacggcgtgagcgagaagatgctgtcccaagggcttcaagccttggagcgggacggtttcgtggcccgcgaggtgcagtccacgatgccgccgaaggtcgagtaccagctgacgccgctcggtacgcagacctcggaccggctggcggacctggtggagttcctggagggccggatgccggaggtcgaggccgcgcaggcccgccatgatgaggccgcctccgccgccgcctcggtgtccgcttccgcgtag

SEQ ID NO: 5975 - DNA, 267 bp, Clostridium perfringens SM101 uid12521
atgaaacctaaaaaaattccaatgagaatgtgtaatggttgcatggaaatgaagcctaaaaaagaactgataagaatagttaaaaattctgaaggagaagtttcagtagatttaactggtaaaaaatcaggaagaggggcttacatctgtaaaagtgttgaatgtttagaaaaagcatttaaagcaaaaagattaaataaaaatcttcaatcaaatattggagatgaagtctatgatagattgagggatgagataacaaatggataa

SEQ ID NO: 5976 - DNA, 297 bp, Streptococcus agalactiae 2603
atggctaaaacaaaaaaaatacctttaagaaaatcagttgtttctggtgaagtgatcgataagcgagatcttttacgaattgttaaaaataaagaaggacaggtttttatagatcctaccggaaagcaaaatggtcgaggtgcctacataaaattggacaatgatgaagctatcctagcgaaaaagaaacgagtgtttgatcgcagtttttcgatggaagtttctgatgaattctatgatgaactattggcatatgtcgaccataaggtcaaaagaagagagttaggccttgaataa

SEQ ID NO: 5977 - DNA, 273 bp, Bacillus cereus ATCC 10987
atgagcaatcgaaaagttccgttacgaaaatgtgttgcaacgcaagaaatgaaatcaaaacgagagctcgttcgcattgttcgttccaaagagggagaagtgtctattgatttaactggaaagaaatcaggacgaggtgcttatttatcaaaagataaagaaagcattcttcaagctcaaaagaaaaatgttttggaacatcatctaaaagcgaaaatcgacagttctctttatgaagaacttcttgagcttgttgagaaggagtcgaaataa

SEQ ID NO: 5978 - DNA, 285 bp, Listeria monocytogenes 4b F2365
atgcgtaataaaaaaatcccccttcgaaaatgtattattaccggtgaacgcttgccaaaaggcgaacttcttcgtattgcgtattcgaaagacggagcgcttacgatagatcctacaggcaaagcacctggacgcggtttctacattattaaaagtgtagaagtatgcgaaaaagcgaaaaagaaaaacgccatttttcatcaactaaaaatgccggaacaagagtccttttatgatgagttaattacttatgtgaagtctctcgaggaaccaacgaatggataa

SEQ ID NO: 5979 - DNA, 273 bp, Bacillus anthracis Ames 0581
atgagcaatcgaaaagttccgttacgaaaatgtgttgcaacgcaagaaatgaaatcaaaacgagagctcgttcgcattgttcgttccaaagagggagaagtgtctattgatttaactggaaagaaatcaggacgaggtgcttatttatcaaaagataaagaaagcattcttcaagctcaaaagaaaaatgttttggaacatcatctaaaagcgaaaatcgacagttctctttatgaagagcttcttgagcttgttgagaaggagtcgaaataa

SEQ ID NO: 5980 - DNA, 282 bp, Bacillus anthracis str Sterne
gtgatgagtatgagcaatcgaaaagttccgttacgaaaatgtgttgcaacgcaagaaatgaaatcaaaacgagagctcgttcgcattgttcgttccaaagagggagaagtgtctattgatttaactggaaagaaatcaggacgaggtgcttatttatcaaaagataaagaaagcattcttcaagctcaaaagaaaaatgttttggaacatcatctaaaagcgaaaatcgacagttctctttatgaagagcttcttgagcttgttgagaaggagtcgaaataa

SEQ ID NO: 5981 - DNA, 282 bp, Bacillus thuringiensis konkukian; identical to SEQ ID NO: 5980

SEQ ID NO: 5982 - DNA, 312 bp, Mesoplasma florum L1
atgatgaagatgaagaagattttgaagaagacgaatacgaagatttatatgatcaagaataatctaagaaaagatgtcgttagtaaagaaatgttagataaatcagcattaattagagttgttttaaataaaaacaatgaaatttttattgatttaacttataaagcagatggacgtggagtttatgttaaaaatgacttaaactcagttaaaatcgctaaacaaaaaaaccttttaagcagaggattaaaaacaaaagttgatttaagtatttatgatgaattagaaaagttatttaatgaacaaaactaa

SEQ ID NO: 5983 - DNA, 282 bp, Bacillus cereus ZK; identical to SEQ ID NO: 5980

SEQ ID NO: 5984 - DNA, 315 bp, Dehalococcoides ethenogenes 195
atgaatcagaggaaatcgacttctaaatttgtgcccatgcggacttgtatcgcctgccgtaccgaaaaggctaaacaagagcttatccggctggtaagaacagaagataatgacgtaagggtagaccatagcgggcgtctggaaggacgcggagcctatttgtgcagagatatggcctgctgggaatccgggctgaagggcagttatattacccacgctttgaagattgccattactccggagaaccgcgaagaattgttgaaatatgggcgcgaagtgtgtgaggtgaaggaaaatggtagagaagacaagtaa

SEQ ID NO: 5985 - DNA, 285 bp, Staphylococcus aureus COL
atgaaaaagaaaaaaattccgatgcgaaaatgtattctttcaaatgaaatgcatcccaaaaaagatatgattcgtgttgttgttaataaagaaggcgaaatctttgcggatgttactggaaagaaacaaggccgtggcgcatatgtttctaaagatgttgctatggttgaaaaagcacaacaaaaagaaattttagaaaaatattttaaagcatctaaagagcaattggatcctgtttacaaagaaattattagattaatttatagagaagagatcccaaaatga

SEQ ID NO: 5986 - DNA, 285 bp, Staphylococcus epidermidis RP62A
atgagaaagaaaaaaattccaatgagaaaatgtattatatctaatgaaatgcgtccaaaaaaagatatgattcgagtggttattaataaagaaggcgaaatctttgcagatgcgacaggaaaaaaacaagggcgcggtgcatatgtgtctaaagatgtagctttagttgaaaaggctcaacaaagagaagttttagaaaaatattttaacgctactaaagatacacttgatcctgtttataaagaaataataagactgatttatagagaagagatcccaaaataa

SEQ ID NO: 5987 - DNA, 276 bp, Prochlorococcus marinus NATL2A
gtgagtcaaaaccccattctgcgtaggtgtatagcttgcaaaaaagttcttgatcgcaagtattttttgaaagttactagagattttcagaatggagtagttttctcaggtgggatgggaagatcagcctatctctgtccaactgagtcatgttttgaagaagctttgaagcgtaaaagattacaaaagtctttgagatgtgatattcactcaagcgttttcaatatgctccaaaaacaacttaatacctgcattgattcagatactgaggcatga

SEQ ID NO: 5988 - DNA, 270 bp, Anabaena variabilis ATCC 29413
atgcaacccaactaccgacgttgtattagttgccgtaaagtaggactaaaacaagacttttggcggattgtccgtgtctttccttcgggaaaggtacaattgaatgagggcatggggcgttcagcctacatttgtccgcagatgagttgcctacaagcagctcagaaaaaaaatcgattagggcgatcgctacaagcatcggtaccagacacactgtaccaaaaattgtggcaaaatctagcccaaaacgatccccaaaatcaaaattag

SEQ ID NO: 5989 - DNA, 279 bp, Synechococcus sp. CC9902
gtgagcgccaagcccatcctccgtcgttgcgtggcatgtcgccagctccaggatcgtcgccacctttggcgggtgatccgtgaccataaggatggggtccttctggacttcgggatgggccgctcggcctatctctgcccgaaggaagagtgccttgaagaggctcggcgccgcaaacgcctgcaaaaagctctgcgatgtcaggtgccagatgcagttcttacgacgctgaatgggcggctcagtgcaagcactggtgaatccgctgaggcaaactaa

SEQ ID NO: 5990 - DNA, 279 bp, Synechococcus sp. CC9605
gtgagtgaccgccccgtcctgcgtcgctgcgtggcctgccgccagctcttggatcgccgccaactctggagggtgatccgcgaccatcaggacggagttcgcctcgatgaggggatgggccgttcggcctatctctgccgcgaggagaactgccttcaggaggcgacccgtcgcaaacgcctgcagaaagccctgcgttgtcaggtgcccgaaacagtgcttgcggtgttgaaacagcggcttaaccaaagcgttggtgaatccgctgaggcagactga

SEQ ID NO: 5991 - DNA, 282 bp, Prochlorococcus marinus MIT 9312
gtgatacaacaaagacctgttttgcgtatatgcatttcatgtagaaaaacatatgacaggaaaaatcttttaaagattaccaaagatcataagcaaggcattatgtttcataagggaatggggcgatcagcttacatttgcaagtcaaacaaatgttactcagattccaagatcaaaaaaaagcttcaaaaagctttaaaaacatttttagaacctcaatttattgaaatttttgaaaaagaaattacaagctataatgactatcccattgagggaatataa

SEQ ID NO: 5992 - DNA, 294 bp, Synechococcus elongatus PCC 7942
ttgagtcggctgccccaagggtatcgacgctgtattgcttgccggcgactcgctcaccggcaggaattctggcgagttattcggctggcaagtaccggagcgatcgccctcgatcagggtgaagggcgatcggcctatctctgtccaaccgtggcttgcttcaaccagggtcgccgcaaaaatcgtctggggcgagccctgcgatcggcgattcctgactccgtttgggtggccctcgaagcaaggctgagtgtgacaatctgcccgagcctgtcagagggctctgacggatag

SEQ ID NO: 5993 - DNA, 282 bp, Deinococcus geothermalis DSM 11300
atgcccgccccgacaccgcgtccccacacgcagcggcactgtcccgaacgtacctgtgttgcctgccgccgcaagcggccacaaggcgagctggtgcgcgtgacccggacggcggagggctggcgggtgctgcggggcagtcgagcgggacgaggagcctacgtgtgcgccgactcgcccgaatgctggcaggaaaagcggctgcggcgggccttccggggggatgccccggtggtcagcgcacagctttacaccctgaatataccgatggatcagctatga

SEQ ID NO: 5994 - DNA, 282 bp, Moorella thermoacetica ATCC 39073
ttgcctaagcccaggaaaatacctgtgcggatgtgtgtcggttgccgggcccgcaatgataagcgcaacttactgcgggtggtgcggacaccggaacaggaggtagttatcgatcccaccggtaaacgggccgggcgcggtgcttatctgtgtccgcgggtagaatgcctgcggaaggctgttaagagccgggccctggaacgggccctgggcgtagctgtttcccctgaggtgctggaacgcctggaggccagtttcaaccaggaagggaaccatgaataa

SEQ ID NO: 5995 - DNA, 255 bp, Trichodesmium erythraeum IMS101
atgaaacccaattaccgtagatgtgttagttgcaaaaaactggctcctaaagaggaattttggcgagttgttcggagcaagaaatctgatactattaaattagatcaaggagaaggtcgttcagcttacatttgttgtggacaaatagaatgtttgaaaattgctcataaaaaaaataagttgggtcgttcactaaaagcttatgtatcaccagaaatatatcaatcattatggcaaagattagaaagtttatga

SEQ ID NO: 5996 - DNA, 267 bp, Clostridium perfringens ATCC 13124
atgaaacctaaaaaaattccaatgagaatgtgcaatggttgcatggaaatgaagcctaaaaaagaactgataagaatagttaaaaatgctgaaggagaagtttctgtagatttaactggtaaaaagtcaggaagaggggcttacatttgtaaaagtgttgaatgtttagaaaaagcatttaaagcaaaaagattaaataaaaatcttcaatctaacattggagatgaagtctatgatagattgagggatgagataacaaatggataa

SEQ ID NO: 5997 - DNA, 282 bp, Syntrophomonas wolfei Goettingen
atgagcaggattcgtaagcagccccagagaatgtgtgtaggttgccgggaaatgaaaaataaacgggaattggttaggatagttcgaagccctcagggggatatcgatttagatactacgggtaaaaagccggggcggggagcttatatttgtcctgaaccagagtgcctcaagcaggccattaagggaaagaggttgcagaaagccctggaacagaatatacctgaaggggttttagaaaagattagagagcaaatcgaacaggataaaaccgggcaataa

SEQ ID NO: 5998 - DNA, 342 bp, Oenococcus oeni PSU-1
atggcaaaaaagaagcgacaatttaaagcacgtaaaataccgatgcgtaaagatatagtcagtggccaaatgttcccaaaaaaggatttgattcgaattgtaaagaccccgtctggagaattagagttggatccaaccggtcgagcaaatggccgcggcgcctatgtcagcgttgatgttacactagctaagaaggcaaaaatagagaagtctctcgattctacctttgaaatgactgttgccgatgttttttatgataaattaattgattttgtcaagcaccaacaagacaggaaggaacttttcagccacgaacaaattatcaaagcagaaaattcttaa

SEQ ID NO: 5999 - DNA, 276 bp, Leuconostoc mesenteroides ATCC 8293
atgagaaaagacattgtaacgggtgaaatgtttcctaaaaaagaactcgttcgagtcgtgcgtagtaaagaaggtgacgtggctttagacccaacagggaaagccaatggtcgtggtgcgtatgttagcctaaatgtaaaaaatgcagaaatggctaaagaaaagcgtatctttgataaagcatttggtgtgaaagtagcagatgaattctatgatgaactcattgcttacgttgaccatcaacaagcacgtcgggagttgtttggtgataaataa

SEQ ID NO: 6000 - DNA, 297 bp, Lactobacillus gasseri ATCC 33323
ttgaaaaaaagaaaaattccaatgcgtaaggatctattgactaatactatgcaacctaaaaaagaattagtccgcgtagttgttgacaaggataaaaatatttcagtggatccaactggaaagaagtcaggtcgaggagcctatgtatctttagagcccgataagatcgcagaagcgaaaaaaaatcaggttttagaaaagagcctaggtgttaaagtttcagctgacttttatgatgatctttatgcatatgttgatcatcaaaaagcaagaaaagaattgtttggtgataaataa

SEQ ID NO: 6001 - DNA, 327 bp, Lactococcus lactis cremoris SK11
atgaagcagaaaaaaattccaatgagaaaatctttagtttcaaatgagcaatttcccaaacgggatttattgcgcattgcctacaacaaagagggagaaatttcaattgacccttctggcaaggcacatgggcgcggagcttatattgcaattcttaataaagaagcaaaagaagctaagaaaaaacgcgtatttgaccgagcttttcaaactaaaatcgctgatgagttttatgatgaattaatcacttatgttgaacaccttgttgctcgacgtgaacttgaatcgacaacttattctgctgatttagcgccggattatgactaa

SEQ ID NO: 6002 - DNA, 297 bp, Streptococcus thermophilus LMD-9
atggctaaaacacgaaaaatacctttacgaaaatcagttgtctcaggagaaatcatcgataaacgtgatttgctccgcattgtgaaaactaaagatggtgaaattttcatcgatccaacaggaaagaaaaatgggcgaggcgcctacattaaattggataatgaggaagccctacaagctaaaaagaaacaagttttcaaccatagtttttccatggatgttcccgaaagtttttacgatgaactcattgcttatgtggatcacaaggtcaaaagaagagaattaggtcttgaataa

SEQ ID NO: 6003 - DNA, 231 bp, Desulfovibrio vulgaris DP4
atgacgccttccgaggaacggcaccagccgatccggatgtgcgtcatctgtagacggcgctttgccaagcatgagcttctgcgctacgtctgccccgccgaaggggcagcgcccgtcgccgacgagcgacaggtccttcccggaaggggatggtacgtatgcggcgacccggcatgccgggagcggctccgcaagttcggcggatggcgacggaagcgcaagggggtttaa

SEQ ID NO: 6004 - DNA, 192 bp, Prochlorococcus marinus MIT 9515
ttgaggattactaaagatcataaattaggaataatgttaaaccaaggcatgggtcgatctgcttacgtttgtaaatcaaaaaagtgttacacagattctaaacttcaaaaaaagcttcaaaaagctttaaaaagcgttttaaatcctgatttttttgatatttttgagagggaaattgcaaactatcaataa

SEQ ID NO: 6005 - DNA, 273 bp, Prochlorococcus marinus AS9601
gtgatacaagaaatccctgtcatgcgtttatgcatttcatgtagaaaaacatatgacaggaaagatcttttaaagattactaaagatcataagcaaggtatcatgcttcaaaagggaatggggcgatcagcttacatttgcaagtcaaaaaaatgctactcagattccaagatcaagaaaaagcttcaaaaagctttaaaaacatttttagaacctgaatttattgaaatttttgaaaaagaaattacaagctacattaactatccccattaa

SEQ ID NO: 6006 - DNA, 279 bp, Prochlorococcus marinus MIT 9303
gtgaaccaacgccccgtcctgcgtagctgcgtgacctgtcgccaactgctggatcgccagcagctttggcgggtgatacgcgaccatcaggagggtgtagtcctcgatgaagggatgggtcgatcggcctatctctgtccaaacgaggcctgcctagaggaggcactccgccgcaaacgtctacagaaagccctgcgttgccaggtgcccaatagcgttgtggaggtgctgcaaaagcggctcaatcactcctttgattccgccgctgaggcaaaataa

SEQ ID NO: 6007 - DNA, 276 bp, Prochlorococcus marinus NATL1A
gtgagtcaaccccccattctgcgtaggtgtgtagcttgcaaaaaagttcttgatcgcaagtattttttaaaagttactagagattttcagaatggagtagttttctcaggcgggatgggaagatcagcctatctctgtccaactgagtcatgttttcaagaagctttgaagcgtaaaagattacaaaagtctttgagatgtgatattcactcaagcgttttcaatatgctccaaaaacaacttaatacctgcattgattcagatactgaggcatga

SEQ ID NO: 6008 - DNA, 279 bp, Clostridium thermocellum ATCC 27405
atgaaacaaaaaaagattccgatgagaatgtgccttggttgccaggaaatgaaacccaaaaaagaacttatcagagttgttaaaaacaaagagaatgaaatctctttggattttaccgggaaaaaacccggaagaggagcatacatctgcaaaaatgtttcctgttttgagaaagccaaaaagggtagaaaatttgaaagggccttcgagacatccattggtgaagagatatatgaattactgcgaaaagaattggaggagggccatgctggagaatag

SEQ ID NO: 6009 - DNA, 273 bp, Prochlorococcus marinus MIT 9301
gtgatacaacaaaatcctgttttgcgtatgtgcatttcatgtagaaagacatatgacaggaaagatcttttaaagattactaaagatcataagcaaggcatcattcttcaaaagggaatggggagatcagcttacatttgcaagtcaaaaaaatgctactcagattcaaagattaaaaaaaagcttcaaaaagctttaaaaacatttttggaacctgaatttgttgaaatttttgaaaaagaaattacaagctacaataactatccccattaa

SEQ ID NO: 6010 - DNA, 267 bp, Desulfotomaculum reducens MI-1
gtgcccaaggtcaaaaaggttccgctaaggatgtgtattggctgtcaggaaatgaagcctaagcgagaattgacaagggtggtgcggaccccccaggaaacggtggagattgatcccactggaaagaaatctggacgaggtgcttacgtctgtcccagtgctaattgcttacaaaaggcaataaaaggtaaaaggttggagcgatctctagaatgtgccatatcaccagaaattatagaaaatcttaagcaaggactggtgaaatag

SEQ ID NO: 6011 - DNA, 315 bp, Dehalococcoides BAV1
atgaatcagaggaaattgacttctaaatttgtgcccatgcggacctgtatcgcctgccgtaccgagaaagctaaagcagaccttgtgcggctggtgagaacagaagataatgacgtaagggtagaccatagcggtcgtctggaagggcgaggtgcttacttgtgcagagatatggcctgctgggaatccggtttaaaaggcagttatattacccatgctttaaagattgccataacaccggaaaatcgcgaagaactgttaaaatatgggcgcgaagtgtgtgaggtgaaagaaaatggtagagaagacaagtaa

SEQ ID NO: 6012 - DNA, 285 bp, Staphylococcus aureus JH9
atgaaaaagaaaaaaattccgatgcgaaaatgtattctttcaaatgaaatgcatcccaaaaaagatatgattcgtgttgttgttaataaagaaggcgaaatctttgcggatgttactggaaagaaacaaggccgtggcgcatatgtttctaaagatgttgctatggttgaaaaagcacaacaaaaagaaattttagaaaaatattttaaagcatctaaagagcaattggatcctgtttacaaagaaattattagattaatttatagagaagagattccaaaatga

SEQ ID NO: 6013 - DNA, 303 bp, Lactobacillus reuteri DSM 20016
atgaaaaagagaaaaataccgatgcgtaaagacattgttaccggtgaaatgatgcccaaacggcaattaattcgggtagttaagaataaggaaaatgaagtatccttagacccaactggtaagaagcctggtcgtggagcatatgttgcagtagatgtggatattgcaaagcgggccaagaaagaaaaaacttttgaaaaggcttttcatgttcaacttgatgaatcattttatgatgaattaatcaagtatgcagaccacctacaggcacgacaagagttatttggtaatgatcaaaaataa

SEQ ID NO: 6014 - DNA, 357 bp, Roseiflexus sp. RS-1
gtgaagggtgcatcgcgccctgatcggagtacagcagtgacgcagacggcaaaaaagaagaaaggaccgcgtcagaagcatgtgccgcagcgtacatgcgttgcctgtcgccataccgatgccaagcgcacgctgattcgtctggtgcgcgacgctgacgctcgggtgcatatcgatccgacaggaaaacgaaatgggcgtggcgcttatctgtgcaacgatccggcgtgctgggatcaggcgctccgacgtcatgcactggaacgtgcactgcgggtaagtgcactgcatcctgatgatctggcggcgcttgaggcatacgcacgaaccctgccgtcggtgacgggtgtgaagtag

SEQ ID NO: 6015 - DNA, 285 bp, Staphylococcus aureus JH1; identical to SEQ ID NO: 6012

SEQ ID NO: 6016 - DNA, 282 bp, Bacillus cereus cytotoxis NVH 391-98
gtgatgagtatgagcaatcgaaaagttccgttacgaaaatgcgttgtaacgcaggaaatgaagccgaaacgagagctcgttcgcattgttcgttccaaagagggtgaagtgtctattgatttaactggaaaaaaatcaggacgcggcgcatatttgtcaatggacaaagaatgcattcttcaagcacaaaagaagaacattttggaacatcatctaaaagcgaaaatcgacagttctctctatgaagaacttcttgaacttgttgagaaggagtcgaaataa

SEQ ID NO: 6017 - DNA, 315 bp, Roseiflexus castenholzii DSM 13941
atgccgaaaaaaaagcagaagggaccgcgcccaaagcatgtgccgcagcgcacatgtgtggtgtgtcgttgcacccatgcgaaacgcgcgctgattcgcctggtgcgcgatgccgatggtcgggtgcatgtcgatccaaccgggaagcgcaatgggcgtggcgcttatctgtgtcacaactctgagtgctggaatcaggcgatccggcgcggtgcgctggcgcgcgcgctgcggatcgacgcgttgcatccggatgatagtgcggcgcttgaagcatatgcgcgagcgttgacgccgttgacgattgcagaatag

SEQ ID NO: 6018 - DNA, 324 bp, Herpetosiphon aurantiacus ATCC 23779
atggctgctcaaaagcagtcgccgcgcccacgccatgtgccacagcgcatgtgtgttgcttgtcggcgtaccgagagtaaacgtcagttggtacgtcttgtgcgcttggccgaccaaagtgttgtggtcgatccaagcggcaagcaagcgggccgtggtgcatatctctgtgctgaacgcccatgttggacgaatgcgctgaaacgcggggctttagaacgagccttgcgcgttgaattgagcgcgattgatcagcaggcactccaaacgattgctgatcaatttcccgatgctgaaccagcggtggaggctgcgatgaactaa

SEQ ID NO: 6019 - DNA, 279 bp, Prochlorococcus marinus MIT 9211
gtgaaccaaaaaaccgtcctgcgtcgctgtgttgcatgtcgaaaattaatcgaccgccaacaactttggagagtgacaagagaccatcagggcggagtagtcctcgacgaaggcatgggtcgctcagcttatctatgccctaatgaggcctgcctcgaagaagctttgcggcgcaaacgtctccaaaaagcactcagatgtcaggtacagatgagtattttagaggtgctgcaaaatcgtttaaatagctgcaatgatgcaagctctgaggcaatatga

SEQ ID NO: 6020 - DNA, 276 bp, Clostridium phytofermentans ISDg
atgaatacaagaaaaattccattacgtaagtgtaccggttgtggagagatgaaaagtaaaaaagagatgattcgggtgttaaagacaccagaagatacgattgtacttgatacaactggaaagaaaaacggtagaggcgcatacatatgcaactcattggaatgtcttagaaaagccatcaaaagcaaagggcttgagagatccttaaaaactgcgattccaaaagaggtatatgaacaattggaaagtgagttgagtgagattgcagatgaatga

SEQ ID NO: 6021 - DNA, 273 bp, Bacillus weihenstephanensis KBAB4
atgagcaatcgaaaagttccgttacgaaaatgtattgcgacgcaagagatgaaatcaaaacgagagctagttcgcattgttcgttccaaagagggcgaagtgtctattgatttatcaggaaaaaaatcaggacgaggtgcatatttatcaaaagataaagaaagcattattcaagcccaaaagaaaaacattttggaacatcatctaaaagcgaaaatcgacagttctctgtacgaagagcttcttgagcttgttgagaaggagtcgaaataa

SEQ ID NO: 6022 - DNA, 273 bp, Thermoanaerobacter sp. X514
atgaagaccaaaaaggttccaatgagaatgtgcttaggctgtcagcagatgaaaccaaaaaaggaattaatacgcattgtaagacgagcgaaagattcagttgtacaggtggatttaacaggtaaagtgccgggaagaggttgttatatttgcaaagatataaattgtcttgaaaaagcttttaaaaacaaaaggttagaaaaagcgttagaagtaccgatctctgatgaaatttacgaacaattaaagagggagatagaggatgaagaatga

SEQ ID NO: 6023 - DNA, 279 bp, Candidatus Desulforudis audaxviator MP104C
atgcccgccaaaaaggtgccattgcgcatgtgcctgggttgccgggagatgcgtcccaagaaggaactgatccgggtggtgcgcaccccggcaggcaccgttgagatagatccgactggaaaacgcccgggacggggtgcctacgtatgcggcagggagtcgtgtgtcgatcaggccgttgagacgaggaggttggaaaaggccctgaaaacaggggttctgcccgaaacgattcaggatctccggagggagatagagaggcgtgcaggcggtatataa

SEQ ID NO: 6024 - DNA, 276 bp, Natranaerobius thermophilus JW NM WN LF
atggcccgcaagaagaaaattcccgtgagaacgtgtcttggatgccaagagaaacaatccaaacgggagttagttcgaatagtgcgtacaccggaaagcgaaatcaaattagatcctaccggtaaagcgaatggaaggggtacatatgtttgcccctccgaagattgcctggaaaaggctctaaaaaaagataaacttaaaaaagcattaaatactggtgtcagtgaggaagaaaaagaaaaaatccgaactgaatgggatcaatttcaaaaatga

SEQ ID NO: 6025 - DNA, 318 bp, Mycoplasma arthritidis 158L3 1
atgaagattgataaactttatttaagaaaatcaattactgatggacaatactatccgcaagatcgattagttaggttcgctaaatctaaagatggaatagtagaatttgaccccaataaaaataaaaaaggtcgtggtgcttattgcttaaaagaaaatgaagtaattgaagaagtgcttaaaaaaagattgcttaatcgagcatttaaaaaaacaattgaagcaagccaatacgaaaaattaagagatgaggtgaatatatggcaaaaaacacaaataaaagaagatcaaacgttgaacacattaaaaaacaattag

SEQ ID NO: 6026 - DNA, 273 bp, Bacillus cereus AH187; identical to SEQ ID NO: 5977

SEQ ID NO: 6027 - DNA, 297 bp, Dictyoglomus turgidum DSM 6724
gtgagtaaaggtaaacatattcctttaagaacgtgtataggatgtggagaaaaaaagcctaaaagggaactcttgaggatagttcgtggagaaaataattctattttttatgatccgacaggaaaagcttcgggtagaggagcatatatatgtccaaagatagaatgtcttgagcttgctattaaaaagagagctttttcgcacgcattaaagtgcgaaatttctaaagaagatctagaaagaatcagagaagaattagaaagagaaatcacaaaacggggggagatggtagtatga

SEQ ID NO: 6028 - DNA, 273 bp, Bacillus cereus B4264
atgagcaatcgaaaagttccgttacgaaaatgtgttgcaacgcaagaaatgaaatcaaaacgagagctcgttcgcattgttcgttccaaagagggagaagtgtccattgatttaactgggaaaaaatcaggacgaggtgcttacttgtcgaaggacaaggagagcattcttcaagctcaaaagaaaaatgttttggaacatcatctaaaagcgaaaatcgacggttctttatatgaagagcttcttgagcttgttgagaaggagtcgaaataa

SEQ ID NO: 6029 - DNA, 255 bp, Cyanothece PCC 7424
atgaagcctaactaccgaagatgtgttagctgtggtcaagtcgccctaaaagactctttttggcgaattgtccgggtctatccatcacgaaagctacaattagattatgggatggggcgctcggcttatctttgtccctgtgcgagctgcttaaaagaggctcgccaaaaaaaccgactcggacgagccttgagagtgcccattccagactacatttatcaagcgttatcagagcgtctaaccccaacaaaataa

SEQ ID NO: 6030 - DNA, 258 bp, Cyanothece PCC 8801
atgaagcctaattatcgacggtgtattagttgtcggaaagttgccccgaaacaagccttttggcggattgttagagtttatccttctcaggaggtacaattggatcatggcatggggcggtcagcctatctgtgtcccgaaaaaagttgtttggacaatgccactaaaaaaaatcgtttaggacgaacactcaaagcctcggttcccccgactatctatcaaagcttatgggagcgtttagaggaactacctccctag

SEQ ID NO: 6031 - DNA, 273 bp, Bacillus cereus G9842
atgagcaatcgaaaagttccgttacgaaaatgtattgcgacgcaagagatgaaatcaaaacgagagctggttcgcattgttcgttccaaagagggcgaagtgtctattgatttatctggaaaaaaatcaggacgaggtgcatatttgtcaaaagataaagaatgcattatacaagcccaaaagaaaaacattttggaacatcatctaaaagcgaaaatcgacagttctctgtacgaagagcttcttgagcttgttgagaaggagtcgaaataa

SEQ ID NO: 6032 - DNA, 252 bp, Desulfovibrio vulgaris  Miyazaki F
atggatgaagccatccgcgggaagcacataccattacgcacctgcgtcatatgcaggcgccgctttgcaaagcgcgagcttctgcggtacgtccccccgacggacgccgccggggcgggggcagaccccgttccggacgaaaggcaggtactgcctggacgcgggttctacgtatgcgaaagccccgaatgccgggagcgattccggaagttcggcggctggcgaaggaagcgcaagggggttcaggaatga

SEQ ID NO: 6033 - DNA, 273 bp, Bacillus cereus AH820; identical to SEQ ID NO: 5979

SEQ ID NO: 6034 - DNA, 270 bp, Desulfitobacterium hafniense DCB 2
atgaagacacgcaaaattccgctaagaatgtgtctgggctgtcaagaaatgaaaccgaaaaaggagctcattcgcgtagttcgcaccccagaaggagccgtggagcttgacctcactggtaaacggaatggccgtggcgcatacatttgccccgatatcgagtgctttaaagcagcagtaaagggtaagcggttccaaaaagccctggaaattgaactggcacctcaagtgattgaggaattggaaaggaagttgggtagagagtgctag

SEQ ID NO: 6035 - DNA, 273 bp, Halothermothrix orenii H 168
atgtcccgaaaggttccggttcgaatgtgtatcgggtgtcagaccaggaagccaaaaaaagagttaataagaataatatataataaaaaaacgggagaaataaaggttgatccgtccggtaaattgccaggacgaggtgcttatatttgtcccgacaaggggtgtttaaaaaaggctaaaaaaggaaatagactcaataaatctctaaagacttcaatttctgacgagatttatacaaaattgatggaggagattgataaaatgaatggatag

SEQ ID NO: 6036 - DNA, 273 bp, Clostridium cellulolyticum H10
atgaagcaaaaaaagattccattacgtatgtgcctgggctgtaaggaaatgaagccaaaaagggaattaatacgtgtggtaaaaaataatgagggagaaatcagtattgatctcgttggtaaaaagcctggcaggggtgcatacatatgcagaagtgccgattgtcttgaacaggcgattaaggctaaaagactggaaaaggcttttgagactacaattgacatggacatttataatattctgaaaaaccaattggaggaaaacgatgaataa

SEQ ID NO: 6037 - DNA, 246 bp, Desulfovibrio desulfuricans ATCC 27774
atgggggaaaggcaagaaactgccgtggccgttgaagggccggtgcgcatgtgcgttatgtgccgccgccgcttcgccaaggcccagcttacccgccatgtgctgacgccccagggaattttgactattgacgctgaaaaaaccagacctggcaggggctggtatctctgttccgatgccgcatgcatggcgaaattcgtcaggttcaggcccggggcacggcgcaaggggggtaaacatgtctga

SEQ ID NO: 6038 - DNA, 255 bp, Cyanothece PCC 7425
gtggaacccaattatcgtcgctgcgtgagttgtcgtcaccttgcaccgaagcaagacttctggcgaattgtccgcgtttatccttccgcagaggtgtgcctggatgagggtagcgggcgttctgcctacctttgtccccaattatcttgcttagaactagcccaaaagaaaaaccgcctgggtcgggcgctgaaaacctcggttcccccagtgatctacctgcagctccgccagcgtctttccccactgtcctag

SEQ ID NO: 6039 - DNA, 225 bp, Anaerocellum thermophilum DSM 6725
atgagtataaaacctaaaaaagagcttttgagaattgtcagaacagataaagaaatttttattgactcaaaacagaaaatgccaggaagaggagcatatatttgtaaagatttagaatgtttaaaacttgctatgaagaaaaaaggattagaaaaatcgctaaaagtgaatatttcaaaagatttttatgaaaagcttgaagaatttttaaaaaattggcagtaa

SEQ ID NO: 6040 - DNA, 213 bp, Acidimicrobium ferrooxidans DSM 10331
gtgcacgtggtggaggggcgcctcgcggtcggggcggggcctgggcgcggtgcgtggatctgtccgcgggaggcgtgcctcgagcgcgcgctcgcgcatggacggctccgacgagcgctgcgactcgccccgtcggacggcgagctcgtcgacgagggcgtgcgccaggcctggcgagcggcgatcgctgggcacggcgcgtcgagcgcctag

SEQ ID NO: 6041 - DNA, 210 bp, Desulfomicrobium baculatum DSM 4028
atgtgcgtgatctgcaggcagcgtttttccaaagacgaactatatagatttacctgccctgttcacggagagctcactctgaccgctgacagcaccggaaaaacaccgggacggggtttttatctttgccgcgatgcggcgtgccggaacaaattcgagcgattcaagggctggcagaagaaatgtaagggggttgggcatgtccactag

SEQ ID NO: 6042 - DNA, 291 bp, Geobacillus WCH70
atggctggtcaaaagaaagttccgttgcgaaaatgcgtcgtgactggtgaaatgaagccaaaaaaagaaatgatgcgcatcgtccgttcaaaagatggggaagtttccattgatccgacaggaaaaaaggctggtcgtggcgcgtacattacactagataaagaatgcattttactagcaaaaaagaaaaatattttagcccatcatttaaaaacggaaattcctgatgcgctgtatgatgagttgcttcagttggcagaaaaggagactgctgctggaaatgagcaataa

SEQ ID NO: 6043 - DNA, 288 bp, Eggerthella lenta DSM 2243
atgacgacgacgaggacggtgcgccagcgcagctgcatcgcatgcgggaagctggccggcaaggccgagctcatgcgcatcgtgcgcgacccgtccggcgccgtgtcgttcgacaagaccggccgtgcgccgggcaggggggcgtacgtctgctccgaggagtgcttcgccgccgcatgcaagaagaaaaagctcgaccgggcgctcaaggcgacgctcggcagcgatgagtacgacaggatcgccgccgacgtcgcttcggctgcgcgcgaagcgagacagaagtag

SEQ ID NO: 6044 - DNA, 327 bp, Chloroflexus aggregans DSM 9485
atggcggccaaagctcaaaccggtacgccgcgaccacggcacatcccacaacgcacgtgtatcgtatgtcgacacagcgatgcaaaacgtgcgctgatccgattggtacgcgatgcacaagggcgagtaacgattgatccaaccggtaaacgatccggccgtggcgcttacttatgccacaacccagaatgttggacacaagccttgcgccgccatgcgattgaacgggcattgaagatttcgatgctgcatctcgatgatcgggcggcaatagaacaaatggctcgacaattgttgcaggcgacaacgtcagcggtatctgaatag

SEQ ID NO: 6045 - DNA, 318 bp, Cryptobacterium curtum DSM 15641
atgatgaacgctgctgcgacaacaagacgctctcatgagcctccgttgcgtacgcgtcgttgtatgacgtgctcgtcaaagcgtgagaaagccgacttgtttcgagttgtgcgccatgctgatggcacggtagcgttcgatccaacgggacgtgcaccgggtcgtggtgcctatgtgtgcagtccggcttgtcttgaagaggcttgtcgcaagggccttatggggcgagctttgaagacgcgggttgataaccgcgcagcgcaacagatcgtcgctgacatgctcagagagcacgagcggcgtgcaggaatagactag

SEQ ID NO: 6046 - DNA, 267 bp, Anaerococcus prevotii DSM 20548
atgaaaaaagctaagaagattccacaaagaaaatgtgtggtatgtggcaagcttaaagacaaaaaagaccttctaagagttgtaaaaaacaaagatgaaggaattttgatagatgaatctggaaagaaaaacggaagaggcgcctacatttgcaaggatgatgcttgcatagaggaagccatcagaactaataagctaaaccgagtttttagaacagaagtttctgacgaactttacgaggagttaaaagcttatgaagtaaattga

SEQ ID NO: 6047 - DNA, 258 bp, Cyanothece PCC 8802; identical to SEQ ID NO: 6030

SEQ ID NO: 6048 - DNA, 270 bp, Desulfotomaculum acetoxidans DSM 771
atggtgcctaaagtaagaaaaatacctcagcgtatgtgtgttggttgtcaggagatgaagccgaaaaaggaaatgatcagggtagtgaaaactcccgaaaattctatagaaatagatccgacgggtaaacgtgccggcaggggtgcttacgtttgtcccagtctggaatgcctgcaaaaagctattaaagcaaggcgtttggaaaaagccttgcatcattcagtttctcctgagataattgatgttttgaagcaggggttggtgaaataa

SEQ ID NO: 6049 - DNA, 282 bp, Alicyclobacillus acidocaldarius DSM 446
atgaatcgcgtgagaaaggtgccgcttcgcaagtgcgtgggctgccaggagatgaagccgaaggcggaactcacgcgcgttgttcgaacgccagagggagacatcgtgctggattcgaccgggaagcggaatggccgaggcgcctatctgtgcccgtctgaagcgtgcctcaacgtcgcggtcaagcgaaaggcgctggagcgcgcgctgaaggcggccattccgcaggagatccatgagtctctccgccgccagctggtgggagacggagatgcgcactga

SEQ ID NO: 6050 - DNA, 261 bp, Desulfohalobium retbaense DSM 5692
atgcaaaaccagcccgtgaaccattcacgacaacacggccaccagccagaacgcatgtgtgtcatctgtaggcgccgtttcgccaaacatcagttgcaccggctagtggcctcagcggactgcgaccgcctgcttgacgatccgaaacagaccaggcctgggcgtggatattatatctgcccagacccggcctgccaaaaacgaatttccaaattccggggctggcggaagaagtgcaaggggggacggcatgacaactaa

SEQ ID NO: 6051 - DNA, 783 bp, Enterobacter sp. 638
atgaaaccaattgatcttcaggcggaaaattcaaccgaaaccgtgggtcgcagtttgcgccgtcgtccgctggcgcgtaaaaaactctccgatatggtggaagaagaactggagcaaatgattcgccggcaggagtttgcgcagggcgaacaactcccgtcagagcgcgaactgatggagttcttcaacgttgggcgtccatccgtacgcgaagcgctggccgcgttaaaacgcaaagggctggtgcagattaacaatggtgagcgcgcacgcgtttccatgccttctgccgacaccataatcggtgaactctccggcatggcgaaagatttcctcacgcaacccggcgggattacccactttgagcagctacggctgttttttgaatccagtctggtgcgctacgcagcggaatttgccacggatgagcaggtagaaagcttgtcaaaagcgctagaaatcaacagtcagtcgctcagtgacaatgcgctgtttatccgctccgatgtcgatttccaccgtgtgctggcggaaatcccaggtaatcccatctttatggcgatccacgtcgcgctgctggattggctgattgcggcccgtccaaaagtctccgacgccgaactctacgaacacaataacgtcagctatcgccagcatattgcgattgtcgatgcgatccgccgacacgatcccgatgaagccgatcgggcgctacaatcccatctcaacagtgtttccgccacctggcacgcgttcggccagggatccaaaaagaagaaataa

SEQ ID NO: 6052 - DNA, 783 bp, Shigella boydii CDC 3083 94
atgaacgcatttgattcgcaaaccgaagattcttcacctgcaattggtcgcaacttgcgtagccgcccgctggcgcgtaaaaaactctccgaaatggtggaagaagagctggaacagatgatccgccgtcgtgaatttggcgaaggtgaacaattaccgtctgaacgcgaactgatggcgttctttaacgtcgggcgtccttcggtgcgtgaagcgctggcagcgttaaaacgcaaaggtctggtgcaaataaacaacggcgaacgcgctcgcgtctcgcgtccttctgcggacactatcatcggtgagctttccggcatggcgaaagatttcctttctcatcccggtgggattgcccatttcgaacaattacgtctgttctttgaatccagtctggtgcgctatgcggctgaacatgccaccgatgagcaaatcgatttgctggcaaaagcactggaaatcaacagtcagtcgctggataacaacgcggcattcattcgttcagacgttgatttccaccgcgtgctggcggagatccccggtaacccaatcttcatggcgatccacgttgccctgctcgactggcttattgccgcacgcccaacggttaccgatcaggcactacacgaacataacaacgttagttatcaacagcatattgcgatcgttgatgcgatccgccgtcatgatcctgacgaagccgatcgtgcgttgcaatcgcatctcaacagcgtctctgctacctggcacgctttcggtcagaccaccaacaaaaagaaataa

SEQ ID NO: 6053 - DNA, 783 bp, Salmonella enterica serovar Newport SL254
atgaacgcttttgattcgcaagcagaagattctccgacatccctcgggcgtagtttgcgccgccgcccgctggcgcgtaaaaaactgtctgaaatggttgaggaagagctggagcagatgatccgccgtcatgagtttggcgagggagaacagctaccgtctgaacgtgaattaatggccttcttcaatgtgggacgtccctccgtgcgtgaagcgttagctgcgctgaagcgtaaaggtctggtgcaaatcaataacggcgaacgcgcccgcgtctcgcgcccctctgctgataccatcatcagtgaactgtcgggtatggcgaaagattttcttactcatcctggcggcatcgctcactttgaacagctacggcttttctttgaatccagcctggtacgctatgcggcggaacatgccaccgacgagcagatcgcgttgttagcgaaagcgctggaaattaatagccagtcgctggatgacaacgcgctgtttattcgttcggatgtcgagtttcaccgggtgctggctgaaattcccggcaatccgatctttatggctattcatgttgctctgctggactggctaatcgccgctcgcccaagcgttcccgatcgtgagctgcatgaacataataacgtgagttatcaacagcatattgtgattgttgatgccattcgccagcgagatcccgataaagcggatcgcgctctgcaaacccacctcaatagcgtttccgctacctggcacgcactcggtaaaaaaagtcaaaaaatgcggtag

SEQ ID NO: 6054 - DNA, 783 bp, Salmonella enterica serovar Heidelberg SL476
atgaacgcatttgattcgcaagcagaagattcaccgacatccctcgggcgtagtttgcgccgccgcccgctggcgcgtaaaaaactgtctgaaatggttgaggaagagctggagcagatgatccgccgtcatgagtttggcgagggagaacagctaccgtctgaacgtgaattaatggccttcttcaatgtgggacgtccctccgtgcgtgaagcgttagctgcgctgaagcgtaaaggtctggtgcaaatcaataacggcgaacgcgcccgcgtctcgcgcccctctgctgataccatcatcagtgaactgtcgggtatggcgaaagattttcttactcatcctggcggcatcgctcactttgaacagctacggcttttctttgaatccagcctggtacgctatgcggcggaacatgccaccgacgagcagatcgcgttgttaacgaaagcgctggaaattaatagccagtcgctggatgacaacgcgctgtttattcgttcggatgtcgagtttcaccgggtgttggctgaaattcccggcaatccgatctttatggctattcatgttgctctgctggactggctaatcgccgctcgcccaagcgttcccgatcgtgagctgcatgaacataataacgtgagttatcaacagcatattgtgattgttgatgccattcgccagcgagatcccgataaagcggatcgcgctctgcaaacccacctcaatagcgtttccgctacctggcacgcactcggtaaaaaaagtcaaaaaatgcggtag

SEQ ID NO: 6055 - DNA, 729 bp, Salmonella enterica serovar Schwarzengrund CVM19633
ttgcgccgccgtccgctggcgcgtaaaaaactgtctgaaatggttgaggaagagctggagcagatgatccgccgtcatgagtttggcgagggagaacagctaccgtctgaacgtgaattaatggccttcttcaatgtgggacgtccctctgtgcgtgaagcgttagctgcgctgaagcgtaaaggcttggtgcaaatcaataacggcgaacgcgcccgcgtctcgcgcccctctgctgataccatcatcagcgaactgtcgggtatggcgaaagattttcttactcatcctggcggcatcgctcactttgaacagctacggcttttctttgaatccagcctggtacgctatgcggcggaacatgccaccgacgagcagatcgcgttgttaacgaaagcactggaaattaatagccagtcgctggatgacaacgcgctgtttattcgttcggatgtcgagtttcaccgggtgctggctgaaattcccggcaatccgatctttatggctattcatgttgctctgctggactggctaatcgccgctcgcccaagcgttcccgatcgtgagctgcatgaacataataacttgagttatcaacagcatattgtgattgttgatgccattcgccagcgagatcccgataaagcggatcgcgctctgcaaacccacctcaatagcgtttccgctacctggcacgcgctcggtaaaaaaagtcaaaaaatgcggtag

SEQ ID NO: 6056 - DNA, 783 bp, Salmonella enterica serovar Agona SL483
atgaacgcatttgattcgcaagcagaagattcaccgacatccctcgggcgtagtttgcgccgccgcccgctggcgcgtaaaaaactgtctgaaatggttgaggaagagctggagcagatgatccgccgtcatgagtttggcgagggagaacagctaccgtctgaacgtgaattaatggccttcttcaatgtgggacgtccctctgtgcgtgaagcgttagctgcgctgaagcgtaaaggtctggtgcaaatcaataacggcgaacgcgcccgcgtctcgcgcccctctgctgataccatcatcagcgaactgtcgggtatggcgaaagattttcttactcatcctggcggcatcgctcactttgaacagctacggcttttctttgaatccagcctggtacgctatgcggcggaacatgccaccgacgagcagatcgcgttgttaacgaaagcgctggaaattaatagccagtcgctggatgacaacgcgctgtttattcgttcggatgtcgagtttcaccgggtgctggctgaaattcccggcaatccgatctttatggctattcatgttgctctgctggactggctaatcgccgcccgcccaagcgttcccgatcgtgagctgcatgaacataataacgtgagttatcaacagcatattgtgattgttgatgccattcgccagcgagatcccgataaagcggatcgcgctctgcaaacccacctcaatagcgtttccgctacctggcacgcactcggtaaaaaaagtcaaaaaatgcggtag

SEQ ID NO: 6057 - DNA, 783 bp, Salmonella enterica serovar Dublin CT 02021853
atgaacgcatttgattcgcaagcagaagattcaccgacatccctcgggcgtagtttgcgccgccgcccgctggcgcgtaaaaaactgtctgaaatggttgaggaagagctggagcagatgatccgccgtcatgagtttggcgagggagaacagctaccgtctgaacgtgaattaatggccttcttcaatgtgggacgtccctccgtgcgtgaagcgttagctgcgctgaagcgtaaaggtctggtgcaaatcaataacggcgaacgcgcccgcgtctcgcgcccctctgctgataccatcatcagcgaactgtcgggtatggcgaaagattttcttactcatcctggcggcatcgctcactttgaacagctacggcttttctttgaatccagcctggtacgctatgcggcggaacatgccaccgacgagcagatcgcgttgttaacgaaagcgctggaaattaatagccagtcgctggatgacaacgcgctgtttattcgttcggatgtcgagtttcaccgggtgttggctgaaattcccggcaatccgatctttatggctattcatgttgctctgctggactggctaatcgccgctcgcccaagcgttcccgatcgtgagctgcatgaacataataacgtgagttatcaacagcatattgtgattgttgatgccattcgccagcgagatcccgataaagcggatcgcgctctgcaaacccacctcaatagcgtttccgctacctggcacgcactcggtaaaaaaagtcaaaaaatgcggtag

SEQ ID NO: 6058 - DNA, 783 bp, Escherichia coli O157 H7 EC4115
atgaacgcatttgattcgcaaaccgaagattcttcacctgcaattggtcgcaacttgcgtagccgcccgctggcgcgtaaaaaactctccgaaatggtggaagaagagctggaacagatgatccgccgtcgtgaatttggcgaaggtgaacaattaccgtctgaacgcgaactgatggcgttctttaacgtcgggcgtccttcggtgcgtgaagcgctggcagcgttaaaacgcaaaggtctggtgcaaataaacaacggcgaacgtgcccgcgtctcacgtccttctgcggacaccatcatcggcgagctttccggcatggcgaaagatttcctttctcatcctggtgggattgcccatttcgaacaattacgtctgttctttgaatccagcctggtgcgctatgcggctgaacacgccaccgatgagcaaatcgatttgctggcaaaagcactggaaatcaacagtcagtcgctggataacaacgcggcattcattcgctcagacgttgatttccaccgcgtgctggcggagatccccggtaacccaatcttcatggcgatccacgttgccctgctcgactggctgatcgccgcacgtccaaccgtggctgatcaggctctgcacgagcataacaacgttagctatcaacagcatattgcgatcgttgacgcgatccgccgccacgatcctgacgaagccgatcgtgcgttgcaatcgcatctcaacagcgtctctgctacctggcacgccttcggtcagaccaccaacaaaaagaaataa

SEQ ID NO: 6059 - DNA, 456 bp, Pseudoalteromonas atlantica T6c
atgagctttaccgggcgcgaccaaacctttactgacaccacaataaccaacaacgggtttttacccgacgtgagcataggcgactttcaagaaaactaccgtgtggccaacgaatacggcctaggtgcagtcaccgaaagcctagagctggccatgattgaaatgaatggccggttaaaaaaacgcttagccgaatgggaattggcagggtacgccagcctaagcgacgtgcccgaacaagcgataccaaaccaataccaaaccttgtatttggccgccgtcatgcactgggcaaaaagtgagttgatccgcaggaacataagcgtgaccacacgcaaagtcagtgacgtaaccggcaccgtggccgagccaaatgaaatttggtacagacgcagagccgaccaatacgcacgccaattaaccgggtcaaccggcattacctgtgtgttgctgtaa

SEQ ID NO: 6060 - DNA, 462 bp, Shewanella sp. MR-7
atgagcggattcggatttaaagcaccagcagaagaaagcatcgttattgatgcggctagcggctggcccgaattatcaacgggcgaatttcgcgaactgcgccgcatccctgagttcttttcagaaaaaaccattgaagactcactcaaccgcagcgtcgccgaaatccagcagcaaattattaattatgtagggcaggcaagcactgacacagacgtccactttaccctaggcgctagcctagcgcctaattttagtgcgcagcaaattagcatttaccgcggggctgtgtacgctcgttcccatgccgatttgctgggttatttttctgccgtcgaccaaaaagacgcaggcaacaacaaagcccaagacgttgaccagcaacaggcgatactcgcgcaatctaatcgcgccgtgcgcctattactcggccttggccgcgccggagtgcacgcgctatga

SEQ ID NO: 6061 - DNA, 456 bp, Desulfovibrio vulgaris DP4
atgagcttcaatgccctcaccgacaagacttcaacccgcatcgtggcgggcgacggctggtggcccgacctttccgtgggcgagttcatgggcaactaccgcctgcccgccgaatacgccgaagacatggtcgaagaccacatcgccatcgcccggctgtgggcggtgcgacagcttgccgcatggcgtgccgggcagcaggcggcaggccacgccagcatcgacaccgtgcccgtgtgcggccttgcgggcgaggccacgcgcctcttcaagcgggcggtgttctgccatgccaaggccctgctgctcgggcagttcgtcactgtggaacggcgcgaggccgcccgcgacgcgggcaaggagacgcccgacatcaccgccatgttctacgcatgggcgcacgacgccatagccgacctgctcggcaacgggcgcgtctctgtggggctggtgtag

SEQ ID NO: 6062 - DNA, 462 bp, Shewanella baltica OS155
atgagcggattcggatttcaagcaccagcagagccaagcatcgttatcgatgcgggtagcggctggcccgaattatcaacgggagaatttcgcgaagaacatagaatcccagaatttttttcagagcaaaccatcgccgactcactcaatcgcagcgtggaagaagtccagcgggagattattaactttgtagggcaggcaagcactgacacggacgtcccattcacgttaagcatgggccttgtgcccaattttaacgccaagcaaatcagcatttaccgcggcgcagtgtattgccgttcacattctgatttgcttggacatttttctgccgttgaccaaaaagaagcgggtaacaacaaagcccaagacactaagcagcaagatgccatcctagcgcaatctaaccgcgccgtgcgtctattgctcggccttggccgtgccggagtgcactcgctatga

SEQ ID NO: 6063 - DNA, 462 bp, Vibrio cholerae O395
atgttcacaggcagcaacaccagctttcaggataccaccatcgagaacgatggattctggccaaacatcaacgcaggagatttcgaacgcctgcgtggaacgccagccgcgcaagacgatgagcgcatcgctcacgctgtggttaacgccatcgcatcggtaaacctgcaactgagtgatctgaaagccaagtacatcgccgcaggtcatgccagcgcagcagacgtgccagcgtttccaaaagtgaatgataaaaacctcatcgtcattcagtaccaaagcgccgtgtttgctcgggcaaaagccgatttactgcccgatttcgccaccgtcagccagaaaaaagaaggtgatcacctcgctgagcgatcacaagaaaccaaaaacgaactgctggccgaaagtgaacgcatcatccgcaatatgctcggcaaaaatcgcgcaagcgtggagctgatatga

SEQ ID NO: 6064 - DNA, 462 bp, Pseudomonas aeruginosa PA7
atgagcttttccggcaaacccacccacgtgatccagcaggccatccccaacgacggcttctggccggacctggacgtcgccgagttccagcgcctgtaccgcatgccggcggaatacctgctggatctgctggtggacggcgtgaccaccgcccgggcagaggtgaaccaggacctggccaagcgcaagcgcgcctggcagaccgccggggtcactcggctggaaaccgcagatccgcaggtgctgccggatcgcgccgagtacgtggcgcactacaagcgcgccgtctactgccgcgccaaggctcagctgctgggccagttcgcaacggtcaaccgccgtcccgaagccgagaacctggcgaaagaagccgaacagacccgcgagctgttcctttcgtacagccagcaggccgtccgcctgatccagggccggtcgcgcatcacggcggagctgatctga

SEQ ID NO: 6065 - DNA, 462 bp, Pseudomonas aeruginosa PA7
atgagcttttccggcaaacccaccaacgtgatccagcaggccatccccaacgacggcttctggccagacctggacgtcgccgagttccagcgcctgtaccggatgccggcggaatacctgctggatctgctggtggacggcgtgaccaccgcccgggccgaggtgaaccaggacctggccaagcgcaagcgcgcctggcagaccgccggggtcactcggctggaaaccgcagatccgcaggtgctgccggatcgcgccgagtacgtggcgcactacaagcgcgccgtctactgccgcgccaaggctcagctgctgggccagttcgcaacggtcaaccgccgtcccgaagccgagaacctggcgaaagaagccgaacagacccgcgagctgttcctttcgtacagccagcaggccgtccgcctgatccagggccggtcgcgcatcacggcggagctgatctga

SEQ ID NO: 6066 - DNA, 486 bp, Marinomonas MWYL1
atgtctctaacaggtaaaccttcacttacgacagctgcgccggttgccaatgatggcttttggcctgatttgtctttgtcggatttgatgaaccgctaccgtatcccttcagagtacgcagacgacacgatctcttggggtctatcgcttgccttggttcgagtgaacgaacagctggagcgagcaaaaaaagcggttttagtaataccgtttgagacgttcgacggctatttggaatcgtctagcgcagctgctttaaaagtgcattacgaacacgcggtttacagctatgccaaggcgtttttgctgcagcagttttctaccatgaaccgtcgtaaagaagccgagaacatggcgaaagaatccgctgaaaccgaacagtactggctagacgaaagtaagaaaagtgtcgcggcgatattgcgacatttcgtcccaggggaagaacacagtaccaaagcgaatttctttgtggggctgatttag

SEQ ID NO: 6067 - DNA, 423 bp, Vibrio harveyi ATCC BAA-1116
atgatgggctttggcggaaaagtggataaggcgagtaaccaagtgatatccggtgaaggctggcccgatttaacgaacgatgagtttcgtcaactgcgccgcattccgcatacgtttgataacgactctatagctgtggccatcacgatagcggccaacaatattcaagagaagttagtgagcctgttggtcgagggaatgccgccatcactaagcgtcgccaaaaccgccttgtataaacgagctgtgtatggccgagcacactcggaattgttacccgagttcgccacgcaagataggcgcaaagaaggggacaatgcggcgttagatgaaccgcaacaggcggcacgttttctggcgcaaagtaacaaagatgtctctcaactgcttggccgcagtgcgaatgggattggcgtgatatga

SEQ ID NO: 6068 - DNA, 453 bp, Yersinia pseudotuberculosis YPIII
atgtttaacggaaaagaaattgattatcaggatgttgagctgaccaatgacggattttggccagacctcaatttaagcgagtttcagcgtaaccgcagtattccggcggatattgatgccgatacgcaagccgatgcgttgctggccagcgtggccgaagtgaatttagacctgcgcccgttagctgcgggatacgtggccaaggggtaccaacaggccgcagcggtgccgggcgtggcgatgaacgggcaaacggcactgattagccagtataaaaaggccgtctttgcccgtgccaaagccgatttactgggggagtattcgacgcagtttagccgggtacccaatgccgggcaggaaaaccccgaaacccgcagccgcctgctggcagaggccagcacagtattgcgcaatatgaaaggtgtgggccgctgcaccgtgaggcagatatga

SEQ ID NO: 6069 - DNA, 504 bp, Salmonella enterica serovar Newport SL254
gtgtgtcattgcgccgtggaaaccggtcagtccgcctttttcgggggatttatgtttagtggaaaaccgctggattatcaggacgagccgctggccaataacggtttctggccggatctgaatctgaaggattttcaggtgcagcggtcactaccgccagatattgacgctgacaccatcagccaggcgctgcttgccgctgtcgcggaggtgaatgccgagctggaaaacgtggaggccagctggaaagcgaaaggccatacgctggcggcagatgtgccgggtgtaaagatgggcggacttaacagcctgtgcgcccagtacatgaaagccgtttttgccagggcaaaagcggatctattgggtgagttcgccactatcggacggcgtgatacccatccggggcaggaaagccaggagacacgggccgggttactggctgaggcgtccgtggtgatccgtcgcatgaaggggcttaaacgggcaacggtgaaaaaagtatga

SEQ ID NO: 6070 - DNA, 504 bp, Salmonella enterica serovar Heidelberg SL476
gtgtgtcattgcgccgtggaaaccggtcagtccgcctttttcgggggatttatgtttagtggaacaccgctggattatcaggacgagccgctggccaataatggtttctggccggatctgaatctgaaggattttcaggtgcagcggtcactaccgccagatattgacgctgacaccatcagccaggcgctgcttgccgctgtcgcggaggtgaatgccgagctggaaaacgtggaggccagctggaaagcgaaaggccatacgttggcggcagatgtgccgggtgtaaagatgggcggacttaacagcctgtgcgctcagtatatgaaagccgtttttgccagggcaaaagcggatctgttgggtgagttcgccactatcggacgacgtgatagccatccggggcaggaaagccaggagacacgggccgggttactggctgaggcgtccgtggtgatccgtcgcatgaaggggcttaaacgggcaacggtgaaaaaagtatga

SEQ ID NO: 6071 - DNA, 453 bp, Salmonella enterica serovar Agona SL483
atgttcagcggaactgcaattgattttgatgatgccattctgactaatgatggcttctggccagacctgagcgtgaaggattttcagtcccagcgtgctattcctgccgatatcgacgcagccaccatccgtcaggcgctgctgaccgcagccggtgaaatcaatgatgatctggtcagggtagtggcggattgtcgcctcagtggccatgcaagcgcggcggacgttccgggcgttgagattgacggtgaaaatctgttgtgcgcccgttaccgcaaggctgtttttgcccgcgccaaagctgacctgatgggcgaatttgcgtctgttgggcgccgtgaaagccatcctgggcaggaaagcgatgaaacccgctccagtctgatagcggaatccacgctggcggtacggcgtatcaaagggctgaaacgcatcacggtggccatgatatga

SEQ ID NO: 6072 - DNA, 465 bp, Aliivibrio salmonicida LFI1238
atgtttagtggttcatcaggcgcagactatcaagacaccgtgatcgagaatgatggcttttggcctaacttgaatgccggtgattttgaaaagcgtcgaagcattccaactgacatggattcagaaacggttgcatatgctttagcagcagcaatagcccaaataaacattgccttaattaataagaaaacggcttacgaagcggaaggcattacatcagcaagtgatgttccagggcagccaatgatagataacaaaaacttattggtgatcttgtatgagaaatcggtatttgccagagctaaagcagatttaatccctgagttcgccatggtgcaaaccaaagatgccggtgatcgagttgcagagaatgaaaccttaattacggaacgtttattagcagaaagccaacaacatattagagctatttttggtaagagccgagtaggggttgaattgctatga

SEQ ID NO: 6073 - DNA, 468 bp, Desulfovibrio desulfuricans ATCC 27774
atgagctccctgaagggttttggcattacaaccggcaaaactgccaccacagtgcttgatggggatggtttttatcctgatctggctgttgccgagtttatggagctttaccgtttgcccgccgaatacgccgaagcgctcattgcagaccatcttgaccttgcccggctttgggccgctggcgaactggccgcgtggcgtgaaaaacagcaggcatctggccacactgcccttgatcaaatttctgttcacggcatttctggcggtgcgctgcgactctacaagcgggcagtattttgccgggccaaggccctgctgttgccgcagttcgccaccattgaacgccgcgaacccgcccgcaacgatgcaaaggaagcgcctgaaagcgcgcaggcctttttcgcccaggcagccaatgccctggccgcaatcaccggacgtacctttatttcggtggaggccatctaa

SEQ ID NO: 6074 - DNA, 618 bp, Ralstonia solanacearum
atgcgcagcctggccggcgtggcggtgattgccatcgccgcgctgtcctattggatcggcgtgcagcgcctgcacgcgtcgcgcgcggaggcggcggtgccgcacagcgggcagcaagcggtggcgcagtcgggcttgccggacgggaagggcgccgccgatgctcgcgcgggacatcgatccgaccggaccgcggccaagccggccacggcagacgcccaggcgcagcccgccaccggcacggacgggccgacgccgcgcgcgcgccttgccgccttgcggccgccgctttctccggagtcggagaacgatccgttcaccgtgctgtcatggctgccgcctgcgccgcccccacccgcggcggcagcgcccgcccccgagccggcgccgccgccgagcgcgcctgcgctgccgttcgtgtacctcggcacgctcaatccggaggcggccaagccgcaggtgttcatcagcagcggggacaggctcctgatcgtttcgcccggggatgtgatcgacggggtgtaccgattcgaatcgatcgcggccacggaagcgcgctttacctacctgccgctcaaccagcggcaagtgatgtccgttcaaggcgaggggaactaa

SEQ ID NO: 6075 - DNA, 513 bp, Ralstonia solanacearum
atgaagcctgtcaaccggcgccttgcctttctgctgctggccctggccggcagtgccggactggtgctgttcggcagtcccgcaacgcaaaccgaggtggtgcagcccagccgttccgccgcgccatcccagccgccggccatgtctaccgggccggcgagcgcatccgcggaagacatgaccgtcctcgcgctgaggccacgcgaagcctcaccggacatcgcgcaggccttcccctcccgcgactgggccccaccgccgccgccaccaccgcccccggcgccgccgcccaaaccgacggcgcccccgttgccgttcgtggtgatcggcaagaaatgggaagacggccaatggcaagtcttcctcggacgcaatgaggaaacgtttgtcgtgaaagcaggcgacacgttcgacgggcgataccgggtggacagcattgtcccgccctcgatgacactcatctacctgccgctgaaagcgcggcagaccctgacgataggcaacatggaatga

SEQ ID NO: 6076 - DNA, 531 bp, Thiobacillus denitrificans ATCC 25259
atgagcctgtcgccggcaaaaagaaagatcgccctcggcgtcgcgctcgcggcgacgctcggcgcgacggtgtgggtcggcgagcaggaagacgccgcgcccgaactcgtcgcgcaggcggtgccgcggcctgccgccgagtcggccgggcggccggcgccgcccgcaagcggcccggcgatcacgcgcggcggcctcaagcgcgagatttcgcgcgagccggtgcccgacgtcttcgccgcgaaatcctggtacgtgccgcccccggcgcccaagtacgttccgccgcctccacccccgccgccccccgcgccggtgccgccgccattgcccttcgtctatctcggcaagctcgtcgacaacggtgaaatcacggttttcgtcgtgttcaagggccgcaatctcgccgtcaaggccaacgaggtgatcgattcgacctaccggatcgacagtgtcgacgcacgcagcatggcgctgacctacctccccctggacatgaagcaaaccctctccctcggagaaagaaattga

SEQ ID NO: 6077 - DNA, 525 bp, Thiobacillus denitrificans ATCC 25259
atgaacgataaacgccggcgtttgctcctgttcgtcgcactcgccgcagtcgtcggctggtcgagccggcttgcactcgacgaggcggcggttgacgcggaagacgcggcgatcgaactcgcggagcccgcgcgcgtccgcgccgacgccccgcgcgccgcggcgccagccgccgcggccagcgccaaggccgagccggtaacaaaggcgcggctcgaacttgcccgtgccgacctctttccgcagcagacctggtacgtcccgcctccgccaccgcctccaccgcccgcgccgccgccccccccgcccccgcaggcgcccgcgctgccgttcgcctacatggggcgctgggacgaagcgggcaccgtcacctactacctcgcccgcggcggcgccaaacccgtgagcgtgcgccccggcgaggttttggacggcgtctggcgcctcgaaccgaccacgggtcgcacgctcagtttcacctacctgccgctgaaccagacgcgcagtctgcaaacaggagaataa

SEQ ID NO: 6078 - DNA, 525 bp, Nitrosospira multiformis ATCC 25196
ttgaaaccgacagagaaggcgcgcaggttatggctggctggagcgctgctggccacgcttctcgtggcccaatgggtgagcggagaagaaggcgaagcaggtccggaaacgcttccagattctgctgaagcaccccatttccaaaaggaagcgcctgcaggcaggaacgcccccgaaaatgaagccgctgagctggatctcgggcggttggagcgcagaaaattcagtgcccaggcaggtgacattttcggacagagatcatgggttccgcctcctcgtccggagccgccaaggcggccctctccgccaccgatgcaattcaggtatctgggcaaggttgtcgaagggaatgaaacacgcgtgtttctcgccctgggagaacgcaattatatcgtcagacctggtgagagcatcaataaccagtatcgattggatgaggtgagcgatcgcggcatcacgttcacctatcttcctcttaacgccaggcagatgcttgctactgcgggaacggcaaacattccatga

SEQ ID NO: 6079 - DNA, 534 bp, Methylobacillus flagellatus KT
atgaagcagacgccgggacagcggctggtatgggtcgcgttgaccatgacgctggctgccacggcgtggaccgccttgaatggcgaacaggctgacgaggtgcacgtcgcggcatcgcgtccgcaaggggtgagtaccgaggtaaagaatcagccgaaatccaggacgtctggcgaggcccggccagcgggtgcggactccctggacgtggcccagctgcaacgcgcgccctggcaggacagcgagcacaatttattcggcggcgggcaactcgtcgcccaggccgaaaccgcacaacaacccatcgtgcagcaggccatggaaattccaccggtcccctttacgtatgcgggcaagctggaggaccacggccaattcaccgtctttctctccctcggagaaaaaaatgtcagcgtcaagaccggcgatatcgtcggcgactggaagatcaaggaaatcaccccttcccgcatgatcctgagctatcagccattgcgtgctgatgtgccattgatgattggagaaagcaattga

SEQ ID NO: 6080 - DNA, 609 bp, Cupriavidus metallidurans CH34 uid250
atgacgcacgatctcgcccgaaagatcctgatcggcacgactggcttcgtgttggccgccgtcgtttcctggtcggtgatgcccgatccgcgcaccaacccggcacttgcagcgatcaataccggcccttcctggggcacgatgacgcggcacggcgcctccagtgatgccgcagcggccagtcacgcgcatcattccgcggcgaagcacccacccgccagcgccgccgtggcccagacgcagacccatgccgcaccacgcgagcagctggagaagctgcgcaagccgatgtccgccgagccggggcacgatcccttcacggcgtcatcgtggttgccgccgccgcccccaccgccgcctccggaaccggtcgtcgagccaccgccaacgccgccgcccctgccgttcagcttccttggtgcgctggacggcaatacgcccaagccgcagattttcctgggcaacggcgaccgcctgttgattgtctctcgcggcgacgtgatcgacgggcagtaccgtatcgacgcgattgcgaccgagagcatcacgtttacctacctgccgctcaatatgaagcaggtcctgcccacccagagcgaggggaaataa

SEQ ID NO: 6081 - DNA, 507 bp, Pseudomonas putida F1
atgaacacacaacgtgcagtcatctgggccggcttccttggcgtgagcgcggcgctggcctgggcaccggaccattggtttggccaggacgatggcgtcgcggccttcgcgggtaaacccgcgcctgcaacagaaagcgctgcgtccatggtcggcgcgggcttacccgcgaaagggccggaacaggcctcccgcgacctgttcccaacccagcaatggacgccacccaaaaccctggccacggtcaccgaacaacccgtcatgaccgcacctgtcgtcgccgcggccccgacggccccggagctgcctttccagttcatcggccgcatgggtgaccgcgacgacctgcaggtcttcctgcagagcggcgaaaaactctacgtcgtgcgccaaggcgacgtgatcgaagacacctatcgcctcgatcgggtatcggccagcgagctgaacctggtctacctgcctttgcaccagtcgcagaccttgtctgtcgggagcgcaccatga

SEQ ID NO: 6082 - DNA, 510 bp, Pseudomonas putida GB 1
atgaacactcaacgtgcagtcatctgggccggtttcctcggcgtgagcgcagcgctggcctgggcacccggccattggttcggccaagaagacgcgctggccccggtcgccggcaagccagctcccacagagactgcgggcagcgccgcttctgcgggtgcggctttggccgcgaaagggccggaccaggcctccagagacctgttccccacccagcagtggactaagcccaaagccctggccaccgtcaccgaacaacccgtggttgccgcgccagcagtagtgccagcgccaaccgctccggcactgccatttgaattcatcggccgcatgggtgaccgcgacgacctgcagatcttcttgcagagcggcgaaaaactctacgtcgtgcgccaaggcgacgtgatcgaagacacctatcgcctcgaccgcgtttcagccagcgagctgagcctggtctacctgcctttgcaccagtcgcagaccttgtctgtagggagcgcaccatga

SEQ ID NO: 6083 - DNA, 498 bp, Pseudomonas putida W619
atgaacactcagcgtgcagtggtgtgggtggggtttctggggcttgccggtgcgttggcctgggcgccggggcactggttcggcgaggaaagcgaggaggccctgatcgccggcaagccggtgcccacacaaccggtttctgagagtgccggcatgccggtgatgaagccggaacaggccacgcgcgacctgttcccccgccagcaatggactaaacccaaggccctggccactgtcaccgaacaacctgtggttgccactgcggtggtagccgctgcccccgcagccccggcgctgcctttccagttcgtcggccgcctgggcgatcgcgacgacctgcaggtcttcctgcgcagcggcgaaaaactctacgtcgtgcgccagggcgatgtgattgacgacacctaccgtctcgatcgggtttcggccaatgagctgggcctggtctacctgcctttgcaccagtcacagactttgtctgtcgggagcgcaccatga

SEQ ID NO: 6084 - DNA, 621 bp, Leptothrix cholodnii SP 6
atgaaagccgcccgccactggcgccccgccctgctgctggccacgctggccggcctgctggcgctcgcggtcggggcgcccaacgcgccgcccacctccccggcgccgacatcgacgacagcgatgacagcctcggccaccgccccccgcctggtgccggcccgcgcaacggccgcccgatcagccgcccgggccggcgcaccgacgccggccgacccgccgatcaccgggcgcgacgcggcgctgtcggcgctcgacaccggcctggtcgcgcgccgcaccgcggccggcggcaaggcgcccgatgcgtttgccgcgcacagctggcatgtcgcgccaccgcccgcgccaccggcgccggtggtctggcagccgccgccgcagcccgcgccaccgcaggcgccgccgctgccgttcaagtacctgggccggatggaggaatcgcccgagcgcaccgtctggtacctgctgcagggcgagcgcctgatcgtgaaggcctccggcgaggcgatcgacagcagctaccgcatcgacggcgccgaggccggccagctgcgtttcacctacctgccgctcggccagcagcagtccctgaccctgccgatcggagcccccccgtga

SEQ ID NO: 6085 - DNA, 528 bp, Azotobacter vinelandii DJ
atggaaaggcgacgactgctgggctggctggcgtttctcggtggcgcgggactgctggcgctgttgcccgagttcttcccgcaggaggaagaactcctggcgctggaggcgcgtcccggcggggcggtcgccaagcccgagacgcgctccggggaagtccgtcccgaagcgcacggggtacgcggcgggccggcgagcgggacgccggtgccgcaggcggatctgttcgccgcacgcagttggcgcgcgtcacgtccggcgtccgggagcgcatcaccgtcggcgctcgtggcgaggccgccggccgcgccggtggcgccgccgttgcccttcgaattcgtcgggaggctggacgacagtgttcgcctcagggtctttctgctgcagggggatcgcctgcacacggtggaggccggcgaggtgatcgacggcacctaccggctggagagaatcgccgacgacgaactgaccctcgtctacctgccgctgaaccagacccagtcgctgtccgtgggagacaatccatga

SEQ ID NO: 6086 - DNA, 213 bp, Bacillus anthracis Ames 0581
atgaagagaggtattattgaccgttttgaaggcgaactagcagttattgaagtgaataacgtaacaattgatgtacctaaatccaaactcccttccactgcaaaagagggtgatgttcttataatagaggatgatacgtatacgattgataaggacgaaacagataaaagaagacgtgaaatacaagatttaatgaataagctatttgaatag

SEQ ID NO: 6087 - DNA, 213 bp, Bacillus anthracis str Sterne; identical to SEQ ID NO: 6086

SEQ ID NO: 6088 - DNA, 213 bp, Bacillus cereus ZK
atgaagagaggtattattgaccgttttgaaggcaaactagcagttattgaagtgaataacgtaacaattgatgtacctaagtccaaactcccttccactgcaaaagagggtgatgttctaataatagaggatgatacgtatacaattgataaggacgaaacagataaaagaagacgtgaaatacaaaatttaatgaataagctatttgaatag

SEQ ID NO: 6089 - DNA, 219 bp, Moorella thermoacetica ATCC 39073
atgcgccgccacgaattgctggttattgaccgttttgaagatgatatggccgttatcgaatacggccagcgcacctttaacctcccccgttccctcttgccccgggccgccaaagagggtgatgtaattaagcttgccgtcgtcttggacccggaagccaccgccaggcgcaaaaaagaagtccgctccctggcggacgaggtgtttgagaagggataa

SEQ ID NO: 6090 - DNA, 213 bp, Clostridium thermocellum ATCC 27405
atgagattaattgtggatagatttgaaggcgattttgccgtatgtgaaaatgagaacaaagaaatgatcaatgtttgcaggtcagaacttccggcagatgtaaaagagggagatgttctgctgaaaatgaatgacaaatatgtaattgacactgcggcaacagaggaaagaaagaaaaaaatatcaagaatgatggatgagctttgggaataa

SEQ ID NO: 6091 - DNA, 255 bp, Herpetosiphon aurantiacus ATCC 23779
atgcttgtagtttttgatcgctatgaaggtgagcatgcggtattaattgatcagcataatcaccaaatctataatattgtcatcggttgcttaccagcatcagcccaagttggcgattatcttgatctcagtttcgatactgccaaccagccccaattaatcctagcccctgaacaacgtcaagctgctgagcaacgaattacagcaaaattggagcgtttgcgccgtggcgatcatttagcaaataattcttaa

SEQ ID NO: 6092 - DNA, 213 bp, Clostridium phytofermentans ISDg
atgaaatatataattgacagatttgaaggaacctacgcagtctgcgaggatgagatgaaaaatatggtaaatatcccaaagtataaacttccaatggaagtcaaggagggagactcccttattgatgacgacggtatcattcgaatcaatgataaagaagcagatgagcgtcgtaaaaaggtcaaccagatgatgagtaagttatttaaataa

SEQ ID NO: 6093 - DNA, 222 bp, Thermoanaerobacter sp. X514
atgcctaaaaaaaatgaaatttgtgttatagatagatttgaaggagattgggcggtcatagaatggaaagataagatttttaatttccctcgggaattacttcctaaggaggtaaatgaaggagacgtactgatatttaatgtggatgtagataaaagcgaaacagaaaagcgcaaaaaggctattgaagatttggcgaaggacctatttaaagatgaataa

SEQ ID NO: 6094 - DNA, 213 bp, Bacillus cereus AH187
atgaaaagaggtattattgaccgttttgaaggcgaactagcagttattgaagtgaataacataacaatggatgtacctaaatccaaactcccttccactgcaaaagagggggatgttcttataattgagggtgatacgtatacaattgataaggacgaaacggataaaagaagacgtgaaatacaagatttaatgaataagctatttgaatag

SEQ ID NO: 6095 - DNA, 213 bp, Bacillus cereus AH820; identical to SEQ ID NO: 6086

SEQ ID NO: 6096 - DNA, 213 bp, Desulfitobacterium hafniense DCB 2
atgaaaggaattattgatcgttttgaaggtgagtttgcggtgattgaacaagaagatcgggttatcatcaatgttccccgtcatgctctgcccagagaagccaaggaaggggacagtttggttttaagcaatggagagtatctgattgatccttccgaaaccgcaaaaaggaaaaaaagaattgaagaattaagtcgagaattgtgggaatag

SEQ ID NO: 6097 - DNA, 213 bp, Halothermothrix orenii H 168
atgataatcatcgatcgttttgagggggaaaaagtcattctggaatatagcaataatcagggaaaaattataacctttgcggttcctgctaatgtccttccccgtaaagctaaagaaggagatattttaaatattataatagacaacgaactaacgaaacaacgcaagaaaagactggagaaaataaaagataacctctttgaaaataactaa

SEQ ID NO: 6098 - DNA, 276 bp, Atopobium parvulum DSM 20469
atgaaagcaatcattgatcgatttgaagacaacaaccttgccgtgcttgagctaaatgatcaatcaggcaatatgcttaccatttctcgccacaagcttccaagtaacgcttgccagggtgatattctttactaccaagacggtgtgtggacgatagctgaggaagagacaacccaacgtcaaaacgatatcgatgagctgttcaactccttgcttgtgcgcgatgataacgaagatgattcctaccaagatgacgcatattcaaaggacgagtag

SEQ ID NO: 6099 - DNA, 201 bp, Desulfotomaculum acetoxidans DSM 771
atgttaattatcgacaggtttgaggaggatcaggcagtgattgagttcggtgacaggctttttgtcataccaaaacttttctttcctttggatgctaaggagggcgatgttattaagcttaagataaccgtggacagggaggctacaagcagtagggcaaaaataataaaaggcttatcagaggagttatttgatagctaa

SEQ ID NO: 6100 - DNA, 693 bp, Shewanella oneidensis
atgattaaacatcacccccatgcagaattacttcaggcccatgcacaaggtgaactccccttgtcgatgtctatggccgtcgctgcccattgtgccttatgtcaagaatgccaaaatcagattgctaaattaactgaacaagcggccaaacttgcttttgtttcctccagtgatgatccggttcaacacaacgcttcaaacgagattgatgtcgtcgataatgacccatggcaacaaatgttatcgaacattatggcgcttcccgaaagcacaatgagtgaaccctacatagaatcttcagtgacggttagccatagaaatatccgctaccaaatccctagggtttttcgtcagcatattgcactaccatggcaacaaattggcaaagtcagtcggatgcgattcgatattgacgaaaaaaatacccgcgccagtttattatatatcgaagccttaggtgaaattccacagcatacccataaagggtttgagttaaccttactattgtcaggcgaattttcggattcgacaggtaattatgtagtcggtgactttattattttagatggtaatactcagcattcacccacaactcaaacgggatgtttatgttataccgtattggatgcaccactctattttactaagggaattagtaaactgttaaaccctatcggagagctcatttattaa

SEQ ID NO: 6101 - DNA, 663 bp, Pseudomonas syringae tomato DC3000
atgggcccactacatcatccggatgacgcaaccctgatcagctacgccgcaggggcgttgtcgcaggtcatcgcggtagtcaccgctgctcacctggagcgctgcgccgaatgccgggcacggctgcggcaggccgaacagatcggcggcgttttgatgcagcagtccatcagccgtgtggtgccgctcaaaagccggatggccatgctggcgcgcctggacgagcaggaaaccagcgtcgattcggtcatgcacgccatgccagcggccaatcatgaccctgacttgcttccccactgcatgcacgcgcatttcggccggcacctgagcacattgaagtggaaaaccctgatccccggtgttcagcgcgtcagcgctcaggggatcgaacagggcaacctcatgctgctgaaaatcgcacccggcgtcagcatgccggtccacagccatgaaagcggcgaaatgaccatggtgctcaagggcgcttatcacgacgtgcagggtgaattcggactcaacgatgtggccgatctggacagccacatccagcaccagcccatcgcctaccctgatcgggaatgcatctgtgtattggcggcagagtcaaagctgcgcttccacggctggatggcgcggatgatgcagccgtttttcgggatttga

SEQ ID NO: 6102 - DNA, 663 bp, Pseudomonas syringae pv B728a
atgggcccacaacatcatccggacgacgccacgctggtcagctatgccgcaggagcgctgtcgcaggtcatctcgttagtcactgccgcgcacctggagcgctgcgccgagtgccgggcgcggctcaggcaggccgaggccattggcggtgtgttgatgcagcagcacaccagcagtgtggtgccactcaagggccgatcggccatgctcgcgcggcttgacgagcagcaagcggggctcgtacccgctatgcattcgatgccggcggccaatcaggacccggacctgatgccggtctgcatgcaggcgcattttggtcgacacctgagcacattaaagtggaagaccctgatccccggcgtaaaacgtgtacgcgctgaaggcatcgaacagggcaacctgatgctgctgaaaatcgcccccggcgtgagcatgccggtgcacagccacgaaagcggcgagatgaccatggtcctcaagggcgcgtattacgacgtacagggagagttcggactcaacgatgtggccgatctggacagccatatccatcaccagcccattgcctaccctgaccgggaatgcatttgcgtgctggccactgaatcgaagctgcgttttcaggggctgctggcgcggatgatgcagccgtttttcgggatttga

SEQ ID NO: 6103 - DNA, 687 bp, Colwellia psychrerythraea 34H
atgattaaccatcaccctaaatttgagcttattcaagcgtttgtaaatggtgatttacctgcatctttatctgctggtatcgctattcatgcagatatgtgtccggtatgtcagcaaacgatcgcccaatttactgaacaagtggctgaaaatagttttgaagaagaatacttagatagattcatcattgatgacaatgaagcactagaagcgattgcaacaatagattttgatcacatgatagataatattgttgaatcttctgatatcgctgttgttgtaccaaaagtagaaaaaacagtcagttttaatgatactacttacactcttcctgcagcattaaatagtatggaaatgggtaaacatgctcaaattggtaagttaacgagagctcgaattcagttgaatgaaaatgaaatccatagcagtttactacatatacagcctggtggaggcgtacctgaacatacgcataaaggttttgagcttacggtgctgttagcgggatcatttcatgatgaaagtggtgagtatgttaagggggattttatcatgcttgacagttctcatcagcatcatcctatttctagcaatggttgtctttgttataccgttgctaatgatgcactacactttacccatggtattaataagttgcttaacccaataggttctttcatatattag

SEQ ID NO: 6104 - DNA, 660 bp, Rhodopseudomonas palustris HaA2
atgacggtgcggcatcacatcggcgacgatctgctgctgagctacgcggccggcacgctggacgaagcctcgagcctgctggtcgccacccatctcgcgctgtgcccggcctgccgcgcccgtgcggcggcggcggacgacctcggcggcgcgctgctcgacgccttgccggcggcggagttgtcgcccgggctgcacgacgccgtgctggcgcggctccgcgccgaacccctggcggcgccggcgccggcgacgccgctgcggccgcgctccgagatcgtgattccggagccgctgcgcagctatctcggcggtgatttcgagacactgcgctggaccaagctcgcgcctcgggtacaccagatcgcgatcgaccttccgaactgccggccgcgcgcgcggctgctgcggtttcaggccggcacccgggtgccggcgcacagtcatgccggccgcgaactgacgctggtgctgagcggcagcctgtgtgaccgcgacgcggtgctggcgcgcggcgacgtcgccgagaccgacgagcacaccgagcatcagccccacgccgggcccggcgacgactgcatctgcctcgccgtcaccgacgcgccgctgaggttcaagggcgttttggcccggctgctgcagccctggttcgggatctag

SEQ ID NO: 6105 - DNA, 642 bp, Jannaschia CCS1
atgactgaaatgaaccactccgtccccgacgacatgctgatgggctatgcgtccggatcgcttgcgaaagccttcgatctggtgctggcgacccatgtgtcgctgaacgatgacgcccgcgcccggctagagacgtttgaagcgcttggcggcgcgatcctctgcggcatggacaccgttgatgtagacgacgacagcctggaacagacgatggccaagatccgtggcaatgcgccaattgaacggcccgcgccgtccgagggcctgttcccgacgcccctgcaatccatggtcggtggcgatgtggatgccgtgcgctggcgcagcgttggcggcggcgtgaagcaatgtgtgctgcattccgatgacggcggcaccgtccggcttctgtcgattgcggcgggccgggccatgcccgcccacagccaccacggaacggaaatgacgcttgtgctgcaaggcgcgtaccgggacgacgacggcatcttcgcccggggcgatctggaactggcggacaccgacaccaaccaccagccagtggccgagcccggtcaggattgtatctgccttgtggccaccaacgccaagctgaagttccagggcctgttgccgcgcattgctcagcccttcctcggcatctga

SEQ ID NO: 6106 - DNA, 672 bp, Saccharophagus degradans 2-40
atggccaactttcacccaagtgacaacacattaatagaatactccgcaggtaacctacctgccgcactagcaatttgcgtagccgcacacctagaatattgcccccaatgcagccaccgcgctagccaactcaattcgctgggtggcaccctgctagaaaccagcgcaaaagctcaagtggccagtactagctttacccaattaatggctcgcattcaagctgcgcccactatgggcgacatcaaagcgcctgtggctacagcaacaaaaacaagtgctaagccaaacttgcccaaagtaataaataagcttattcaccccgcaaggccactaaaatggaagcgagtatcacccgcgttaaaagaagccattgttactgtaggccaagatcaatatgaagtgtgttttcaccgcataaaacgcggcggcaaggtggcggagcacgaccatggcggcacagaaatcactgttgtattggaaggaagtttttctgatgaactaggcacctacacggtaggcgactatatagaaaagcaaccgggagacattcaccgccccatggccacccaaaatgaagactgtttatgcctgtctgtaagcgaagccccagtaaaaataactggtttgctgggtaaattaattaacccgttcatttcttttgcaccgcgctaa

SEQ ID NO: 6107 - DNA, 675 bp, Shewanella denitrificans OS217
atgaatatcatgattaattaccacccgcacaagccagtattaacaagttttgttgatggagacttgcctgcatccattagtatcatgattgccagccacgtggagctttgcgcccaatgtaaaacgcaagttcagctgttgacagatcaagccgccatggtccaattcgaatccaatgccgaagactttgatacttcagacatggatttagatgctttggctatgatagatactattacccaaataacggcagataatcacgactccctgcctcaaactgtgactgaaatcgccattgcagggcagcggatccccttacccagagcccttaagtctgtggcactaaaaccctggcaaggtctagggaatttatcccgtgcgcggctcgaccttcaagacgatgagcggcgtatgagtctgctgtatatcgcacccggtggcagtgttccccgtcatacccatcaaggttttgaaattaccttgttattacaaggaagttttgaagatgaaatgggccagtaccacaccggcgattttatctggctcgatggcaaccacacccatcaacctgccaccgcagatggctgcgtgtgtttgaccgtttccagtgatgccattcgtttcactcaaggcatgagtcagttgcttaatcccataggtaaatttatttattag

SEQ ID NO: 6108 - DNA, 657 bp, Rhodopseudomonas palustris BisB5
atgacggtgcggcatcacatcggcgacgacctgctgctgagctatgcggcgggcacgctggacgaggcctcgagcctcctggtcgccacccatctcgcgctgtgtccgcactgccgcgcccgagccgcggcggcggatgatctcggtggcgcgttgttcgaggacctgccggtggccgagctgtcgcctgggttgcgcgacgcggtgttggcgcggctgcgcagcgaatcagtcgctgcgcccgcgacgaggccgcaccggccgcgctccgacatcgtcatcccggagccgctgcgcagctatctcggcggcgacctcgacacgttgcgctggacgtcagtggcgccgcgggtgcagcagatcgcgatcgatattgcgaactgcgggccgcgtgcgcggatgcttcggtttcagcccggcacccatgtgccggcgcacggtcacgccggccgcgaactgaccctggtgctcagcggcagcctgtgcgaccgcgacgccgtgctggcgcgcggcgacgtcgccgaaaccgacgaacataccgagcaccagccctacgccgggccggacaaggattgcatttgccttgccgtcaccgacgctccgctgcgattcaaggggatgttcgcccggatgctccagccatggttcgggatctag

SEQ ID NO: 6109 - DNA, 636 bp, Ruegeria sp. TM1040
atgacgggtattacgcaccatatccctgacgagttgctgatagcctacgcggcgggcagcttgacaaaggcgttttcacttgtggtcgccgcgcatgtttccatgtgtgacgaatgccgcgcgcgccttggcgcgcatgaggcgctcggtggcgcgctccttgatgatatgcccgtggccgaggtttcggcggatatgaagggacggctgtttgacgcgctcgacgatccggttgcccgagaaaagcgctatgaccgggcggggatttttcctgcacctgtcatggaagccttgggggggctgccgccaaagtggaagcccctcgggctcggtgtgcggcagatgatcctcgatcatgatcgcagtggcagcgtgcggcttctctacattccggctggacaaggggttccggatcatgggcacaacgggctggaattgaccttggtactgcagggcgcgttttatgacgagaccggacattttggtgtcggtgatctggaggttgcagatggggatctggaacatgaacccgtcgctgctgatggtcctgcttgcatctgtcttgctgcgacggatgcctcgcttcggttccgctcttttgtgcctcgccttttgcagccgattttccggatctga

SEQ ID NO: 6110 - DNA, 672 bp, Pseudoalteromonas atlantica T6c
atgattaattttcacccagatttggcgcatcttcgcgctttcgctgaaggaacctgcccaacaaatttagctttgatgatatccgcccacgtagatatgtgccctcgctgccaagcaataaccatgcaggcacaagaagaggtgggacttgaggtttttccaaccaacctagaagcggttgaaccacaacctgattttaacgatatgatgttgcaaataatgcaaactcccaacgttgaagctccggttcttcagcccgttaataacatgcttgagttggatggaaagcactttgccctgccaagagcgcttgctcgatacacccacaaaacgggtaattggtcacggcttgtaggtaagctatggcaggcgccggttgatttaggtcaggtcggacaagctaacttcatctacatggaaaagggcggcaaagtaccagagcatactcacaagggaaccgaatttacgttagtgattgatggtcaatttagtgatggattagctgattacgattgcggagacttcactatcatggatagcaccaagaagcatatgccgttttcagaagctgacgagggatgtttggtgtttactatggtggacaagccgttacattttacgtcaggcttagcccgtcttttgaatccgttcagtcaattatttttcaaataa

SEQ ID NO: 6111 - DNA, 675 bp, Rhodospirillum rubrum ATCC 11170
atgaccctgtcccaccacccgagcgaaagcctgctcgccgcctatgcggcgggagtcctgggcgagggggcgagcctgatcgtcgccgcccatctgaccctctgcccgcattgccggggtgccgtcgaccatctggaggccctgggcggggcgcttctcgaggagatggcccccttggctttggccgagggcgccctcgacgccgttctcgcccgcctcgacaccccggccgccccgtccccgacccgcgccacggcttcccgcctgccgccgcccatgggcgaggcggccctgctgcccgcccccttgcgccgtcaccttgccgatccttcggccgccaccttgccgtggagggcgatcgccccgggcatccggcagattgccctgttgccgcgcaccgccggcggaggcaatgcccatttgttaaagatcgcccccaagaccgcccttccccggcacggtcaccatgggcaggaatacaccctggtgctggcgggggcctttcaggatcgctcggagcgcttcgcccggggggatgtcgccgaggtcgaagccgacagggtccaccaaccgatcaccgacggccaggattgcctgtgtctggtcgtgacagaaggccctttgcgctacatgggcatgatcccgcgcctgatgcagcccttcaccggtttctaa

SEQ ID NO: 6112 - DNA, 696 bp, Shewanella sp. MR-7
atgattaaacatcatccccataccgatttattgttggcccatgcacaaggcgagctgccgttgtctatgtcaattgccattgcggctcattgtgccctttgccatgaatgccaatcgcaagttagccgctttacggagcaagcggcagaactggcctttttagcgccgagcaacatcactgaacaagctttaatcagcgaaaccgattcagcacaagacgacgcttggcagcaaatgttgtcgcatattatggacttacccgaagcaacgccagttgaaagcgactatcctgccaaagcgacggtttcccttaatcataaacatgtgcgctatgagatcccgacagtatttcgccaacatattgctcatccgtggcaacagattggtaaagtcagccgaatgcgtttcgatgtggatgaaagccatacccgcgccagcctattgcatatcgacgccttaggtgaaatcccgcaacacacccataagggatacgagctgaccctattattggcgggggaattttcggacctcaacgggcagtatgttcccggcgatttcatcatcttagatggcaacacgcatcattcacctaaaacccagtctggctgcctctgctacacagttttagatgcaccgttatattttaccaaagggctcagtaaattattgaatcccatcggtgagctgatttattaa

SEQ ID NO: 6113 - DNA, 642 bp, Rhodobacter sphaeroides 2 4 1
atgacgatccggcaccatgtttccgacgccctgctgaccgcctatgcggcgggcacgctttccgaagccttctctctggtggtggccacgcacctgtcgctctgcgacgagtgccgcgcccgcgccggcgcgctcgatgcggtggggggcagcctgatggaggagacggcgccggtcgcgctctccgagggcagcctcgcctccgtcatggcccagctcgaccggcagatccagaggccagccccggcgcgccgcgccgatccgcgcgcgcccgcgccgctggccgattatgtgggcaggcggctcgaggacgtccgctggcgcaccctcggcggcggcgtgcggcaggcgatcctgccgacgggaggagaggccatcgcccggctgctctggatccccggcgggcaggcggtgccggatcacggccaccgcgggctcgagctgacgctcgtcctgcagggcgccttccgcgacgagaccgaccggttcggcgccggcgatatcgagatcgcggatcaggagctggaacatacgccggtggccgagcggggcctcgactgcatctgcctcgccgccaccgatgcgccgctgcgcttcaacagcttcctaccgaagctggtgcagcccttcttccgcatctga

SEQ ID NO: 6114 - DNA, 696 bp, Shewanella sp. MR-4
atgattaaacatcatccccataccgatttactgttagcccatgcacaaggcgagctgcctttatccatgtctatcgcaatctcggcccattgtgccctatgtcatgagtgccaatcccaagtcagccgctttacagagcaggcggctgaactcgcctttttagcgccgagcaaaatcactgaacaagctttaatcagcgaaaccgattcagcacaagatgacgcttggcagcaaatgatgtcacagattatggccttacccgaatcaacgccaactgaaagcgactatcctgctaaaactacggtttcccttaatcataaacatgtgcgttatgagatcccgagagtgtttcgtcagcatatcgcccatccatggcaacaaattggcaaggtcagccgcatgcgtttcgatgtggatgaaaataatacccgcgcgagccttttacatatcgatgctttaggtgagatcccgcagcacacccataaaggatacgaactgaccttgttattagcgggcgaattttcggatcttcacggccaatatgttcctggtgattttattatcttagacgggaaaacccatcattctcccaagacccaaacaggatgcctctgttacacagtgttagacgcaccgctgtattttacaaaagggctcagtaaattattgaacccgattggagaactgatttattaa

SEQ ID NO: 6115 - DNA, 684 bp, Maricaulis maris MCS10
atgacccaacgcggtcacacgctcgatgatgcctggtatctgggctacgctgccggaagtctggcaagcgaggcggaaacagtgcttgtccagtcacatgtcgaattgaattctgatgcacaggaccgggtcgagcagctcgaccgcattggtggggtcctgctcgaccggatgccggtcggggaagcgctcccattcagtgccgatgaacttttggaaatggccgaccggagtgatccgttgcaagccggtgaaagcgtgtccgacgaggccgccaatgtccctgacgccctcgatggggtcaatctgccgccggccctcgcgcagtatctcgcccgctcgccggcccgcctgaaatgggaattcctcggtccgggtctgcgcaaatccattttgtggcgcggcaaggacggggagcggctctggttgctcaaggcgcagcccggagtcgctatcccgcatcacgggcatgccgggtcagagctgactctcgtgttgaagggcagcttctgggatggagaccaggagtatcggcgcggcgatgtcgaagaggcccatgaagatgttgaacatgacattcggatcggaacaggtggagagtgcgtctgcttggccctgacccaggggaaattgcgcttcgaaagtccgcttttgacggcttttcaggtctttaccggactttga

SEQ ID NO: 6116 - DNA, 687 bp, Shewanella frigidimarina NCIMB 400
atgattaattaccacccagatcagcatttgctgtctctccatgctaaaggcgagttgccgctatctatgtcgattgctatctccgcccatgctgaattgtgccctcattgccagcaacaacttgaccagatgactattgcgctgtctgaacaacagtttgagtcagcagtaaaaactcagtcggtagacactaatgataatcatcaattagacgcactactcgagcagctattaaattcgaccttagacactttagagattgaacaggctagtacgattgatacgattgaagataacagcgttagtattaaaggtcagcattatcctctgcctaaggtatttcgtaagcaaattaatgcttcttggcaaggtattggtaaagtcagccgcttgagactcgatactggagagccacaagcaagagcaagtttgttgcatatcgcagccaatggtgaaattcctgaacacacacacaaaggcgcagagctaacattactgctcgctggtgagttcagcgactgttacaacacctacaagccaggtgattttatgctgcttgataaagagcaccaacattcaccaaaaacacttgaaggttgtttgtgctataccattgttgatgctccgttatacttcactaaaggtttcagtaagttactaaacccaattggcgatttactttactaa

SEQ ID NO: 6117 - DNA, 696 bp, Shewanella sp. ANA-3
atgattaaacatcatccccataccgatttactgctagcccatgcacaaggtgagctgccgttgtctatgtcgattgccattgcggcccattgtgccctttgccatgagtgtcaatcgcaagtcagccgctttactgaacaagcggcagaactcgcctttttagcgccgagccaaaccactgaaccagcttttatcagcgaaaccgataccgcacaagatgacgcctggcagcaaatgttgtcgcatattatggacttgccagaagcaacgccaactgaaaacgactatctcgccaaagcgacggtttacctaaatcataagcatgtgcgctatgagatccctacagtctttcgtcaacatatcgctcatccgtggcagcagattggtaaagtcagccgaatgcgtttcgatgtgaatgaaagccacacccgcgccagcctattgcatatcgacgccttaggtgagatcccgcagcatacccataagggatacgaactaaccctgttattggcaggagaattttcggatctcaacgggcagtatgttcccggcgatttcatcatcttagatggcaacacgcatcattcacccaaaacccagtctgggtgcctctgctacacagtattagatgcaccgttatattttaccaaagggctcagtaaattattgaatcccattggtgagctgatttattaa

SEQ ID NO: 6118 - DNA, 789 bp, Shewanella amazonensis SB2B
atgattaaacatcaccccagcgacgagatgttgcttacccatgctgccggcgaaactgtgcttggtctggcgattgcgctcagcgcacactgtgaactttgccccacctgcgcagcaaaagtggagcattttcagcataaattggctatgcatcacctgccccttcccgaccaaacaagcgaggctgcacccagtggtgtaatcagtaaaagtgcgtctgaggggcacattgaccaatcaggtgtatccgctttggatagcgcttgggatatctcttgggaaagtcaggataacagccttgactcactctttgacgccattactgccactccggcagcaaatgctgcgcagatatccgcaaccgccggcaatgctgtcttgctggcaacggaggtgaagggtgtcagttattccttgcctaaagcattcaggccttttattgcaaaccctgcgctggcttcctcctggagtggtattggtcaggtaagccgtatgcgtttggatacccgggacggtaaagccagatccagcctgctgcacatcgccgctggcggcgaaattccagaacacactcataaggggcaggaaatcaccctgctgcttcatggccacttcagcgatgaaatgggagactatgcaccgggagactttatggtgaccgatacccgccaccaacacacgcccaagacacttgatggctgtctgtgttacacagtggtcgatgcaccgctgcacttcaccaagggattatccaagctgcttaatcccataggagagctgatttactga

SEQ ID NO: 6119 - DNA, 651 bp, Psychromonas ingrahamii 37
ttgattaaacatcatccaacatccgcattattagccagccatagcgctgcacaactccctctgtctttatcaattgcggtgagtgcccatcttgaaatgtgccctaaatgcgtcactgttaccagacaaataacggaacaacaatcagatctttttgaagcacaggatgtcacaaagaatatcaatttttctaatatattagataaaatttttgagcatcaacccgagcggcaggtagagcctaaaaaagtagtgatgaatagcatttctgttgccgggactgagtaccaattaccgcgtgcatttacccattttacggatcttaaatggtcttcttttggtgcaataagccgtgcgcgcgtggttaaggatacagataatattcgtgctagtttattacatatcgacaaaaatagcattattcccagccatacccataaaggttatgagcttacgctattattagagggggcttttagcgacgaaagtggtgtttataacaaaggtgatttcatctggctgaataacgaccttgaacataccccctttactaaagaggggtgtctttgttatgcggttcaagatgcgccactgcgttttgtctcgggtatcagccaggcacttaatccgcttggtcaattaatttattaa

SEQ ID NO: 6120 - DNA, 672 bp, Acidovorax avenae citrulli AAC00-1
atgacgatccatcatcatcccggagatgacctgctcctcgacctggccgcggggcggctgccgccggggccggcgctgctggcttcggtgcatgccgagatgtgcccgcagtgcgggcagcgcctgagggccctggaggccgccggcggcgttctgctggaatccctgccgccagagacgctgaggcccgacgcgctttcccgcgtgctgggggccatcgatgcccttcccggggacgatgctcgccggccgggtgcggctgccgaaccggtagctggcggccctgactggcctgcgggaacaccgtggccgcaagcgctgcgcggcgtcgcgttttcgccctggaaatggatcgccccgggcatgcgctggagccgccccctctcgccgccggccggcgacgtgaacgtgttcctgctgcgcatcggccccggccgcagcctgcctgcccatacccacggcggtttggaatggacgcaggtgctgcacggcgccttccatgacggacatgcgttgttcggcgcgggggatttcgatgccgccgatggcaacgtgcatcaccagccggtggtgcaggggccgggagactgcatctgcctggcggccgtcgatggccgcctgcgcttcgacggaatgctggcgcggctggcgggcagcctggtgggcatgtag

SEQ ID NO: 6121 - DNA, 639 bp, Marinobacter aquaeolei VT8
atgacacggcaccatcccgacagcctgagtctgatggagtacagtgcgggcaacctgagcgagccccatgcactgtgcatccgcctgcatctggagcagtgcccccactgccgtagccgggtagatactctgaacagcctgggcgctgtcatgatggatcaccagccaaaggtgacggtggctgattcgagctttgagcaactgatggcgcgtatcgatagctccccgcaagcatcatctccggtggtcccccagccaaaggtgagccctctgcagaaactgctcggggatgacatcaatgcgctgccctggaaacgtcagcttgcggacgtgagtgtgctcgacattaccgacaagtttcccggccagaacgagagggtcgtcctgcaaaaactggtagcgggcggcaaggcgccggcccatacccaccgtggcgatgaaaccacgattgtgctgcaaggggcatttgccgaccagaagggcgtattcaatcagtgggactttgtggttctgaacgaacaggacgaacatcgtccggtggccgtcggttgcgaagactgcattacgctgtcagtgctgagcgcccccctgaagctgaccgggaccttcacccgcctgctcaacccgttcctgcgttaa

SEQ ID NO: 6122 - DNA, 732 bp, Shewanella baltica OS155
atgattaagcatcatccccaacaagaattactcgtgagccatgcgaatggggtcttacctttatcgatggccattgcagtatcagcgcattgcgcattatgtgagacgtgtcgtgagcaactagccctattaaccgagcaagctgccaattcggcattaaatccagatggcgctcatgctcatgctgcaaagcagcatataggccaagagttgattcacactgcacatattgatgctggaaacactcaagcgactaatgtaccagtgatggatattgacgatatgctggcgcaaatcatggctcagcctgcggcgacggatgtgcctaataatgctcctctagatgttcaagtaaaacaacagcattacacagtgccgtcggtgtttcgccagcatttggcccgtccttggcaaatcttaggcaaagtcagtcgtatgcgttttgatgtcgatgaaatgaacacccgcgcgagcttattacacatagatgcgcaaggtgaaatcccccaacatacccataagggctatgagttaaccctattgttagcgggagcgttttcggatcttaacggtgactatgtgccaggtgattttattgtgctcgatagccaacatcaccactcacctaaaaccgttgacggttgcttatgctacacagtgttagatgcgccgctgcattttaccaaaggcctaagcaagttgcttaaccccataggtgaactgatttattaa

SEQ ID NO: 6123 - DNA, 642 bp, Rhodobacter sphaeroides ATCC 17029
atgacgatccggcaccatgtttccgacgccctgctgaccgcctatgcggcgggcacgctttccgaagccttctctctggtggtggccacgcacttgtcgctctgcgacaagtgccgggcccgcgccggcgcgctcgacgcggtggggggcagcctgatggaagagacggcgccggtcgcgctctccgagggcagcctcgcctccgtcatggcccggctcgaccggcagatccagaggcccgccccggtgcgccgcgccgatccgcgcgcgcccgcgccgctggccgattatgtgggccggcggctcgaggacgtccgctggcgtaccctcggcggcggcgtgcggcaggcgatcctgccgacgggaggagaggccatcgcccggctgctctggatccccggcgggcaggcggtgccggatcacggccaccgcgggctcgagctgacgctcgtcctgcagggcgccttccgtgacgagaccgaccggttcggcgccggcgatatcgagatcgcggatcaggagctggaacatacgccggtggccgagcggggcctcgactgcatctgcctcgccgccaccgatgcgccgctgcgcttcaacagcttcctgccgaagctggtgcagcccttcttccgcatctga

SEQ ID NO: 6124 - DNA, 750 bp, Shewanella loihica PV-4
atgattaatcaccatcccaactctgatgttttggcgcaatttgtcgcaggtaccttaccagcatcggtatccgtactggtcgccagccatgtggagctatgtagcgagtgtacccgcgcggtgcaggccctcaccgaacaggccgccatcgacgccttcggcgagtctagtcaagaagccttacgagatgcgtctcaacccgctggcttagcggatgtttctggcttggacgattttgatggcttggacgattttgatactagcgaccagttcggcgactcagacgagtttgctgattgcattaacgccatcacggccctggagcgcgacgatacgcagcagttgccgcaaaccgtcaccgaaattgccgtgggcggcgagcgtatcccgctgccgaccgcgcttaggtctatcccccttaaagagtggcagggcatgggcaagctatcccgttcgcgcctggcgctggacgatggcgatctcaggatgagcctgctgcacatagacaaaggtggcagcgtgccttgtcatacccacaaagggttcgagatcaccttgctgctgcagggcagcttcaccgatgagatgggcgaataccgcaagggcgatttcatctggctcgacggtcaacacacccatcagccggtgacggagaagggctgcgtctgtctcacggtatcgagcgacgccattcgtttcacccaaggggtgagccagctgcttaacccaatcggacgattcatctattag

SEQ ID NO: 6125 - DNA, 708 bp, Shewanella putrefaciens CN-32
atgattaagcatcacccaaatcaacaactattgcttgcccatgtaaagggcgagttatctttatcaatggctattgccgtttcagcccattgtgcgctgtgtgatacctgtaaaacagctgttgctcaatacacaaaagaagccgcgtccctcgccttcaatcaagaggagatagccgatacaacagcagataaagccgacatcagtgctcacagtattgcattcatggaatacgatgttcctgaagagttgcaaaccatgttagcgcaaatactttgtcaaccagagtcaacgacgactccaagttatgaacctcttttcgtctcggtaaaaaatcagcaatactcagtaccatcagtatttcgccaacatcttgattatccttggcaacagttaggcaaagttagccgcatgcgtttcgatttagatgagatgaatacacgcgcaagcctattacatattgatgcattaggggaaattccacagcatacacacaaaggctatgaactcaccctcctacttgccggagaatttagtgatattaatggccactatgttcctggtgactttattatgctggaccagcatactaaacatgcacctaaaacactcgaggggtgcttatgttacacagtgctagatgcgcctctgcacttcactaaaggattgagcaagttattaaaccccattggcgaactcatttattga

SEQ ID NO: 6126 - DNA, 645 bp, Rhodobacter sphaeroides ATCC 17025
atgacgatccggcaccatatttccgacgcccttctgacggcctatgcggcaggctcgcttcccgaggcattctcgctggtggtggccacgcatctttcgctctgcgacgactgccgcgcgcgggcggcggccctcgatgcggtgggcgggcggctgatggaagaggcggcgccggtcgccctctccgagggcagccttgccgccgtcatgtcccggcttgaccgccgcatcgaggtgcccgcgcggcctgcccgccgcgccgatccccgcgcccccgcgcctctggccgattatgtgggcggccggctcgaggatgtccgctggcgggcgctcggcggtggcgtgcggcaggcgatcctgccgaccggaggcgaggccatcgcgcggcttctgtggataccgggcggtcaggccgtgcccgaccacggccaccggggaatggagctgacgctcgtgctgcagggcgccttccgcgacgagacggaccgcttcggccccggcgatctggagattgccgatcaggagctggaacatacgccggcggccgaggccgggatcgactgcatctgccttgcggccacggacgcgccgctgcgcttcaacagcttcctgcccaagctggtgcagcccttcttccgcatctga

SEQ ID NO: 6127 - DNA, 681 bp, Vibrio cholerae O395
atgagttatcaccctaattatgctttactcgcagcctatgctgagggcggtcttgattctgcgcatggtttggcgatttctgctcatttggaaatctgcccacattgtcgtgacttggtgcatgagattgaggcagaacttggtgagttactcaatcagcaagcggcctcttctgtcgccttgtcagacgatgccaactggcaagcgatgttcgattcgattgtggccttgccgcagcaagcggcatcgaacactcccgttaaaaccacaccggtaatggtgacggtaaacggtaagcagattgcgattcccaaagtcttagcgcgtttggttaaacctgagcagcagtggcgcagctacggtggcaaagtgttcagtttacctttgcagtcggaagataatgtacggatgaatctgatgtacatcagccaaggggtttctattcctcagcacacccataaagggtttgagtcgaccttggtgttgcacggtggttttagtgatgaaaatggtcattacgatgtgggtgattttatgcagcatgatggtcaaatctgccattcgccaagcacaccgcaagatcaagactgcctttgcttaaccgtattgactgagcctatggtctttacccaaggggtagcgcggatctttaacctgtttggcaagggactttacccgtaa

SEQ ID NO: 6128 - DNA, 651 bp, Bradyrhizobium BTAi1
atgacgatcagccatcacccgccggaagacctgctggccgactatgccactggtgcgctcgacgaggccgagcagctggtggtcggcgtccatgtcgccgactgcccacgctgccggcgcttcgtgcgtgcgatcgagcggctggccggcgcctcgatcgaggcggccgagccggtcgcggtggccgccgatgcattcgacgccgtgatggcccggatcgaccgccgcccgcaagccgcgccgcgtgtcagcgaggccgccgagcacgatcccgagctcgccgacctgcccgagatggtcaagcgctgcaagatcggcaagcggcggcgcgtggcgcccggcatcagcatgcgtccgatcatgctctccggcaccggcaagtcgcgcgccttcctgctccgttcggaacccggcgcgcgcatgctggagcatacccattcgggcagtgagctgacctgcgttctgaagggcagcttcagccatctcggcggctactacggtcccggtgacttcgactatggcgacgacgaggtcgaccatcgtccggtggtcggcgatgaaggcccttgcctgtgcctcgtcgccatgaccggcgaccttcgcatgcacggcctgctcggccgactgatcagcccgttcgtccgtctctga

SEQ ID NO: 6129 - DNA, 696 bp, Marinomonas MWYL1
atgattaactaccatccatcgattgaaatactgaccgactatgctgccggctcattaccattagcgcattctttatgtgtatctacgcatctagaacgttgccatgaatgccaacagcaaatccgcaagttggaaatgcttggttcacacctattcgatcaaactaaagccgacagccgccaacttagcaatttgaaagacagctttttcgaaaaaataaacgcacaagctgagcaaaaaagcgatctcttgaagacagaagaagagccaacagcgattgattggggtaactacaccgttccgaagagtcttcgtcagtttattaagaagagctacgatgacttaaattggatgcgtctttcaccttcatttaaaatcgctacgctttataacgaagaaggcggcgcacaaattgctctgaccagagttaaagctggtgctcacatgccaactcacactcatactggcgatgaaattaccttagttttagaaggcgctttttctgatgaaagcggagtttatcgccaaggcgattttatcaatcgtgatgccagccataaacataagccaatcgtcaccaaagacgcggaatgcatctgcctaacagtgttggacgcaccgattgaatttactggttggttaacacgactattgaacccaattattcgtcgttaccatcctcattcaagtagataa

SEQ ID NO: 6130 - DNA, 723 bp, Shewanella baltica OS185
atgattaagcatcatccccaacatgaattactcgtgagccatgcgaatggggtcttacctttatcgatggccatcgcggtatcagcacattgcgcattatgtgagacgtgtcgtgagcaacttgccctgataaccgagcaagccgccaattcggcattaaatccagatggcgctcatgctgcaaagcatatagaccaagagtcgattcacactgcgcatattaatgctgaacacactcaagctactaatgtaccagtgatggatattgacgctatgctggcgcaaatcatggctcagcctgcggcgacggatgtgcctaataatgctcctctggatgttcaagtaaaacaacagcattacacagtaccgtcggtgtttcgccagcatttggcccgtccttggcaaatcttaggcaaagtcagtcgtatgcgttttgatgtcgatgaaatgaacacccgcgcgagcttattgcacatagatgcgcaaggtgaaatcccccaacatactcataagggctatgaattaaccctattgttagcgggagcgttttcggatcttaacggtgactatgtgccaggtgattttattgtgctcgatagccaacatcaccactcacctaaaaccgttgacggttgcttatgctacacagtgttagatgcgccgctgcattttaccaaaggcctaagcaagttgcttaaccccataggtgaactgatttattaa

SEQ ID NO: 6131 - DNA, 681 bp, Parvibaculum lavamentivorans DS-1
atgagcgcccattttctacatcatcctgtccggcacccgctcggcgaggaatggctgatggcctatgccgccggcgccttgagcgaaggccagtcgctgcttgtcgcctcgcatctgagctatctcgatgataccgcgtcgcgtctcgccgtcgccgaggccgcgggcggcgcgctgctcgaggccgtcgaccccgcgcgcatggcgccggaagccctggcgaacacgcttgcccgcctcgatgaaacccggcaggaaacgaaggccgcaccgcgcgccaaggatcagacgaacgacgtccttccgccgccgctccgcgcctggctcggccgcggcgtcgatgagttgaactggagccttctcggccccggcatgaaaaaggtgaagctctggcgcggcggtccgaacgatcagcgcctctggatgctccgtgcccgtcccggcatcgaaatcccgatgcatggccatagcggcaccgaactcgtcctcgtcctgaagggcagcctcgaagacgagcacggcatcttccgcgccggcgatgtggaggaaagcaatgacgatcgcatccacagcctgcgcaccggcccggaagaggaatgcatctgcctcgccgtcaccgaaggccccacccgcttccagggctggctggcccgcgccctccagcccctcatcggcctgtag

SEQ ID NO: 6132 - DNA, 708 bp, Xanthobacter autotrophicus Py2
atgagcgtccattcccatcccggcgatgcgaccctgctgcggtatgcggcaggcacgctgccggccgggccggccctgctggtggagatccaccttcagggttgcccgcactgccgcgcggcggtgcgccggttcgaggcggtgggcggggcgctgctggacgccgccgagccggctgccctcgccgccgacgctttcgcccgcaccctggcgcggcttggacccgcccccgtgtccgggggcctgacgggcggtggcgcccggcgggatcatctggaggcggccttctccggaccggccgccgcgccgcgccttcccgaggggctggtgctgccggaaggcgtccgcctaccgcggccgctcacctcccgccgcatcggcgccatgatgccggtggcgcccggcgtgcgcgtggggcgggtgcatgtacccgaggacgggcagtccaacgtgttcctgttccagatcgggccgggccgggccattccccggcacacccacgacgggacggaatacacccacgttatctgcggcggcttcagcgacccgtccggccattacggtgccggcgacctggtggaggcggacggggacgtggagcattcaccgcgggtggatgatgatggcacctgcatctgccttgccgccttcgagggtcgcctgcgctttcgcggcctgctgggcgtggtgctgcggccgttcctttga

SEQ ID NO: 6133 - DNA, 660 bp, Vibrio harveyi ATCC BAA-1116
atgaacaaacatccagacaaaacattgttagaggcatatgcttccggaagtattgatgcagtttctggtctggtggttgccactcacctagaaacctgccccaaatgtcgagcttatgtcaatcaactagaggcggctcaggccagtttggtgaacgatataccgtctatttatgacgctgagtttgatagtatgttaaacgacattatcacttcagaactaacgtctgacagcatcattgttagagatgtcgccaaagttatggtcgcaggcaaagatttcaaactacctaaaacactgagccgtttctcagacttggtgggcgaatggaagagctatgggggcaaagtctacagtgcacagattgatctaggggaagaagcgcgcgtcaaccttatgtatataagcgaagacgtaaggattccgcagcacacgcacaaaggtcaggaatcaacgctagttttacaaggcggcttcagtgatgaggacgggcattacgaagttggagatgtacttgtacgagatgcatctgcaaaacatagcccattcaccaagcctggcgaagattgcttatgcctaactgtattgacagagccaatgatcttcacacaaggtgtggcgagaatcttcaatatgtttggcaaaggtatgtatccctaa

SEQ ID NO: 6134 - DNA, 672 bp, Dinoroseobacter shibae DFL 12
atgaccggtatcaagcaccacctgaacgacgcactcctgatggcgtattccgcgggcaccttgcccgaggcgttcagcctcgtggtcgcaacccatatctccatgtgcgatgactgccgcgccgccctggccgcccatgacgcggtcggcggggcgctgctcgaggataccgccgaggtcgagctggcgcccgaggcgctggacaaatgccttgccgcgatccaggcgctgccgcccaaagggccgatcaagctgcccaaatccatgacaaacgggtccgcgccgcgcagctccgtcttccccagcccgcttgcggaatacgtgaagggcgatgtggaggatgtgaattggcgctctgtgggtctcggggtgcgacaggcgatcctgccgacctccaaggaagcgtccgtgcggctgctctatatcccggccggggccgaagtgcccgatcacggccatcacgggaccgagctgaccctggtgctgcaaggggccttccgggacgaattcgaccggttcggcccgggcgacatcgaggtggccgacccgaatgtggaacacaccccggtggccgaagcgggggaggcctgcatctgcctcgccgcgaccgacgcgccgctgaaattccgcagcatcctgccgaaaatcgcgcagcccttcctgcgcatctga

SEQ ID NO: 6135 - DNA, 732 bp, Shewanella baltica OS195
atgattaagcatcatccccaacaagatttactcgtgagccatgcgaatggggtcttacctttatcgatggccatcgcggtatcagcacattgcgcattgtgtgagacgtgtcgtgagcaactagccctgttaaccgagcaagctgccaattcggcattaaatccagatggcgctcatgctcatgctgcaaagcatcatatagaccaagagtcgattcacactgcgcatattgatactggaaacactcaagcgactaatgtaccagtgatggatattgacgctatgctggcgcaaatcatggcccagcctgcggcaacggatgtgcctaataatgctcctctggatgttcaagtaaaacaacagcattacacagtgccgtcggtgtttcgccagcatttggcccgtccttggcaaatcttaggcaaagtcagtcgtatgcgttttgatgtcgatgaaatgaacacccgcgcgagcttgttacacatagatgcgcaaggtgaaatcccccaacatacccataagggctatgagttaaccctattgttagcgggagcgttttcggatattaacggtgactatgtgccaggtgattttattgtgctcgatagccaacatcaccactcacctaaaaccgttgacggttgcttatgctacacagtgttagatgcgccgctgcattttaccaaaggcctaagcaagttgcttaaccccataggtgaactgatttattaa

SEQ ID NO: 6136 - DNA, 639 bp, Caulobacter K31
atgagctcgcatcgtggtccctccgaggaactgctgctcgcctacgccgcaggcgtccttagctcgcccgaggcggttgtcgtcgccacccatctggcgctgcgtcccgccgccgatgcctgggtgcgccggctccagaccgtgggcggcgagtttctggaaacgacagcgcccgtcgccctctccacggaagccctgacacggaccctggcgcgtatcgagaccgacgccggcgaagttgaaaggccgcgcccggccaacgacatggccgaactgcccgaaccgctgcggcgctacgccttggggccatggcgctggatcggaccgggaatgcgcgtgcgcgacgtccacgccccgcgcgacggcaaatgccgggtcattctgctcaggatcgatccaggccgcgagacgccccgtcacacccatggtggtgttgaactgacctgcgtcctgaccggcgcctacgcgaccgagactgatcgtttcgacgtcggtgatctggaggaggccgacagcgaggtgcttcaccggccccgggtggtctccgacaagccttgcctctgcgccgtcgccctggacggcgagatccaactcgacggctggctggggcggctgatgcagccgttcgttcggctgtag

SEQ ID NO: 6137 - DNA, 741 bp, Shewanella woodyi ATCC 51908
atgattaaattacatcctaaagggccgcttctgtcctcatttgttgaaggatctttgcctgcttcgctttcagtcgtgattgctagccatattgagatgtgtcctgagtgccaaaagcaggttgaactcctgacagaacaagctgcgaatgcttgttttggtgaaagttcaacctcagctacacagtcaggcttagggccacaagtggagaggctttgcgaagagttaatggattctgacattgaagcatcactcagtggcagtgaattgtctatgttggatgcgataacgtccattaccgaggttgagcacagtgcagaaactgtggatttggcggccattatagataaagaaattgaggtttctggtgctaaatttaaagtgccaagggcgttaagaaacattgagataaaaccgtttcagggcttgggcaaactttctcgctctcgtttgaatattgaagatggcgacttaagaaccagcctgctgcatatcgataaaggaggcagtgtcccgacccatactcataaagggtttgaagtgactttgttactgcagggcagctttgaagatgagatgggggtttatcaagcgggagactttatttggcttgatgctgagcacactcaccaaccagtgactaaaacaggttgcgtgtgcctcactgtttcaaatgacgcgattcactttaccaaaggggtcagtcagttacttaaccctattggtcagttcatctattag

SEQ ID NO: 6138 - DNA, 663 bp, Rhodopseudomonas palustris TIE 1
atgacggtgcggcaccatatcggcgatgatctgctgctgagctacgcggccggcacgctggacgaggcctcgagcctgctggtcgccacccatctggcgctgtgcccgcattgccgcgcccgcgccgcagccgccgatgcgctcggcggcgaaatgctcgacgcgctgcctgcagcggcggtgacgccgcagctgtggcagaacgtgctggcgcggacgcaagaccagccggagacaccgccggccatccctgcaacggcgctgcggccgcgttccgatatcgtgatcccggagccgctgcgcagctatctgggcaccgacctcgccggcctgcgctggacacggctggcgccgcgggtgcagcagatcaccatcgacattccgggctgccgtcctcgcgcgcggatgctgcggttcgaggccggcacgcgtgttcttgaacacgggcattccgggcgcgagctgacgctggtgttgcacggatcactgtgtgacggcgctgcggtgatgcggcgcggtgacgtcgccgagacggacgagggcaccgagcaccagccgcaggccggccccgacggcgactgcatctgcctcgccgtcaccgacgcgccgctgcggttcaagagccggttcgcccggctgctgcagccctggttcggtatctag

SEQ ID NO: 6139 - DNA, 645 bp, Stenotrophomonas maltophilia R551 3
atgagctatgccgcgggcgcgctgccggcgccgctgagcattgttgccggcacgcacctggagcagtgcccgcaatgccgccagcggctgcgggatgccgaggtgatcggctcggtgctgctggagcagacgcagccgccgcaaagcggcggtgacgcgcaccggactgcacttcgcgatgcgatgttgcggcgcctgactacggagtcgcccgtcagcgttgcagcgccggtacgtccagtgccgccagagcggcctgaagcggatcccgatcatctgccggcgtcgctgcatccttacttcggcacttcgctcagtggcctgcgctggcgctggatggcgccgggggtgcattgcatccgcgccgaacagatgccttcactgatcatgctgaagatcgcgcccggcaaatgcctgcccatgcacagccatggccgcagcgagctgacccagatcctgcgcggctcctacaacgatgctctgggcttgtttgcgccgggtgacatggcggatctggatggagacgtggagcaccagccggtgacggcgccgggcgtgccctgcatctgcgtatccgcactggacgcaccgctggtgttcagcggctggctggcgcggaagatccagcgtttcgtgaagctctaa

SEQ ID NO: 6140 - DNA, 741 bp, Alteromonas macleodii  Deep ecotype
atgattaggtttcacccaagtgcccgacagctgtcagactttgttgagggcacattgtcacccgcaatatcattgatggtctcagcacattgcgatatgtgcgagaagtgtcagcgttttgttgaggtcgaaacagaacgtcttgctaaggatctcgtatctggcgcaggtgtaggtgacaagttagaggtatcgtttcaattagatgagatgctctctcagattactcaacttcctacagcaccgcaaatcgaatcaaaagcaatcaaagctaacaacgctgttgcttcaccacgcaatcaagaagcgaacatcagtcagcgcaaggctacgaatgcgatagagctagacggaagagtctttacgctacccagaacgttacatcgctatatcgataagacgggaaattggtcgagtctagttggaaagctatggcaagcgcccgtagatttaggtaaccaaggcgttgcgaacttcatttttatggggcggggcggaagcgtaccagaacatacccaccgcggcaccgaatacacgctagttatcgacggagaattcagtgacggcttaaatcgctacgatactggggattttattttcatggatggagagaaaactcacacgccaaagtctgaagacaaagacgggtgtcttgtttttagtatcgtcgaccagccactccattttacgtctggtttggcgagattgttaaacccctttagccacctgtttttcagatag

SEQ ID NO: 6141 - DNA, 732 bp, Shewanella baltica OS223
atgattaagcatcatccccaacaagatttactcgtgagccatgcgaatggggtcttacctttatcgatggccatcgcggtatcagcacattgcgcattgtgtgagacgtgtcgtgagcaactagccctgttaaccgagcaagctgccaattcggcattaaatccagatggcgctcatgctcatgctgcaaagcatcatatagaccaagagtcgattcacactgcgcatattgatactggaaacactcaagcgactaatgtaccagtgatggatattgacgctatgctggcgcaaatcatggcccagcctgcggcaacggatgtgcctaataatgctcatctggatgttcaagtaaaacaacagcattacacagtgccgtcggtgtttcgccagcatttggcccgtccttggcaaatcttaggcaaagtcagtcgtatgcgttttgatgtcgatgaaatgaacacccgcgcgagcttgttacacatagatgcgcaaggtgaaatcccccaacatacccataagggctatgagttaaccctattgttagcgggagcgttttcggatattaacggtgactatgtgccaggtgattttattgtgctcgatagccaacatcaccactcacctaaaaccgttgacggttgcttatgctacacagtgttagatgcgccgctgcattttaccaaaggcctaagcaagttgcttaaccccataggtgaactgatttattaa

SEQ ID NO: 6142 - DNA, 693 bp, Agrobacterium vitis S4
atgactgttcaccatcatgtcagcgatgaattgctgctcgattacgccaatggcagccttgccgaaggctggggcatcgccattgccacccatctcgccttgtgtcccgattgtcgccggcgccttgcgaccatggaggttactgccggggcattgttggaggccgagaaacctgttgatgccgatctcagcgtcgaccgctcctggcaagatatgcgagcaaggctgactgcctccggcgaacggtcaagggaaagcaccgtcagccgggttgaggcgtcgccggacgccacccgccgtcagcgcgatgcgatcctgccggaaccgcttcgctcctatctggggcaggatcttgatggtttgaaatggaagtcgcttgggcgcggcgcctatcacattccgatcaagacccgcgatggtgaaaccagcgtgcgtctgctgcgcattccggccggaaagccggtgccggaacatagccatggcggtcgcgaactgacactggtgctgaaaggcagcttccacgatggacaggggcggtttgcccgtggcgatctggaggaagcagatgagcagttggaacatcagcctattgctgaagacggcgaagattgcatctgcctggctgtgactgacgcccccctgcggtttaagagccgacttgtccggctatttcaaccgatcctcggtatatag

SEQ ID NO: 6143 - DNA, 1242 bp, Clostridium perfringens SM101 uid12521
atggaaaacagagttgttataactggattgggagcaattacaccaattgggaacaatgtaaatgaattttggactaatgctaaaaaaggtgtttgtggaattgatgaaataactttatttgatactagtgattataaagttaaaattgcagcagaagttaaaaactttaaagcagaggagtttatagataaaaaggaagctaagcgtttagatagatttactcattttgctcttgtagctacagaagaggcaatgaaggatgctaaattagacttaaaggatgaaaatgtagatccaaatagagtaggagttatagttggttcaggaataggtggatatggcaccttagaatcacaatttgatgttttattaactaaaggaccaaatagagtttcaccttttgcaattccatcaggaataataaacttagttgctggaaatattgctattaagtatggggcaaaaggggtatgtgaatcactagttactgcatgtgctacaggggtaagctctataggtgcagcttatagaagtataaaacatggatattcagatatagttatatcaggtggatcagaggcttctataactagagctgccattgcaggatttaccaatcttaaagcattaaatattaataatgatcctaaaagagcttcaatacctttcgataaagaaagatctggattcgttatgggagaaggcgctggaatattaatattagaaagtttagaaagcgctaaaaaaagaggtgctagaatttatggagaaattataggatatggtgcaacttgtgatgcatatcatataacttcacctgatccagaaggtgatggagctaagagagctatagaagcagctatagaagaaggaaaaataaataaggatgaaatttcatatataaatgcacatggaacaagtactcctttaaacgataaatttgaaactttagctattaaaggatgttttggtgaaaaagcttatgacataccagtttcatcaacaaaatcaatgactggtcatttattaggtgcagctggagctatagaatcagtaatatgtgttaaagctttagaagaaggatttattccaccaacaataggatataaagttcctgatgaagattgtgatttagattatgttgtaaatgaaggtagagaagcagaattaaattatgtaatcaataatgcattaggttttggtggtcataacgcatcattattatttaaaaagtgggattag

SEQ ID NO: 6144 - DNA, 1233 bp, Streptococcus agalactiae 2603
atgacattacagcgagtagtagtaacaggttacggtgtaacctcacctattggaaacacaccagaagaattttggaatagtcttaaagaaggaaatgttggtattggacctatcactaaatttgattcaagtgatttcatggtcaaaaatgctgctgaaattcatgattttccatttgataaatattttgtcaaaaaagatctgaacagatttgatatgtattccctttatgccttatatgcttcaagtgaagctattcaacatgctaatttaaatttagatgaaattgatgcagatcgatttggtgtcatcgttgcatcaggtattggagggattcaagagattgaagaacaagtgattcgtcttcatgaaaaagggccaaaacgcgtaaaaccaatgacgcttccaaaagctctaccaaatatggcagctggaaatgttgcgatgaggttaggcgctcatggtgtatgtaaatcaattaatacagcttgtgcttcttctaatgatgctattggagatgctttccgtaatataaaatttggtattcaagatattatggtagtcggtggtgcagaagctgctattacaaaatttgccattgctggattccaaagtcttacagcattatcaacaactgaagatccatcaagagcatctattccatttgataaagatcgcaatggatttatcatgggagaaggttctggaatgttggtcttagaaagtttagaacacgctgaaaaacgaggagctactattcttgcagaagttgttggttatggtaacacttgtgacgcatatcatatgacttcaccacatccagaaggtttaggagccactaaagctattcaacttgcactggttgaagctaatattaaacctgaagaagttaactatgtaaatgctcatggaacttcaacacctgctaacgaaaaaggagagagtcaagctattgttgctgcacttgggacagacgttccagtttcttcgactaaatcttttactggtcatcttttgggtgccgcgggagctgttgaggcaattgcaactattgaagcgatacgtcatagttatgttccaatgactgctggaacgacagaattatcagaagatattacagcgaatgttatttttggtcaagggcaagacgctgatattcgttatgccatttcaaatacatttggttttggaggacacaatgcagttctggccttcaaacgctgggaggattaa

SEQ ID NO: 6145 - DNA, 1242 bp, Clostridium perfringens ATCC 13124
atggaaaacagagttgttataacgggattgggagcaattacaccaattggaaacaatgtaaaggagttttggaccaatgctaaaaaaggtgtttgtggaattgatgaaataactttatttgatgctagtgattataaagttaaaattgcaggagaagttaaaaactttaaagcagaggattttatagataaaaaggaagctaagcgtttagatagatttactcattttgctcttgcagctacagaagaggcaatgaaggatgctaaattagacttaaaggatgaaaatgtagatccaaatagagtaggagttatagttggttcaggaataggtggatatggtaccttagaagcacaatttgatgttttattaactaaaggaccaaatagagtttcaccttttgcaattccatcaggaataataaacttagttgctggaaatattgctattaagtatggggcaaaaggagtatgtgaatcactagttactgcctgcgctacaggggtaagctctataggtgcagcttatagaagtataaaacatggatattcagatatagttatatcaggtggatcagaagcttctataactagagctgccattgcaggatttactaatcttaaggcattaaatactaataatgatcctaaaagatcttcaatacctttcgataaagaaagatctggattcgttatgggagaaggcgctggaatattaatattagaaagtttagagagtgctcaaaaaagaggtgctagaatctatggagaaattataggatatggtgcaacttgtgatgcatatcatataacttcacctgatccagaaggtgatggagctaagagagctatagaagcagctatagaagaaggaaaaataaataaggatgaaatttcatatataaatgcacatggaacaagtactcctttaaacgataaatttgaaactttagctattaaaggatgctttggtgaaaaagcttatgatataccagtttcatcaacaaaatcaatgactggtcatttattaggagcagctggagctatagaatcagtaatatgtgttaaagctttagaagaaggatttattccaccaacaataggatataaagttcctgatgaagattgtgacttagattatgttgtaaatgagggtagagaagtagaattaaattatgtaatcaataatgcattaggatttggtggtcataacgcatcattattatttaaaaagtgggattag

SEQ ID NO: 6146 - DNA, 1233 bp, Oenococcus oeni PSU-1
atgacacgagtagtaatcactggtatgggtgccgtaacgccgttgggaagttcggttaatgaatttgtttccggcttgcgaaaacaacaggttggttttcgaccgatctcgacttttgattcaagcgcaaccggcgtgactttagctggtgaagcagcagactttgatcctttggttcgtttaagcaaaaaagatttgcggagaatggatcgcttttcgcaatttgccgtttattcggctttggaagcttatcaacaagctgggttggaagatcaaacacccgatcccgaacgttttggagtaatttatggttctggaatcggcggtttaacaactattcaagaacaggttattagaatgcacgatcttggtgctgatcgcgtttcgccaatgtttgttccaactgcaatcgcgaatatggcggccggaaatttggcgatccgttttcatgcacaaaatatctgcatgacgatcgtaacagcatgttcttccggcgcaaacgcgatcggcgaagcttttcgagcaatcgagtccggccgagccgatataatgctaaccggtggttctgaggcttcgattaatgaaattggaatcggtggtttcgctgctctttcgactctgtccaaagcaactgatccaacaaaagcttctctaccctttgataaaaaccgtaacggctttgtgatgggagaaggaggcggaacacttattttagagtcgctcgaacacgcccaaaaacgtggcgctgaaattcttggcgaattagttggctatggtgccagcgaagatgcttaccatattacaagtcccgacccggctggaactcaagcagctagagctatgcgattggcaattgaagaggctggcttaaaagcagaacaaattggttacataaatgctcatggcacagctactcatggcaatgatttcgctgaagctgccgcaattaatcaagttttctctaaagatcagcaggttttggtcagcagctctaaatcaatgaccggtcatttgcttggtgcagctggtgcgatcgaggcagttgcgactgttagcgcattgcgtgatgggcagttgccagtcaacgtcgggattactgaacaggatccggaatgtcaagttaatctagttactgaagagaatgctcaaacaaaagttgactatgctttgagtaattcctttgggtttgggggccataacgctgttttggcctttaaaaaatggagtgattaa

SEQ ID NO: 6147 - DNA, 1263 bp, Leuconostoc mesenteroides ATCC 8293
atgacacgcgtagtaattacaggacttggcgcagtaacgccattaggaaacgatacacagtctttcttggacggtattttcaatgaaaaaattggtattaaaccaattacaaaatttgatgcatcagagacgggaatcaccgtggcaggacaggttgatggttttgatcccgcagctcgtgttggtaagcgtgatgcacgtaagatggatttgttttcacagtatgcggttgatgctgcagatcaggctttgactaatgctggattaaaggcagaagaaggtgctgaagcaccaaccactgttgctgatcctactcgattcggtgtaattttaggtaatggtattggtgggttgactactatacaagatcaagtaatcaagatgcatgataaggggccacaacgtgttagtccattgtttgtgcctgaatcaattcccaacatggtatcaggaaatgtttcgttacgttttggtgcaaagggtattaattcaacaattgttacggcttgtgcttcagcaacaaatgcgattggggaagcgttctggcgtattcaatctggtaaagccgatgtcatgttaactggtggttcagaagcaacggttaacgaaattggtattgctggtttcgcagccttgactgcgttatcaaaggaagaagatccaacacaagcttcaaagccttttgataagaatcgtcatggatttgttttgggtgaaggttcaggaattttggttattgaaagtctagaacatgctcaagcacgtggtgctcatattcttgcggaattagttggttatggtgcatcatctgatgcatatcacatgacgtcaccatccccagatggtgaaggtgctgcacgcgcaattcgtgatgcattaaatgacgctaatttggaagccaatcaaatttcatatatcaatgctcacggaacagcaacaggagcaaatgattcgggtgaagcacatgctattgccactgtgtttggagaaaatacagtacctgtttcttcaacaaagggaatgacaggtcatttgcttggtgctgctggtgccatagaagctttgatttctgtaggttctttgacacgtggtgaattaccagtaaacgtcggtcttgatgaacaggacgaggacactaaggtagttaatttagttgatcaagaaaacaagcatcaagcacctgagtatgtaatgagtgctaattatggttttggtggtcacaacgctgtcatcgtatttaagaaatggcatgaaggagtgtaa

SEQ ID NO: 6148 - DNA, 1236 bp, Lactococcus lactis cremoris SK11
atgacaaatagagttgtaatcactggttatggcgtagttagtgcaattgggaatagcccagaagaattttggaacaatcttaaagctggtaaaactggaattggtccaatcactcattttgatgccgaagcaacaggaatttctgttgcagcagaagtaaaagaatttccatttgacaaatatttccagaaaaaagatgcacgacgcatggatactttctcactttatgcggtttatgcagcgcttgatgcgatggaaatgtctggaattacagaagaaaatactaattttgaccgtttgggttgtatcatggcttctgggattggtggacttgaacaatcacaaaaaaattcacaagcgattgttgctaaaggacctcgtaaaggcgtagcaccactctatgttccacttgctattgctaatatggcaactggtaatgttgctttacgtacaggtgctcgtggtgtttcacgtgccgaagttactgcttgtgcggctggtgccaatgcaattggttcagctttccgtgaaatcaaacatggttacgctgatgcaatgattgctggtggtgctgaagcggcaatttgtgaacttggaattgctggatttgctaatttgacagctttgactaaagaaactgaccctgaaaaagcatgtattccatttgataaaaaccgttctggtttcgtaatgggtgaaggctctggtgttttgattttggaaagtcttgaacatgcacaagctcgcggtgctaatatcttggctgagattgttggttacggaaatacaaatgatgctttccatatgacaactccttcaggagttggtgctgaaaatgccattaaattggcattggaagaagctggggcaagtcctgctgatgtagattatgtcaatgctcacggaacttcaacacatgctaatgaagaaactgaaagcaaagcgattcacaatgttatcggcgataaagcttacgtttcatctacaaaagctttgcatggacatgcacttggtgcaacgggtgcaattgaagcagtagcaactgttcaagcccttttgaatcaatatgcaccagtaaacgctggaacaactgaacttgatgaaggaatgacaattaatgttgttcttggtgaagggaaacctgctgaaattaaccttgccttgtcacaagactttggttttggtggacacaatgctgtattggcattcaagaaatgggaaaatgcggccgaataa

SEQ ID NO: 6149 - DNA, 1233 bp, Streptococcus thermophilus LMD-9
atgtctacaaatcgtgttgttgttacaggttacggtgtaacctcgccaatcggtaatacaccagaagatttttggaacagtcttcatgacggtaagattggtattaagccaatcaccaagtttgatgcttctgaaatcccagtctttaacgctggtgaaatccaagatttcccattcgacaagtattttgtgaaaaaagatactaaccgtatggacacttattcactttatgcgatttatgctgctatggaagcacttgaaaattcaggacttaatatggaagaagtaaatcgtgatcgcgttggtgttatcgtgtcatctggtatcggtggtttacaagaacttgaagatcaaattatccgcatgtatgaacgtggtatgaaacgtatcaagccaatgtttattcctaaagctctctcaaacatgggtgcagggaacattgctcttaagattggtgctcaaggagtatgtaaatcagtgacaactgcctgtgcctctgccaatgatgctatcggtgaagccttccgcgaaattaaattcggatttcacgatgttgtcttggctggtggtgcggaagcttcaatcactaaaattggtattggaggttttaacgctcttacagccctttcaacaacagaagatccagaacgttcttcaattccatttgataaagaccgtaatggttttgttatgggtgaaggtgctggggttcttgttattgaaagcttggagcatgcgcaaaaacgtggtgccaacatcttggctgagattgttggttacggatcaaactgtgatgcctatcatatgacaacgccaactccagacggttcaggagctgctaaagcaattaaattggctatcaatgaagctggtatcaagcctgaagatgttgactatgtcaatgctcacggtacttcaacaccagccaacgaaaaaggtgaaagtggtgctattgtgtctgtacttggtaaagatgttccagtttcatctactaaatcatttacaggtcacctgcttggtgctgctggtgctgttgaagctattgcaacaattgaagctattcgtcacagctttgtaccaaaaactgctggtacaaaagaattgtctgactacattgaagctaatgttgtttacggtgaaggtaaagaagctgatattgagtatgcaatctcaaatacctttggttttggtggacacaacgctgttcttgcctttaaacgttgggagggctaa

SEQ ID NO: 6150 - DNA, 1233 bp, Lactobacillus reuteri DSM 20016
atgacaagagttgtaataacaggaatgggtgctgttgctcctaatggtaacggtattcaagaatttataagtaatagttttgcaggcaaagttggaattaaagcgatcaagaaatttgatgccaagccgacaggaattaccgtggcaggtgaaattgacgattttgaccctaatgatgtcatcgggagaaaagctgcgcgccgaatggatctttattctcaatacgccttacaaagcgctattgaagcaatggaaatggcggagattaacgaaacaaataccaagccagtcgacatgggcgttatctatggatctggaattggtggtttgacaactattcaagagcaaattatcaaaatgcatgataagggtcctagacgggtatcaccaatgtttgttccaatgtcaattgctaacatggcagccggtaatatttcaattcactttaatgcgcaaaatatttgtacatcgattgtgactgcttgtgccactggagctaatgcaattggagaggcctttcgtcaagttaaagaaggacgcgctaaagtaatgattgccggtggatcagaggcttcggtaaatgagatcggaattgctggctttgcggcattgacagccctatcacaagcaactgatccacttaaagcctctttgccatttgataaagcacgccaaggatttgttttgggtgaaggcggtgcaacacttgttttagaggatcttgagcatgcgcaaaaacgcggtgctaacattcttggcgagattgtcgggtatggtgctacctcagatgcttaccatattacatcccctgatccaactggtgcaggagcggcaagagcaatggaactggcaattaaagaagctgtaattaatcctagcgaaatttcctatattaatgcccacggaactgctactcatgctaatgatgaaggcgaatctaaagcaatcaatcaggtatttggttccgatagcaatgttcgtgtcagttcaacaaagggaatgactggacatttgcttggagctgcaggagcaattgaggcggtcttaacagtagccgctttacaaaagggacaattaccgttgaatataggttgttttaatcaagatccgaagtgctcagttaaccttgtgacggcagaaaatagtgacgcatcaaacgcccgttacgcaataagcaattcttttggcttcggtggtcataatgctgttttagcctttaagaaatgggagtga

SEQ ID NO: 6151 - DNA, 1236 bp, Clostridium phytofermentans ISDg
atgaaacgagtagtagtaacaggtatgggagtaattactccaatcggaaagaatgtggaagatttttggagtaatattaaaagtggaacaacaggttttgggccgattacctattttgatacaaccgattatcgtgcaaagcttgcagcagaggtaaaagattttaatgcagccgactatatggatgggaagtcagcaagacgtatggaaaaattctgtcaatatgcagtagctgcgacaaaggaagcgatcgaatccagtggtcttgatttaacgaaagaagatagaacaagaattggtgtgtctgttggttctggtattggtgacttagtgattatcgaaaaggaatacgaaaaagttttaaataacggtcctaagagaaccaacccattatttgttccgctgatgataagcaatatggcagctggtaatgtatcaattaatttcggactaaagggaaaatgtattaacgtagtaactgcatgtgcgacaggaacacattcgattggagaagcgtaccgtgcaattcaatgtggtgatgcagatgttatggtttgtggtggcacggaagcagcgatttcaaagcttggtattgcaggatttggagcacttactgcattaagttcatcggaagatccaaagagagcctccattccttttgataaagaacgtaacggctttattatgggagagggtgctggtgttgttgtgattgagtccttagaacatgccaaagcaagaggagcgaatatcttagcagaagtagctggatatggagcaacagcagatgcttttcatattacctcacctgctgaagatggagaaggtgcgatgagagcaatgctccttgcagtgaaagaagcaggcttaaaaccagaagatgttgattacatcaatgcacacggaacaagtactcatcacaatgatttatttgagacaaaatcgattaaagctgcatttggagagcatgcatatcatcttaatgtgaattctacaaagtcaatgacaggtcatctgttaggtgctgctggcgctgttgaatttattgtatgtgtgaaatctgtacaggaagattttattcatgcgacagttggttatagcgtaccagatgaagaacttgatttggattatacaaaggaagctagaacggacaaaaaggtaaatgtagcaattagtaattctctaggatttggtggacacaatggaactcttctagtaaaaaaatatgtagagtaa

SEQ ID NO: 6152 - DNA, 1218 bp, Slackia heliotrinireducens DSM 20476
gtggtaacgggcttgggcgtcgtgagcccgctcggaagcgacatggatacgttttggaagaacgtgacggacggggtgtgcggcatcggacccatcacccgtttcgacacgtcgcaatacaaggccaaggtggcggccgaggtgaaggatttcgaccccgcgcaatacctgagcacgaacgagctgctgcgcaccgacctgtacgcgcagtatgccatcggcgccgcggagcaggccgttagcgaaagcggcattgtgggcacgctgcctcccgaccgcttgggcgtgtacttcgggtcgggcatcggcggtttggaaaccgtctgctcaggagtcgccaagctcaacgagcagggtccccgccgagtgtcctcgctgatcatccccatgatgattgcgaacatggccgcaggtctcatcgccatccgctacgactgccagaatggcgccatgccggcggtcacggcgtgcgcgaccgggtcgaacgccatcggcgaggccgtgcgcaccatccgccacggctacgcggacgccgtcatcgcgggcggctcagaggcatccatcgttcctttgggcgtcgccgggttcgtgaacatgcgcgccctgtccacggcggacgacccgatggccgcatcccttcccttcgatgcgcgccgtgccggattcgtcatgggcgaaggcgccggtgcgctggtgctggaagagctggagcatgcgcgcgcccgtggagcgcacatctacggcgagatcagcggatacggctccacctgcgacgcctaccacatgaccgcttcgcaccccgaaggcgacggcggcaggcgggccatcgcgcaggcgctcgaagagtccggatacacgggcgacgagcgtctgtacatcaacgcgcacgggacgggtacgcccatcaacgacgcatgcgaaacgctggccatcaagggcgcgctcggtcaggaaaagggccgcgaggcgctggtcagctccacaaagtcgatgaccgggcacatgctgggcgcagcgggcgccgttgaggcgatcgtgtgcctgaaggtgctgcagacgggcattgttccgcccaccatcaacctgctcgagcccgatccggaatgcgatttgaaccacgttgcgcagacggctgtgcaggcggaaatcgacctgtgcctttcgaactccctcggattcggcgggcacaatgcaaccttggcgttcaggaaggtgtag

SEQ ID NO: 6153 - DNA, 354 bp, Jannaschia CCS1
atggcccgcgtcacggttgaagattgcgttgataaggtcccgaaccggtttgagttggtgatgcttgcgtcccaccgcgcccgtgagattgccgcaggcgatccgctgacgatcgaccgcgacaatgacaagaaccccgtcgtctctttgcgtgaaatcgccgatgagacccagtcggcagacgatctgcgcgaacgcctgatcgaaagccaccagacgcagatcgaagtcgacgagcccgaggaagacgccatggcgcttctgcaaggcgtggagcaggatcgccctgcccaggacgacatgagcgaagagcagatgctgcgcgcgctgatggaagcgcagggtcagaagtaa

SEQ ID NO: 6154 - DNA, 354 bp, Ruegeria sp. TM1040
atggcccgcgtgacggtcgaagactgcgttgacaaggttcccaaccgatttgagctggtgatgctggccgcacatcgtgcgcgtgagatctctgccggtgccgaactcaccgtggaccgtgacaacgacaaaaacccggtcgtctccctgcgcgagattgccgaggaaacgcaaagcgccgatgccctgcgcgagcgcctgatcgagagcaaccagtctcagatcgaggtggacgagccggaagaagattccatggctctcttgatgggtggcgaagcggacaagccacaagaagacgacatgagcgaagaaaagctcctgcgcgccttgatggaggcccagggtcagggctga

SEQ ID NO: 6155 - DNA, 417 bp, Rhodospirillum rubrum ATCC 11170
atggcccgcgttaccgtcgaggactgcgtcctcaagatccccaatcggttcgaactggtgctggtcgccggccagcgggcgcgtgacatctcggccggatcggccctgaccgtggatcgtgacaacgataagaacccggtcgtgtcgctgcgcgaaatcgccgatggcaccgttgatatccccaatctcaaggaagccgtcatccaggggctgcaaaagcacgtcgaaatcgacgagcccgaggaagacgatttcgacgccatgggcctcgatcgcgatctgatgcccggggtcgccctggccgaggatgacgacaccctggaagccgacggcctgaccattcacgatggcgccgattccgatctcgacctgtccgatgacgccggccaggacaccgatgaggcggacgaagactag

SEQ ID NO: 6156 - DNA, 354 bp, Rhodobacter sphaeroides 2 4 1
atggcccgcgtgacggttgaagactgcgttgacaaggtcccgaaccggttcgagctggtgatgctggctgcccatcgggcacgcgagatcgcctcgggctcgtcgctgaccatcgaccgcgacaatgacaagaaccctgtcgtggcgctgcgcgagatcgcggaagagacccagagcgccgagtcgctgcgcgagcgcatgatcgagagccaccagacccagatcgaggtggacgagccggaagaggatcagatggcgctgctcatgggcagcgaggtcgaccgcccggtgcaggacgacatgtccgaagagaagctgctgcgtgcgctcatggaagcgcaggggcagaactga

SEQ ID NO: 6157 - DNA, 372 bp, Maricaulis maris MCS10
atggctcgcgtcactgtcgaagactgcatcgaaaaaattcccaatcgtttccgtctggttctgatggcggcacatcgtgcccgcaacatctcggccggctccgagctgacgattgatcgcgacaatgacaagaaccctgtcgttgccctccgcgagatcgcggacgaaaccctcgacatggactcgctgaaggacagcctggtcaacggtctgcagcgcgtgctgccgagcgaggacgaggaagatgcggcgcgcgaagagcgtggccagcagatggaagccctgccggcaccgccggtcgagctcgacgaagccgagatgctcaaggccctccagaacgaccgggacggcgcgcctgacggccgcctctaa

SEQ ID NO: 6158 - DNA, 357 bp, Paracoccus denitrificans PD1222
atggcccgcgttacagtcgaagattgcgtcgataaggttccgaaccgttttgacctggtgatgctggctgcccatcgcgcacgcgaaatcgctgccggcagcccgctgaccgtcgatcgcgacaacgacaagaatcccgtcgtctcgctgcgcgagatcgcggacgaaacccagcccgtggacgatctgcgcgagcgcatgatcgaggcccagcagacccagatcgaggtcgatgagcccgaagaggatgcgatggcgctgctgctgggtgccgagatggatcgtccgaaacccgccgacgaagagtcggaggagcgcatgctgcgcatgatgctggaagcgcagggcaggaactga

SEQ ID NO: 6159 - DNA, 354 bp, Rhodobacter sphaeroides ATCC 17029
atggcccgcgtgacggttgaagactgcgttgacaaggtcccgaaccggttcgagctggtgatgctggctgcccatcgggcacgcgagatcgcctcgggctcgtcgctgaccatcgaccgcgacaatgacaagaaccctgtcgtggcgctgcgcgagatcgcggaagagacccagagcgccgagtcgctgcgcgagcgcatgatcgagagccaccagacccagatcgaggtggacgagccggaagaggatcagatggcgctgctcatgggcagcgaggtcgaccgcccggtgcaggacgacatgtccgaagagaagctgctgcgcgcgctcatggaagcgcaggggcagaactga

SEQ ID NO: 6160 - DNA, 354 bp, Rhodobacter sphaeroides ATCC 17025
atggcccgcgtgacggttgaagactgcgttgacaaggtcccgaaccggttcgaactggtgatgctggccgcccatcgcgcacgcgagatcgcctcgggctcggccctgacgatcgaccgcgacaacgacaagaacccggtcgtggccctgcgcgagatcgcggaggaaacccagagcgccgagtcgctgcgcgagcggatgatcgaaagccaccagacccagatcgaggtggacgaaccggaagaggatcagatggcgctgctcatgggcagcgaggtcgatcgcccggtgcaggacgacatgtccgaggaaaagctgctgcgcgccctgatggaagcgcagggacagaactga

SEQ ID NO: 6161 - DNA, 411 bp, Acidiphilium cryptum JF-5
atggcacgcgttaccgtcgaagactgcatcgaacagatccccaaccggttcgaactggtgctcctcgccgcccagcgcgcgcggaacctctccaggggcgcctcgatcacgatcgatcgcgacaacgacaagaacccggtggtcgcactgcgcgagatcgctgattccacggtcgatttcggcggtctcgagcaggatctcgtcaagtcgctgtctcgcgtgccggacccggaaccggcggacgaagaggttcaggacctcatcccgaccgatcagaacatcttcggcctgcaggacgtctccgccgaggaggaagccgcagcgatggccgccgaatccgaggagatgacctccgaggacatcgccgcggcgatcgaggccgaactcggcggcggacgaccgcgccgctga

SEQ ID NO: 6162 - DNA, 426 bp, Parvibaculum lavamentivorans DS-1
atggcccgagtgaccgtggaagattgcgtcgacaaggtgccgaaccgctttgagctcgttctgctcgcggggcaccgggcgcgcgccatgtcggcgggtgccgaactcactgtcgatcgcgacaatgacaagaacccggtcgttgcgctgcgcgaaattgccgaccggaccatcatgccggaagatctccgcgaagagctgatcggcagcatgcagagccgcgtcgagaccgaagagccggaagtcgagcagatgcagcttctgatgtcgggcgaagcggccggcgaagtgaaagatacgttcggtgcggccgaaggcggtggcgagcggatgagcgaggaagacctgctgcgggccattcagagccagatcgactcgccgcagcagaagtccgccgatgccgacgatatggacggggaagactga

SEQ ID NO: 6163 - DNA, 357 bp, Dinoroseobacter shibae DFL 12
atggcccgcgtgacggttgaagactgcgttgacaaggtacccaaccgcttcgagctggtgatgcttgccgcgcatcgcgcgcgcgagatttccgccggatccgaactgacgatcgaccgcgacaacgacaagaacccggtcgtgtccctgcgcgagatcgccgaggagacccagtcggcggacgcactgcgcgaacggctgatcgagtccaaccagacccagatcgaggtggacgagcccgaagaggacagcatggccatgctcatgggcggcggccagccggacaagcccgccgaggacgacatgtccgaggagaagttgctgcgtgcgctgatggaagcgcaaggccagccgtga

SEQ ID NO: 6164 - DNA, 399 bp, Gluconacetobacter diazotrophicus PAl 5 JGI
atggctcgcgtcaccgtcgaagattgcgttgaacgggttcccaaccgattcgaactggtcctgctcgccgcacagcgcgcgcgcggcctgtcgcgcggggaagaattgacggtcgaccgcgacaacgacaagaacccggtcgtggcgctgcgcgaaatcgccgaccagacgatcgtgctggagcagattcgcagcgatctcgtccgttcgctggcccgcgcgcccgagcccgagcccgccgacgaggaggtcatggacctgatcccgaccgagcagaacatcttcggactgcaggatgtctcggccgaggaagaagcatcccacggtactgccggcatgtcggccgaagaactggaagccgcgatcgaggccgaactgggcggccgcgcgcgtcgataa

SEQ ID NO: 6165 - DNA, 639 bp, Escherichia coli BL21 (DE3)
atggctgtcgctgccaacaaacgttcggtaatgacgctgttttccggtcctactgacatctatagccatcaggtccgcattgtgctggctgagaaaggtgtaagtttcgagatcgaacacgtggaaaaggacaatccgcctcaggatctgattgacctcaacccgaatcagagcgttccgaccctggtggatcgtgagctgaccctgtgggaatctcgcatcattatggaatatctggatgagcgtttcccgcatccgccactgatgcctgtttacccggtagctcgcggtgaaagccgtctgtacatgcatcgcatcgaaaaagactggtacacgctgatgaacaccatcatcaacggttcagcttctgaagcagatgccgcacgtaagcaactgcgcgaagaactgctggcgattgcgccggtcttcggtcagaagccgtacttcctgagcgatgagttcagcctggtcgattgctatcttgctccgctgctgtggcgtctgccgcaactgggcatcgagttcagcggcccgggtgcgaaagagctgaaaggctatatgacccgcgtctttgagcgtgactctttccttgcttctttaactgaagcagaacgtgaaatgcgtctgggccggagttaa

SEQ ID NO: 6166 - DNA, 618 bp, Pseudomonas syringae tomato DC3000
atgggcgtgaccaaccggttggcctgttactccgaccccgccgaccactattcccatcgcgtgcgcatcgtgctcgcggagaaaggtgtcagcgccgagatcattgaggttgtggcgggtcgtcatccgccgcagcttatcgaagtcaatccgtatggcagcgtgcctaccctggtcgatcgcgacctggccttgtacgagtccacggtggtgatggaatacctggatgagcgttatccgcatccgcccttattgcctgtctatccagtcacccgtgccaacagccgtctgctgatccatcggatccagcgtgactggtgtggccttgtggacctgattctggatactcgcagtaaagagcctgcccgtgttcaggcgcgcaaggagctgcgtgaaagcctgaccggggtttcgccgttgttcgcggaaaaagcttttttcatgagcgacgagctaagtcttgttgactgctgtctactcccaatactctggcgtttgccgattttgggtattgaattgccgcggcctgccaagccgttgcttgattatatggagcgtcaatttgcgcgtgaggcttttcaggcaagtctgtctgccgccgaacgtgaaatgcgctaa

SEQ ID NO: 6167 - DNA, 618 bp, Pseudomonas syringae pv B728a
atgggcgtgaccaaccggttggcctgctactccgaccccgccgaccactattctcatcgcgtacgcattgtgctcgccgagaagggtgtcagcgccgaaatcattgaagtggtggcaggtcgtcatccgccgcaactgattgaagtaaatccgtacggcagcgtgccgaccctcgtcgatcgtgacctggcgttgtacgagtcgaccgtggtgatggagtatctggatgagcgctatccacatccgcctctgctgcccgtctatccggttgcccgtgccaatagccgtttgctgatccatcgtatccagagagactggtgcggccttgtcgacctgattctggacacgcgcagcaaagagcctgctcgtgttcaggcgcgcaaggagcttcgcgagagtctggccggggtttccccgttgttcgcggaaaaagcttttttcatgagcgacgagctaagtctcgttgactgctgtctactccccatactctggcgtttgccaattttgggtattgaattgccgcggcctgccaagccgttgcttgattacatggagcgccaatttgcgcgtgaggcttttcagacgagtctgtctgctgccgaacgtgaaatgcgctaa

SEQ ID NO: 6168 - DNA, 627 bp, Chromohalobacter salexigens DSM 3043
atgggtgtagtggccaagcggtcgtcgatgaccttctattctggcagcgatgatcattacagccatcgcgtgcgtatcgtgctggcggaaaaaggagtggccgtcgatgtcatcgaaatcaacgatgacaaccatcccgacgagcttgccgacctcaacccctacaacagcacgccgaccctgctggatcgcgacctggtgctctatgaatccaaggtgatgatggagtacctcgacgagcgcttcccgcatccgccgctgttgccggtgtatcccgtggcgcgtgcgcaaagccgcctgtggatgcatcgtatcgaacgcgagtggtgtccgctggtcgaaaccattcagcagggcagcaagaaggatgccgagaaggcgcgcaaggagctgcgcgagagcatcgccggcatctcgccgatcttcgaagacatgccctttttcatgagtgaagagttttcgctggtcgattgctgcatcgcgccgattctctggcgcctgccggcgttgggcgtggagctgccggaaaagcaggtcaagccgctgatgaattacatggaacgcctcttcagtcgtgatgccttcaaggcttctctgctggaggcggagaaggaaatgcgcacctga

SEQ ID NO: 6169 - DNA, 639 bp, Haemophilus somnus 129PT
atgacaagcgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttagccagtcactttattttatgagcgaagaattcagtttagttgattgctatattgcgccgttattatggagaatgcagcaacttggtgttgtatttacaggcacaggcagtaaagcgattaaatcttatatggagcgagtttttcaacgtgattcatttttacaatctgttggtgaaatgacacctaaaaatttaatggaggataaatag

SEQ ID NO: 6170 - DNA, 639 bp, Enterobacter sp. 638
atggctgtcgctgccaacaaacgttcggtaatgacgctgttttctggtcctactgacatttatagccatcaggttcgtatcgtgctggccgagaagggtgtcagttttgagatcgagcatgtggaaaaggataacccgcctcaggatctgatcgatctcaacccgaaccagagcgtaccaacgcttgtggatcgcgagctgaccctgtgggaatcccgcatcattatggaatatctggatgagcgtttccctcatccgccgctgatgccggtttacccggttgcgcgtggcgaaagccgcctgtatatgcagcgtatcgagaaagactggtacacgctgatgaacgttatcgtcaacggttcctcttctgaagcggacgctgctcgtaagcaactgcgtgaagaattgctcgcaatcgccccggtgtttggtcagaaaccattcttcctgagtgatgagttcagtctggtcgattgctacctggctccgctgttatggcgtctgcagtctctgggcgtagaattcagtggtccgggtgcgaaagagctgaaaggctatatgactcgcgtatttgagcgtgattctttcctcgcgtccctgacagaaccggaacgcgaaatgcgtcttggccgaggttaa

SEQ ID NO: 6171 - DNA, 633 bp, Marinomonas MWYL1
atgggtgttattgcaaagcgctcctcaatgacgttcttttctgatggagaggatcattatagccatcgagttcgtattgtattggctgagaaagccgtcacagtggacatcatagatgtagacccgtttaacaagccagacgagttggcggatgttaatccatacaatgagctaccagctttagtcgatcgtgatttggttctttatgagccaaatgtcatgatggaatacttggatgaacgttttccacatcctccgttgctgcctgtatatcctgttgctcgtgctgaaagtcgcttgtttatgtatcgtattcagcgcgattgggcaaagctagttgatttgattcttactagtaaggacaaagaagctgttgctaaagcacaaaaagaattgcgtgaaggtttgttgaacgttactccaatttttgaagaaaaaccttatttcatgagtgatgagttcactatcgtggattgctgtttggctccaatcttgtggcgtttgcctgtattaggagtggaaattcctaaagaccaagcaagagcgctatacaagtatatggatttggttttttctcgtgagtctttccaagaaagtctttctgaagctgaacaagaaatgcgtttagactga

SEQ ID NO: 6172 - DNA, 639 bp, Escherichia coli HS; identical to SEQ ID NO: 6165

SEQ ID NO: 6173 - DNA, 639 bp, Escherichia coli E24377A; identical to SEQ ID NO: 6165

SEQ ID NO: 6174 - DNA, 642 bp, Serratia proteamaculans 568
atggctgtcgctgccaacaaacgttcggtaatgacgctgttctctggcccgaccgacatttttagccatcaagtacgtatcgtactggcggagaaaggtgtcagcgttgagattgagcaggttgagttggataacctgccgcaggatctgattgacctcaacccgtaccagacggtgcctaccctggtcgatcgcgaactgaccctgtatgaatcccgtatcatcatggaatacctcgatgagcgtttcccgcacccaccattgatgccggtctacccggttgctcgtggtgagagccgcctgatgatgctgcgtatcgagaaaaactggtattcgctgatgtacaaaatcgagcagagcaacggccaggaagctgaatcagctcgccgtcaactgcgcgaagaactgctggcgattgcccctatctttggtcagaccccgtacttcatgagcgaagagttcagcctggtggattgctacctggcgccgctgctgtggcgtttgccgcagttgggcattgaactgagcggtgccggttccaaagagctgaaaggctacatgactcgcgtgttcgagcgtgacgctttcctggcctccctgaccgaagccgagcgcgaaatgcgcctgcagactcggggctaa

SEQ ID NO: 6175 - DNA, 630 bp, Coxiella burnetii RSA 331
atgttaaaacgctcgattatgacgttgtattctggtcctttggacatatacagccatcaggttcgcattgttttggcagaaaaaggcgttactgtggacattcacaatgtagatgccaaccatcctagcgaagatttaatcgaattgaatccttatgccactttgccaactttagtggaccgtgacttggttttattcgaatcgagggtcatcatggaatatttagacgaacgatttcctcaccctcctttgctccctgtctatccggtcgctcgaagtcggtgtcgtttgttaatgtatcgtattgaacggaatttttaccattccatgaaaattattgaagaagggactcccaagcaagccgaaacagagcgagagtttcttaccaaagaattgatcgagcttgatccagtgtttggggagaagacttatttcatgaatgacgattttacgttagtcgattgcgtgatggcgccgttgttatggcgtttgccgcacctcggtgttcatgtgccgccgcgggctgcaaaatcaatgtataaatacaaaaagctcattttcgaacgggagtccttcaaagccagtttaagtgagtctgaatcggaacttagagaagtcgatggcatttga

SEQ ID NO: 6176 - DNA, 642 bp, Yersinia pestis Angola
atggctgtcgctgccaacaaacgttcggtaatgacgctgttttccggcccgaccgacatttttagccatcaagtacgtatcgtactggcagagaaaggtgtcagtgttgagattgagcaggttgaagctgataacctgccacaggacctgattgacctcaacccctaccgtactgtccctactttggttgatcgcgagctgacgctgtatgaatcccgcattatcatggaatatttggatgagcgtttccctcacccaccattgatgccagtctatccttttgctcgtggtagcagccgcttgatgatgcaccgtattgagcacgactggtattccctgctgtataaaattgagcaaggtaatgcacaggaagctgaagcggcacgtaaacagttacgtgaagagttactgtccatcgcgccagtctttaacgaaacacctttctttatgagtgaagagttcagtctggtcgattgttacttagctccgttgctatggcgtttaccggtgttagggattgagttcacaggggcgggctctaaagagctgaaaggctatatgactcgcgtctttgagcgtgatgcgttcttggcttcactgactgaagctgaacgtgaaatgcatctgaaaactcggagctaa

SEQ ID NO: 6177 - DNA, 639 bp, Escherichia coli C ATCC 8739; identical to SEQ ID NO: 6165

SEQ ID NO: 6178 - DNA, 642 bp, Yersinia pseudotuberculosis YPIII
atggctgtcgctgccaacaaacgttcggtaatgacgctgttttccggcccgaccgacatttttagccatcaagtacgtatcgtactggcagagaaaggtgtcagtgttgagattgagcaggttgaagctgataacctgccacaggacctgattgacctcaacccctaccgtactgtccctactttggttgatcgcgagctgacgctgtatgaatcccgcattatcatggaatatttggatgagcgtttccctcacccaccattgatgccagtctatcctgttgctcgtggtagcagccgcttgatgatgcaccgtattgagcacgactggtattccctgctgtataaaattgagcaaggtaatgcacaggaagctgaagcggcacgtaaacagttacgtgaagagttactgtccatcgcgccagtctttaacgaaacacctttctttatgagtgaagagttcagtctggtcgattgttacttagctccgttgctatggcgtttaccggtgttagggattgagttcacaggggcgggctctaaagagctgaaaggctatatgactcgcgtctttgagcgtgatgcgttcttggcttcactgactgaagctgaacgtgaaatgcatctgaaaactcggagctaa

SEQ ID NO: 6179 - DNA, 639 bp, Shigella boydii CDC 3083 94; identical to SEQ ID NO: 6165

SEQ ID NO: 6180 - DNA, 639 bp, Salmonella enterica serovar Newport SL254
atggctgtcgctgccaacaaacgttcggtaatgacgctgttttctggtcctactgacatctatagccatcaggtccgcattgtgttggctgaaaagggtgttagttttgagatcgaacatgtggaaaaggacaatccacctcaggatctgattgacctcaacccgaatcaaagcgttccgacactggtggatcgtgagctgaccctgtgggaatctcgcatcattatggaatatctggatgagcgtttccctcatccgccgctgatgccggtttatccggtcgcgcgcggtgaaagccgtctgtacatgcaccgtattgaaaaagactggtatacgctgatgaacgtcatcgtaaacgggtctgcttccgaggccgactctgcgcgtaaacaactgcgtgaagagctgctggcgattgcgccggtatttggtcagaaaccgtatttcctgagcgacgaattcagcctggttgattgctacctggcgcctctcttgtggcgtttaccgcagttgggtattgaattcagcggcgcaggggcgaaagagctgaaaggctatatgacccgcgtctttgaacgtgattctttcctggcttctttaaccgaagctgaacgtgaaatgcgcctcggtcggggttaa

SEQ ID NO: 6181 - DNA, 639 bp, Salmonella enterica serovar Schwarzengrund CVM19633
atggctgtcgctgccaacaaacgttcggtaatgacgctgttttctggtcctactgacatctatagccatcaggtccgcattgtgttggctgaaaagggtgttagttttgagatcgaacatgtggaaaaggacaatccacctcaggatctgattgacctcaacccgaaccaaagcgttccgacactggtggatcgtgagctgaccctgtgggaatctcgcatcattatggaatatctggatgagcgtttccctcatccgccgctgatgccggtttatccggtcgcgcgcggtgaaagccgtctgtacatgcaccgtattgaaaaagactggtatacgctgatgaacgtcatcgtaaacgggtctgcttccgaggccgactctgcgcgtaaacaactgcgtgaagagctgctggcgattgcgccggtatttggtcagaaaccgtattttctgagcgacgaattcagcctggttgattgttacctggcgcctctcctgtggcgtttaccgcagttgggtatcgaattcagcggcgcaggggcgaaagagctgaaaggctatatgacccgcgtctttgaacgtgattctttcctggcttctttaaccgaagctgaacgtgaaatgcgcctcggtcggggttaa

SEQ ID NO: 6182 - DNA, 639 bp, Salmonella enterica serovar Dublin CT 02021853; identical to SEQ ID NO: 6180

SEQ ID NO: 6183 - DNA, 639 bp, Escherichia coli O157 H7 EC4115
atggctgtcgctgccaacaaacgttcggtaatgacgctgttttccggtcctactgacatctatagccatcaggtccgcattgtgctggctgagaaaggtgtaagtttcgagatcgaacacgtggaaaaggacaatccgcctcaggatctgattgacctcaacccgaatcagagcgttccgaccctggtggatcgtgagctgaccctgtgggaatctcgcatcattatggaatatctggatgagcgtttcccgcatccgccactgatgcctgtttacccggtagctcgcggtgaaagccgtttgtacatgcatcgcatcgaaaaagactggtacacgctgatgaacaccatcatcaacggttcagcttctgaagcagatgccgcacgtaagcaactgcgcgaagaactgctggcgattgcgccggtcttcggtcagaagccgtacttcctgagcgatgagttcagcctggtcgattgctaccttgctccgctgctgtggcgtctgccgcaactgggtatcgagttcagcggcccgggtgcgaaagagctgaaaggctatatgacccgcgtctttgagcgtgactctttccttgcttctttaactgaagcagaacgtgaaatgcgtctgggccggagttaa

SEQ ID NO: 6184 - DNA, 642 bp, Dickeya dadantii Ech703
atggctgtcgctgccaacaaacgttcggtaatgacgctgttttccggtccgtccgacatttttagccatcaggttcgtatcgtgctggctgaaaaaggagtgagtgtcgagattgagcaggtagacatggataatctgccgcaggatcttattgacctcaacccttacggttctgtgcctacgctggttgatcgtgaactgactctgtatgaatcacgcatcatcatggaatatttggatgagcgtttcccgcatccaccgttgatgccggtttatccggttgcccgtggcaacagccgcctgatgatgcatcgcatcgagcaggactggtactcgttgctgaaaaccattctgaacggcaacgcccaggatgtagaagcagcgcgcaagcaactgagagaagaactgctggcgattgccccggtgttcaatgaagcgccttatttcatgagtgaagaattcagcttggtggattgctatctggcgccgttgttgtggcgtttgccgctgctaggcattgaattgagcggttctggtgcgaaggaactaaaggcgtatatgacccgtgtattcgagcgtgacgctttcctggcttctctgaccgaagccgagcgcgaaatccgcctgcagaccagaggctaa

SEQ ID NO: 6185 - DNA, 642 bp, Dickeya zeae Ech1591
atggctgtcgctgccaacaaacgttcggtgatgacgctgttttctggtccgtccgacatttttagccatcaggtccgcattgtactggccgagaaaggggtaagtgtcgagattgaacaggtggacatggataatctgccgcaggatcttatcgatctcaacccttacggttccgtgcccacattggttgaccgtgagctgacgttgtatgaatcacgtatcatcatggaatatctggatgagcgtttccctcacccgccgttgatgccggtctatccggtagcgcgaggaaacagtcgtttgatgatgcatcggatcgaacaggactggtattcgttgatgaaaaccatcgtcaatggtaatgctcaggatgcggaagccgctcgtaagcaattgcgtgaagaactgctggcgatcgccccggttttcaacgaagcgccttattttatgagcgaagaattcagtctggtggattgctatctggcaccgctgctgtggcgcttgccgttgctgggcattgaattgagtggttccggcgccaaagagctgaaaggttatatgacccgcgtattcgaacgtgaggccttcctggcttctctgacagaagccgagcgcgaaattcggttgcaatccagagggtaa

SEQ ID NO: 6186 - DNA, 642 bp, Pectobacterium carotovorum PC1
atggctgtcgctgccaacaaacgttcggtaatgacgctgttttctggtccatccgacatttttagccatcaggtccgcatcgtattggcggaaaaaggtgtgagtgtcgagattgagcaggtagacatggataatctgcctcaggatcttattgacctcaatccttacggttccgtgccaacgctggtcgatcgtgaactgacgctctatgaatcacgcattatcatggagtatctggatgaacgttttcctcatccgccgttaatgcctgtctacccggtagctcgtggtaacagccgcctgatgatgcatcgcattgagagcgactggtattctttactgaagaaaattacccatggcagtgcgcaggaagcggacgcggcgcgtaagcaactgcgtgaagagctgctggctattgctccggtgtttaacgaagcaccttatttcatgagcgaagagttcagtctggtggattgctatctggctccgctgctgtggcgtttgccgcagttaggcattgaactgagtggttcgggcgcgaaagaactgaaaggctacatgactcgcgtctttgagcgtgatgcgttcctggcttccctgacggaagtggaacgtgaaatgcgtttgcaaacccgaggttaa

SEQ ID NO: 6187 - DNA, 489 bp, Escherichia coli BL21 (DE3)
gtggcgagctatcgtagccagggacgctgggtaatctggctctctttcctcattgcgctgttgctgcaaatcatgccctggccggataacctgattgttttccggccaaactgggtgttactcatcttgttgtattggatcctggccttgcctcatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgcaaagtccgtcagcagtttgcagtgcaataa

SEQ ID NO: 6188 - DNA, 489 bp, Shewanella oneidensis
atgagtttacaagcggctaatggacgtatcgtggtttggctgaccttgtttgtcggactcttaagccaaattatgcctctacctacgattgttgaggcttggcggccggattggctactgatgattttgatctactggtccattgcgttgccacacaggtataacattctcacagcatgggtaatgggtttagctctcgatattctcttgggcgccaccttaggggtacgttctctggcgatgtcgctagtgatttatattgcgattttacattgtcagcgtttacgcaacttccctaaatggcaacagtcgctggtagtaatgctgctcattgctatctaccacctgattgtttattgggtcgagtttgtgatggatggcgcaacattccacgcggaactgtttttgcctgcgctatcgggcctggtattttggccttggattttttggattttacgtcgtatccgacgtcattataaggttcgttag

SEQ ID NO: 6189 - DNA, 492 bp, Pseudomonas putida KT2440
atgatggctgcatcacgccgcaataacggctgggtcatctggcttacgttcgccatcggcctgctgctcagcgtttcccccatgccgcagttcatggaagtgttccggcccatgtggctggccttgctggtgtcgttctggacccttgccgtgccgaacaaggtcggcatgaccacggcattcgtgctgggccttgccgaggacgtgctgtatggcacgctgctggggcagaatgcgctggtccttaccctcatcaccttcttggtgctgtccctgcagcagcgtctgcgcatgttccccatgtggcagcaaagcctggtcattctggtgatcttcggtatcgcccagttgatccagctgtggctcagtgcactgaccggcaaccgactgcccaccctggcgctggtctggtcggcggtgatcagcgccttgctctggccttggatcagctttgccttgcgcgacctgcgtcgacgcttgcacatcaactga

SEQ ID NO: 6190 - DNA, 492 bp, Pseudomonas syringae tomato DC3000
atggttagtcatgtttccgggcgcaacggctgggtagtctggctgacgttcgcaatcggtttgttgctgagtgtttcgccgctgccgcagttcatggaaatctttcggccgctgtggctggccttgctgttaaccttctgggtactggcgctgccgcacaaatacggcatgaccacggcgtggatattggggctgatggaggacgtgctgtacggcacgctgctcggccagaatgcgctgatcctcagcctgatcacgttcctggtgatgtccttgcagcagcgtctgcgcatgttccccatgtggcaacagtgcctggtgctgctggtggtgttcggtctggcgcagcttgcgcagttgtggctcagtgccttgacgggcaatcgccagccaacccttgcgctggtgttgcctgctttggtcagtgcgctgttgtggccttgggtcagttatggtctgcgtggattgcgcaaacgtttgaaaatcaattaa

SEQ ID NO: 6191 - DNA, 492 bp, Methylococcus capsulatus Bath
atgtggcgcactaggcgaacaccctcccgtatcctgattttcgcgagcctggccgctgcgatggcgatgcggatcgtccctttgccgcaagattgggcgctgtggaacccggactggattctgctggtgctgatctattgggccgtgatggctcccgaccgcgtcggcgtcggtacggcctggctgaccggccttctggcggacgcactgacgggccggttgctgggtcaagatgcgctggcatacagtgtggtcatctatgtcggcgtgcgatttcaccggcgttttcgggtctattcgatggtgcagcaggttttggccgtcgtgctgctgctcggcttggggctcctgctcaccctgtggacacgtcatatccggggactggccagtgcgccggaaggctactggttcgcggcgttgtccggcgggctggtctggccctgggtccgtgtcgcgctcgacggcctgcggcgccgttacggcgcggcgtag

SEQ ID NO: 6192 - DNA, 492 bp, Pseudomonas syringae pv B728a
atggttagtcatgtttccgggcgcaatggctgggtggtctggctgacgtttgcgatcggtctgctgctgagcgtttcgccgctgccgcaattcatggaaatcttccggccactgtggctggccctgctgctgaccttctgggttctggcgctgccgcacaaatacggcatgaccaccgcgtggatactgggcctgatggaggatgtgctgtacggcaccttgctcggccagaacgccctgatcctcagtctgatcacctttctggtgatgtccctgcagcagcgcctgcgcatgtttcccatgtggcaacaatgcctggtgctgctggtggtattcggtctggcacagcttgcgcaactctggctcagcgcgctgaccggcaaccgtcagccaacgctggcgctggtgctgcccgcgttggtcagtgctctgttgtggccctggatcagttatggcctgcgtggattgcgcaaacgtttgaaaatcaattaa

SEQ ID NO: 6193 - DNA, 486 bp, Psychrobacter arcticum 273-4
atggcatatcctgattctgatcatgcaaatgggctgctgcatgccgtgattgtactgagttttattattgcctcatcgctcagtgtttatccattaagccctagtatggccacattgcgtcctatgatcatgatcatgatactgatttattggttattatttcagccacgttatgtgggcatttttagcgcctttaccattggccttattgctgatttactgatggatactcatttaggacaacaagctttttctgctgtggtagtggcgctcatgataaaggtcaccagtatttatatcagacagctaaacacggttagtgcatggataatagccagtttgggattgtttgtgtttcaagcgagtttatggatgctacagatgtttgtgcaaaatgtctttgttgcccaatctactttttctttattgatgagcatcatcagttggccattggtgcttttgacgttacgaaaatttgtacgctaa

SEQ ID NO: 6194 - DNA, 480 bp, Colwellia psychrerythraea 34H
atgtttagcaataatggttttattattttccttaccctattaattgctttgatggcaagtattacccctatgccattgagcgtagatgcttttcgcccagattgggtgcttattgtattggtttactggtgcttagcattacctaataaaataaatatttttaccgcgtgggtaatgggctttatccttgatgttttacttggctctgtgctgggtgttcatgcttgtgcgatggctttatctgtttatattgttgtagttaattttcaaaaaattagaaatttctccgtttggcaacaagcactcattattggcgtactctctgcgcaataccaccttgttgttttttggttgcaacgcttcttaagtgatgttgtattcttacctaattatttatacccagtgataactacgattgtactttggccatgggtgtttttattattacgccgtgtccgccgtcatttccgcattgaataa

SEQ ID NO: 6195 - DNA, 522 bp, Dechloromonas aromatica RCB
atgcaaccaaccttttcctcatcccgcattctgttgccggtccggccttggttcatattcttcagcctgatcgccgccgcgctcctcaacttcctgccaacggcacactggccagggatgccggactggattgcactggtcctgtgtttctggagcgttcgagagttccgcaaggtcggcatgggctggggcttcgcactcggtctgctgatggatgtcgccgatggcgcggtgcttggccagcattgcttcgcctacgtgatactggcctacaccgcggcctcgctgtcacggcgcatcctctggttcccgctcgtccagcaggccctgcaaatcatgccgctcttactcgcggcgcaggtattgcaggccttgatgcgccttgccgtgggcgccgacttccccggctggggctatttcgtgggcccgttgatcgctacgctgctctggattcccgccaccttcatcctgctcctgccgcagtaccggccggtcgagcaagaccccaaccgcccgatttga

SEQ ID NO: 6196 - DNA, 501 bp, Thiobacillus denitrificans ATCC 25259
atgaacgtcgccgccgagacgagcggccgctggcgccgcatcctgggcagcctgacgctcgccgtgctggtcgagcagctgccgtggtcgggcctcgccatggtattgcgccccgacttcgtgctggtcgcgctgctgttctgggtactgcaccagccgcagcgcgtgggcttcggcattgcgttcttccttggcctgatcgcggatttccaggacggcgcagcgctcggccagcatgggatcgcctacgtcgtcggcgtttatctggtgctctacctgcgtctgcggctgctgcagttcgaccctttccggcaggccgcgcagctgttcccggtgcttctggcggtacagctggtcgtgctgctgggtggctggctcgcggtcaatccgccggccgggctggccatcctgatgccggtattcggcagcacgttcctgtggtatctgtctgccctcgttctgcggctgtggcacggcaagggcgcgcaggattctcactga

SEQ ID NO: 6197 - DNA, 504 bp, Thiomicrospira crunogena XCL-2
atgtccgataaagttttctctcttcgtttttcagacattaaatggctgttaatattcagttactttatttctgttgtcattgatagcatgatgattctaagcttcaacatcaactttgtgccttatttcacgcttctcatcctattattctggtcgacgcaaattcttaaccaaactcacttattttcagcgtttgcactgggccttctgttcgatgcctcgatgaataccccactaggatcccacagtttaatttttgtgaccatcaccttcttgatgctacgatcacgcttacgatttaaaggataccctctctggcaacaatccatgattgtcggcagttatttcatcatattccaggccatgagctggtttatatttcacccggttttagtggggaatgcattattgtattactggattgagccgttactggccattctgatctggcctgtattaactcaagtaatgcatcgattgacccaccgttctgtctttagttaa

SEQ ID NO: 6198 - DNA, 522 bp, Nitrosospira multiformis ATCC 25196
gtgacgctcgctaattcatccaggcacgaaattctgatgccagccaaaagctggttcatcatgctcagcctgatcgtggcgctactcctgaatctcatacccgtcacaggcaccgctcggacgctgcagcccgattttgtcgcgctggtgatgctttactggtatctcaacgaaccccagcgtgtgggcattggcatggcattctggatgggtctgctcatggatctgagcaatgccagtaccttcgggcaacacgcgctcgggtacagcgtaatggcgttcatggcactggtcttcaaccggcgcatgggtatcttcgaaggatataaacaagctccccagataggactggttctgctttcagggcagatcgtcacacttcttgccgggctgtttgccggttctcctttccccggctggaacttctttcttggcagcattgtcggcatgttactgtggccgcttctctcagccatattgagggtgccgcagaaaccctggtctgcttccgatgcaagatga

SEQ ID NO: 6199 - DNA, 489 bp, Saccharophagus degradans 2-40
atgcccaatctcggcctgtccttttatattttcttctgtgtatctgcattctttgcactagttctatctatttatcctatccctcacgcttatgcggcattgcggccagagcttttttgcctgttggtagtgtactgggttattaactatccgcagtattttggcgtaaccacagcttggttaatgggcctgtttttagatgttgtgcacagcactgtttggggcgcacacgctctgggcttggctgctgtggcttatatttgtttgtcatcttaccagcgcattcgcagctactcgctgtggcagcaaacgctgtgggtgtttgtatttgtgggcattcatcaggttattgtgaattggatgctgggtttaagtggttaccataagcccactcatattattttggtgaccacggcagtaagtgcacttagctggccggttatggtgctgttgtttaggcgcctgcgtcgccgctatagattgctatag

SEQ ID NO: 6200 - DNA, 480 bp, Methylobacillus flagellatus KT
atgtccgcaactagcctgaaacccgtatacctgtcgttactggtggcattgctcatgcaaatcctgccatggtcaggcagcctgctgacaatacgcccagaatttctcctgctgactgtgctttattggacactgagagcgccccatctgtgcaatatcggcaccgcttggttcgccggcctcatgatggacctggcttcaggcgggttattcggtcagtttgcgctcgcttattccgctgcgtctttttttgcagtgtcctaccagcgacgccttgccctattcaacatctggcaacaagcaggttacgtgtttctgctgctcctgctcagccaggtcatcaccctggtgctgaaactattctccggtggtgagctgccgggctggcaatatttcctgcccagtgtcagcggcatcctgctctggcaattcgtcaccttttcacgtctccgtatcgatagccgatccgaccaggcctga

SEQ ID NO: 6201 - DNA, 492 bp, Shewanella denitrificans OS217
atgagtaaccatattgctaatggccgcttgattgtgtgggtcacactctttttcggggtcatgtttcaaatcatgcctttgccaagtttagtggaactctggcgcccagattggctgttaatggtcatcatgtattgggccatggccttgccccataggtacagcattctcaccgcttggtttcttggggtggtgttagatattctgctcggggcccatcttgggatccgcgccatggcgttttcattagtgacctatatcgtagtgctgcatttccagcgtctgcggcactttccccgttggcagcaatctattgtgatagccgccttcatctgtttgtatcacctagtggtattttggctagaatttattgtggttggcggggttcagtttaaaacggaatatcttcaacctgttgtttctagtatatttatttggtggtgggtgttttgggtattacgtaatattcgtcgaagttataaggtaagataa

SEQ ID NO: 6202 - DNA, 480 bp, Chromohalobacter salexigens DSM 3043
atgcgattgccgggactgatcgccatttggctgacgctggtgatcagcctttgcctgcaggtcatgccgctgccggatgcctggctgatgtggcgtcccaactggctggggctggcgctggcctattggtgcgtgaccgcgccgcagcgcgtgggcgtcttccatggtttcgtatgcggcctcctgctggatctgatcgaggggactccgctggggcagaacgcgctgacgctttccttgctgacctatctctgcctgctgctctatcagcgcctgcgcgcctattcgatctggcagcaggcggtgatgctgttcgtgctgctggggttgatccagctcgtcgagcagtggctgcgcaccatcttcgggccggtatcgattcatctggcgttcctgctgcccgcgctcatcggcggtgcgttgtggccgtggctgttcaccatgatgcaggtactgcgtcggcgtctggggatcacgtaa

SEQ ID NO: 6203 - DNA, 486 bp, Psychrobacter cryohalolentis K5
atggcatatcctgattctgatcatgcaaatgggctgctgcatgccgtgattgtactgagttttattattgcctcatcgctcagtgtttatccattaagtcctagtatggccacattgcgtcctatgatcatgatcatggtattgattttttggttgttgtttcagccgcgttatgtgggcatttttagtgcctttgctattggccttattgctgatttgctgatggatactcatttagggcaacaggctttttctgctgtggcagtggcgcttatgataaaggttaccagtatctatatcagacagctaaatacgattagtgcatggataatagcgagtttaggattgtttatatttcaagcgagtctgtggatgctacagatgtttgtacaagatgtctttgttgcccaatctactttctctttattgatgagtattattagctggccattggtactattgacgttacgaaaatttgtgcgttaa

SEQ ID NO: 6204 - DNA, 513 bp, Cupriavidus metallidurans CH34 uid250
gtgacgacatcccaatacctgctgcgcccggtcaatcccgcgttcatcgcgctgaccttcgtgctggccttcctgatcaacctgatgccctggggcgagacgctctggattccggacgtcgtggcgctggtgctggtgttctggaacatccaccagccacgcaaggttggcatgggcgtggcgttcctgctgggtttgctgatggacgtgcatgacgctcgcctgcttggcgaacatgcgcttgcctacacgctgttggcctacttcgcgatcacgatccatcgccgggtactgtggttttcggtctacgcgcaggcgctgcacgtgctgccgttgttgttcatcgcgcacgcggtgccggtggttatccgcctggccatgggcgcgccgctgcccggctggcaattgctgctggccccggtgatcgaggcggtgctgtggccgatggccaccagcctgctgctggcgccgcaacgcagatcgaacgaagtcgatgagacgcgtccgatctag

SEQ ID NO: 6205 - DNA, 477 bp, Baumannia cicadellinicola Homalodisca coagulata
atgacacgattttatcgtcaatataactgggttatatggttattctttttttttattatcatcatattaccaatcataccatgtaacaaacctattaatttattttggccatcttggctcaatttattactaatttattgggttatggtgcgacaaaatcgaatacatgtgggaatagtatttttaataagtattattgttgatttgatacgaggatcaaaattaggtatacatcctctattaattagtataattatatatatagtttttataaaaattaaattttttcggaataaaaatatttatcaacaagtaattattataatattggcttcagcaattgctaaattcatagtaaatattactaattatttattactaagtaattcatggcaaacaggaattttatctagtagcatagtagatggtatagcatggcctttagttttatgtattatgcgtaaaatcacaagctaa

SEQ ID NO: 6206 - DNA, 477 bp, Pseudoalteromonas atlantica T6c
atgaaactaagaaacaataccatcggtctgagtattatagtggctttggtgctgcaaattatgccgatgccggccatagttgaacagtatcgtcccgactgggtgtttttggtcctagggtattgggcgcttgccctgcctgaacgcgtcaatgtaggcgttgcttttatcgttggtttagtactcgatatattgttaggcaccagtattggcgtacacagctttgccatgagcttgagtgtgttcgtacttgcagccaattatcagcgtttgcgaaattattcggtttggcagcaagcggttgtgatcggtattttatgtgcgctttataatttagtggtattttggttaatgcatttattaaccgacatctatttcatgcttacttacatgtggcctgtgattacctctatggtaatttggccatggatattttggttactacgtcgggttcgccgtcagtttcgtttgagctga

SEQ ID NO: 6207 - DNA, 555 bp, Rhodospirillum rubrum ATCC 11170
atggcacggcgcggcggcctcaaaagcacctatgatccaacccagccaaccctgtggcagcggttggactggcttgcccgacggctggttcccgtcgggttgaccctgctcttgctgctgatgagcgtggcgccatcgcggcttcccggcttcgtccacatcgcgccgatgatcgccctgatcagcatctattactgggcggtctgccggcccgaggtcatgggctatggcagcgccttcgtccttgggctggtggaagacagcctgaccggggcgccgctgggggtgggggccctggtcttgctgctgacccaggcggtggtcgccacccagtacaagttctttctcaataagccgttcctggtgacatggtgggccttcgccctggtcgcgggcgtcgccgccgtggtgaagtggttggcggtttcggcgatctacggcacttttgtcgatggaacggcgctggtcttcagcaccttgttcaccgtcgcggtctatcctcctttcgcctggctgttcggccgggttcaccacatgctgttccgcgaggcatag

SEQ ID NO: 6208 - DNA, 489 bp, Haemophilus somnus 129PT
atgaaagtaaaatttttgttacaaattttagtgatcagcggtttgtttatttttacttttgctcttgaacttatgccttggccagtaacttttcagagttttaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatag

SEQ ID NO: 6209 - DNA, 489 bp, Shewanella sp. MR-7
atgagtttacaagctgctaatggcagactcgtggtatggctgaccctctttgtcgggctcttgagccagattatgccgctgccttcgattgtcgaagcctggcgtcccgattggctattgatgatcttaatttattggtcaattgcgctgccccacagatataacattctcacggcctggctgatgggattggccctcgatattctgctcggcgccaccttaggcgtgcgctcgctggccatgtcgctggtgatttatattgcgattttgcattgtcagcgtttacgtaacttccctaagtggcaacagtcgctggtggtgatggtgctgatcgttatctatcacctgatcatctactgggtcgagtttgtgatggatggcgctaagttccatacggatctgtttttacccgcactatctgggttggcattctggccatggattttttggattttacgtcgtgttcgacgtcattataaggttcgttag

SEQ ID NO: 6210 - DNA, 489 bp, Shewanella sp. MR-4
atgagtttacaagctgctaacggcagattcgtggtatggctgaccttatttgttggattattaagtcaaattatgcctttgcctacgattgtcgaagcctggcgtcccgattggctattgatgatcttaatttattggtccattgcgctgccccatagatataacattctcacggcctggctgatgggattggccctcgatattctgctcggcgccaccttaggcgtgcgctcgctggccatgtcgctggtgatttatattgcgattttgcattgtcagcgtttacgtaacttccctaagtggcaacagtcgctggtggtgatggtgctgatcgttatctatcacctgatcatctactgggtcgagtttgtgatggatggcgctaagttccatacggatctgtttttacccgcactatctgggttggcattctggccatggattttttggattttacgtcgtgttcgacgtcattataaggttcgttag

SEQ ID NO: 6211 - DNA, 489 bp, Alkalilimnicola ehrlichei MLHE-1
atgaacccggccattccccgcggccgctgggtcatcctcgccagtctggtgctggcggggatgctggtgatcgtgcccatgcccgattgggcggtgccggcgcggccgcaatgggtggccctggtgttattgtactgggccatggcgttgcccagccgggtgggggtgacggtggcctggctggccggcctgtttcaggatgccctggtcggcagcctgctgggccagcacgcgctggccttcgcactgatcgcctggatcatcctcaagctgcaccggcggatgcgcctgatgcccgtctggcaacaggcgctgaccatcctgctgctgctctatgcagtgcagttggtgctgttctgggtcaatggttttgtcggccggccggtgcccccctggcaggcctggctggcaccggtgattggcgcggcgctgtggccctgggtctttttcctgctgcgtaccgcgcgccgccatttcggcgtacagtag

SEQ ID NO: 6212 - DNA, 492 bp, Shewanella frigidimarina NCIMB 400
atgagcgcacatattgcaaatggtcgcttagtggtatggctgaccttattcatcgggatgatgtttcagattatgccgttgccaaaaatggtagaagcctggcgaccggattggctattgatggtgatgatgtattgggccatggcgctaccgcatcgttacagtattctcactgcgtggttgttaggggtgatgcttgatgtgttgttgggagctcatctagggatccgttcattagcattatcattagtgatttatattgtggtgttgttgtgccaacagttacgtaactatcctcgctggcaacagtcgttactagttgcatgttttatttgtatttatcatgcagtgatattttgggtgcagtttgttgttgttggcgcagccccatttaatgtggacatgtttttacccgctatttcgagtttatttatttggtggtgggtgttttgggtgttacgcaatatgcgccgccattataaagtacgttaa

SEQ ID NO: 6213 - DNA, 495 bp, Pseudomonas aeruginosa UCBPP-PA14
atggctcgcgcgactcaaggttcgaacaatgtctgggtgatctggctgagcctgctggtcgggctggtgctggccgtagcgccgatgcctaccttcaccgagatcggccgcccgctgtggctggcgatgctgctgacctactgggtgttgctgctgcccgagcgcgtcgggatggtcaccgcctggctgctcggcctggcccaggacgtgctctacggcaacctgctcgggcagaacgcgctgatcctcggcctgatcaccttcctcgtgctgtccctgcaccagcgcctgcgcatgttcccggcctggcagcagtgcctggtgctggtggtggtctacggcctggcgcagctgctccagctctggctcaacgccctgaccggcaatcgtccgccgaccctgaccttcctgctcccggccctggtcagcgcgctgctctggccctgggtgtacgccctgctgcagttcgtccgcctgcgtctcaacgtgaggtag

SEQ ID NO: 6214 - DNA, 516 bp, Magnetococcus MC-1
atgacgctagcagggagcctgctggcaccttggttgccgctgttaagtctcatgctggcggtggcggtgcaggaggtggcgttgccttatcaggcttggtcggtgtttcgtccagacctgttgttggtggcgctcttttattggcgtctctaccggcctgaccgctgtggaccgggttctgcctttggggcaggggtggcggtggacctgctcagcggtggtcccatggggatcaacgctttgagtaaaattttgattaccctgctgatccgccgttttgggccacgtttgcgggcgaccgatgccatctttttggtgccaatcctggcgctgttgtcgctgttggaccaaatgatacagttgggtctagccaccctggtgcaggggtggggggtgcggtggccgctgctgctggggcgggtggtctccaccgcgctggtggcgccgctggtggtcggggcgctgatccatattcaccgtatctggctaggagagacacctcgtgctggaagatga

SEQ ID NO: 6215 - DNA, 489 bp, Shewanella sp. ANA-3
atgagtttacaagctgcaaatggcagactcgtagtatggctgaccctatttgtcgggctgttaagtcagattatgccgctgccttcgattgtcgaagcttggcgccctgactggttattgatgatcctgatctactggtcgattgcgttgccccacagatataacattctcacggcttggctgatgggattggccctcgatattctgcttggcgccaccttaggtgtgcgctcgctcgccatgtcattagtgatttatatggcgattttgcactgccaacgtttgcgtaacttccctaagtggcaacaggcgctggtggtgatggtgctgatcgttatctatcacctgattatctattgggtcgagtttgtgatggatggcgctaagttccatacggatctgtttttacccgcgttatcgggcctagtgttttggccgtggattttttggattttgcgtcgaattcgacgtcattataaggtgcgttag

SEQ ID NO: 6216 - DNA, 489 bp, Shewanella amazonensis SB2B
atgagtctgcaggcccccaatcgtcgcatcgtggtctggctaaccctgtttgtcggcttgttgtttcaaatcatgccgctgcctgatctggttgccgcctggcgtccggactggctgctgctggtgctcatctactggaccatggctttgccccatagatacaacatcctgaccgcctggattttgggggtggtattggatgtattgctgggcgcgaccctcggcgtcagggcgctggctttttcattggtgatttacgtggtggcactgcattttcagcgtatgcgtaacttcactatctggcagcagtctttgttggttgcatccctggtaggggtgtttcatctggtggtgtactggctgcagtacgtgctgaccaaggccacttactcccacgccatcttctggcctgtgttgtccagcctcgttatctggccctgggtgttctggttcctgcgtcgggtgcgtcgccgttataaagtgagataa

SEQ ID NO: 6217 - DNA, 402 bp, Psychromonas ingrahamii 37
atgctgaatgcttttcgtcccgattggatgatccttattattttttattgggtactcgcattaccgcatcgggttagcatcgtgcatgcgtttattttaggggtagtatttgaccttttattaggctctacgttaggcatgcatgccttattattttcatttttagcctacatagtcattaccaattaccaactttttcgttatttcactctggtacaaacaaccctcttagtcggtttgtattctttactgtcgaaactggcgttatatttgatggcatcaagcttacaagatattattttacatcaatcttatttctggtcagtctttacctcgatgctggtttggccctggttttttctttttttgcgttttattcgtcgccgttttaaggtcgtataa

SEQ ID NO: 6218 - DNA, 519 bp, Acidovorax avenae citrulli AAC00-1
atgatcatgccccgcggcgaacagttgctgctgccggtgcgccctgccttcatcgcggccagcctgctggtggcgctggcgttcaacatgctgccgctggggcgcttggtgtggacgcccgacctcgtcatggtgctgctcgtcttctggggcgtgcaccagccccagcgcgtgggcatggccgtcgccttcgccatgggcctgtgcatggacgtctaccagaccgcgctgctggggcagcatgcgctggcctactgcgccatgatgttcggcgccatctacctgcaccggcgcctgctgtggttcagcccgttctcgcaggcgctgcaggtgctgcccctgttcctggccgcgcatgcgatcgaactgctggtgcgcatggtgtcgggcggcatcctgcccgggctgccggggctgatctcgcccgtgatcgaggccctgctgtggccgctcgccagttgggtgctgctcgcgccgcagcgcctgccgcccgaccgcgacgagaaccggccgctctga

SEQ ID NO: 6219 - DNA, 522 bp, Acidovorax sp. JS42
atgatcatgcccaagggccagcagctgctgctgcccgtgaacccggtcttcatcgctgccagcctggtggccgcgctggcgctgaacatgctgccactgggccgcgtggtctggacgcccgactgggtcatggtgctgctcgtgttctggggcatgcaccagccgcagcgcgtggggctgggggtggctttcctcatggggctgtgcctggatgtgtaccagtctgccctgctgggccagcatgcgctggtgtactgcctgctgatgttcggcgcgcaatacacgcaccgccggctgctgtggttcggcccgctgctgcaggcgctgcaactgctgccgttgttctttgcggcccatgcgctcgaactgctgctgcgcgtagccatcggcgggggcatcctgccgggtttcgaaggcctggtggcaccgctgctggaggccgccctctggccgctggccagctgggtgctgctggcgccccagcgccgcccgcccgaccgcgatgaaaaccggccgctgtga

SEQ ID NO: 6220 - DNA, 519 bp, Verminephrobacter eiseniae EF01-2
atgatcatgccgcgcggtgaacctttgctgctgccggtgaacccggtgttcatcggcgccagtctggcggtgggcctggcgctgaacatgctgccgctcgggcgcatcgcctggatgcccgatctgctgatggtgctgctggtcttttggggcgcgcaccagccgctgcgcatgggcatggggacggccttcgtgctcgggctgtgcatggatgtgggccagtcgaccctgctcggccagcatgcgctgtcgtacacggtgctgtcctttgcggccgtggccatccaccgccgcctgctgtggtttggcgtgccttcgcaggcgctgcaggtcttgccgctgttcgcgttggcccatgcgctggagcttttgccgcggctggccagcgggggcatatttccggggcctggcctgttggcggccccgctgctggaagcgctgctctggcccctggcctgcggggtgctgttggccccgcagcgccgcccgcccgatagcgatcaaaaccgtcctttgtga

SEQ ID NO: 6221 - DNA, 492 bp, Halorhodospira halophila SL1
ttgaccgggcatcggccacgcaacggcggcgggatcatcctgctcagcttcatcatcgccctgatgctgaccatcgtccccatgccgggctgggcgcaggagttccgcccggagtggacggcgctgatcctgctctactggggcctggcactgcccgagcgggtgggcgtgggcgtcgggtggctggtggggctgttccaggacgccctgctcgggaccctgctcgggcagcacgccctggccttcgccctgatcgccttcctggccctgcggctgcaccagcatctgcgcctggtgccggtctggcagcaggcggtggtggtactcgggctactggtggtcgcccagctggtcgtcttctggatcaacggcatcatcgggcggccggctccggagtggcaggcgtgggccgcgatcctggtcggcgctgccatctggccgttggtctttcacatcatgaggggggtgcggcgccgcttccaggtgcagtga

SEQ ID NO: 6222 - DNA, 477 bp, Marinobacter aquaeolei VT8
atgttgtctgtcatcagttatccgctgttcgccatcaccgtggtgttatcgttggtgctgagtatctccctgttcccggtggactggtttcagtttcgcccggagtggctcggactgattgtcttctactggaccttccgcgccccggcccagtttggcattctgatggcctggtgcctggggttgttactggatattctcgagtctaccccgctgggcgtgaatgccatgggcatggccctgatcgcctttctggttctgaccattcaccagcggttgcggatgtatccgctgcctcagcagtgcctgatggtgtttctgttattgggcatcaaccagatgctggtacatttcgtgaaacagttactgggtgctgaaagcgccggtttcagctacttgtggccagccttgacgagcgctctggcctggcctgtggtcagtggcgtactggacacaatcaaccgtaaactgggataa

SEQ ID NO: 6223 - DNA, 489 bp, Shewanella baltica OS155
atgagttttcaagcagccaatgggcgcttcattgtttgggtgacattatttatcggcgtgatcagccagatcatgcctttgccgagtgtggtcgatgcttggcgtcccgactggttgttgatgattgtgctctactggtctatcgcattaccccatagatacaacatcttaaccgcttgggtcttaggcttagtgttagatattttattgggtgccaccttaggtgtgcgctctttagcgatgtctttggtaatttatgtcgccatcttgcattgccagcgattgcgaaatttccctaagtggcaacagtcgttggtgatcatgctgcttatttgtatgtatcacttagtgatttactgggtagaatttgtcatgcaagaggcggtgttcgatacggatctattcttacctgcgatttcaggattggtgatctggccttggatattttggattctacgtcgggttcgacgccactataaggttcgctaa

SEQ ID NO: 6224 - DNA, 489 bp, Shewanella loihica PV-4
atgagcatgcatattccccacggtcgttgggtggtctggttaagcttcctgctggccatgttatttcagatcatgccgctgcccggcctggtagagggctggcgccccgactggctgctgctggtgatgatctattgggcgatggcgctgccgcaccgctacaacatcctctcggcctgggtgctgggcgtcttgttggatatcctgctgggggcccacctcggcatacgcgcgctctccatgtcgctggtgatctatgtggtggtactgcattttcagcggctgcgtaacttccccatgtggcaacaggcactgatggtggccagcctggtgtgcctgcaccatctgctggtgttctgggtacagtttgtggtgaacgtggcgagcttcgatgtcagcctgttcctgccggccctgtcgagcctgatcatctggccttgggtattttggatgctgagacgcattcgccgtatttataaagtgagataa

SEQ ID NO: 6225 - DNA, 525 bp, Polynucleobacter necessarius asymbioticus QLW P1DMWA 1
atgatcgatttccaaagcggttatattctgcgcccggtcaatccggtatttatttatttcagcttattctgtgcgctgcttttaaatctattgcccattggaaactatggttgggtacccgactggctcatcatctgcatggtcttttggaatattcaccaacatcgttatgtgagcgtgattaccgctttcatactgggtctaatgatggacgtgcacaactccgatctactaggcttgcacgcctttagctattcattggttgcgtatgtagccatctcttggcataggcgaattgtggcgctaacagtgctttcccaagcagttcatttgctacccgtcttcctgctagtggcgctatttccagtcttagtacattgggcgctcagcggtgaactgtattggtgggccttaacgggcgcagttcaagcttttattgaagccatgctttggccgcttgctacgcgcattctgctagccccgcaacgtcgacccattgacgttgaccataatcgccccctataa

SEQ ID NO: 6226 - DNA, 489 bp, Enterobacter sp. 638
gtggcgagctatcgtagtcagggtcgttgggttatttggctctcgttcttcatcgcactgttgctgcaagttatgccctggccggacgaccttctcgttttccggccaaactgggtgctgctcattttactgtactggtcccttgcactgccgcaccgcgtaaatgtgggcacaggttttgtgatgggtgccatactggatctcattagtggctcaacgcttggcgtgcgcgccttgtccatgagtattattgcgtacctcgtcgcactgaaattccagcttttccgaaacctcgcgctctggcaacaggcgctggtggtgatgttgttgtcgcttgccgcggatatcattgttttctgggctgagtttttagtgatcaacgtctctttccgaccggaagtgttctggagtagtgtagttaacggtgtgctctggccgtggttgttcctgctgatgcgcaaaattcgccagcagtttgccgtgcaataa

SEQ ID NO: 6227 - DNA, 489 bp, Pseudomonas mendocina ymp
atggtcggtgttcaatcgcgcaacggctgggtgatctggctcagcctggcgctcggattgttgctcagtgtttcaccgctgcccgagttcatgcagatcggccgcccactgtgggtcgcgctgatcctcacctattgggtgctggcgttgccgcatcgcgtcggcatgaccacggcctggttgctggggctggcacaggacgtgttgttcggtaccctgctggggcagaatgcgctgatcctgaccctgatcacctttctggtgctgagcctgcatcagcgtctgcgcatgttcccactgtggcagcagagcgtggtgctgatggtggtgttcggcctggcgcagctggtgcagctgtggctcaacgccctgaccggcagccgtccgccgaccctggccttcgtcctgccggcactggtcagcgcactgctctggccctggatctgcggcatcctgcgcggcctgcacctgcgcctcaacgtcaactga

SEQ ID NO: 6228 - DNA, 489 bp, Shewanella putrefaciens CN-32
atgagtttacaagctgccaatggtcgactcatcgtctggttgacgctgtttatcggattgctaagccaaattatgccgttaccttcggtggttgaagcttggcgccctgactggctgttaatggtggttatgtattggtctattgccttgccacacagatacaatattttaactgcttgggttttaggtttggccctcgatattctgttgggagcaaccttgggtgtgcgctctttagcgatgtcattggtgatctatattgcgattttgcattgccaacggttgcgtaatttcccaaaatggcagcaaaccttagtagtggcgctgctaattgccctttaccacttagtcgtttactgggtagagtttgtgacggatgaagcgacgtttaatgcggatttgtttctacctgccatttctgggctagtgatttggccttggattttttggattttacgtcgtgttcgacgtcattataaggttcgctaa

SEQ ID NO: 6229 - DNA, 489 bp, Vibrio cholerae O395
atgctcagcagtgatattaaaggccgcatggtcattcttgcctcatttttactggcgctgattttgcaaaccatcccatggccgggaaccttagatctgttccggccaccttggctgctgctggtctgttgttactgggtattggcactgccgcaccgagtgaatgtcggcagcgctttggtcatgggcttattgtgggatctgttactcggttccaccttaggtattcgcggcatgatgatgtcgatcatcatctatctggtcgcgatgaatttcttggtactgcgcaacatggctctatggcagcaagcgattgtgattggtttgctgtcgatgggattggaagtgctgattttctgtggtgagtacctgatccagaatgtgacattcaatccgttgtcactctggagtggagtgattgcctgtatactttggccgtggatgtttttattactgcgccgagttcgacgccattggcatgtgaaatga

SEQ ID NO: 6230 - DNA, 489 bp, Pseudomonas putida F1
atggctgcatcacgccgcaataacggctgggtcatctggcttacgttcgccatcggcctgctgctcagcgtttcccccatgccgcagttcatggaagtgttccggcccatgtggctggccttgctggtgtcgttctggacccttgccgtgccgaacaaggtcggcatgaccacggcattcgtgctgggccttgccgaggacgtgctgtatggcacgctgctggggcagaatgcgctggtccttaccctcatcaccttcttggtgctgtccctgcagcagcgtctgcgcatgttccccatgtggcagcaaagcctggtcattttggtgatctttggtatcgcccagttgatccagctgtggctcagtgcactgaccggcaaccgcctgcccaccctggcgctggtctggtcggcggtgatcagcgccttgctctggccgtggatcagctttgccttgcgcgacctgcgtcgacgcttgcacatcaactga

SEQ ID NO: 6231 - DNA, 489 bp, Psychrobacter PRwf-1
atgatcaagtctcccttaagcccgttacaatctttgctgttggttattgcaagttttgtggcggcttctgtcgttaatatctacccgcttagtttggatgcctcgaagctacggcccatggcacttattatggtgcttattttttggcttatctataaaccgcgctatgtgggggtggtgaccgcttttgccattggtattatctcagacttgttgttagatacccgcttagggcagcagggatttgcggcagtgattatggcgttttcgctacgttttgttgggcagtatatcaagcaagttaatctgcccgttgcttggacggtggcgacaggggcacttatcgtgtttcagctgacgttatggattgtgcaatacctgacccagaacatattttatgccagtgcaatttttagcttattggtcagtgtcattagctggccgttggtattttttggattgcaccgttttatcaacaagtattcatag

SEQ ID NO: 6232 - DNA, 495 bp, Pseudomonas aeruginosa PA7
atggctcgcgcgacccagggttcgaacaatgtctgggtgatctggctgagcctgctggtcggcctgctgctggcggtggcgccgatgccgacctttaccgagatcggccgcccgctgtggctggcgatgctgctgacctactgggtgttgctgctgcccgagcgggtcgggatggtcaccgcctggctgctcggcctggcccaggacgtgctctacggcaacctgctcgggcagaacgcgctgatcctcggcctgatcaccttcctcgtactgtccctgcaccagcgcctgcgcatgttcccggcctggcagcaatgcctggtgctggtggtggtctacggcctggcgcaactgctccagctgtggctcaacgctctcaccggaaaccgtccgccgaccctgaccttcctgctcccggcactggtcagcgcactgctctggccctgggtgtacgccctgctgcagttcgtacggctgcgccttaacgtgaggtag

SEQ ID NO: 6233 - DNA, 474 bp, Marinomonas MWYL1
atgaaaccgatttttgttttttgtattactctgctgacagctttaatgcttgaagccatgccttttcctgaagagcttgtttggttccgtcccgaatgggcattgctggttatcctttattgggttattgctttgccatttcgtgttggcgtgggcttggcttggtttctgggcttaatggtcgatttattgcagggcggcataattgggcaacactcgctaacctatgtcattattgcttatacatgtgctgtattttacaagcgattgcgaatgtatcatcgttggcaacagggcttttttatctgcttgctagtcagtattaatcagctgcttgatttctggatcgatcactatcttggtcatgctgagccgaccttaatgatctttatgcctgcggttattactgggctattatggccttggtcatttattattttgcgtagcgtacggcgcatttatgctatccgttag

SEQ ID NO: 6234 - DNA, 489 bp, Shewanella baltica OS185
atgagttttcaagcagccaatgggcgcttcattgtttgggtgacattatttatcggcgtgatcagccagatcatgcctttgccgagtgtggtcgatgcttggcgtcccgactggttgttgatgattgtgctctactggtctatcgcattaccccatagatacaacattttaaccgcttgggtcttaggcctagtgttggatattttattgggtgccaccttaggtgtgcgctctttagcgatgtctttggtgatttatgtcgccatcttgcattgccagcgattgcgaaatttccctaagtggcaacagtcgttggtgatcatgctgctcatttgtatgtatcacttagtgatttactgggtcgagtttgtcatgcaagaggcggtcttcgatacggatctattcttacctgcgatttcaggattagtgatctggccttggatattttggattctacgtcgggttcgacgtcattataaggttcgctaa

SEQ ID NO: 6235 - DNA, 489 bp, Yersinia pseudotuberculosis IP 31758
gtgaatcgttacagtagtcatggtcgctgggttatctggctatccttcctgattgcgatggtgctacaaattatgccgtggcctgaacagatctatatgtttcggccctcatggttagccttggtactcatttattgggtgatggccttgccacaccgggtgaatgttggcacggggtttattctggggctgattatggaccttattttaggatcgactctgggagtccgggcgttggcattcagtatcatcgcctatctggtggcctttaagtttcagttattccgtaatatggcactgtggcaacaggcacttatcgtcatgctgctttcgctgacgatggatgttgtggtgttttggtctgagttcttggtgattaatgtcgcattccggcccgaagttttctggagtagcgttgtcaacggcattctctggccatggctattcctgctaatgcgtaaaattcgccgccaattttcggtgcaataa

SEQ ID NO: 6236 - DNA, 489 bp, Vibrio harveyi ATCC BAA-1116
atggccaatagtgtattaagaagtcgaatggtcatcggcgtcagctttttcgttgcgctagtcctacaaaccattccatggccgggcgtactcgatttgttgcgcccatcatggctgttcctagtgacctgttactgggtgttggcattgccgcaccgtgtcaatgttggtaccgctctgatcttaggtttgttgtgggacattttgattggctcgacgctcgggatccgagggatgatgatgtcgatcattatctacttggtggcattaaacttcttggttatccgtaacatggcattatggcaacaatctattttgattgccttttttaccgtgctactagagcttctcatattctgtggggaatatttgaatcaggacgtagtatttaatccattatccctgtggactgcagcaataaactgtatactttggccatggatgtttttattaatgcgacgcgtccgtcgcgcatggcacgtaaggtag

SEQ ID NO: 6237 - DNA, 489 bp, Escherichia coli HS
gtggcgagctatcgtagccagggacgctgggtaatctggctctctttcctcattgcgctgttgctgcaaatcatgccctggccggataacctgatttttttccggccaaactgggtgttactcatcttgttgtattggatcctggccttgcctcatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgcaaagtccgtcagcagtttgcagtgcaataa

SEQ ID NO: 6238 - DNA, 489 bp, Escherichia coli E24377A
gtggcgagctatcgtagccagggacgttgggtaatctggctctctttcctcattgcgctgttgctgcaaatcatgccctggccggataacctgattgttttccggccaaactgggtgttactcatcttgttgtattggatcctggccttgcctcatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgtaaagtccgtcagcagtttgcagtgcaataa

SEQ ID NO: 6239 - DNA, 489 bp, Shewanella sediminis HAW-EB3
atgagtatgcatattgctaatggacgctgggtggtatggttgagtttcctggtcgccatgttatttcagataatgcctctgccggatcttgtcgagccgtggcgcccggactggttactgctggttatcatctattgggccatggcgttgccccaccgatataatattttatcggcctgggtcttaggcgtgctgctcgacatcatgcttggggcacatctgggtattcgagcgttatcgatctctctggtcgtctatgtggtggtgctgcattttcagcggttacgtaacttccccatgtggcagcaggcactgatgatctccagtttgatatgcttatatcacctggtcatcttctgggttcaatttgtcgttgatacggccacatttgatgtgcgcctatttttacccgccatctccagcctcattatctggccttgggtattttggatcttacgtcgtgtcaggcgtttatataaggtgagataa

SEQ ID NO: 6240 - DNA, 489 bp, Serratia proteamaculans 568
atgaatcgctaccgcagtaatgggcgctggataatctggctgtcattcctggtggcgctggtgctgcaaattatgccgtggccggaacagatctacatgttccgtccctcctggctggctttgatcctgatctactgggtaatggcactgccacaccgggttaacgtcggcaccggctttgtgctggggttgattatggatctgatcctcggttctacgctgggtgtgcgtgcgctggcgctggggatcattgcctatctggtcgcgtttaaattccaactgttccgcaacatggccctctggcaacaggcgttgatcgtcgtgctattgtcactggcgatggatgttgtggtgttctgggccgagtttttagtgatcaacgtttctttccgcccagaggtgttctggagtagtgtggtaaacggcattctgtggccgtggttattcctgctgatgcgcaaaatccgccgtcagttcgccgtacagtaa

SEQ ID NO: 6241 - DNA, 489 bp, Shewanella pealeana ATCC 700345
atgagtttacatgtagcaaatggccgctgggtcgtttggttaagcctattagtggctatgctgtttcaaattatgccattgccagatgtggtagaggcgtggcgtccggattggctattactggttatcacctattgggcgatggcattgcctcatagatataatattttaacggcatgggtgctcggtgtgatgctagacatcttactcggggcaaccttaggtattcgtgcctttgctatgtcagttgttgtatatgtggtcgtgctgcactttcagcgcttacgtaatttccctatgtggcaacaagctttattggtggccatgcaggtcgcagtatataacctagtggtattttgggtgcagtttgttaccgagtctgctgtgtttgatattagcttgttctacccggcaatttccagcttgattatgtggccatggatcttctgggtattacgccgtgtaagacgcctgtacaaggttagatag

SEQ ID NO: 6242 - DNA, 489 bp, Shewanella baltica OS195; identical to SEQ ID NO: 6234

SEQ ID NO: 6243 - DNA, 489 bp, Coxiella burnetii RSA 331
atggaaggtaattatgcaaaagatgtgttagctatcggcctcaccctaataatggcaatgatgttgacgatattacctttgcccgcatgggccgtctggtaccaacccgcttggatcttcatggtgctgttattttggatgatcgctcttccatatcgggtggggataggggctgctttcatctgggggctgctttttgatttgctgtcaggcacaattttgggacagcatgcgttgatattcaccatcatcgcttattttattatccgctttcaaacgcccctacgcagtctaccgaactggcaacaaatgatacttgtttttatcgccactgctgtttatttagcgttacaatattggattatggcgatggctgacgcatcgccagagacagcaaaatattggctacccctcatgagcacgactctcttatggccttgggtacgagttttattaaaagattatcagagtcgttttagattaggttaa

SEQ ID NO: 6244 - DNA, 489 bp, Yersinia pestis Angola
gtgaatcgttacagtagtcatggtcgctgggttatctggctatccttcctgattgcgatggtgctgcaaattatgccgtggcctgaacagatctatatgtttcggccctcatggttagccttggtactcatttattgggtgatggccttgccacaccgggtgaatgttggcacggggtttattctggggctgattatggaccttattttaggatcgactctgggagtccgggcgttggcattcagtatcatcgcctatctggtggcctttaagtttcagttattccgtaatatggcactgtggcaacaggcacttatcgtcatgctgctttcgctgacgatggatgttgtggtgttttggtctgagttcttggtgattaatgtcgcattccgccctgaagttttctggagtagcgttgtcaacggcattctctggccatggctattcctgctaatgcgtaaaattcgccgccaattttcggtgcaataa

SEQ ID NO: 6245 - DNA, 489 bp, Pseudomonas putida GB 1
atggctgcatcacgccgcaacaatggctgggtcatctggctgacgttcgccatcggcttgctgctcagcgtttcgcccatgccgcagttcatggaagtgttccggcccatgtggctggcattgctggtgtcgttctggaccctcgccgtgccgaacaaggtcggcatgaccaccgcgtttttgctgggcctggccgaggatgtgctgtacggcaccctgctggggcagaacgcgctgatccttaccctcatcaccttcctggtgctgtccctgcagcaacgcctgcgcatgttccccatgtggcagcaaagcctggtcatcctggtgatcttcggcatcgcccagctgattcagctgtggctcagcgcactgaccggcaatcgcctgcctaccctggcgctagtctggtcggcggtgatcagtgccttgctctggccgtggatcagtttcgccctgcgcgatttgcgccgacgtttgcatatcaattga

SEQ ID NO: 6246 - DNA, 489 bp, Escherichia coli C ATCC 8739; identical to SEQ ID NO: 6187

SEQ ID NO: 6247 - DNA, 489 bp, Pseudomonas putida W619
atggccaaaacgcgccgtaaccacgggtgggtcatctggctgacctttgccattggcctgctactcagcgtctcgcccatgccaccgtttctcgaggtgttccggcccatgtggctggcgatgctggtgtcgttctggaccctcatggtcccgaacaaggtcggcatgacaactgcattcgtgctgggcctggccgaggacgtgctgtacggcacgctgctcgggcagaatgccctggtcctgaccctgatcaccttcctggtgctgtcgctgcagcagcgtctgcgcatgttcccgatgtggcagcagagcctggtaatcctggtgatcttcggtatcgcccagctgatccagttgtggctcagtgcgctcaccggcaaccgtttgccgacgctggcactggtctggtcggcagtcatcagcgccttgctctggccgtggatcagcttcgccctgcgtgatctgcgccggcgtttgcatatcaactga

SEQ ID NO: 6248 - DNA, 489 bp, Yersinia pseudotuberculosis YPIII; identical to SEQ ID NO: 6244

SEQ ID NO: 6249 - DNA, 489 bp, Shewanella woodyi ATCC 51908
atgagtatgcatattgccaatggccgttgggtcgtttggctgagttttttagtggccatgttatttcaaatcatgccactcccggatctggttgaagcttggcgtcctgattggctgctgcttgtgatgatctactgggcgatggccctgcctcatcgatacaacattttatctgcatggatactgggggtgatgctggacatcatgttgggtgcccacttggggatccgagcactctctatgtctttggttgtctacgtggtggttttacattttcaacgactacgtaatttccccatgtggcaacaggcgctaatggtcgcgagcttaatctgtttgcatcatctcgtgatattttgggtgcagtttgtggtggggacggtaacctttgatgtcagtttattccttcctgctatctctagcttgattatctggccctgggtgttttggattttacgtcgagttcggcgcttatataaggtgaggtag

SEQ ID NO: 6250 - DNA, 486 bp, Xylella fastidiosa M12
atgacccggctgcgtaatacttggttattgccggtcagtgtgatattggccttgcttctggggttacttccgttaccagtgtcagtgcgaccaatccgtccttactggttagcgttggtgctgatgtactgggtgatcgagacgcctggtcgcgttggaatcggtttcgcttttgtaatgggtgtactggctgacttcctttatggtggtttgttaggggagcaggcgttgcgtctggtggtgatgtccttcatcgtgcaacgttttcgagcccgcctgcgcttcttcccgatgccgcagcaggcgttggtcatcggtggcttgctattcaacgattgtgtagttgctacggcgttgcatttgaccttgggtcagccattgttgccctggagttattggtcggcaccgctattgggaatgttgttgtgggcaccgttgtttgtgttgctggatgcgttgcgactaggtcatgggagtcggaagtga

SEQ ID NO: 6251 - DNA, 489 bp, Escherichia coli SMS 3 5
gtggcgagctatcgtagccagggacgctgggtaatctggctctctttccttattgcgcttttgctgcaaatcatgccctggccggacaacctgatagttttccggccaaactgggtgttactcatcttgttgtattggatcctggccttgcctcatcgcgtaaatgtgggcacaggttttgtgatgggtgccatactggatctgatcagcggctcgacacttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggagtgctctggccgtggattttcttgctgatgcgtaaagtccgtcagcagtttgcagtgcaataa

SEQ ID NO: 6252 - DNA, 507 bp, Leptothrix cholodnii SP 6
atgggcgaccagctgctgctgcccgtcaacccgtggttcatgtgggcctcgctgctgctggcgctgggtctgaacatgctgccgctcggccgcctgccggcgatgcccgacctggtcgcgctggcgctggtgttctggaacgtgcaccagccgcgccgggtcggtgtcggcgcggccttctgcttcggcctgctgatggacgtgcacgaaggcgccgtgctcggccagcatgcgctggcctacacgctgctgagctacttcgcgatcaccatccaccgccggctgctgtggttctcgaccccggcgcaggcactgcacgtgctgcccctgatggccgccgcgcacctcgtgaccctgctgctgcggctggccaccggcgggcatttcccgggctggagcctgctgctgtcgccgctgttcgagaccctgctgtggccgctggtgagcctgctgctgctggcgccgcagcgccgcgcgcccgacccggacaagcaccggcccctatga

SEQ ID NO: 6253 - DNA, 525 bp, Polynucleobacter necessarius STIR1
gtgattgatttccaaagcggctacattctgcgtccggtaaatccggtctttatttacttcagcttattttgtgcgctgctactaaatctattgccgattggtaactacggttgggtgccagattggttaattctgtgcatcgtgttttggaatattcatcaacatcgttatgtcagtgtcattaccgctttcattcttggtttaatgatggacgttcacaactcggatctgcttgggctgcacgccttcagttactctcttgtagcctgcgttgccatctcctggcataggcgtattgtggcgctcaccgtgctttcacaggccttacatctgctcccgattttcttattggtatcgctgtttcctgtgctagcccattggctactcagcggagaactatattggtgggctttaacgggcgccattcagactctaattgaagcaatgctctggccaatagcgacgcgcatcttacttgcaccacagcgtcgccctatagatgttgatcacaatcgacctctctaa

SEQ ID NO: 6254 - DNA, 486 bp, Xylella fastidiosa M23
atgacccggctgcgtaatacttggttattgccggtcagcgtgatattggccttgcttctggggttacttccgttaccagtgtcagtgcggccaatccgtccttactggttagcgttggtgctgatgtactgggtgatcgagacgcctggtcgcgttggaatcggtttcgcttttgtaatgggtgtactggctgacttcatttatggtggtttgttaggggagcaggcgttgcgtctggtggtgatgtccttcatcgtgcaacgttttcgagcccgcctgcgcttcttcccgatgccgcagcaggcgttggtcatcggtggcttgctattcaacgattgtgtagttgctacggcgttgcatttgaccttgggtcagccattgttgccctggagttattggtcggcaccgctattgggaatgttgttgtgggcaccgttgtttgtgttgctggatgcgttgcgactaggtcatgggagtcggaagtga

SEQ ID NO: 6255 - DNA, 489 bp, Shigella boydii CDC 3083 94
gtggcgagctatcgtagccagggacgttgggtaatctggctctctttcctcattgcgctgttgctgcaaatcatgccctggccggataacctgattgttttccggccaaactgggtgttacttatcttgttgtattggatcctggccttgccccatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctagtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgtaaagtccgtcagcagtttgcagtgcaataa

SEQ ID NO: 6256 - DNA, 486 bp, Stenotrophomonas maltophilia R551 3
atgagccgcctgcgcgacaacccctgggtgctgccggccagcctggtagtggccctgctgctgggcctgctgccgttgccggcgctgctgcagccgctgcgtccgtactggctggcgctggtgctggcgtactgggtgatcgaagcgcccgagcgcgtcggcctgggcatcgccttcgccagtggcgtcatcgccgatctgctgtacggcggcgtgctgggagaacaggcgctgcggctggtgatgctggccttcatcctccagcgcttccgcgcccgcatccgcttcttcccgatgtcgcagcagatgctcgccattggcggcctgctgttcaacgaccgcatcgtcagcgcgctggtccacatcgtggtggatgagccgaccctgccgtggtcgtactggtgggcgccgctgctgggcatgggcctgtggccgctggtgttcgtgctgctggacgcggtgcgtttcggcaagcgcgggcgctga

SEQ ID NO: 6257 - DNA, 492 bp, Salmonella enterica serovar Newport SL254
atggtggcgagctatcgtagccaggggcgctgggttatctggctctcgtttcttattgcgctgttgctgcaaatcatgccctggccggacgacatcattgttttccggccaaactgggttttgctcatcttactgtactggattctggccctgccgcaccgcgtaaatgtggggacgggatttgtgatgggtgccatacttgatctcatcagcggttccacacttggcgtgcgcgctctgtcgatgagtattgtcgcctatctggtcgctctgaaattccagctcttccgtaacctggcgctctggcagcaggcgctggtggtaatgttgctttcactggccgtggacattattgttttctgggccgagtttttagtgatcaacgtctctttcagaccggaagtgttctggagtagtgtagtcaatggcgtgctgtggccctggctctttttgctgatgcgtaaagtacgccagcagtttgctgtgcaataa

SEQ ID NO: 6258 - DNA, 492 bp, Salmonella enterica serovar Heidelberg SL476; identical to SEQ ID NO: 6257

SEQ ID NO: 6259 - DNA, 492 bp, Salmonella enterica serovar Schwarzengrund CVM19633
atggtggcgagctatcgtagccaggggcgctgggttatctggctctcgtttcttattgcgctgttgctgcaaatcatgccctggccggacgacatcattgttttccggccaaactgggttttgctcatcttactgtactggattctggccctgccgcaccgcgtaaatgtggggacgggatttgtgatgggtgccatacttgatctcatcagcggttccacacttggcgtgcgcgctctgtcgatgagtattgtcgcctacctggtcgctctgaaattccagctcttccgtaacctggcgctctggcagcaggcgctggtggtaatgttgctttcactggccgtggacattattgttttctgggccgagtttttagtgatcaacgtctctttcagaccggaagtgttctggagtagtgtagtcaatggcgtgctgtggccctggctctttttgctgatgcgtaaagtacgccagcagtttgctgtgcaataa

SEQ ID NO: 6260 - DNA, 459 bp, Alteromonas macleodii  Deep ecotype
atgatctggattagcctattagtggcactggttctacaaattgtgcccctacctacacaagttgacctttaccggcctgactgggtattagtggtgctggcctattggagtatggcgttaccgcatcgagtgaacgtggggatcgcctttttaacgggtgtcgccatggatgttttggtaggcactaccttaggcatccacagttttgcgcttagcatttgcgtttatatactggctgctaattaccaacggctgcgtaattattccgtatggcagcaagctattatcatcggccttctatcatcgttatatcacctgatgacattttgggttcagcaccttctgaccgatatttattttcaagtggactatttatggccggtgttaacttctatggtgctatggccttgggtattttggttacttagacgtacacgtagacagttttctatttcgtaa

SEQ ID NO: 6261 - DNA, 492 bp, Salmonella enterica serovar Agona SL483
atggtggcgagctatcgtagccaggggcgctgggttatctggctctcgtttcttattgcgctgttgctgcaaatcatgccttggccggacgacatcattgttttccggccaaactgggttttgcttatcttactgtactggattctggccctgccgcaccgcgtaaatgtggggacgggatttgtgatgggtgccatacttgatctcatcagcggttccacacttggcgtgcgcgctctgtcgatgagtattgtcgcctatctggtcgatctgaaattccagctcttccgtaacctggcgctctggcagcaggcgctggtggtaatgttgctttcactggccgtggacattattgttttctgggccgagtttttagtgatcaacgtctctttcagaccggaagtgttctggagtagtgtagtcaatggcgtgctgtggccctggctctttttgctgatgcgtaaagtacgccagcagtttgctgtgcaataa

SEQ ID NO: 6262 - DNA, 477 bp, Acidithiobacillus ferrooxidans ATCC 53993
atgatcgccgtcgtagtcgttctcggttttttcttcgcgctcgtggcggaagccattccctgcggtccgttttacgcatcgctccacccggattttgtagccctgctactgctctattgggccatcagcagtgcttctgaactgagctttaccgtggtctggctgatcgggctacttcaggatatggtacttggcgatgtgctgggagcccaggctatcgccggggtcgtcatgatttatctgctctacaccggcattgccagggttcgcagtctggcgtcctgggagcaactcttcttcatattcatgttgctgctggcccaccggttgctggtctggtcgtggcaggcctgggcaggcaccatcacatggcatttttcgctgcttttagggccactgatcggcgccctgttgtggccgctttttacgttgacgctcgattatctgcgtcacgcattgcgcctgaaccatacatga

SEQ ID NO: 6263 - DNA, 492 bp, Salmonella enterica serovar Dublin CT 02021853; identical to SEQ ID NO: 6257

SEQ ID NO: 6264 - DNA, 492 bp, Aliivibrio salmonicida LFI1238
atgacgagtagtcatcttatgcgtggaagagtcattatttggctctcttttttgatcgcattaatattacaggcggcaccttggcctggaacattagaagtattacgaccttcttggatcatattagtgactttctattgggtattagcattgcctcatcgggttaatgttggtactgccatgatacttgggatcttatgggatctattacttggcacaacgcttggtatccgtggaatgacgatggcgattttggtctatctggttgctgcgaattttaagttgttgagaaaccttgctctttggcaacaagctgcaatcttctcagcattaacgttactgggtaaactcttagaatttttaggcgaatttttagttcatgatgtgtcattcaacggacattttttatgggcgggcgtgttaaactttattttgtggccttggttatttttattgatgcgtagagttcgccgtcattggtctattcgataa

SEQ ID NO: 6265 - DNA, 489 bp, Escherichia coli O157 H7 EC4115
gtggcgagctatcgtagccagggacgctgggtaatctggctctctttcctcattgcgcttttgctgcaaatcatgccctggccggataacctgattgttttccggccaaactgggtgttactcatcttgttgtattggatcctggccttgccccatcgcgtaaatgtgggcacaggttttgtgatgggtgccatactggatctgatcagcggctcgacgcttggcgtacgcgtattggcgatgagcatcattgcttacctggtggcgctgaaataccagcttttccgcaacctcgcattatggcagcaggcgctggtcgtcatgttgctttcgctggtggtggatattattgttttctgggcagagtttttagtgattaacgtctctttcagaccggaagtgttctggagtagtgtagtcaatggggtgctctggccgtggattttcttgctgatgcgtaaagtccgtcagcagtttgcagtgcaataa

SEQ ID NO: 6266 - DNA, 522 bp, Thauera sp. MZ1T
atgcaccccaccaaccgttccagccgcatcctgcagccggtcaagctgtggttcgtctacctgagcctgttcgtcgcgctcggcctggagtacatccccaccggacgcacgcccggcctgcccgactgggtagcgctggcgttggccttctggtgcgtgcgcgagccgctcgcgatcggcatgggcgcgggtttcgccttcggcctgctgatggacgtcggcctcggcgcggcgatggggcagcacgcgctcgcctatgtcgtgctggcttatctggccaacgcgctcgcccgccgcgtgctgtggttccccgcctggcagcaggcgctgcacgtgttgcccctgctgctgctggcgcaggcgatcatggcgctggtgcgcctggtggcgggggcggagttccccgggtgggcgtatttcctgtcgagcttcggcagcgcgctgctgtggacgccgctgtccttcctgctgctgctgccgcagtaccagccggacgagcgcgatgacaatcgcccgatctga

SEQ ID NO: 6267 - DNA, 489 bp, Shewanella baltica OS223
atgagttttcaagccgccaatgggcgcttcattgtttgggtgacattatttatcggcgtgatcagccagatcatgcctttgccgagtgtggtcgatgcttggcgtcccgactggttgttgatgattgtgctctactggtctatcgcattaccccatagatacaacatcttaaccgcttgggtcttaggcttagtgttagatattttattgggtgccaccttaggtgtgcgctctttagcgatgtctttggtgatttatgtagccatcttgcattgccagcgattgcgaaatttccctaagtggcaacagtcgttggtgatcatgctgctcatttgtatgtatcacttagtgatttactgggtcgagtttgtcatgcaagaggcggtgttcgatacggatctattcttacctgcgatttcaggattagtgatctggccttggatattttggattctacgtcgggttcgacgtcattataaggttcgctaa

SEQ ID NO: 6268 - DNA, 477 bp, Acidithiobacillus ferrooxidans ATCC 23270; identical to SEQ ID NO: 6262

SEQ ID NO: 6269 - DNA, 492 bp, Thioalkalivibrio HL EbGR7
atgagcaatccccgcggctgggtctgggccatcccgctgaccttcatcgtggcgctggcgctcaccgtcgtgcccctgcccgactgggccgccccctggcgtccccagtggctggccatgaccctgatctactggagcatggccctgccccggcgcatcggcgtcggcctgggctggttcctgggcctgctgctggatgccgccaccggtgccctgctgggccagcatgccctgggcttcgccctgatcgcctacctgagcatccgcatgcatcagcgggtgcgggtgttccccctctggcagcaggcactgaccgtgggcggcctgctggccctgcacctgctgctggtgctctggatcctgggcatgaccggccgcgcaccgggcacctggctgtactgggcgcccctggtaagcagcatgatcctgtggccctggctgttcgtgctgctgcgcgacgtgcggcggcgttggtgtctggctttgagctga

SEQ ID NO: 6270 - DNA, 522 bp, Diaphorobacter TPSY uid29975
atgatcatgcccaagggccagcagctgctgctgcccgtgaacccggtcttcatcgctgccagcctggtggccgcgctggcgctgaacatgctgccactgggccgcgtggtctggacgcccgactgggtcatggtgctgctcgtgttttggggcatgcaccagccgcagcgcgtggggctgggggtggctttcctcatggggctgtgcctggatgtgtaccagtctgccctgctgggccagcatgcgctggtgtactgcctgctgatgttcggcgcgcaatacacgcaccgccggctgctgtggttcggcccgctgctgcaggcgttgcaactgctgccgttgttctttgcggcccatgcgcttgaactgctgctgcgcgtagccatcggcgggggcatcctgccgggtttcgaaggcctggtggcaccgctgctggaggccaccctctggccgctggccagctgggtgctgctggcgccccagcgccgcccgcccgaccgcgatgaaaaccggccgctgtga

SEQ ID NO: 6271 - DNA, 480 bp, Azotobacter vinelandii DJ
atgggcgagcacaacggttggctgatctgggccagctatctggtgggcctgttgctcagcgtggcgcccatgccggatttcatggaactcggccggccgttgtggctggcgatgttcatcacctactggattctgtccgtgccgcagcgggtcagcctgaccctgacttggctgctggggctggcgatggatgtgctctatggggttctgctcggacagcatgccctgaccctgacgctgatcgccttcctgatgctgaccttgcagcagcgtgtccgcatgtttccgctctggcaacagagcctggtcctgctggtagtcttcggcctggcccaactggtacagctctggctcaatgcgctggccggcaatcgcccgccgaccctggtcttcttgctgccggctctggtcagcgccctgctctggccctgggtgttcaccgctctgcgcagtcttcgactgcgcttcaatgtcaattga

SEQ ID NO: 6272 - DNA, 489 bp, Dickeya dadantii Ech703
atgaacagttatcgtcggcacggccatgggatcatctggttgtcctttctggtggcgatggtgttacaggtcatgccgtggccggacgcaatctaccactatcgcccgtcctggctgacattaatcctgatttattgggtgatggcgctgccgcaccgggtcaatgtcggcaccgggtttgtcttggggatcatcaatgatctgattctggggtcgacgcttggcgtgcgtgcgctggggttgagcatcattgcttatttagtggcgttcaaatttcagatgttccgcaatatggcgctctggcaacaggcgctgatcgtgatggtgttgtcgctgattcttgatttgctggtgttctgggccgaattcctggtgagcaatgtctcattacgaccggaaattttctggaatagtgtggtcgacggcgtgctctggccatggattttcctgctgatgcgcaaaattcgtcgtcagttcgcggtgcaataa

SEQ ID NO: 6273 - DNA, 489 bp, Dickeya zeae Ech1591
atgaacagctatcaccgacacggtcactggattatctggctctcttttttggtggcgatggtgctgcaaatcatgccctggccggatgagctttatatgtatcgcccctcctggctgaccttgatcctgatttactgggtgatggcgctgccgcaccgggttaatgtcggcaccgggtttgtgttggggatgatcaccgacctgattctcggttctacgctgggggttcgggcgttggggctgagtattgtcgcctatctggtggcgttcaaattccagttgttccgtaatatggcgttgtggcagcaggcgctgatcgttatgttgctgtcgctggtattggatttactggtgttttgggcagagttcctggtgatcaatgtctctttacggccggaaattttctggaatagtgttgtcgacggcgtgctatggccgtggctgttcctgctgatgcgcaagattcgccgccagtttgccgttcaataa

SEQ ID NO: 6274 - DNA, 489 bp, Pectobacterium carotovorum PC1
atgaaccgttatcgcaggcatggcaactggattatctggctttcttttctgatcgccatggtgttgcagattatgccgtggccggatgaaatctacatgtttcgcccctcctggctgacgctattcttgatttactgggtgatggcattgccacatcgggtgaatgtcggcacaggatttatattaggtctgattatggacctgattcttgggtctacactgggagtacgggcgctggcgttgagcattattgcttatctggtcgcctttaaattccaactgttccgaaatatggcgttatggcagcaggcattaatcgtcatgctcttgtcgctgctgatggacctcacggtattctgggcagaatttttagttattaatgtctctttccgaccagaaacattctggaatagcgtcgtggatggcgtactctggccgtggctgttcctgctgatgcgtaaaattcgtcgtcagtttactgtgcaataa

SEQ ID NO: 6275 - DNA, 765 bp, Nitrobacter winogradskyi Nb-255
atggcctacgatccggagccgccgaaacgttccccgaatccgacgatctgccggagcccgccggccggcggaagcgctccgctgcctgacgtaaagtcatcttcgtccgatatcgccgcgttcgttgcgaaggcgagatcaatgtcgccttatgcatcagacggccgtggcaggctgttgttcgcgctcgacgccaccatgagccggcagccgacctgggacatggcatgcactcttcaggccgacatgtttcacgaagcggtcggcatcggcagcctcgacattcgccttgtctactaccggggactcaacgaatgccgttccagcggctggatacccgacagcgcgaaactcgcaaggttgatgagcgccatcgattgccgcggcggcaacacccagatcggcaaggttctttcccacgcgcgcactgaagctgtcgcctcaggcatcaaggccgtcgttttcgtcggtgacgcgatggaagaatcggtggacgatctttgcgcgaaagcgggagaactgggactgctgaaagtccccgtgttcatgtttcaggaagggcacgatgcgattgccgagcaggcttttcgcgaaatcgcgcggctgaccggcggcgcctggtgtcggttcgatcctggcgcggcgagccaattgcgcgaactgcttcgcgcagcggcggcttatgcggtgggcggccgggaggccttgcggcggctgtcgacgaccgtaacaagtgccacccggctattgggacagatgaagtaa

SEQ ID NO: 6276 - DNA, 717 bp, Nitrosococcus oceani ATCC 19707
atgacagagaaaaccggtaaatcactccgaaaaccatccagcagcagtgaggtggacgccttcctgaagaaagttgcggccatgccccagattaaacctggtagccgccatggccggctgatctttgccatggatgccaccgccagccgggagccaacctgggaccgggcctgccatattcaagcccagatgttccaggaaacagccagcttaggtgggctggaaatacagctatgttattatcgtggctttaaagaattctccgccagttcttggctccgtcactccgacgcgcttttgaagcaaatgaacaccgtggcttgtcgcggtggttacactcagattgaaaaagcgttgcagcatacccaaaatgaaacgcgaaaacaaaaggtcaatgccttggtttttgtaggtgactgcatggaggaaaagatggagcgtctctgccatatggctggtgaattaggcattttgggcgtacctgcctttgtctttcaggaaggctatgatctggtggcggagcgggcttttcggcaaatcgctcaattaacccaaggggcctattgccgttttgacgccgctagcgcggcccaactacgggacttattaaatgccgtggccgtttatgccaccggagggcgagccgccctggaaaatttcagccagcgccaggggggagtaacgttgcggctcattcaccaaatcaaaaaagactag

SEQ ID NO: 6277 - DNA, 741 bp, Rhodopseudomonas palustris HaA2
atgcctcacgatccgaccaaatcttcccaacgaccgctgacggacgctgccgatcgatcggtgcggaccggcaattcgtcggacgaaatcgccgccttcgtcgccaaggcgcgggcgatgacgccgggggcgaccggcgcgcgcggccggctggtgtttgcgctcgatgcgacgatgagccggcagccgacctgggacatggcctgcgcgctgcaggccgacatgtttcgcgaggcggaggcgatcggcagcctcgacatccggctggtgtattatcgcggcctgagcgaatgccgcgccagcggctggatctcgaccagcgacgaactggcgcggctgatgggccggatcgactgccgcggcggccacacccagatcggtcgggtgctgtccgacacacgccgcgaggcgatcgcctcgggggtgcgcgcggtggtgttcgtcggcgacgccatggaagaatcgatcgacgatctgtgcgcgaaagccggcgaactcggcatgctgaaggtgccggtgttcgtctttcaggagggttacgatccggtcgccgagcagaccttccgggagatcgcgcggctgaccggcggcgcctggtgccggttcgatccgggcgcggcggcacagttgcgcgaactgctgcgcgcggctgcggcctatgcggccggcggccgcgacgcgttgctgcggctcgcccgcgggggcgggggtgcggcactgctgctcgggcagatgaaatag

SEQ ID NO: 6278 - DNA, 744 bp, Rhodopseudomonas palustris BisB18
atgacacgccaaccgacgaaacctccttcgccgccgccggtttcgccgaccggctcgctgccggacagtaagatttcgccatccgaggagatcgccgccttcgtcgccaaggcgcgcgcgatgtcgccgcacgccgccggcgccaaaggccgactggtgttcgctctcgacgccaccatgagccggcaacccacctgggacatggcctgcagcctgcaggcggagatgttccgcgaagccgcggcgatcggcagtctggacattcggctggtgtattaccgtggcatcaacgagtgtcgcgccagcagttggatctcggattccgcaaagctcgcgacattgatggcgaagatcgactgccgcgccggcaacacccagatcggcaaggtgctctcggaggctcggcgcgatgcggtggcctccggcgtgcgcgccgtggtgttcgtcggcgatgcgatggaagagtcggccgacgacctttgcgccaaggccggcgagttggggctgctccaagtgcccgtgttcctgttccaggaaggccacgaccccgccgccgaacagaccttccgccagatcgctaggcttaccggcggggcctggtgccggttcgatccgggtgccgcggggcaattgcgcgaactgttgcgggcggccgcggcctatgcggccggcggccgcgaggccttgcagcggctgtcgacatcgaccggtgccgcagcccggctgctcggccagatgaagtga

SEQ ID NO: 6279 - DNA, 741 bp, Rhodopseudomonas palustris BisB5
atgccccacgagccgaccaaatcccccgttcgaccgccgaccgatgcagccgatggcgcattgcggcggagcaattcgtcggacgaaatcgccgccttcgtcgccaaggcgcgggcgatggcgccggcggcgaccggcgcgcgtggccggctggtgttcgccctcgacgcaacgatgagccggcaaccgacctgggacatggcctgcgcgctgcaggccgacatgttccgcgaggcggaggcgatcggcagcctggacatccggctggtatattaccgcggtctgaacgaatgccgggccagcggctggatctcgtccagcgcgcaactggcgcggctgatgggcaggatcgactgccgcggaggccacacccagatcgggcgggttctgtccgacacccgtcgcgaggcggtggcttccggcgttcgcgcggtggtgttcgtcggcgacgccatggaggagtcggtcgatgagctgtgcgccagagccggtgaactcgggatgctgaaggtgccggtgttcattttccaggagggcggggacgcggtggccgaacaggcgttccgcgagatcgcccggctgaccgggggcgcctggtgccggttcgatccgggggcggcggcgcagcttcgcgagctgctgcgcgcggctgcggcctatgcggccggcggccgtgacgctttgcttcggctcgccagaagcggcggaggcgcggcgctgctgctcggccagatgcgatag

SEQ ID NO: 6280 - DNA, 696 bp, Nitrobacter hamburgensis X14
ttgcctgacataaagccgtcggcctcggccgatatcgcggcgttcgtcgccagggcgcgggcgatgtcgccctgcgccacgggcagtcgaggcaagctggtgttcgcactcgacgccaccatgagccggcagccgacatgggacatggcctgctcactccaggccgacatgtttcgcgaagccgccggcatcggcagccttgacatccgcctcgtctactatcgcggactcgacgaatgccgttccagcggctggatatccgacagcgcaaagctggcaaggttgatgggtgccatcgattgccgtggcggcaacactcaaataggtaaagttctttcacacgcgcgcagcgaagcggtggcgtcgggtatcaaggccgtcgtgttcgtcggcgacgcgatggaggaatctgtcgacagtctctgcgcgacagccggcgagttgggcttgctgaaggtgcccgtgttcatgttccaggaaggacatgatgcgattgccgagccggggtttcgagaaatcgcgcggctgaccggcggcgcctggtgccggttcgaccccggcgctgcggctcagttgcgtgaattgcttcgcgccgccgcggcctatgctgcgggcggccgggaagccctgcaacggctgtcgacgaccgccgccggtgcgacccggcttttgggacaaatgaaattagcgccataa

SEQ ID NO: 6281 - DNA, 729 bp, Mesorhizobium BNC1
atgagcgacagaaagccgccgatggagaccgggaggaaagcggaggtctcgaagccgcgctccgagaacagcgcgattgaagcctttgtgcgccaggcgcgggcgctggcaacaattggaaaaggaaacgggcgcctcattcttgcgctcgatgccaccatgagccgccaacccacctgggacctcgcctgcgagattcaggctgagatgttcgacgccgtcggcaaggctggtgcgctgaacgtgcagcttgtctattaccgcgggttcggggaatgcgccgcatccaggttcgtaaccgacacggaagcgctcaaaaagctgatggcgcggatcgattgccgcggcgggcgcacgcagatcggcaagattcttgctcatgctttgaaggaaaacgcgcgtggcaaggtgaatgctctcgttttcatcggtgatgcgatggaggaggatgtggacctgctctcccagcgtgccggcgaactcggcttgaaaagtgtaccggtgttcgttttccaggaaggccgcgacccctcggccaccggcgctttcaaggaaattgcaaggctctccaagggggcctggttccgcttcgatcgaaacgccggcgacgtattggccaagcttctcggagcggtggcggtctacgccaccggtggcctacccgccctggaggcgagggggcggccagaagaccggatgatgatcgagcatctaagcggcaagaaatga

SEQ ID NO: 6282 - DNA, 252 bp, Psychromonas ingrahamii 37
atgcagtgccattcagatttgcccctcagccctgtgtttgtttttcaggagggaaaaaatccaaaggttggaagtatcttctcacagctagcgacattgagtggcggcgcatattgccagtttgatcaaggcagtgccagacagttaggtcagttgttagcagcggttgcagtgtatgcagcgggcggtaaacctgccctggaaagtaatttattgagtaaggatgcgagcgtgcgccgtttattgcagtag

SEQ ID NO: 6283 - DNA, 687 bp, Bradyrhizobium BTAi1
ttgccgcaggccgagccgtccggcggcgatgcgattgccgccttcgttgctcaggtgcgcgctatggcgcccgcgacccagggcgccaggggccgtctcgtcttcgcgctcgatgcgaccttgagccggcagccgacctgggacatggcctgcgcgctgcaggcggaaatgtttcgcgaggccgcggcgctcggcagtctcgacatcaggctggtctattatcgcggcttcagcgagtgtcgtgccaccggatggatttccgacagcagcgagctggcgcggttgatgggcaagatcgattgccgcggcggcaagacccagatcggcaagatccttggcgaggccagacgcaacgcgaccgccgagggaatccgcgcggtggtgttcgtcggcgatgcgatggaggagagcgtcgacgaattgtgcgccagggctggcgaactcggactgttgaaggtgccgctgttcatgttccaggagggccatgacccggcggccgagcaggcgttccgcgagatggcgcggttgtcaggcggcgcctggtgccggttcgatcccggagcggcggcgcaactgcgcgatctgttgcgtgccgccgcggcctacgctgccggcggccgtgaggctctgcgtcggctggccgcggccgaatccggcgcggccttgctgctcggccaaatgacgtag

SEQ ID NO: 6284 - DNA, 834 bp, Xanthobacter autotrophicus Py2
gtgtccgcgcatcaactgctgagttggcgtttccgtgcaggcggccccgccccttggttcggcgggcggcccggcttatgtgtggaccaagaggccccgatggcgaagaccgacgacaagaacgcgcgcctgcccaaggcgaaggatacggcatccccggtggtttccggcgccgacgacgtggcgcgattcctggcggcggctcgggccatgcccccggcgcggccggcggacgggcgcggacgcctcgccttcgccctcgatgccaccggctcgcgccagcccacctggacgctggcctgcgacattcaggccgacatgttcgcctccgccgccgcccatggcgggctcgacatgcagatcgtctattaccgggggcagggggaatgccgggcctcgcccttcgtgaaggacgcggtgacgcttggcgccctcatgcgccgcattgcctgccagggcgggctcacccagatccatcgcgtgctcgcccacctgtcgcgggaggctgagcgctccggcctcaaggcggcggtttttgtgggcgatgccatggaggaggatgccgcccggctcatagaggcggcgggccagctggcgttgcgcggggtgcggctgttcatgttccaggaggggcgtgacagccgggtggaggaggtgttccgcaccctggcggatgtcacctccggcgcctattgccggttcgatgcccatgcccccgacgaattgcgccagctgctctcggcggtggccgcctatgcggcgggggggcgcctcgccctcgccaaccgacgcgatgccggggcgcgcctgctcatcgccgcgctcggccgctga

SEQ ID NO: 6285 - DNA, 741 bp, Rhodopseudomonas palustris TIE 1
atgtcccgcgagccgacctcaactccgtcccagacgtccgtccgcgacagtggcgcggcgacgcctgcgccgtcgacgtccgcggagattgccgccttcgtcgcgaaagcgcgcgcgatggcgccgaacgccgcgggcgcccgcggccgcctggtgttcgcgctcgacgccacgatgagccggcagccgacctgggacatggcctgcgcgctgcaggccgacatgttccgcgaagccgaagcgatcggcagcctcgacatccgcctggtgtactatcgcggcttcaacgaatgccgggcctcgaactggatctcgtcgagcgccgagctggcgcgtctgatgggcaagatcgattgccgcggcgggcatacccagatcggccgcgtgctggccgatgcccgcaaggaggcgatcgccgcaggagtccgcgccatcgtgttcgtcggcgacgcgatggaagagcaggccgacgagctgtgcgccaaggccggcgagctcggcatgctcaaggtcccggtgttcgtgtttcaggagggcgtcgacccggttgccgaacagacgtttcgcgagatcgcgcggctgagcggcggggcgtggtgccggttcgatccgggtgctgcagcgcagctccgcgagctgctgcgcgccgctgctgcgtatgcggctggcgggcgggaggcgctgcagcggctggccgccagcggcggcggcgcggcgctgctgctcgggcagatgcggtag

SEQ ID NO: 6286 - DNA, 702 bp, Methylobacterium sp. 4-46
atgggcgcgcgctcgggccctcccgctccggccgacccggccgcggtcgccgccttcctcgaccgggcgcgccgcctcgcccccgccgcgacggcggcgccgcggctgatcttcgccctcgacgcgacgatgagccgccagccgacctgggacctcgcctgccggctgcaggccgggatgttcgaggccacggccggcctcggcgggctcgcggtgcagctcgtctacttccgcggcctcggcgagtgccgggcctcgcgcttcgtcgccgacgcccgcgccctcaccgacctgatggccgggatcgcctgccgcggcggccagacccagatcgcccgcgtgctgcgccacgcccgcgccgaggccgccaagggtccggtgaaggccctggtcctggtcggcgacgcggtcgaggaggatctcgacggcctctgcgcgctcgcgggggaactcggcctgctcggcgtgccggccttctgcttccgggagggggaggatccccaggccctgcggggcttctcggagatcgcccggctgtcgggcggcgcccacgcgcccttcgaccgggccgcgcccgcgaccctggcggggctcctgcgcgccgtcgcggtctacgcggcgcggggactcgacggactgcgcctcgccgcgcgagaagacgcgcaggcgcgccggctcctcggcgccatgacgccgcggtga

SEQ ID NO: 6287 - DNA, 714 bp, Methylocella silvestris BL2
gtgcaacggcaaaaggatggacgggatctcgttggagccgatcggaattcgaaatccgagatcgacgcttttctgtcggagacggaaaagcgtccggtgatcgcgacaggccgcggcaggctgatctttgccctcgacgcgacgatgagccggcagcccacctgggatctggcgcagcatctgcaagcgcatatgttcgagacggccgccgcccatggcggtctcgatgtgcagctcgtcttctatcgcggcttcaacgaatgcaaggcctcgcgattcttgaatgggggaaaggcgctcgccgcggccatgacccgcatcaccgtcgccgccggccatacccagatcggcaaggtgctccgccatgttctcgaagaagcgggcaatgcgccggtccgcgcgctggtgttcatcggggatgcgatggaggagcgggctgatgatctcgccgatcttgccgggcggctcgggctcatgggcgtcaaggccttcgtctttcaggagggcgccgaccgcgtcgccgagcgggcgttccggcagatcgccttgctgaccggcggcgcctatgccacatttgacgctggcgcagcgcagcgtctggcggcgctcctctcggccgctgcggcctatgccgcgggcgggcggcaggcgctggagctcgaggctgcggacaaaggcgctgcggcgatgctgctcctcagtcaaatgagctag

SEQ ID NO: 6288 - DNA, 702 bp, Methylobacterium nodulans ORS 2060
atgggcgagcgctccgttcctcccgtcccgaccggcgaggccgccgtcgcggccttcctcggcgaggcgcggcggctcgcgcccgccaccccggccgccccgcggctgatcttcgccctcgacgcgacgatgagccggcagccgacctgggacctcgcctgccggctccaggcggagatgttcgcggcgacggcggatctcggcggcctcgccgtccagctcgtctatttccgcggcttctccgagtgccgcgcctcgcgcttcgtcgccgatccgcgggcgctcaccggtctgatgaccgggatccactgccgcggcggcctgacccagatcggccgcgtcctgcggcacgctcgcgcggaggccggcaaggggccggtgaaagccctcgtcctcgtcggcgacgccgtcgaggaggatctcgacgggctctgcgcggtcgcgggcgaattgaggctgctcggggttccggccttctgcttccaggagggtggagagccgcaggcggcgacgggcttcgccgagatcgcccggctgtcgggcggcgcccatgcgcgcttcgaccgcgatgcccccgcgacgctggccgggctgctgcgggccgcggccgtctacgccgcgcggggactcgacgggctgcgcctcgctgcgcgagaagatgcggtggcgcgccggctcctcggcgccatgacgccgcggtga

SEQ ID NO: 6289 - DNA, 462 bp, Frankia CcI3
atgacgaccgctccccccggtggcccggcgggcccgcgcgcgccggaactcgtcgcgccccgcacccccgggctctcccgccggcgggggaagccgggcagcgccaaggcgcgcaccaacttcgagctctacgcctgggtattcatgcgggtcagcggcctgctgttgttctttctggtgctcggccacctgttcatcatgaacatcctcgacggcggggtgcagcgggtgaacttcggattcgtcgccggccgctgggcgtcaccgttctggcgcacctgggacctggtgatgctgctcctggcggagctgcacggcaccaacggcctgcgcacgatcatcaacgactacgccgggcggccccagacccggttctggctgaagacgctactctatacctcggcgttcctggtcgtcgccctcggcaccctcgtcatcttcaccttcgatcccgacatctga

SEQ ID NO: 6290 - DNA, 378 bp, Deinococcus geothermalis DSM 11300
atgattcgcgcgcgcaccctcaccgatgctcggcagcagtcacactccaacgccgagctgaactggtggatcttcatgcggatcagcggcctgattctggtcttcttgatcctgggccacatctacatgacctttatccaggtcagcgagtcggacgccacctttgacgcggtggtcgccaagcttcagaacccagcctggaagttctacgactggctgattctgctgctggcgatgctgcacggcgtcaacggcgcccggtactccattgaggactatgtgcgttcgcgccccaaccgcgcctgggtcaagggtatcttctataccatctgcgccgtgattttcttgctcggcacagttggcctgttctccatctga

SEQ ID NO: 6291 - DNA, 480 bp, Mycobacterium MCS
atgagcccggcggagaacccctacgaccacgtcaccgaccgcggcggacccgcgccggtgctgcagcgcagccacgaccggccgccgagcctggacaacccgcgcgcacccaagcgtgccggcggcatgccgaacttcgagaagtacgcatggctgttcatgcgcttctccgggatggtgctggtgttcctggcgctgggccacctgttcatcatgttgatgtgggacaacggcgtgtaccgcatcgacttcaactacgtcgcgcagcggtggtcctcgccgttctggcagacctgggacctgctgctgctgtggctggcccagctgcacggcggcaacggcctgcgcgtgatcatctcggactacgcccgcaaggactccacgcggttctggctgaactcgctgctggcgctgtcgatgatcttcatcctcgttctcggcacctacgtgctgttgacgttcgacgcgaacatctcgtaa

SEQ ID NO: 6292 - DNA, 495 bp, Arthrobacter FB24
atgactgcaaccattcagagtccccgcagtggaaaagacggcggcaagccgggcgcaggactgattgcccccaagtaccgccgcagcggcgcttccaagggcaacttcgaaatggctgcctggctgttcatgcggctttcgggcgttgtcctggtagtcctgatcttcgggcacctgttcgtcaacctcatggtaggcgagggcatccatgccattgacttcggtttcgtggccggcaagtgggccgatccgttctggcagttctgggacctggccatgctctggcttgccatgctgcacggcacgaacggtgtccgcaccatcatcaacgactacgccgagaaggattccacacgcttctggctgaagatcgtcctttacgccgcaacggctgtcatcatcatcctgggcaccctggtgatcttcaccttcaacccgtgcccgctggacgtcaacggcgtaccgctgcccggcggcttctgccccgcagcctag

SEQ ID NO: 6293 - DNA, 480 bp, Mycobacterium KMS; identical to SEQ ID NO: 6291

SEQ ID NO: 6294 - DNA, 492 bp, Mycobacterium vanbaalenii PYR-1
gtgagttcaggaaagaagatggccgagaacccctacgaccacatcagcgaccgcggcgggcccgctcccgtcatgcagcgcagctacgaccggcccgcagggctggacaacccgcgatcgccccggcgggccggcgggatgccgaacttcgagaagtacgcctggctgttcatgcgcttctcgggcatcgtcctcgtctttctcgcgctcgggcacctgttcatcatgttgatgtgggagaacggcgtgtaccgcatcgacttcaactacgtcgccgagcgctggtcctcgccgttctggcagacctgggacctgctgctgttgtggctggcccagctgcacggcggtaacgggatgcgcacgatcatcgccgactacagccgcaaggactcgacgaagttctggctcaacaccttgctggcactgtcgatggcgttcacgctggtcctggggacctacgtgctgctgacgttcgacgcgacgatttcctga

SEQ ID NO: 6295 - DNA, 480 bp, Mycobacterium JLS
atgagtccggcggagaacccctacgaccacgtcaccgaccgcggcggacccgcgccggtgctgcagcgcagccacgaccggccgccgagcctggacaacccgcgcgcacccaagcgtgccggcggcatgccgaacttcgagaagtacgcatggctgttcatgcgcttctccgggatggcgctggtgttcctggcgctgggccacctgttcatcatgctgatgtgggacaacggcgtgtaccgcatcgacttcaactacgtcgcgcagcggtggtcctcgccgttctggcagacctgggacctgctgctgctgtggctggcccagctgcacggcggcaacggcctgcgcgtgatcatctcggactacgcccgcaaggactccacgcggttctggctgaactcgctgctggcgctgtcgatgatcttcatcctcgttctcggcacctacgtgctgttgacgttcgacgcgaacatctcgtaa

SEQ ID NO: 6296 - DNA, 504 bp, Mycobacterium gilvum PYR-GCK
gtgactcaggcaagccgtccggcctccggccgggccgaaaacgcgtacgaccacatctccgatcgcggtggacccgccccggtgatgcagcgcagcttcgaccgccccgccgggctggacaacccgcgcgcgccgcgccgctccggcgggatgccgaacttcgagaagtacacctggctgttcatgcggttctcgggcatcgtgctcgtgtttctcgccctgggccacctcttcatcatgttgatgtgggagaacggtgtgtaccgcatcgacttcaactacgtcgcgcagcgctggtcgtcgccgttctggcagacctgggacctgctgctgctgtggctggcccagctgcacggcggcaacgggatgcgcacgatcatcgccgactacacgcgcaaggactcgacgaagttctggctcaatactctgctcgcgctgtcgatggcgttcacgctggtcctggggacctacgtgctgctgacgttcgacgcgtcgatttcctga

SEQ ID NO: 6297 - DNA, 435 bp, Mycobacterium tuberculosis F11
atgagcgccccggtcagacagcgcagccatgaccgtccagccagcctggacaacccacgatcaccacggcggcgtgccggcatgcccaacttcgagaaattcgcctggctgttcatgcggttttccggtgttgtgttggtgttcctggcgatcgggcacctgttcatcatgctgatgtgggacaacggcgtgtatcgcctggacttcaacttcgttgcccaacgctgggcgtcgccgttctggcagacctgggatctgctgttgttgtggctggcgcagctgcacggcggcaacggtctgcgcaccatcattgacgactacagccgcaaagacaccacccgattctggctgaactcgttgctggtgttgtccatgctgttcaccctgatgctgggaacctacgtgatagtgacattcgacccgaacatctcctga

SEQ ID NO: 6298 - DNA, 489 bp, Chlorobium phaeobacteroides BS1
atgagtcaacactatgaaaacgaggggtcggcagcttcccgttcaaaggcttttgtctggcttatgcagcgggtgaccggagtcggccttgtgctgtttctcgtgcttcatttctgggttcagcatatgccgacagggtttcttgctactgccggggagtatagtgaaatactcaagaccctttcggaagcaagtccggaagttgttgatgcaattgccgatgggaagatcaaggaagcgcttcccggcgagcatgtgataacctacagcaaggtgcttgaacggctgcgtactccgctgtggagaattatcgatattctgctccttctgtttgcccttctgcacggtatgctggggctgatgaatgttctcggggattatatgaagcgggttcgactgcgaaaggctgtcgtgttctgttgctgggcggtgacgctttttcttgcgggccagggcattgttgttattatggctgttggaatgaaatag

SEQ ID NO: 6299 - DNA, 498 bp, Prosthecochloris aestuarii DSM 271
atgaatcagtcacttcatgagacaccgccggtaactatttcttcaaagatcgaggcgtttggctgggtgatgcagcgctttacaggtcttggtctggtgctctttcttgccctgcatttctgggtgcagcatatgccgaatggatatcttgcgacagcgaccgagtacaacgatatcgtggctgaatttgcgacaaagagtcctgaatatgctgaagctattgcggacggccatatcaaagaggctcttcctgaagagcatgtcattacctacagcagcgttgccgcaaggttagccaacccgttgtggaaggcgattgatattatgctgctgctttttgctcttgctcatggtctcaacgggttgaacaatgttcttgtcgattatgttcaacgggcagcgcttcgtaaggccctgtttgcaggaagtcttgccgtctgtcttttcctctctgttcagggaattgcctctattcttgctgccgggtctggcgcgtaa

SEQ ID NO: 6300 - DNA, 462 bp, Arthrobacter chlorophenolicus A6
atgactgcaaccatcgagagcccccgcagcgggcggatcgcaccccagtaccgccgcaacggcggaagccggggcaacttcgagatgatcgcctggctgttcatgcgcctctccggcgtggtgctggtggtcctcatcttcgggcacctgttcgtcaacctcatggtgggcgaaggcatccacgccatcgacttcggcttcgtggccggcaagtgggcagacccgttctggcagttctgggacctcgccatgctgtggctggccatgctgcacggcaccaacggcgtgcgcaccatcatcaacgactacgcagagaaggactcgacccgccgctggctgaagacggtcctttactcggccaccgtggtcatcatcgtcctgggcaccctggtgatcttcaccttcgatccgtgccccgtggtggacggcgttccgctgcctggcggcttctgccctgcctag

SEQ ID NO: 6301 - DNA, 417 bp, Actinosynnema mirum DSM 43827
atgagcgaactggctctcgaccgcccccgcaccccgcgcaggcccgcggcgcggcgcaacaacttcgagctgtacagctggttgttcatgcgcctgtccggcgtggcgctgctcgtgctggtgctcggccacctgttcatcatgaacatcctcgacggcggcgtgcaccggatcaacttcggtttcgtcgcgggccgctgggcctcgccgttctggcagatctgggacctggccatgctgtggctggcccagatccacggcggcaacgggctgcggacggtcatcaacgactacgcccgcaaggacgccacccgcttctggctgaagatgctgctctacgtgtcgatggtcctgatcatcgtgacggggacgtacgtggtgttcacgttcgatcccggcatcgccaccaccaactga

SEQ ID NO: 6302 - DNA, 459 bp, Beutenbergia cavernae DSM 12333
atggcgaccatcgacgacggcgtcatcgccaacccgcgggcgcggtacacccggcgcctgcgcacgcccggcaacagcgagctgtgggcctggatcttcatgcgcgcctcgggcgtgctgctcatcgtgctgatcttcgggcacctgttcgtcaacctgctcgtgggcgacggtgtcggcgcgatcgacttcgcgttcgtgggcggcaagtgggcctccccgttctggcaggtctgggacctcctcatgctgtggctcgcgatgatccacggcacgaacggcgtccgcacgatcatcaacgactacgcggagcgcgacgtgacgcgcgtcgtcctcaagtcgctcctctacctcgcgttcgtcgtcaccgtcgtcctcggcacgctcgtgatcttcacgttcgacccgtgccccaccggcgccgcggcgcacctgctgccgtcgttctgcaccgcctga

SEQ ID NO: 6303 - DNA, 453 bp, Brachybacterium faecium DSM 4810
atgacctccaccacctcgatccccgatccgagcacccgctaccgccgcaccggccagcgcggtctgaactccgagatgctctcgtggatgttcatgcgcgcctccggcgtgctgctggtgatcctcgtgttcggccacctgttcgtgaacctctggctcggccagggcgtcaagggcatcgacttcgccttcgtgggcggcaagtgggcctcccccttctggcaggtctgggacctgctcatgctgtggctgggcctcatccacggcggcaacggcgtgcgcacgatcatcaacgactatgcgcgcggcgaccggctccgcctggtcctcaagggcctgctctacttcgccgtggtcgtcacgatcatcctgggcacgctggtgatcttcaccttcgatccctgccccaccggcgccgagccgagcctgctgccctccttctgcgagggctga

SEQ ID NO: 6304 - DNA, 480 bp, Micrococcus luteus NCTC 2665
atgagcaccaccgctgagaccaccatcgcggcgccccgcagccgccgtctggaccccacgtacacgcgcgacggcggcggccgcggcaacttcgagatgctcgcctggctgttcatgcgcatctcgggcgtcttcctcgtcgtgctgatcgccgtgcacctgaccaccaacctgctggtcggcgacggcatccacgccgtcgacttcggcttcgtggccggcaagtgggcgcacccgctgtggcagttctgggacctggccctcctgtggctggccatgctgcacggcgccaacggcgtgcgcacgatcatcaacgactacacccgtcgcggcaccggccggttctggctgacgatgatcctgtacatcgccacggccgtgatcatcatcctcggcaccctggtgatcttcaccttcgatccctgcatggtggacgcctccggcgccctgcttgagggctccccggccttctgcggctga

SEQ ID NO: 6305 - DNA, 456 bp, Catenulispora acidiphila DSM 44928
atggcacagagcacacacgtctctttggaggcgccgcggaccggcaaccccggccgctcccagcgctaccgcagccgcaagggcccgggcaaggtcacccggggcaacttcgagctctactcctggctgttcatgcgggcctccggggtcctgctggtcttcctggtcctgggccacctgttcatcatgatggtcaccgacggaggcgtggagaagatcggcttcgccttcgtggccggccgctgggcctccccgtggtggcagttctgggacctgctccagctctggctggcgatgatccacggcagcaacggcatgcgcaccgtcatcaacgactacgccgacaaggaccgcacccgcgcgatcctcaaggggctgctgtacaccgcggccgtgctgacgatcgcgctcggcaccctggtcatcttcacgttcgacccgaatatcaagggctag

SEQ ID NO: 6306 - DNA, 417 bp, Saccharomonospora viridis DSM 43017
atggctgaggcactgactctcgacaagccgcgctctcctcgcaggcccgcggctcggcgcagcaacttcgagctctacagctggttgttcatgcgcatctccggcctgctgctcgtagtgctggtgctcggccacctgttcatcatgaacatcctcgacggcggtgtgcaccggatcaacttcgcgttcgtcgccggccgctggtcctctccgttctggcagttctgggacctgacgatgctctggctggcgatgatccacggcggtaacgggctgcgcacggtcatcgaggactacgcacgtaaggaaagcacccgcttctggctgaagatggtgctgtacgtggccacggtggtgatcctgctgctcggcacactggtgatcttcaccttcgacccgaacatcccggctgactga

SEQ ID NO: 6307 - DNA, 441 bp, Jonesia denitrificans DSM 20603
atgaccacccagatcgacaacccccgcgcgccctaccgccgccaaaaaatcacacgctccaactttgagatgtggggctggctcttcatgcgcggctccggcgtgatcctcgtcgttctcattttcgggcacctgttcgttaacctcatggtgggcgaaggagtgagccgcattgacttcgccttcgtcggtggaaaatggacgtcaccgttttggcaaacctgggacctgctcatgttgtggcttgccatgattcacggcaccaacggtgtccgcacaatcattaacgactactccgaacgccacatcacacgcctgatcctcaaactcgctctctacagtgcgttcattctcacggtcgtcctgggcacactcgtgatcttcaccttcgaaccgtgccccgccaacgcacccgctgatcttctcccgtcgttctgctga

SEQ ID NO: 6308 - DNA, 432 bp, Nakamurella multipartita DSM 44233
atgaccgccgcgttcgatccgccggccacccgcggcatcgtggccccgcgggccccgcgcaagcgggtcaccgggcgccgcagcagcttcgagatgtactcgtggatgttcatgcggttgtccgggatcgtgctggtggtcctggttctgggccacctgctgatcatgaacgtgctcgacggcggggtgcaccggatcaactggggcttcgtggccggccgctgggccagcccgttctggcagatctgggacctgctgatgctgtggttggccgagctgcacggggccaacggcctgcgcacggtgatcaacgactacgcccgcaaggacggcacccggttctggctgcagctgctgctgctgatctcggtcgtgctgacgctggcggtgggcacgctggtgatcttcactttcgatcccacgatgagctga

SEQ ID NO: 6309 - DNA, 819 bp, Staphylococcus epidermidis RP62A
gtgaaggataataatgaagtattaaagttatttatagtttcagattcaattggagaaacagcgcaacgaatgattcatgcgacgctgacacagtttccagatttaactcaagtagaaattaagaaatttccatatattaaggacgaacaagaatttttaaatgtcttacaattagctaaagaacaaaatgcaattgttgcaacaacattagtaagtgagtcatttaatgcattaggtcatcagtttgcaaatgaacatcaaattccctatgtagattacatgtctgagttaattagcataattaaacaacatacacacgctaaaccattaatggaaagtggtgcgttgcgtaagcttaatgatgagtattttaagcgtatagaagcaattgagtattcagtgaaatatgatgatggtaagcattttacagatattggagaagcggatgctttaatagtaggtgtatcacgtacctctaaaacgccattaagtatgtacttagctaataaaggatataagattgcaaatattcctttagtccctgaagtggctattccagataatgtatttcaacaaaagaatttaaaggtatttggattaacagcaagtcccaattatatcgcaaatatacgacgtaatcgtgcagaaacattagggctatcttcagaatctaattacaatagtttagagcgtatcaaaaaagaattatcttatgctgaagaagtttttagaaaattaaatgcaacggtaattaatacagaatataaatcgatagaggaatcggcattttatattgaaaagtttttagctaaacgttaa

SEQ ID NO: 6310 - DNA, 885 bp, Moorella thermoacetica ATCC 39073
atgggtaatagggccggagcccatttctgtctggcttccggactccgacttccaagtaaaggaggggttaccatcggcgttatttacgtgatctcagactccctgggggagacggccgagtatgtcgcccgggcggcagccagccagttcgacggcggcgggctggacatccgccgggtgccctatgttaccgaccttgaccacctggaggaggtagtcaacgaagccgcccaggaacaggggatcatcgccttcaccctggtactaccggacttaaaaaagaagctcctggaactggcggcagcccggggcctcgaggcggtagacctgttgggccccctgatggacgccatcacccgggttactggcggccggccccggctggagccgggcctgattcgccgtaccgacgaagactacttccgcaaaatggaggccattgattttgccgttaaatatgataacggcaaagatatccggggcctgagccacgccgatctggtcctcatcggagtgtcccgcacctccaaaacgccggtgtgtatgtacctggcccataagcgcttgcgggccgcgaatctcgccctggtgccggaagtacccctgccgggagaattgctcaacctgccgccggaaaagataatagggctgaccattgacgccgggctcctctatcagatccgccaggaacgcctgaaaaccctggggctgccgggaccggccggctacgccaccagggaacgtatcgaagaggaactggcctacgcccgcagggtcatggaccagctcggctgtccggtaatcgatgttaccaataaggccgttgaagaaacggccggtaaaatactccaaatctattatcggagggaaagaaatggcaagtaa

SEQ ID NO: 6311 - DNA, 822 bp, Syntrophomonas wolfei Goettingen
ttgagtaatcacttgcctggggtttttatagtatcagattcgataggggaaacagctgagatggtggttcgtgcagctgccagccagtttaattctggtaatatggaaataagacaggttcccaatatatctgataccgaaaccctggaggaaataattaatcaagccgcagccagcaattttatcattgcctataccctggtcattaacgaattggccgatttcctgaagatggaggcccggaaaaaaggtgtgatttgcgttgatgttttaggcccggtaatagaggctttcaagagtgttagtgatatagagccccgccgggaaccgggattattgcgcaaagttgacgaaatgtattaccggcgggtggaagcggtagaatttgctgtgcgctatgatgacggcaaggatccccggggagtaatgcagtcggatattgttctggtaggggtatcccgaacctccaaaacaccactttccatgtacctggctcacaaaagaattaaggtggctaatgtacctctggttcctgaggtagaacccccggaagagatttttcaagtggagaagggaaaagtaattggtctggtaatcaacccggaacaattaaatcagattcgcaccgaacgattaaaaaccctggggcttaaaggccaggctagttatgccaatctggagcgtattctggaagaaatggaatatgcccaggaaataatgaaacgactgggatgtccggttatagatgtaaccaaccgtgcagtagaggaaacggccagcaagattttggaaatttattataggaggttaagccatgtctaa

SEQ ID NO: 6312 - DNA, 861 bp, Desulfotomaculum reducens MI-1
ttggcgaagggtcttgaggaggggtttaccattatagcacctaaagacgatcatcctgtagtttatattgtatcggattccattggcgaaacagcggaactggttgcgaaagcggcggttagccaatttaacggcggtaacgttgaaatacgacgggttccctatgtaaatgaccctcaggatattgtagatattgttgacgaagcccaaggtcagaactgcatcattgccttcacattagtgttacctgagctacgggaagtcctcgtgagggaagcagacaaacataatattcccacagtggatattatgggaccatttttggatgccttaaccctaattacagctgccccccctaaacttgaacccggtctggtacgtaagttagatgaggaatatttccgcaaagtggaagccattgaattcgctgtaaagtatgacgatggtaaggatccccggggtattcaaagggcagatctggtaattctaggggtgtcccgaacttctaagacccctttgagtatgtatttggctcataaacgaattaaggctgccaatgttccactggtgcctgaagtagcacctcctcaggaaatctttagcctgtcatctcataaagtgattggtttaaccattaagccccaacaattaaatgtgattcgcactgaacgcttaaaaaccctggggcttacatccaatgctgactacgccagccatgaacgcattttaaaagaattggactatgccgagtccattatgaaacgggttggttgcccggtaattgatgtaaccaataaagcggtggaagaaactgccagcaaggtactggagatatattaccgaggcgaacggtacaggtag

SEQ ID NO: 6313 - DNA, 849 bp, Gluconacetobacter diazotrophicus PAl 5 JGI
atgtcatcgcattccatcgttctgcacttggtctcggacgcgacgggccagacgctggattcggtcgtgcgggcctcggtcgcgcagttcgaccatgccgaaatcacctatcaccgctggaacctgatccgcacgcgggcgcagttgcgccgcgtgctggaagggatcgaacgcgacccggggccggtcctgtcctcggtcgtcgatccgcgccttttgcatgaactgacggtcggctgcgcgcatatcggcgtgcggctgaccaacgtgctggaccccgtcaccgccgtgctgcaggacgaactgggcgagaaagcggtcggccggccgggtggccagtacgtgatggacgacgcctatttccgccggatcgacgccatgcatttcgtgctggcccatgatgacggtcaggaaatcgccggcctggcgcaggcggacgtggtgctggtgggcatttcgcgagcgtcgaagacgccgacctcgttctacctggccaattgcggggtgaaggcggcgaacgtgccgctgatcccggacctgccgctgccgggggaattgctgcacctgccgcgcccggtcgtgggcctgaccatcgacccggacgtgctgatcagcatccgtcgccaccggctggacatcatggccgaccggggaaaggacctgctgatgcggcgggacaatccctatatcgaccccgagcaggtcgaggaggaagtccgctgggcacggcgcctgtgcgtccgccacggctggccgctggtcgatgtcagccgccgctcgatcgaggaaacctcggcggcggtgatggaactgatggccgactggcaggaacggacaagggctccctga

SEQ ID NO: 6314 - DNA, 834 bp, Kytococcus sedentarius DSM 20547
atgaccacccagcacatcgagttccacgtcgtcgccgactccaccggcgacaccgcggcccgggtggcgcgcgccaccgcggcgcagttccccgacatcgagacccacatcgtgcgccacccgcgcatcaccaccgaggacacgctgcgctcggtgatgggccgcatcgagaacgacgcccaccaggtggtggtgttctccaccatcgtcgacgaccgcctgcacgccctggtgcacgagctcgcccagcaggcccacctcgagcacgtggacatgctgggcccggccctcgaggcggtggagcgggtcgccgaccggcaggccgagcacaaggtgcgcccggtgggcatcagcgcggactacttcacccgcatcgcggcgatggagtacgccgtggccaacgacgacggaaacatggggcagacgctcgaccaggccgacatcgtgctcatcggcgtctcccggtcaggcaagacgccgctgtcgatgtacctgggctacctgggctacaagaccgccaacatcccgctggtcaacggcatcgagccgcccgcggagctgttcgacgtgccgcgctggaaggtggtgggcctggtgatcgacccggagcggctccaggacatccgctcgcggcgcgtgaggtccctcggcggccggcaggggcgcgacggctacgccgacctgatgaagatctacgaggagctcgaccacgccgaccagatcttccgccgcgtggggtgccccaccatcaacaccaccgagctggccctcgaggagtccgccggacgcgtcattgaactggtggagaaccggcgcgctactcttcgcgggtga

SEQ ID NO: 6315 - DNA, 891 bp, Eggerthella lenta DSM 2243
atggacgaattcatcgcctacggaagctccaccgagttgcccacgatccacgtgatcagcgactcggtgggtctgacggcccaggcggtggcccgtgcggccgccgcccagttcggcgtcacgaaccccgtcatcgaggtgctgccgaaggtgcgcacgttcgaggagatcaaggagttcatcgacgagcacagcgccgtgcacaagcgcaacaccggcgatgggcgcatgctcgtgttctacacgctcgtcgaccgcgacctctcgcgccaactggccgaatacgccggcggtcgcgatgacatcgtggcggtcgacctcgtgacggacgccatcggcgccatcgcgcacatgacgggcaagcagccgtccacgaagccgggcggcctgcacgttgccgaccagtactacttccggcgcatcgaggccatcgagttcaccatcgcccacgacgacggccgcaacccgcaggagctccaccaggccgacatcgtgcttctgggcgtgtcgcgctcgtcgaagacgcccacgtccatctacctgtcgcagcagggctacaaagtggcgaacatccccctcgatcccaccaccgagcctccggcggagctcgagcaggtcgaccgcacgcggctgttcggattgatgacgacgcccgaggtgctcatcggcattcggcagcgccgtttggggcgcgcgagtgccgtcgcttcgcgctatgccgatcccgaatacgtgtaccgggacttggaggacgcccgcgcgctcatgcgcaaactgggctgtattgtcatccacaccgaaaatcgtgccgttgaggaaacggcgcaggaaattttgcgctactatgagcgagcccatcctccatcagctgatatgatagggtcagcctga

SEQ ID NO: 6316 - DNA, 876 bp, Cryptobacterium curtum DSM 15641
atgattccaaccatcaacatcattagcgactcggtcgggaccaccgctcaggctattgcccgtgcggcggcaagtcagtttggcgaaaccgagcccattatcgaactattgccaaacgtgcgtacatttgaagaagtcgaaacgtttctgcaaaagcgacttgatgaaacacggcgtcgcacaggaagccctgaaatgatcgtgttttatacgattgttgaagccgaagtaacgcgacagctgaaggaatacctggcgtttcaccctgaaatccatgcggttgatcttattaccgatgcggttgatgctatttcgcaggtgtcagggcgcgagcccatggtagtaccgggcgagctgcatattaccgacgaacgttactttcaccggattgaagctatcgagtacacgattgctcacgatgacggccgcaacccgcaagatcttccctctgctgacatcgtgcttttgggtgtttcgcgatgtgggaaaacacctacttctatctatctggcgcaagaagggtatcgggtttctaacgtgcctcttgatttagtaagtgcgccgccggcagagattcataaggttgatccgtctcgtctttttggcttggttaccacgcccgatgtactggtagatattcgccgtcgccgtttaggcaatgcattggcggttgcgggcgattatgccgatcgtgaaaaagttgaacaagatctagaaaaggcacgatcacttatgcgtcaactggggtgctttgtcattcacaccgagaatcgagccgttgaagagacggcccaggaaatcatgcggtattatgaagtcgctcatccgcggaagggaagtttgcgcggagaaggcgatcttcaaactgtcgaataa

SEQ ID NO: 6317 - DNA, 816 bp, Anaerococcus prevotii DSM 20548
ttggatatttatattatttcagatacagctggccttgctatatcagagatagtccacttctccttgagtaagtttgatataaattctaatattattatcaaatctcaagtcaaggaaatagacgagctttctgatttattagcgagtattaagaccgacaatataataatttatcactctttccaagattctaagatgagtgcctatattaaaacttttgcccagactaaagagattgagacaatcgaccttatggcctactctatcaacagtctctcaaagattcttaatcaaaagcctcttgataatccaaactttatcaatgcttatgattcaaatcatatgagaaggctagatgccctagatttcgccatcaaatacgacgacggagcagactttaggggtattaagttttgtgatatagctattataggagtttctagatcttctaagactcccctatccatgtatttggcaagcaagggcctaagggtatcaaatattcccttgattgtggactcgaaggctccgagagagctttttgaaatcgatcccagacgcataattggccttacaatcgataagggtaggctaaaaagtgtaagagatgaaagattaaaatcacttaagctatctagcgattcaatctattctagtagggaaaggatagatgccgagctaaaatacgcagacgatttgatgaaggatttgggctgttttgtaatcgatgtaacctataggtcaatcgaagaaacttcagatatcattattaattatttaaacaaaaataagttattggaaaggaaagaaaaatga

SEQ ID NO: 6318 - DNA, 924 bp, Slackia heliotrinireducens DSM 20476
gtgcacgaggagggatgcgctttgcctggcgaaccgagcattcagatggggtcctatcacgaggggttcccgaccatccacatcgtcagcgactcgcttggcttcacggcccaatcgctggccagggcggcggccggccagttcggcgtcaccgaccccgccttcgaaatcttctccaggatcaccgatgccgaaaccgcaggcaaggtcctgctgaaacaccgcgccgagcaggccaacaacggcataaacgagcccatggtggtgttcttctcgttcgtcgacgccgaggagagcgccaagctgaagagaatctgcgagaagcacgacatctatgcggtcgacatgatgaccgagccgatcgccatgctcgaaaaggcgtcgggcctcacgtcgtcccgccagcctggcctgttccgccagaccgacgagaactacttcaggcgcatcgccgccatggaattcaccatcaaccacgacgacggacgcaactaccaggaccttcccaaagccgacatcgtgcttctgggcgtctcccgctcgtcgaagacccccatctccgtgtacatgggaatggaaggttaccgcgtggccaacgtgccgctggccgtgggcaccgagccgcccgctgaggtgttcgaatgcgaccccacgcgcatcttcggtcttatgaccacccccgacgtgctggtcagcatccgccagcgccgcctgggcaacgccggcaagggcgcgacgggcgccgccgggcagtacgcccagagggattacgtctacgatgacctggaatcggcccgcgccctcatgcgcaaactgggctgtatcgtcatccacaccgaaaacaaggccgtcgaagagaccgcacaggaaatattgcgatactatgaactgactcacccagcgcgcaagccgcctattgagtga

SEQ ID NO: 6319 - DNA, 399 bp, Atopobium parvulum DSM 20469
atgagtacacttgatattgacaacaacaacactcttggtgatggtctgcctatcatctatgttctgtcagactctcgcggtgagactggtgctgcagtagttaaggctgcagctgctcagtttggcgatgattccgttgagattgtgagggttccaaatattcatagtgttgaagacgttcgtacgtatttcaatgagcgtgaagatgaggatcgccctcgtgcagtctttcatacctttgcagatggttctctcagaagagaaattcgtcgtgagcttgatcagcgtcttatcccatctattgatcttcttggaccagctgtaaacgttatttctacgcttaccggtgaggagccaagtcacgcaattggtgctttctttgagggagttacacgctaa

SEQ ID NO: 6320 - DNA, 834 bp, Desulfotomaculum acetoxidans DSM 771
atttcagctgaaaaaaagggcagaaccgttatttatatcatttctgattcggtgggtgagactgctgagctggtagccagagccgcggccagtcaatttgacggcggcagggtggaaatacatggcgtgccttacgtgcagaatcccgaggaaataccggaaatagtaaagatggcagcagaggatgagagcattatcgcttttactctggtgatgccacatctgcgtgaggttttaataagggaagcccaactgcataaagttgttattgtagatattatgggcccgatgctggatgcgctgactaaagcggagggaatttcccccaggttagagccgggtttggtgcgtaagatagatgatgagtattttagaaaagtcgaagccattgagtttgctgttaagtacgatgatggcaaagatccgcggggaataatgcgagcagatatagtagttatcggtatttccagaacatccaaaacacctctttgtatgtatttggctcataagcgtattaaggcggccaatgttcctctggtacctgaggccgctccgccggaagaattgtttaaactgccctctcataaaattgttggcttaaccataaaaccgagtcaattgaacgaaatcagaacagagcgtttaaaaacccttggtttaacctctgacgctgattacgccagtatcaacagaattatcaaggaacttgagtatgctcaggatattatgcgaagagtgggttgtcatgtgatagatgtcacaaataaagctgtagaggaaacagccagcaaggtgatggagttatactatcgcggagagagaagcaaacagtaa

SEQ ID NO: 6321 - DNA, 795 bp, Porphyromonas gingivalis W83
atgatgtcagagacaaaaatcagtccgttggcatgggtggatccgcatgccgagataggagtaggtgttgagataggtccatttgccgtcgtggaagccggagctaagattggtgatggttccattttgcatcctcatgctgtggttcgttatggatcgacgctcggtaagggttgcgaaatccatccgaatgcagtaatcggaggagtaccgcaggatctgaagttccaaggtgaagataccactgctatcctcggcgattataccatcgtacgcgaatgtgctaccgtcaatagaggcaccgcctctcgtggcactaccgtagtgggcagtcattgtctgctgatggcttatagtcatatagcccatgactgcgtattgggcgatcatatcattgtcggcaatgcttcacagatagccggcgaagtagaaatagacgaccatgccatcatcagcggcggagtgttgatacaccagttcgtacgcatctctcagcatgtgatgatccaaggtggctcccgcctctcgaaggacatccctccgtatgtactggtgggacgggatcctctcgtttattgcggaatcaacatcgtaggtctgcgccgccgaaatttcaccaacgagcagattttcctgatcaatgatatttaccgcacactttaccaaagaggactgaataattccgatgcgatcgatattatccagcaggagtacgccgattgtcatgagaaggaacttatattagactttatcaagtcttccaaacgcggcattgtccgcggaaccatggagtga

SEQ ID NO: 6322 - DNA, 780 bp, Cytophaga hutchinsonii ATCC 33406
atgaatcagccattagcatatatacatccggaagctaagattgcacagaatgtagtaatcgaaccatttacaacgattcataaaaacgttgaaataggtgaaggtacctggataggccccaatgttacgattatggaaggtgcgcgtatcggaaaaaactgcaagattttcccgggtgcatctatttcaacgcttcctcaggatctgaaatttgaaggagaagaaacattaacaatcattggtgacaataccgttatcagagaatgtgttaccataagcagaggtacaaaagataaattcaagactgttgtaggcagcaattgcttattaatggcatatgtacacattgcacacgattgtatcgtaggtgatcactgtatccttgcaaatgcggtacaggttgctggccacgctattattgatgattatgcaatcatcagtggtgcgagcgctattcaccagttctgcaagatcggtgcacacgtgatggtatccggaggttcattggtacgtaaagatgttccgccatatacaaaggccggacgtgagccgttgagctattgcgggattaactccgtaggattaagacgtcgtggtttttcaaatgaaaaaatcaacgagatacaggatatttaccgtgttatttatttaagaggattcaataactctcaggcattaaatcacctggaagtaaacttcgcgccttcaaaagaattagatgagatcgtaaacttcatgcgcaactcggacagaggtatcatgaaaggaataggcgactag

SEQ ID NO: 6323 - DNA, 786 bp, Flavobacterium johnsoniae UW101
atgaatcaaccattagcatatgttcatcctggcgcgaaaatcgctaaaaacgttgtaattgagccttttacaacaattcacaataatgttgttattggtgatggtacttggattggttcaaatgtaaccattatggaaggagctcgaattggaaaaaattgtaacatttttccaggagctgtaatttctgctgtgcctcaggatttaaaatttggcggtgaagattctttagctattattggtgacaattgtacaattagagagtgtgtaactattaatagaggaacaattgcttcaggacagactattcttggaaacaattgcttagttatggcttacgctcacattgctcacgattgcgaaattggtaataatgcaattattgtaaacggtgtagcattagctggtcacgtagttgtaggtaatcatgccgtaattggcggtttggctgcaattcaccagtttattcatattggagatcatgctatgatttctggcggatctctggtaagaaaagatgttcctccttacacaaaagcggctaaagaaccattgtcgtatgttggtatcaattcagttggtttaagaagaagaggatttagtactgaaaaaattagagaaattcaggaaatttacagaattttatatcaaaagaattacaatactacgcaagctttaagtattattgaagctgaaatggaagcaactcctgagagagatgaaattcttgattttattagaaattcatcacgaggaattatgaaaggttattcaggaaactattaa

SEQ ID NO: 6324 - DNA, 789 bp, Opitutus terrae PB90 1
atgtcttccaagattcatccgacggcgattattgaaccgggcgcccagctgggcagcgacgtggagatcggcgcctatgcgttcgtcggcaccggcacgacgttgggcgacggcacccggctgcatcaccacgcgagcgtcgaaggcaacaccgtgctgggcaaggcgtgcgaggtttatccgtatgcctgcattggcggcaagacgcaggatctgaaatacaagggcgggaaccccgggctgcggatcggcgatcgcaatgtctttcgcgagtacgtgaccgtgcacgcggcgacgaaggacggcgaaaacacgatcatcggcaatggcaacaatctgctcgcgctgtcccatgtggcgcacgattgcgtgctcggcgacgggatcgtgatgagcaacaatgccgggctggccgggcacgtcacggtcgagaatcacgtggtgatcggcgcgaacgcgggggtgcatcaattctgccggctcggcgccttcgtgatgttgtcggcgtatgcgaagctcgtgcaggacgtgccgccattcttcatcgctgacggcgcaccggcgacggtacggacgttcaacaaggtcgggctggagcgcaacggcttcacgcccgagcagatcgagcgcgtgaaaaccatcttccgcatgctgtatcgcggcgggctcaaccgcacgcaggcgctggaacagctcgcggcgcacgaacaggcggcgagtgcggaatttcagcgcgtgctcgagttcgccaagaagagcgaacgcgggatggcggcgggcggacgatag

SEQ ID NO: 6325 - DNA, 777 bp, Candidatus Amoebophilus asiaticus 5a2
atgattcagtcattaaactatatacatcctcaggcacaactcggtgaaaatgttagtgtaggcccttttaccactatctcggaaaatgtaataattggtgagggtacctggattgggccacatgtaaccattttgccaggggctaggataggacggcattgccaaatatttcctggtgcagtcattgcaacaatacctcaggatttaaaatttcaaggagaagagactacagcagaaattggtgactatactatcatccgagaatatgtaaccattagccgagggaccttagcagggcctaccactaccataggtaatcatgttttactaatggcttatgtacatgtagcgcatgattgtattatcggtgaccattgtgttcttgctaacgctgtgcagttagctggacatgtagagctggggacacacgtgaaaataggaggtactgctgctttacgacaatttgtgaaggtaggagcatacgctatgataggcggtgggtcgttagtaaaaaaagatataccaccttttgtcaaagtagctcgagaaccactcaaatactgtgggcttaatatagtagggctcaagaggcttgggtttactgcataccaactacaaactatccagcttatttatcgctatatctttcaacaagatctacccttggcagaagcacttacacgtatagagcaagaaataccatcttgctgggaaaaagatactatattaaaattcattaacaacgctagtttgggtattgttaaaaatacaatttga

SEQ ID NO: 6326 - DNA, 795 bp, Capnocytophaga ochracea DSM 7271
atgattcaacctttggcttatgtccaccccgatgccaaaatcgctaaaaatgtagtgatagagccttttactactatcagtaaaaatgtagaaataggtgagggcacttggataggacctaacgtaaccattatggagggagcgcgtatagggaagaactgcaaaatttttcctggagctgtaatttcagctattccacaagatctcaagtataaaggtgaagaaaccactactcacataggcaataatactactatcagagagtgtgtaaccatcaataaaggtactgtcgaccgtatgagaactgtagtaggcaacaattgcttgataatggcttactctcatatcgctcacgattgtattgtgggggacaactgtattttctctaatggtactactcttgcaggacacgtaactgtaggtgattgtgctgtgatggcaggaatgactgctgtttatcagttttgttctatagggagttatgcttttgtaacaggaggttcgctcgtaggtaaagatgttcccccttatgtaaaggccgcgcgcaacccactttcttatgtaggggtgaattctatagggttacatcgtcgtggatttactactgagaaaatacgtgagatacaagatatttaccgtgtacttttccaaaagaaactcagtacctctcacgctttggactatatagaagctgaaatggaagccactgtagaacgcgatgagatattgcaattcgtgcgtcgctcacagcacggtattatgaaaggctatcacggtgaattaataaaagagtaa

SEQ ID NO: 6327 - DNA, 786 bp, Pedobacter heparinus DSM 2366
atgatacaacctttagcatacattcatccccaggcaaaaatagcagacaatgtcgttattgagccttttgcggtaattcataaagatgttgaaattggtgaaggaacctggatcggctctaatgtggtgatcatggatggagcaaggatcggaaaaaactgcagggtgtttcccggctcggtgatctctggtgtaccccaggatttaaagtttgccggcgagatcacgaccgcggagattggcgacaatacaacaatcagggagtgtgtaacgataaaccgtggaacgaaggataaatggaaaacggttattggcagcaattgcctgatccaggcgtattcacacattgcgcacgactgtgaggttggtgatttttgtatattttctaacagtactacgcttgcagggcacattacaatcggaaattatgtggtgcttgcgggcctggtggccatccaccagtttgtaaaggttggctcacatgcttttgttaccgggggttcattggttagaaaggatgttccgccttatgtaaaagccgccagagagccgctttcttatgcagggattaattctgtaggcttacgcagaaggggcttttcttcggaaaagatcaatgagatacaggaaatttacagggtcttatttgtgaagcataacaatgtgactaaagccctggatatgatagaagcagaatttaaacctaccgagatccgggatgagatcgtagattttatcaggaactcgaacagaggggtgatgaaaggttttggctctggcagttaa

SEQ ID NO: 6328 - DNA, 813 bp, Dyadobacter fermentans DSM 18053
atgactcaatcattagcatatatccatcctgacgccaagatcgctcagaatgtaaccattgaacctttcgcgatgatccatgctgatgttgagatcggcgagggctcgtggatcggttcgcatgcggtaatcaattctggagcacgaatcggaaagcactgtaaaatctatcccggtgcggtcgtttcggctacaccccaggatttgaaatacaataacgaatacacgctaacgatcgtcggcgacaatacaacgatccgggaatacgccaccatcagccggggtaccgaggaacattggaaaaccgtggtaggctccgactgcctgatcatggcttacgcacacgtagcgcacgattgccgggttggaaacaacgtgatcatcggtaacaatgtgcaaatggccggtcacgttcatgtgggcgactgggcgattgtgagcgcattgagcgcggtgcaccagtttgtcaaaatcggcgttcatgcattcgtttccggcgcctcgctcgttcgcaaagacgttccgccgttcaccaaagccgcccgtgagcctatttcttatgtgggtatcaactcggttggcctgcgcagaagaggatataccaatgagcaaatcattgatatacaaaacatttaccgttttgtgtacatgaaaggcctcaacaatgcggaagcgctgcaaaagatcgagctcgaaatggcaccttcggacgagcgcgacgagatcatcaactttatccgcaactccgagcggggcattatgaaaagcccgttccagacaaccggggcgagcgaaacggaagctcagtcttag

SEQ ID NO: 6329 - DNA, 795 bp, Chitinophaga pinensis DSM 2588
atgatccatccgcttacttacattcacccggacgcgaaggttgcgccaaacgtgaaaatcgatccgtttaccgttattcacaaaaatgttgaaatcggtgaaggcacctggatcggttcaaacgtcactattatggaaggcgcaaggatcggcaagaactgccgtatcttccccgggtctgtaatttccgctatcccgcaagacctcaaatttgctggcgaagacactacaaccgaaatcggagacaacaccaccatcagagagtatgtaaccattaaccgaggaaccaaggacaaatggaaaaccgttatcggcaagaattgcctgatcatggcctatagccatattgctcacgactgcgaagttggtaacagctgcgtattctccaacagcactacactggcaggtcatatcaccgtgggcgactacgtggtacttgcaggtatggtggctgtacaacaattctgtaaaattggcgatcatgcctttgttacaggtggctccctggtaagaaaagacgtgccgcctttcgtaaaagcagcccgtgaaccgctgtcttacgtaggtgtaaactctatcggtctcaaaagaagaggtttctcactcgaaaagatcaatcacatacttgacatataccgtgtgatattcgtgaaaggatacaagctctccaaagcaatcagtatcatcgaagcggaatatcccgccaccgacgaaagagatgaaatactctccttcatccgtgaatccggccggggcattatgaaaggttatacgtcactagccggcgacgaatga

SEQ ID NO: 6330 - DNA, 303 bp, Clostridium perfringens SM101 uid12521
atgataacaacaaaacaaagagcatatttaagaggattaggtgctaaattaactcctatatttcaaataggtaaaaacggaatagaagataactttttaaagcaagttgatgatgctttagaagcaagagagattttaaaaataaatgttcttgaaaatagtggattagagacaagagaagcttcaaatttcatctgtgaaagattaggatgtgaaggggttcaatctataggaaacaaaatagttctttacagagcatcaaaaaataatcctaagatagaattacctaaaaaagggaagtaa

SEQ ID NO: 6331 - DNA, 303 bp, Clostridium perfringens ATCC 13124
atgataacaacaaaacaaagagcatatttaagaggattaggtgctaaattaactcctatatttcaaataggtaaaaatggaatagaagataactttttaaagcaagttgatgatgctttagaagcaagagaaattttaaaaataaatgttcttgaaaatagtggattagagacaagagaagcttcaaatttcatctgtgaaagattaggatgtgaaggggttcaatctataggaaacaaaatagttctttacagagcatcaaaaaataatcctaagatagaattacctaaaaaagggaagtaa

SEQ ID NO: 6332 - DNA, 291 bp, Clostridium thermocellum ATCC 27405
atgcttacaggtaagcaaagaagctatttaagaagtttggcaaacagcatcgaacccatctttcagattggcaaaggcggaataaatgacaatatgataaagcagtttaacgaagctttggaggcaagggagcttataaaagttgcggtgcttaaaaacgccatggttgatacaaaggaagtgtgtcatgaagtggcaagtcttgtgggagccgaagtggtccaggtgataggcaataaatttgttttgtacaaagaatcaaaagagaacaaggtaatagagcttccgtaa

SEQ ID NO: 6333 - DNA, 291 bp, Clostridium phytofermentans ISDg
atgacaagtaaacaaagagcatatttaaagggtcttgcaatgaacatagatccaatttttcaagttggtaaggcgagcatatcacctgaactaacaactggtatctctgaggcattagagaaaagggaattaataaagatatcagtgttaaaaaactgtttagatgatccaagagagatcgcttctgtattatcagaacgtactcattcagaagttgttcaggtcatcggaaagaaaatagtattatatcgtgagtcaaaggaaaagaagaagatcgaattgccaaagtaa

SEQ ID NO: 6334 - DNA, 294 bp, Desulfitobacterium hafniense DCB 2
gtgttaaccggaaaacaaaaaggttttttacgctccctgggcaatgagatggatcccatcttacagattggtaaaggaggagtcacagaggctgtcatagcacaaaccgatgagactctggaagcccgggaattgattaaagggagagtgctccctaacagcatggaagatgtacaaagcgcagccgcagaattggcggaacgcacctctgcggagttggttcaggtcattgggagaaattttctgctctatcgcgagtcgaagaagaagcccatgatcgatttgccgcgatag

SEQ ID NO: 6335 - DNA, 291 bp, Halothermothrix orenii H 168
atgttaacaggaaaacagaggagttatctcaggagtgaagccaataaccttaacccggttattcatattgggaaagatgggattaccccttctttgttgaatcaggttgatgccgccctggatgaccatgagttgattaagtgccgggttttaaaaaattccctgggtgagcccaggtcctttgccgatgaaatatccagtcaattaaattgtgatgtagttcaggttatcggtaatgtgtttgttttattcaggagaaatgaagaagaaccaatttatattctcccataa

SEQ ID NO: 6336 - DNA, 291 bp, Clostridium cellulolyticum H10
atgcttacaggtaaacaaagaagctatttgagatcaattgcaaataatcttcatcccatttttcaggtaggaaaaggcggggtaagcgataatctgataaagcagttttccgacgcgttggaagctagggagctgataaaggccactgtcctaaaaaatgcagaatgtgatacgaaaaccatttgtgaagaaatagcagaacagacaaattccgaagtagttcaggttatcggaagtaaatttgtactgtacaggccatctgaaaagaattccgtgatagagctgccctag

SEQ ID NO: 6337 - DNA, 285 bp, Anaerococcus prevotii DSM 20548
atgttaacaggtaagcaaagagcaaaattgaaacaagaatcacatgatttcaaaccagtaattaatattggaaagttttcagttactgacgaattgattaaggctatagatgaagcattagaagcgcgtgagcttattaagataaaaattttaaacaataatatggatgaccaagaagaaattattgatactattattgaaaagactggttctgaatttatttctcacttaggttcaatatttacaatttacagaaaaaacaacgataacaaatacgagctataa

SEQ ID NO: 6338 - DNA, 813 bp, Pseudomonas syringae tomato DC3000
atgctgccttacccgcagattgacccggtagccgtcgctatcggcccgctgcaaattcactggtacggtttgatgtacctggtcggcatcggtggcgcctggctgctcgcgtcgcgtcgtctgaataagttcgacccgacctggaccaaggaaaaactctccgatctgattttctggctggccatgggcgtgatcgtcggtgggcggttgggctatgtgctgttctacgacctgtctgcctacatcgccaatcctctgttgatattcgaggtctggaagggcggcatggcgttccacggcggctttgtcggggtcatgatcgcggcctggtggttcggcaagcgtaacggcaaaagcttcttccagttgatggattttgtcgccccattggtgccaatcggcctgggtgccgggcggatcggcaactttatcaatgccgaactgtggggcaagccgaccgacgtgccgtgggcaatggtcttcccgccattcagcgaccctgcacagttggcgcgccacccgtcgcagctgtatcagttcgcactggaaggcgtggcactgttcatcattctcaatctgtacgcccgcaagccgcgcccgactatggccgtttccggcatgttcgcgctgttctacggcatcttccgctttgtggtcgaattcgtccgcgttcctgatgcccagctgggctatctggcatggggctgggtcaccatgggtcagatcctcagcctgccgatgatcatcgctggtctgttcctgatctggctggcctacaagcgcgacccggctgccagcaaggcagcggtttaa

SEQ ID NO: 6339 - DNA, 813 bp, Pseudomonas syringae pv B728a
atgctgccttacccgcagattgacccggtagccgtcgctatcggcccgctgcaaattcactggtacgggttgatgtacctggtcggtatcggcggcgcctggctgctcgcgtcgcgtcgcctgaacaagttcgacccgacctggaccaaggaaaaactttccgatctgattttctggctggccatgggcgtgattgtcggtgggcggctgggctacgtgctgttctatgacctgtcggcctacatcgccaatccgctgctgatcttcgaggtctggaagggcggcatggcgttccacggcggctttgtcggcgtgatgatcgcggcctggtggtttggcaagcgcaacggcaaaagcttcttccagctgatggacttcgttgccccgctggtgccgatcggcctgggtgccgggcgtatcggcaacttcatcaacgccgagctgtggggcaagccgaccgatgtgccgtgggccatggtcttcccgccgttcagcgaccctgcgcaactggcgcgccatccctcgcagctgtatcagttcgcgctggaaggcgttgcgctgttcatcatcctcaatctgtacgcccgcaagccgcgtccgaccatggccgtttccggcatgtttgcgctgttctacgggatcttccgctttgtggtcgagtttgtccgcgtccctgacgcccagttgggttacctggcgtggggctgggtgaccatgggtcagatcctcagcctgccgatgatcatcgcgggcctgttgctgatctggctggcctacaagcgcgacccgtccgccagcaaagcagcggcctaa

SEQ ID NO: 6340 - DNA, 825 bp, Saccharophagus degradans 2-40
atgaattatccggatattgatcctattgcgctctccattggggcgttcgaactgtttggctttgaaattgggcctattaatgttcactggtacggcattatgtacctgtgcgcatttttgggggcttggggcttgggccgctatcgggccagcaagccgggcgcttgccttaccaaggcgcaggtggaagaccttatcttctacggcgctgtaggggttgtggtgggtggtcgtcttggttatgtgtttttctacaatttctctgcctttttggctgaccccgtttggttatttaaagtgtgggagggcggcatggcgttccacggcggtttaattggtgtggcagttgccatgctgttattcgcccgcaaggtaaaccgcaatttctttgatgtgatggactttactgcacccttggtgcctataggtttgggctttggccgtataggcaactttattggtggcgagctgtggggccgcgaaacaaccgtgtcttggggtatggtgttccctaaggatgagcttggacttgtgcgtcatccatcgcagctgtatcaagcatttttagagggcgttgtactgtttgcaattctcttctggttttcggctaagccgcgcccgcgcgcagcggtttcggcactgttcttaattgtgtatggttgtcagcgttttgcggttgagtttgttcgccagccagatgagcatattcaattcgatttatttgactgggtaacgcgcggccaaatactgtcgctgccaatgattgcagtgggtttaattgtatttgcatgggcctatcgcaccaagcctggcgctactcgttaa

SEQ ID NO: 6341 - DNA, 873 bp, Serratia proteamaculans 568
atgaccaatagctatctggcgtttcctaaatttgatccggtgattttctcgatcggcccggtttctctgcattggtacggtctgatgtacctggttggctttgtttttgccatgtggctggcggtacgccgggctaacaaaccaggcagcggctggaccaaggatgaagtagagaacctgctgtacgccggtttcctcggtgtgttcgtcggtggccgcgtgggctatgtgctgttctacaacctgccgctgttcatggaaaacccgctctatctgtttaaagtctgggatggcggtatgtcgttccacggcggtttgatgggggtgatcctggtgatgttctggttcgctcgccgcaccaaacgcaccttcttccaggtttctgattttattgccccgttgatccccttcggcctgggcgccggccgtttgggcaactttatcaatggtgaactctggggccgcgtgactaccgataccccatgggcgatgctgttcccaagctcgcgtgcagaagacgtggcgcttgccgccgccgatccgaaactgttgcctatcctgaaccaatacggcgtgttgccgcgtcacccgtcccagctgtatgaactgctgttggaaggcgtggtgctgtttatcattctgaacctatttatccgcaagccgcggccgatgggtgccgtctccggcctgttcctgattggctatggtgcattccgtattattgtcgaagctttccgccagccggatgcccaactcggcctgttcgacggcgtaatcagcatggggcagatcctgtccgtccctatggtggtggccggtattattatgatgatttgggcgtatcgtcgccgcccgcagcaacaactgtcgtga

SEQ ID NO: 6342 - DNA, 786 bp, Coxiella burnetii RSA 331
atgctttattacccgcacatcgatcccgtggcctttcgacttggcccgcttaaagttcattggtatgggctcatgtacctcgttggatttgcaatggcctggggacttgcgttataccgcgcgcgagatccgaaacgtcattggactgcccagcaagttggcgatttaattttttatggcgctttagggcttatcatcggcgggcggctgggatacatgcttttctatgatttttccaattttatcgccaatccgttaacgctttttcaagtgtggcgtggcggaatgtcgtttcacgggggtctcatcggcgttattgttacgacttggattttcagtcgacgaactcacaaacgctggatggatgttactgattttgtggttcctttagtgccattgggtttggcagcgggtcgtatcggcaattttattaacggtgaattatgggggcgtgtgacgacggttccctggggtatggtatttcccaatgcgggacctttgccgcggcatccttctcaactttatgaatttttgctggaaggggtgcttttatttattgtaatatggtggttttcagctaagcttcggccccggtttgcggtatcgtctttattcttgttatgttacggattattccgctttactgcggaattttttcgacaaccggatccgcaactcggatttgttgcatttggttggctgaccagggggcaagaattatcactgccgatgattatcatcggtggttttgccttatggtgggcttatcgacacaaggagcgttaa

SEQ ID NO: 6343 - DNA, 873 bp, Yersinia pestis Angola
atgagcaatagctatctggcgtttcctaaatttgatccggtcattttctcaattggtccggtttccctccattggtacggcctaatgtatttggtgggcttcgtgtttgcgatgtggctcgctgtccgtcgtgcgaataagcctggtagtggttggaccaaagaagaagtcgaaaacctgctgtacgctggtttccttggcgtctttatcggtggtcgcgtgggttatgttctgttctataacttgccgatgttccttgataacccactttatttgtttaaagtatgggatggcggtatgtcattccatggcggtttgattggtgtcatttgtgtcatgctatggtttgcccgccgaaccaaacgcaatttcttccaggttgctgattttattgccccgctgatcccttttggtttgggcgcagggcgtctggggaattttatcaatgccgaactttggggccgtgtcactaccgataccccgtgggcgatgttattcccaacttcccgcaataccgatatcgccatcgtggccgctgatcctgctaaatggcaggcgatatttaatcaatacggtgtcttgccgcgtcacccctcgcaactgtacgaaatgatcctcgaaggggtggtgctatttatcatcctgaacgtgtttatccgtaagccacgtcccatgggcagtgtctctgggctgttcttgattggttatggtaccttccgcatcattgtggagtgcttccgccaaccagacgaacaactcggcttgttcgagggcatgatcagcatggggcagatattgtctgtgcctatgattctggccggtattattatgatgatttgggcatatcgccgtcctacgcaaaaactttcgtga

SEQ ID NO: 6344 - DNA, 873 bp, Yersinia pseudotuberculosis YPIII
atgagcaatagctatctggcgtttcctaaatttgatccggtcattttctcaattggtccggtttccctccattggtacggcctaatgtatttggtgggcttcgtgtttgcgatgtggctcgctgtccgtcgtgcgaataagcctggtagtggttggaccaaagaagaagtcgaaaacctgctgtacgctggtttccttggcgtctttatcggtggtcgcgtgggttatgttctgttctataacttgccgatgttcctcgataacccactttatctgtttaaagtatgggatggcggtatgtcattccatggcggtttgattggtgtcatttgtgtcatgctatggtttgcccgtcgaaccaaacgcaatttcttccaggttgctgattttattgccccgctgatcccttttggtttgggcgcagggcgtctggggaattttatcaatgccgaactttgggggcgtgtcactaccgataccccgtgggcgatgttattcccaacttcccgtaataccgatattgccatcgtggccgctgatcctgctaaatggcaggcgatatttaatcaatacggtgtcttgccgcgtcacccctcgcaactgtacgaaatgatcctcgaaggggtggtgctatttatcatcctgaacgtgtttatccgcaagccacgtcccatgggcagtgtctctgggctgttcttgattggttatggtaccttccgcatcattgtggagtgcttccgccaaccagacgaacaactcggcttgttcgagggcatgatcagcatggggcagatattgtctgtgcctatgattctggccggtattattatgatgatttgggcatatcgccgtcctacgcaaaaactttcgtga

SEQ ID NO: 6345 - DNA, 876 bp, Salmonella enterica serovar Heidelberg SL476
atgaccagtagctatctgcattttccggactttgatccggtcattttctcaattgggcccgtcgcgcttcactggtatggcttgatgtatctggtggggttcgttttcgcgatgtggttggcggtgcgtcgcgctaaccgtccgggaagcggttggaccaaaaacgaagttgaaaatttactctatgcaggtttcctgggggtcttcctggggggacgtattggctatgtcctgttttataacttccctctgtttctggataacccgctctatttattccgcgtctgggacggcggcatgtccttccacggcgggcttatcggcgtgatactggtgatgattatcttcgccaggcgcacgaagcgctcgttctttcaggtgtctgattttattgcgccgttaattccgttcggcctgggcgccgggcgtctgggcaactttatcaacggtgaattgtgggggcgcgtcgatcctgacttccggtttgccatgctctttcctggatcacgcgcggaagatattgcgctgctgccgtcacatccgcaatggcagcctatttttgatacctacggcgtattgccgcgccacccttcccagttgtatgagctggcattagaaggcgtggtgctgtttatcatccttaatctctttattcgcaaaccgcgtccgatgggcgcagtctccggattattcctgattggctatggcgcgtttcgtatcattgttgaattcttccgccagccggacgcgcaatttaccggcgcgtgggtacagtacatcagcatggggcagattctctctatcccgatgattatcgctggcgcgatcatgatggtttgggcatatcgccgccgcccgcagcaacacgtttcctga

SEQ ID NO: 6346 - DNA, 876 bp, Salmonella enterica serovar Schwarzengrund CVM19633
atgaccagtagctatctgcattttccggactttgatccggtcattttctcaattgggcccgtcgcgcttcactggtatggcttgatgtatctggtggggttcgttttcgcgatgtggttggcggtgcgtcgcgctaaccgtccgggaagcggttggaccaaaaacgaagttgaaaatttactctatgcaggtttcctgggggtcttcctgggggggcgaattggctatgtcctgttttataacttccctctgtttctggataacccgctctatttattccgtgtctgggacggcggcatgtccttccacggcgggcttatcggcgtgatactggtgatgattattttcgccaggcgcacgaagcgctcgttctttcaggtgtctgattttattgcgccgttaattccgttcggcctgggcgccgggcgtctgggcaactttatcaacggtgaattgtgggggcgcgtcgatcctaacttccggtttgccatgctctttcctggctcacgcgcggaagatattgcgctgctgccgtcacatccgcaatggcagcctatttttgatacctacggcgtattgccgcgccacccttcccagttgtatgagctggcattagaaggcgtggtgctgtttatcatccttaatctctttattcgcaaaccgcgtccgatgggcgcagtctccggattattcctgattggctatggcgcgtttcgtatcattgttgaattcttccgccagccggacgcgcaatttaccggcgcgtgggtacagtacatcagcatggggcagattctctctatcccgatgattatcgctggcgcgatcatgatggtttgggcatatcgccgccgcccgcagcaacacgtttcctga

SEQ ID NO: 6347 - DNA, 876 bp, Salmonella enterica serovar Agona SL483
atgaccagtagctatctgcattttccggactttgatccggtcattttctcaattgggcccgtcgcgcttcactggtatggcttgatgtatctggtggggttcgttttcgcgatgtggttggcggtgcgtcgcgctaaccgtccgggaagcggttggaccaaaaacgaagttgaaaatttactctatgcaggtttcctgggggtcttcctggggggacgtattggctatgtcctgttttataacttccctctgtttctggataacccgctctatttattccgcgtctgggacggcggcatgtccttccacggcgggcttatcggcgtgatactggtgatgattatcttcgccaggcgcacgaagcgctcgttctttcaggtgtctgattttattgcgccgttaattccgttcggcctgggcgccgggcgtctgggcaactttatcaacggtgaattgtgggggcgcgtcgatcctgacttccggtttgccatgctctttcctggctcacgcgcggaagatattgcgctgctgccgtcacatccgcaatggcagcctatttttgatacctacggcgtattgccgcgccacccttcccagttgtatgaactggcattagaaggcgtggtgctgtttatcatccttaatctctttattcgcaaaccgcgtccgatgggcgcagtctccggattattcctgattggctatggcgcgtttcgtatcattgttgaattcttccgccagccggacgcgcaatttaccggcgcgtgggtacagtacatcagcatggggcagattctctctatcccgatgattatcgcaggcgcgatcatgatggtttgggcatatcgccgccgcccgcagcaacacgtttcctga

SEQ ID NO: 6348 - DNA, 876 bp, Salmonella enterica serovar Dublin CT 02021853
atgaccagtagctatctgcattttccggactttgatccggtcattttctcaattgggcccgtcgcgcttcactggtatggcttgatgtatctggtggggttcgttttcgcgatgtggttggcggtgcgtcgcgctaaccgtccgggaagcggttggaccaaaaacgaagttgaaaatttactctatgcaggtttcctgggggtcttcctggggggacgtattggctatgtcctgttttataacttccctctgtttctggataacccgctctatttattccgcgtctgggacggcggcatgtcctttcacggcgggcttatcggcgtgatactggtgatgattatcttcgccaggcgcacgaagcgctcgttctttcaggtgtctgattttattgcgccgttaattccgttcggcctgggcgccgggcgtctgggcaactttatcaacggtgaattgtgggggcgcgtcgatcctgacttccggtttgccatgctctttcctggctcacgcgcggaagatattgcgctgctgccgtcacatccgcaatggcagcctatttttgatacctacggcgtattgccgcgccacccttcccagttgtatgagctggcattagaaggcgtggtgctgtttatcatccttaatctctttattcgcaaaccgcgtccgatgggcgcagtctccggattattcctgattggctatggcgcgtttcgtatcattgttgaattcttccgccagccggacgcgcaatttaccggcgcgtgggtacagtacatcagcatggggcagattctctctatcccgatgattatcgctggcgcgatcatgatggtttgggcatatcgccgccgcccgcagcaacacgtttcctga

SEQ ID NO: 6349 - DNA, 864 bp, Dickeya dadantii Ech703
atgacgacgagctatttggtgtttccccagtttgatccggtgattttttcgatagggccggctgccctgcattggtatgggctgatgtatctggtcggttttgtcttcgccatgtggctagcggtgcggcgggctaacaaaccgggcagcggctggacgaaagatgaagtggaaaatctgctgtatttcggttttttgggggtatttgtcggcggacgtctgggatatgttctgttctacgcacttcctctgttccttgataatccattgtatttgttccgggtgtgggatggcgggatgtccttccacggcggattggtgggcgtgattaccgtgatggcctggttcgctcatcgcacccgccgaacctttttccaggtttccgatttcatcgcgccgttaatcccattcggcctgggcgccgggcgtctggggaattttatcaacggcgaattgtgggggcgcgtctccacggacacgccttgggcgatgttgtttcctggcgcgcgcggcgaagacatggcgctggcggcgtcccatccggaatggcaaccgattttcgcccagtacggcatgttgccccgtcacccgtcacaactgtatgaaatgctgctggaaggggttgtgttgttcatcgtcctgaatgtattcatccgcaaatcgcgtccgatgggcagcgtatccgggctgtttctggttggatatggcattttccgcattattatcgaattcttccgtcaaccggacgcccaactggggctgttcagcggcatcagcatggggcagatactgtcggtgccgatggtgttgatcggtttgctgatgatgctctgggcctatcgccgtcagccggtacggcaataa

SEQ ID NO: 6350 - DNA, 870 bp, Pectobacterium carotovorum PC1
atgatgacgacaagctatctggcgtttcctcagtttgatccagtgattttctcaattggcccgctggcgctgcactggtatgggctgatgtatctggtgggttttgtatttgccatgtggctggcggtgcgtcgggcgaataaaccgggtagcggttggaccaaagatgaagtcgaaaacctgctgtatatggggttcctcggagtcttcgtcggcgggcgtttgggctacgtcctgttttatgccttcccgtcatttcttgaaaatccgctctatcttttcaaagtctgggatggcggtatgtcgttccacggcggcttaatgggcgttatttgcgtcatgctgtggttcgcgcatcgcaccaaacgccatttcttccaggtcgctgattttattgcccctctgattcctttcgggctgggcgctggccgcctgggcaacttcatcaacggcgaactgtggggacgcgtaacgaccgatacgccgtgggccatgctgttccctggctcgcgcagcgaagatatgatgctggccgttagcaatccgcagtggcaggcgattttcaatcagtacggcatgctgccgcgtcatccttcccagctgtatcaaatgatgctggaaggcgtggcactgtttattattctgaatctctttattcgtaagtcccggccgatgggcagcgtctctgggcttttcctgatcggttacggcacgttccgtattatcaccgaattcttccgccagccggatgcgcaactgggtctgtttggcgacctgttcagcatggggcaaatcctgtcgctgccgatggtgatcgccggtattctgatgatggtctgggcctatcgccgtcagcccgtacagcaataa

SEQ ID NO: 6351 - DNA, 552 bp, Rhodoferax ferrireducens T118
atgcgctgtctcacaaatttcaatccatcatttaaggaccattcaatgattaaagtaggcgatcaacttcccgcaaccactttgatggaattttcggaagtggagggcggcggctgtagtctcggccccaaccccgtggacgtcgcgaaggccagcgcgggcaagaccattgccctgtttgctttgccgggggccttcacgccaacttgttcggctaagcatgtgcctggctatatccagcacttcgacgcgctgaaagccgccggggttgatgaaatctggtgcgtcagcgtcaatgatgcttttgtcatgggtgcctgggcgcgcgaccagaagaccaacggcaaggtgcgcatgctggccgatggcgacgcggcttttgccaaggcgactggcttgacgctggacctgaccggcaaaggcatgggactgcgcagcaaccgttactccatgctggtaaaagatggcaaagttgtcacgctcaacatcgaagcccccgggaaatttgaggtcagtgacgcggccaccctgctcgcgcaagcaaaagcctga

SEQ ID NO: 6352 - DNA, 507 bp, Polaromonas JS666
atgatcaaagtaggcgacacccttccggcagcgacgctgatggaattttccgaagtcgaaggcaatggttgcagcattggccccaacccggtcgatgtagccaaggtcaccgccggcaagaccattgcattgttcgcactgccaggtgctttcacccccacctgctcggccaagcatgtgccgggttatgttgagaaggcggccgagttcaaggccgctggcgtcgatgaaatctggtgtgtgagcgtgaacgacgcgtttgtcatgggcgcctgggcacgcgaccagaagacggacggcaaggttcgcatgctggccgacggcagtgcagattttgccaaggcgaccggtctgacgctggacctcacggcgcgcggcatgggcctgcgcagtaaccgctactccatgctggtcaaagacggcaaggtgatgagcctcaacgttgaaggtcccggcaagtttgaagtcagcgatgcagccacgctgctggcgcaagccaaggcctga

SEQ ID NO: 6353 - DNA, 507 bp, Acidovorax avenae citrulli AAC00-1
atgatcaagatcggagaagcgctgcccgccgtgacgctgatggaatactcggaagtcgagggcggaggctgcagcatcggccccaaccccgtggacgtcgccaaggcctcggccggcaagacgatcgcgctgttcgccgtgccgggcgctttcacgcccacctgctccgccaagcacgtgccgggctatgtcgagcaggccgaggccttcaaggcggcgggcgtggacgaaatctggtgcctgagcgtcaacgatgccttcgtcatgggcgcctgggcgcgtgaccagaagaccgacggcaaggtgcgcatgctggccgatggcgatgccgccttcgcgaaggccaccggcctgacgctggacctcaacggcaagggcctgggcctgcgcagcaaccgctattccatgctggtcaaggacggcaaggtggcttcgctgaacatcgaggcgcccggcaagttcgaggtgagcgacgccgacacgctgctggcccaggcccgcggctga

SEQ ID NO: 6354 - DNA, 558 bp, Acidovorax sp. JS42
ttggggcccgcagatcctgccggggccctccaacccagcaaggagattctcatgatccaagtcggcgacacgctgcccgccatcacactgatggagtactcggaagtcgagggcaatggctgcagcctcggcccgaacccggtggatgtgcaaaaggccgccgcgggcaagacgattgcgctgttcgcggtgccgggcgccttcacgcccacctgctcggccaagcacgttcccggctacgtggagcaggcgggcgccctgaaggctgccggcgtggacgagatctggtgcctgtcggtgaacgatgccttcgtgatgggcgcctgggcgcgcgaccagaagaccgatggcaaggtgcgcatgctggcggacggcgacgccgcgttcgccaaggccaccggtttgacgctggacttgaacggcaagggcctgggcctgcgcagcaaccgctattccatgctggtcaaggacggcaaggtggttgcattgaacgtcgaggcgccgggcaagttcgaggtgagcgacgccgctacgctgctcggccaggccaagggctga

SEQ ID NO: 6355 - DNA, 507 bp, Polaromonas naphthalenivorans CJ2
atgattaaagtaggcgatacccttcccgcagccacgctgatggaatttgtcgaagtcgaaggcaacggctgcagcctcgggcccaatccggtcgatgtggcccaggccagtgccggcaagacgattgccctgtttgccgtgccaggcgctttcacgccgacctgctcggccaagcatgtgcccggttatgtcgcgaagttcgccgaattcaaggccgctggcgtcgatgaaatctggtgcctcagcgtgaacgatgcgttcgtgatgggcgcctgggcgcgcgaccagaaaaccgagggcaaggtacgcatgctggccgatggcgatgccgctttcgcccaagccaccggcctgacgctggacctgaacggcaagggtcttggcctgcgcagcaaccgctactcgatgctggtcaaggatggcaaggtcgcgagcctgaatatcgaagggccgggcaagtttgaagtcagcgatgcggatacgctgctggcgcaagtcgctgcctga

SEQ ID NO: 6356 - DNA, 507 bp, Verminephrobacter eiseniae EF01-2
atgatcaaagtcggagaccgcctgcccgcaaccacgctgatggagtatcacgaagtcgaaggcccgggctgcagcgtgggccccaaccccgtgcccgttgtcgaggccacggccggcaagacgatcgcgctgtttgccctgccgggcgcgttcacgcccacctgctcggcccggcatctgcccggttatctgcaaaaggccgatgaattcaaggccgcaggcgttgacgaaatctggtgcatcagcgtcaacgacgccttcgtgatgggggcctgggcgcgtgagcaaaagagcgccggcaagctgcgcctgctggccgatggcgatgccaccttcaccaaggccaccggcctgacgctcgatctgagcggcaagggcctgggactgcgcagcaaccgctactcgatgctggtgcgcgatggcaaggtggtcacgctcaacgtcgaagccccgggccaattcgaggtgagcggcgcagaccggctgctggcccaggccaagggctga

SEQ ID NO: 6357 - DNA, 510 bp, Methylibium petroleiphilum PM1
atgctgaaagtcggtgacaagctgcccgagggcgctctgcaggagttcatcgaggtcgagggcgaaggctgctcgctcggtccgaacactttcgaaatcggcaagttgaccgcagggaagaccatcgccgtcttcgccttgccgggggccttcacgcccacctgttcggcccagcacgtgccgggcttcgtgaaacacgccgatgcattcaaggcggccggtgtcgacgagatctggtgcctgtcggtaaacgacgcgttcgtcatgggcgcctggggccgggagcaggggaccggtggcaaggtccgcatgatggcggacggtagcgcggcgttcacgcaggcaacaggccttacgctggacctcaacgcccgcggaatgggactgcggtctcaacgctactccatgctggtcgtcgacggtaccgtcaagacgctgaacatcgaggcgccaggcaagttcgaggtgagcaatgcggagacgctcctagcgcaggctggggcgctgtga

SEQ ID NO: 6358 - DNA, 579 bp, Delftia acidovorans SPH-1
atgtgggtcgttttttcgtttggggaccaccatttcggcggcccccggttttgcaccacaaaggagatagagatgatcaaagtcggagatgccctgcccgctgccaccctgatggaatacgtggaagtcgaaggcaatggctgcagcatcggccccaaccccgtgaagctgcccgaagccgctgccggcaagaccatcgcggtcttcgccgtgcccggcgcattcactcccacctgctcggccaagcatgtgcccggcttcgtggagcaggccgaagccttcaaggctgccggcgtggacgagatctggtgcctgtcggtcaacgacgccttcgtgatgggcgcgtgggcccgtgaccagaagaccgacggcaaggtgcgcatgctggccgacggcgatgccgccttcgccaaggccaccggcctgacgctggacctgaacggcaagggcctgggcctgcgcagcaaccgctactccatgctggtcaaggacggcaaggtcgccacgctgaacgtggaaggccccggcaagttcgaagtcagcgacgctgccaccctgctgggccaggccaaggcctga

SEQ ID NO: 6359 - DNA, 507 bp, Leptothrix cholodnii SP 6
atgttgaaggtcggagacaagctgcccgcgggcacgctcaatgagtacatcgaggtcgagggcaatggctgctcgctcggtcccaacagctttgacgtgacgaaagaaaccgccggcaagaccgtcgcgatcttcgctttgcccggtgccttcacccccacctgttcggcccagcatgtgccgggttatgtccaggcggccgatgccttgaaggcggccggtgtcgacgagatctggtgcttgtcggtcaacgacgctttcgtgatgggcgcctggggccgcgatcaaggcacggcgggcaaggtgcgcatgatggccgacggttcgggcacgttcacgcaggcgaccggcctgacgctcgacctggtggcgcgtggcatgggcctgcgctcgcagcgctactcgatgctggtggtcgacggcgtggtcaagacgctcaacgtcgaagcccccggcaagttcgaggtcagcgacgcacagacgatgctgcgtcaggctgccgcctga

SEQ ID NO: 6360 - DNA, 507 bp, Diaphorobacter TPSY uid29975
atgatccaagtcggcgacacgctgcccgccatcacactgatggagtactcggaagtcgagggcaatggctgcagcctcggcccgaacccggtggatgtgcaaaaggccgccgcgggcaagacgattgcgctgttcgcggtgccgggcgccttcacgcccacctgctcggccaagcacgtgcccggctacgtggagcaggcgggcgacctgaaggctgccggcgtggatgagatctggtgcctgtcggtgaacgatgccttcgtgatgggcgcgtgggcgcgcgaccagaagaccgatggcaaggtgcgcatgctggcggacggcgacgcagccttcgccaaggccaccggtctgacgctggacttgaacggcaagggcctgggcctgcgcagcaaccgctattccatgctggtcaaggacggcaaggtggttgccctgaacgtcgaggcgccgggcaagttcgaggtgagcgacgccgctacgctgctcggccaggccaagggctga

SEQ ID NO: 6361 - DNA, 507 bp, Variovorax paradoxus S110
atgatcaaagtcggcgacacccttccttcggcaaccctgcaggaatattccgaggtcgaaggcgaaggctgcagcatcggcccgaacccggtggacgtgagcaaggccacggccggcaagaccattgcgctgttcgcgctgccgggcgccttcacgcccacctgctcggccaagcacgtgcccggctatgtgcagcactacgacgacttcaaggccgccggcgtggacgagatctggtgcgtgagcgtgaacgacgccttcgtgatgggcgcctgggcgcgcgaccagaagaccggcgccaaggtgcgcatgctggccgacggcagcgccgatttcgccaaggccaccggcctcacgctcgacctgaccggccgcggcatgggcctgcgcagcaaccgctattcgatgctcgtgaaggacggcaaggtggccacgctgaacgtcgaggcaccgggcaagttcgaggtcagcaatgccgagacgctgctggcccaggcccgcggctga

SEQ ID NO: 6362 - DNA, 651 bp, Chromohalobacter salexigens DSM 3043
atgacggataggctgcttggcgtgttgaccggcgatgtcgtcggctcgcgccgcatcaccgaccgacaacggctcgacgaggcgctggataccaccctggcgttgctggaacggcatttcggcgcccacgtggaccgctaccgtggcgatggctttcaggtggcgctgcgcgcccccggcgaggccatgacggcggccgttctggcgcgcgccgcattgctgcgttattcgccctcgcggcgcgacgtctgggatgcgcgcattgccgtgggcatcgggtacggtcatctgcccgaagcgccacatatcgcctcggcggacggcgatgccttcgtgcgctcgggacaggccctggaccgcttgagcgaaagcgacgaacggctcgccctggtactgccgcagcccgacgacgacctagccctgctgacccggttcgccgatgtcatcctccaggggtggacgcacaacgccgccgaggtcgtgtactggcaattgcggcatcccgagacccagcaggccctggcgacgcgcctgggccgggcccagtcgaccattcaccaacgcttgagcgccgcacgctggccactgatacaggactatctggcgcatgtcggcgagcggctcaacgctctcatggagaccatgcgatga

SEQ ID NO: 6363 - DNA, 633 bp, Pseudoalteromonas atlantica T6c
atgatcgctgttttaaccggagacctagtagactcgacagccatgcctgcgaaagattaccagtgtgcggtcagtatcatggatgattatctcgccaaatgccaaacacgatttgctgcaaaaggcgaaatctatcgtggtgatagtttgcagcttattttcaagcagccacaacatgctatgcgcgcagcaattgagcttaaaagcctactctttagtactgatgcaactcaacgacctttgggaattacgctgtctgtaggcttgggggagcagcttattgacggtaacaaacccagtgtttcacaaggaagcgcatttaccttatcaggtagaggactggacagtacacctagtgggcacattagcttacatcatgaggggggcgcattttttgatgcacttgtgctagcaacgcagtttttagataacgtgttgtattcgcacacgcaaaaacaagcgagggtgctttttcattatttaagtatggattttcccactcacacccagttagccaatgcattgtcaaccagtcaacaaaacgtgactaagcatttagcgcgtattagcgcggatttgattaaagcctatgttgttttttttgaggaaaaattaagcaaggaaagtgactaa

SEQ ID NO: 6364 - DNA, 681 bp, Cytophaga hutchinsonii ATCC 33406
atgaaaggttcggtaattacagctgatctagtgaattcatcgggaatgtcgtttgatcagaaagacagattacttgaaagtatccggcagagattgttgcagcttcagagcagtggtatacttgcgagtagccaattgtacagaggcgacagttttcagtgtctgttaaggaatcccgtaaatggattacgcgctgccttgattttaaaaacctatataaaaagtcttgatccggccacgcttaggtcatcacctgtaaagcattcagcctcgggattaatatttattgataaaatgtttgacgtgcgtgtgtcaataggcatgggcgaagtaatcaataatataaccgatcctggattatcagacggagaggcttttcagctttcaggcaggaaacttgatgaaatgaaaaaacagaaactgacgtttgcgatcagtacagatgatatttataaagaagaattgattaccctatcagcgttacttgattttatcatctctaaaacaacagcgctgcaatgtgaagtcattacctttaaactggcaggacttactgaagtggatatagcagaacgcctggcggtacatcaatcggccgtaaatcaacgcgccgctgctgcaggatggagcgctattgaaaatgcagtgaaacgatttgaaacgatatacagcaatggataa

SEQ ID NO: 6365 - DNA, 651 bp, Shewanella frigidimarina NCIMB 400
gtggagcctaccaataaacctatagccgtgattgttggcgatgttgttgactcaacaaagctaacctctgcgcagtttgagctactacttaaacagatcaaatctatccagtcttggattagcgaggggcatagcgaaaatgcgcacagtattgagcgcggtgatgagtttcagtctgtcgtgcatgatattgaaaatgcgttgagatacaccgttatataccggattggtattaaggcgcttggtaaagcatttgatagccggattagttttgcaattgcggcaaatgccgatttacgtgagtcggtgtcggagtcgatggggcaagcatttgtgctgtctggccgcggactcagtggccttaagaatgaccgattattgtttagctccgatagcatcgctctcactgagtattttgacttactgtttaagtatcttgataagcaacttaacgacttaactgcgcgccaatgtgaagtgatgttgccaatgcttcgaaccaatgaggatttgtcgattagtgagttagctgacatgcttgatgtggctacagcgactgttagcaagtcacttaaagcgtctggttggccgttgatccatgagttaaattgtcggtttataaagaaagtcgcggggctcaagtatgtttga

SEQ ID NO: 6366 - DNA, 615 bp, Flavobacterium johnsoniae UW101
atgactagtgtaattacaggcgatataatcgattcgagaaaaaacgaatcacagcattgggtagaagatttaaaaaagatcttgtctccaattggcaaaacaccagttcaatgggaagtttacagaggggacgaatttcaaattgaaattgaaaatcctgaagatgctttcttgactgctgttttaattaaagcacatttgagagccataaaatctgatgcgcgaatgagtattggttttggaaataaaacgcattgtgctgctaaaatttccgaaagtaacggaaccgcttttatcaattctggagaactttttgaaactttaaaaaaacaaaaagtaactttagcgatgcgtacgggtgatactgtttttgatgaaaaattgaatttaatgattcagctggctttgacttttatggacagctggcttgtacaatcggctgagtttgttgcaaaagcaatagaaaacccaacactttcgcaggaagaattggggcagatattaggcattaatcaagctgcagtaagcagaagacaaaaacgagctcagtttgatttggtcatgaatttagatcgatattttaaaacacaaataaaacaacttacagcctcatga

SEQ ID NO: 6367 - DNA, 642 bp, Serratia proteamaculans 568
atgcgaaattcaaccatcactccccgcttcagagcagacaaatacatgccagcccaagtcagcgtgatcaccggcgatctggtcaattcccggcagttagacaccactcactaccttagcggcttaaatgccctgcttagccagctgcaacaggctaagcttattcagcagttcgagattttccgtggcgatgcctttcaggcagtggccgagccgcagtctggtttgctgctggcggtgtatatccgcatcgcgctcaaagccatggacgcccaacgctgggatgcccgtatcgctgtcggcctgggcacagagcaggctcagagcgccggctatggcagtgcctttgtgaattcgggtcaggcgttggacggcctgatgaaaaattgccgactggctctgaaaaatgataacgatcagaccaataccattgtcagcgatctgttgccaatgttagatcatgtggttagccacctttcgcagaccgaagcgcggatagtccaggcccgtatgttcgccaccagtaaccaggaagtggcagagaaactgcaaaaggccgcctccacggtctccgcaacgctcaaacgcgcggcctacgaggaaatcatgcgatttattcacgcgattaacaggatcacctga

SEQ ID NO: 6368 - DNA, 699 bp, Caulobacter K31
atgagccaggctaactcatcgaacgcccccaagggcgccgtcgcagttttgacgggggatatcgtacggtcgcagcgtctgggctcaggcgggatggcgctcgttcacgcgaccttccacgaagctgttgcctcgctcaatcggcgttggccgggcctggtgatgggcgaagctcaattctttcgcggcgatgcgtggcagttggctttgtcgcggccggagatgtttctgcgggtggccctcttcatccgcgcccgtctgctgtccgtcggagcctcaatggacacgcgcatcgccgttggccttggcggcgttgagatcttcgatgatgaggcggtgtctcgctccgtcggcgaggccttcaccctgtcgggccatagcctggacgagatgggcagccgagtggacatgtgggtgaacgtccctgaggcggttcggggctcgtttttctggttgcccccgcttctatccttgtgcagcaccttggttggacgctggaaacccaagcaggcctacaacgtgtctctcgcccttctggccactaacaagaagcaggaggctctggccaaggatgcgagggtcaagcggcaaaccctcggcatttcacttacttccgcgggctggcccgcactcgaagacgtcttgaccatgatcgaggacttggacttcgacggcctgttgcggggaccggcggcatga

SEQ ID NO: 6369 - DNA, 759 bp, Alteromonas macleodii  Deep ecotype
atggtacagtcaggtaagcacactaaatcgggaagtagtgacacacgtcaagacgctgctaagcggttaaatgacgtgcagctgaacgataaaagtgaccacaaagcaggtgtgcttactggcgatatatcccagtctcaatcattttctgatgacgattttacttctattctagccaccctcaaggcgctactctcaaaatacgctgaccaatacagcggagactttgatgtttacagaggggacgcgtttcagttagtcgttaagcagcctgagcacattatgctgattgctattgggctacggctagcgctaaaagccctaaacccgagcgtagatgttcgaattagtgctgccgtgggggacgcacagtttcgcgcaaaagaggtgaaaacgggaacgggggaagcctttgtgttgtcaggcagagggcttgacgatattaagccttaccacctcgcttttcatacgagccatcaagcgcttgaaaacagtacacagttaatcacgcgtttcgctgatgctcaccttacagggctaacgcctacccaatctcaaaccttattggcctatatcgaagcgtcagacaaaagccatgaaaacgtggctgccatattgaataaaaatagaagcaatgtgagtagaattctaaatgccagtaattacaaactggtagcagaatacctaagctacatggagcaggaaattaacgtgtggaaacttggccaccggccattgagtaacgcgcctgtaaaataa

SEQ ID NO: 6370 - DNA, 633 bp, Pedobacter heparinus DSM 2366
atgaatgcacaggcagtaatcacaggagatattatcaacttcacccggctgaatgcggcaaacaggaaaaaattgattgaagatacagagctgctgcttaaaagatggataaaagaaaagcaaaatgcagagatttttcgcggcgatagttatcaggtactttttgatgatatttttgaagccctcacaaaaagcatacaactgatatgctggtttaaaaagcattccgatgaaaagaataaaatatatttaagtacaagaatttctataggtattggagcagtatcctatcgaggtaaaaatgtacttaactcggatggagaagcgtttcatttatcgggcaggaattttgataccatgaaggaaggagaatttttaaccattcataccaataacgagcgaaagaatgcaggaattaaaatcatacttagcttcattaataaatacattgccaactggacgatggcacagtcggaagtgatttttctgcttttagaaggtaaaacccaacaggaaatagcagaatatctatccctctctcagccttccgttaacagcaggttaaaatctgcaggttggaaagagtttgaacctacaatgagatatattgcagaattagtaaaacaggaataa

SEQ ID NO: 6371 - DNA, 633 bp, Dyadobacter fermentans DSM 18053
atgaagacgttccaggccgttatcaccgcagatatggtgaactatacccagttttcacgcgaggaaacaactttgtggctggaagaaatgctcgccattctacatcagaaccagacttttaaatggacgctcgcgcctgaaatataccgtggcgacagcttccaggccgtgctgaaaaacccggaagaagccatgcgcgttgccatcctcgcccgcgcatccatgcgcaagcaggctcccgccgccgacctgcgcatagccatcggaatcggcaaaaccgaacagctcaccgaccgccccgggacttccgatggcgaggcgttcaggttatcggggcacctggctgatacgatgcgccggcagaaagccaggatcggcattgcgctgcccaggccctcggaaccgctgtcggccacgttggatctgctggaaacggtcatcgatagctggaccgtggcccaaagccaggtgattgaagccctgctgcaaggcaaaaatgtaactcaaatcgccgacatgctttccatcagtcaaccggcagcgagccagcgcattgcggcttcccggtggtgggcaattgaaagttttcttgctacctttccgcagcagttatcactatacaccaaacgctaa

SEQ ID NO: 6372 - DNA, 849 bp, Candidatus Methanosphaerula palustris E1 9c
atgggaacagagatcgtcgcggtattgacgggagatttggtaaaatctcaaacgtatttgactgaggcgctcacgtcgaccctcgctgatctcagatctgggtttaagacgtttaaagaaataatgggcgaagctcataatcagagtaattttgatctgatgatctcccgtggcgatagttttcagggacttcttctacagcctgagatcgctctcaaagcagcgatatatattcgtgcggatttgatccgtgatagtaaagcaaaatttcgtcgtgatgcgagaattgcaatcgggattggcacggttgaagatatggatgcttctctgggagaggcgtttatcaaatccggtgtctggttagatgaattaaaagatatgaaacaaaatcttatcatcaggacctcatttggagatgaaataaacagagaattcgatactgaatgcgcattaactgatggaataattcagaaatggacatctggccaggctgaggccgtaaaggagtatgtaatcagcgaaaatcaagaggaggttgcaaagaaattaggcatttctcaggccgcagtttcgttaagactgaatggtagtaattattcgttactacaaaaattcttttcacgatatcaagagatcatctctcgtgaaatccagaaacaaacggaaattacaaccaataacagatcagaaaatctggatcttgctgcgaagcgaatagcagaagtcatgtggaaccttggttatcgtcatttatccgatgccgaattaaattccctttcaaaaaacgatgcattatcccggaaagttgaagccagacttaaacaatatcagggatcggcacagaaatag

SEQ ID NO: 6373 - DNA, 564 bp, Shewanella sp. MR-7
atgtatagcaaacacgcgggcatacaagcagccagcagcagccagataaaagcggcacatcaaccgcatgtggcgggcgcgctaaggcaatttgcagatagcgaagaactgagcgaagtcgccaacgcggccaacatcagcaaaccgcaaatgctgcgcaataagctgctacttaaccagccacaccagttaagcatccacgaagccgtggacattgccaaggtaagcggcaatcgctgcattatcgacggcatgctgcttgagctgggctgcgtgccatcggtgccagtggcagagctagccaatagtgaacgcctatcactgaccgaccgcgcgttagaaatcaccgccaattcagcccgtttgggcgccatcgctctggacattaaagcccgtcgccgcgttaacgagcgcatgcgccatgaagtggttaagcgtgccagtttggtaatgagcgaattagccatttttgtgcacgacgttgaacaaaagttccaagccgtacccgtgttatcagtggcattcgatgccatgcaaaccatgcccatgccgggcgtgatgtaa

SEQ ID NO: 6374 - DNA, 567 bp, Shewanella baltica OS155
atgtatagcaacagttcaggcacacaagcaggcacgctaccgccagcaaaagccgcgcaccagccgcacattgcgggggcgcttaggcagtttgccgacggcgagcaactgaatgaaatcgccatagcggccaagttcaatcgcccgcaaatgctgcgcaataaattgctacttaatcaaccacatcaattgagcatccacgaagcggtcgacatcgccaaggcgagcggtaaccgctgcattatcgacggcatgttactcgaattggggtgtgcgccctcgatagcgattgatgatttaaaccagtgcgagcgcatgtcgttaaccgaccgcgctttagaaattagcgccaatgcgggatggctgggcaacatggcattagatgtcaaagcccgtcgcggtggcgtgaccgaacgcatgcgacacgaggcggtaaaacgcgctagccgtgccatgagcgaactcgcgttatttatgcacgacgtagagcaaaagtttcaggcaatacccgtgttatccgttgcattcgatgcagtacaaaacttgcccatgccgggcgcaatgtga

SEQ ID NO: 6375 - DNA, 510 bp, Enterobacter sp. 638
atgtttgactatcgcatatcaaaacatcctcatttcaatgaggcctgccgggccttcgcgctgcgtcacaacatggcaaagctggcagaacgtgcaggtatgaatgttcaaaccctgcgtaataagctcaacccggagcaaccgcaccagcttacagcgccagatatctggctgctgatcgatctcaccgaagattcaacgctggttgatggttttctggcgcagatccattgcctgccatgtgtaccaaccaatgaagtcgcacgagagaaaatgcctcagtacgtcctgaaagccaccgctgagatcggccgtgtcgccgccagcgcagtatctggcgttcagatgaatgcaaccacacgccgtcaggttgtggaaagcgtcaattctgttactcggctgatggctcttactgccatttcactgcaggcgcggctacaggctaacccggcaatggcaagtgttgtcgataccgtgacgggcattggctcctcttttgggctgagctga

SEQ ID NO: 6376 - DNA, 540 bp, Vibrio cholerae O395
atggtttctgacatcgccatgtatgaattacgtgaacgcaaacagcaagcttacaacgccgtttgcagtgatttcgttgtcaatcacaacattgaacagctcgccaaacgcatttcgttagacgggcaatcgctgcgcaacatgctcaaccctgcacagccgcacaaactgagcccagttgatttagtgctgctgtgcaaggcatcaggggattacaccatcatcaatacccttttcagtgattgcggcgtagttgccgtggcgctgccagagcaaggggaagaaaagaacatcattgagcgcgtactgctcaacacctcgctttgtggggaactctctagtgatgcaatgcaaatgtgcaccgcagagcgtttaccgcgcagccgtaagcgcaaaaccctcgcgaagtgccaagccgccttgggcaacttggcattactgatcgccgatttagaaaaacgcacaacaggcctgcaacccttgatacaaatgggttcggatttcatggctcaaggtgcgccaatccccggattcgcataa

SEQ ID NO: 6377 - DNA, 510 bp, Escherichia coli HS
atgtttgattaccaagtttccaaacatccacattttgatgaagcctgtcgtgcattcgcattgcgccacaacctggtgcaactggcagaacgtgctggcatgaatgtgcagattctgcggaacaagctgaacccagctcaacctcatttattaaccgcaccagaaatctggctgcttaccgatctgactgaagattcaacgctggtagatggttttctggcacagattcattgtctgccatgtgtaccgattaatgaggtggcaaaagagaaactgccacattacgtcatgagtgcaaccgcagagatcgggcgtgttgctgcaggtgcggtatctggcgatgtaaaaacctgtgccggtcgtcgtgatgctatcagcagcattaactctgtaacacgactgatggcgctggcggctgtttcattgcaggcccgtttacaggctaatcctgcgatggcgagtgcagttgataccgtgactggcctcggtgcttcattcggtttgctgtga

SEQ ID NO: 6378 - DNA, 510 bp, Escherichia coli C ATCC 8739
atgtttgattaccaagtttccaaacatccacattttgatgaagcctgtcgtgcattcgcattgcgccacaacctagtgcaactggcagaacgtgcaggcatgaatgtgcagattctgcggaacaagctgaacccagctcaacctcatttattaaccgcaccagaaatctggttgcttaccgatctgactgaagattcaacgctggtagatggctttctggcacagattcactgcctgccatgtgtaccgattaatgaggtagcaaaagagaaactgccgcattacgtcatgagtgcaactgcagagatagggcgtgtcgcggcaggtgcggtttctggcgatgtaaaaaccagtgcaggccgtcgtgatgcgatcagcagcattaactctgttacacgactgatggcgctggctgctgtttcattgcaggcccgtttacaggctaatcctgcgatggcgagtgcagttgataccgtgactggcctcggtgcttcattcggtttgctgtga

SEQ ID NO: 6379 - DNA, 534 bp, Yersinia pseudotuberculosis YPIII
atggttactttgggtgggttgactatgtttgattatcaggtttctaaacatccttgttttgatgtggccatgcgcgggtttgctttggcgcataatctcagtgaactggcgggccgggttgggatgaatgcgcaaacgttgcggaataagctcaacccggagcaaccgcaccagcttacggttactgaattgcttgcgatcacagatgcaacagaagacgccaaccttatcgatgccatgttggcgcaaataaactgtatgccgtcagtgccagtaaatgaggccagcgctgataacatttctacctacgcgcttaaagcaactgccgccgtgggttcgattgctgccgcagcggtgcagggcaatcacaaaacagcattcagcaaatctgctctgctggatagcgttaatactgcgattcgccatctgtcactgattggcctgacagtgcaatgtcgtattcagtcaacccctgctcttgcttcaaccgttgatgttattagcgggttgagtgctgccgccggtttgagttga

SEQ ID NO: 6380 - DNA, 339 bp, Methanosarcina barkeri fusaro; identical to SEQ ID NO: 2163

SEQ ID NO: 6381 - DNA, 489 bp, Burkholderia pseudomallei 1710b
atgaagcgcaggccgcccgaggtgaagcgcgaggcgcgcgacgatgccgcgcgcggcgacgcgcggcacgccggcgccggcgccgcgccggatgacccacgcggcgccgcgcggcgcgacccgccgcccggctcgcgcgccgcgcgcggcggcgcaacgcatccggccgcgcgagccgccgagcccgccgcgccgaagcccgccgccgatcgcgtcgagcgggccgcgcacacggccgcggcgcgcgcggcgcgcggcgcgcgcgatccggaaccgtcgctcggccggcggctcgcgcagatcggcgtgctcggctggacgatcgtcgcgccgacgctcgccgcgctcgcgctcggccgctggctcgaccggatgttcgcgacgcgggtgtttttttccgcgccgctcctgatgctcggcgcggcgctcggcctctggctcgcgtggcgctggatgaaagctcaacagcatggagatcgcgatgattga

SEQ ID NO: 6382 - DNA, 369 bp, Pelobacter carbinolicus; identical to SEQ ID NO: 2164

SEQ ID NO: 6383 - DNA, 321 bp, Chlorobium luteolum DSM 273; identical to SEQ ID NO: 2165

SEQ ID NO: 6384 - DNA, 492 bp, Nitrosospira multiformis ATCC 25196; identical to SEQ ID NO: 2166

SEQ ID NO: 6385 - DNA, 489 bp, Burkholderia thailandensis E264
atgacgaagcgccggccgttcgaagcgaagcgcgacgatgcggcgcgcggcgacgcgcgccgcgccggggcgagcgccgcgcgggacgacgcgcgcgacggtgcgccgcgcgagccgtcgccggaatcatccggatctcccgccgcgcgcgatggcggaaggcccccggccgtgcggcccgccgacgccgcgccgaagcccgccgccgaccgcgtcgcgcaggcggcgcgcacggcggcgacgcgcgcggcgcgcggcgcgcgcgatccggagccgtcgctcggccggcggcttgcgcagatcggcgtgctcggctggacgatcgtcgcgccgacgctcgccgcgctcgcgatcgggcgctggcttgaccgcgtgttcgcgtcgcgcgtgttcttttccgcgccgctcgtgatgctcggcgcggcgctcggcttctggctcgcgtggcgctggatgaaaggtcaacaagaaggagatcgcgatgattga

SEQ ID NO: 6386 - DNA, 336 bp, Rhodoferax ferrireducens T118; identical to SEQ ID NO: 2167

SEQ ID NO: 6387 - DNA, 318 bp, Burkholderia xenovorans LB400
atgagcacaccgcagcgcgacgagcgcagctctcgtgaggacaagctggccggcgcggcccagcaggccgcggaacgcgcggcgcgcgggcgggcggagccggagccctcgctcggcacccggctcggccagatcggcattctcggctgggccatcgtggtgccgacactgctcgggctggcgttgggacactggctcgaccgcaccttcggtacgcgggtatttttctcggcgccgcttctcatggtgggggcagcgctcggcttctggtccgcatggaaatggatgcatcgtcaacagggagcacatcgtgaatag

SEQ ID NO: 6388 - DNA, 312 bp, Burkholderia xenovorans LB400
gtgagcaggtccgacgaacccgatgacaacgagcgcctcgcgcatgcagcaagacaggcccgtacacgcgagcggcgggctcgcgacgaacccgagccatcgctcggcaaccgtctggggcagatcggcattctcggctggtcgatcgtcattccgacgctgctcggcctggccattggccactggctcgaccggcacttcggcacaggcgtgttcttttccgcgccgctgttgatgatcggcgccgcgtttggcctgtggtcggcgtggaaatggatgcaccggcaaacaaggagcaagcatcatgactga

SEQ ID NO: 6389 - DNA, 393 bp, Pseudoalteromonas atlantica T6c; identical to SEQ ID NO: 2168

SEQ ID NO: 6390 - DNA, 366 bp, Rhodobacter sphaeroides 2 4 1
atgaccggccccggcccgggatccgccccgcccggagccggtcccggaccggatcccgcggccgcgcccgccatttcgcccccggccccgcccggggcctccccggatccgctcgcggaggccgtccggcgcagcgccgtccgcgccgaggcggggcggcgcgatcccgagccctcgctcgcgcgccgcttcggccagatcggggtgctgggatgggtgatcgtgctgccgaccctcggcggcgtgctggccgggggctggctcgaccggctcctcggcaccgggatcacctttgccgccgccctcacgatggcgggcgcggccctgggcctctggctcgccctgcgatggatgcatgcgcaatga

SEQ ID NO: 6391 - DNA, 378 bp, Shewanella frigidimarina NCIMB 400; identical to SEQ ID NO: 2169

SEQ ID NO: 6392 - DNA, 384 bp, Psychromonas ingrahamii 37; identical to SEQ ID NO: 2170

SEQ ID NO: 6393 - DNA, 336 bp, Polaromonas naphthalenivorans CJ2; identical to SEQ ID NO: 2171

SEQ ID NO: 6394 - DNA, 366 bp, Rhodobacter sphaeroides ATCC 17029
atgaccggccccggcccgggatccgccccgcccggagccggtcccggaccggatcccccggccccgcccgccatttcgcccccggccccgcccggggcctccccggatccgctcgcggaggccgtccggcgcagcgccgtccgcgccgaggcggggcggcgcgatcccgagccctcgctcgcgcgccgcttcggccagatcggggtgctcggatgggttatcgtgctgccgaccctcggcggcgttctggccgggggctggctcgaccggctcctcggcaccgggatcacctttgccgccgccctcacgatggcgggcgcggccctgggcctctggctcgccctgcgatggatgcatgcgcaatga

SEQ ID NO: 6395 - DNA, 492 bp, Burkholderia mallei NCTC 10247
atgatgaagcgcaggccgcccgaggtgaagcgcgaggcgcgcgacgatgccgcgcgcggcgacgcgcggcacgccggcgccggcgccgcgccggatgacccacgcggcgccgcgcggcgcgacccgtcgcccggctcgcgcgccgcgcgcggcggcgcaacgcatccggccgcgcgagccgccgagcccgccgcgccgaagcccgccgccgatcgcgtcgagcgggccgcgcacacggccgcggcgcgcgcggcgcgcggcgcgcgcgatccggagccgtcgctcggccggcggctcgcgcagatcggcgtgctcggctggacgatcgtcgcgccgacgctcgccgcgctcgcgctcggccgctggctcgaccggatgttcgcgacgcgggtgtttttttccgcgccgctcctgatgctcggcgcggcgctcggcctctggctcgcgtggcgctggatgaaagctcaacagcatggagatcgcgatgattga

SEQ ID NO: 6396 - DNA, 501 bp, Burkholderia pseudomallei 668
atgatgaagcgcaggccgcccgaggtgaagcgcgaggcgcgcgaggcgcgcgacgatgccgcgcgcggcgacgcgcggcacgccggcgccggcgccgcgccggatgacccacgcggcgccgcgcggcgcgacccgccgcccggctcgcgcgccgcgcgcggcggcgcaacgcatccggccgcgcgagccgccgagcccgccgcgccgaagcccgccgccgatcgcgtcgagcgggccgcgcacacggccgcggcgcgcgcggcgcgcggcgcgcgcgatccggaaccgtcgctcggccgacggctcgcgcagatcggcgtgctcggctggacgatcgtcgcgccgacgctcgccgcgctcgcgctcggccgctggctcgaccggatgttcgcgacgcgggtgtttttttccgcgccgctcctgatgctcggcgcggcgctcggcctctggctcgcgtggcgctggatgaaagctcaacagcatggagatcgcgatgattga

SEQ ID NO: 6397 - DNA, 501 bp, Burkholderia pseudomallei 1106a; identical to SEQ ID NO: 6396

SEQ ID NO: 6398 - DNA, 405 bp, Bradyrhizobium BTAi1
atgacgcagcccgaaaatcacgagcggctgggacaggcggtcagaagacggcaggaacgccgcgagcgctggcagcgcgagggcgaacggtcgctgggccagaacttcgccatgatcggagcactgggctggaccatcgtggttccgacactgctcggcatcttcgccggtcgctggctcgaccggaccttccatagcgggatcttctggacctgggcctgctcgtggcaggtctggcagcgggctgcacatttgcatggaagaggatgcacagcgcatgatccgcacgagtttgatcactcatcccgaactcacgctgttgacggcatttgcgggtctgatgtttgggctggcgtattttgcggctctcaagcgcagcgtgacgctgcttgtccgcagcgatag

SEQ ID NO: 6399 - DNA, 381 bp, Marinomonas MWYL1; identical to SEQ ID NO: 2172

SEQ ID NO: 6400 - DNA, 288 bp, Dinoroseobacter shibae DFL 12
atgacgcagaagccagacagatccgcggaggatatcggccagcgcgcgcgccggatgaaggccgcgcgcgacgatcccggtcccagcccgttgcgcggcatcggcacgttcgggatgatcggctggtccatcgcggtgccgacggtgggcggcgtgttcctgggcctgtggctcgaccgcgtggcgccgcagacgttttcctggaccatcgcactgcttctggggggcgtggtgctgggggcgctgatcgcctggaactggatcggcaaggaaggagacggaagatga

SEQ ID NO: 6401 - DNA, 255 bp, Beijerinckia indica ATCC 9039
atggcgcaagcggcccgggaggctgcggaacgcgccaggaaaggcgcggaaaaccccgagccatctctcggggcacgcctcggccagattggcattctcggctggaccatcgtcgttccgactttgctcgctttgcttctcggacgatggctcgatcagattttcgcaacaggcatattcttctcagctcccctcattatgatcggtgctggcatcggtttctggtccgcttggaaatggatgcaccgcccatga

SEQ ID NO: 6402 - DNA, 315 bp, Burkholderia phymatum STM815
atgacgagacagcggaacggacatgtgacaccggacgatcgggtcgccaacgccgcacgccgcgccgcgaatcgcgacgcaatggggcgcgaagaccgggagccctcgctcgccgcgcggctcgggcagatcggcattctcggctggacgatcgttttgccgacactcgccggtctcgcgctgggtcgctggcttgaccggctgatgggaacgcgagtgtttttctcggcgccgcttctgatgctcggcgccgcgatcgggttctggtccgcatggaaatggatgcatcggcagcaaaggagagatcgtgactag

SEQ ID NO: 6403 - DNA, 318 bp, Burkholderia phytofirmans PsJN
atgaactcgcagcttcccgacaggcgcaaatcgggcgacgaccgcatggccggtgcagcccgccacgccgccgcgcgtgacgcgcatgggcgcgctgatcccgagccgtctctgggcagccggcttggccagatcggcatcctcggctgggcaatcgttctgccgacgttgctgggactcgcgatcggccattggctggatcgcgcttttggcacgcgcgtgttcttctcggcgccgctcctgatgatcggcgccgcagtcggcttctggtcggcgtggaagtggatgcatcgtcaacaacgagggcaccatgattag

SEQ ID NO: 6404 - DNA, 318 bp, Rhodopseudomonas palustris TIE 1
atgaccgcgccaaagcaaaccccacaacctgaacccacggcagtgccggacgaacaggattcgctggtcaaaggggtacggctccgcggcgggcgtcaccagcgctggctgcgcgagggcgacccatcggtggcgcgcatgctcgcccagatcggcgtgctcggctggatcatcgtcgtgccgctgctgattgcagtgttcggcggccagtggctcgatcagaaattcaactccggaatcttctgcactgccccgctgctgatcgtggggctggcgctcggatgctggtccgcctggaagtggattgaacgccaatga

SEQ ID NO: 6405 - DNA, 336 bp, Prosthecochloris aestuarii DSM 271; identical to SEQ ID NO: 2173

SEQ ID NO: 6406 - DNA, 288 bp, Azotobacter vinelandii DJ
atgaacccgcaacgagacgagggacgcgagccgttgggcgaggcggcgcgtcgtgccgtgcgccgcgaggagcaggcgcgccgcgatccggagccttcgctgggccggcgcctggggcagatcggcgtgctcggctgggccatcgtcgtacccgtgctgctcggcctgctgctcggccgctggctggatcgcctgttcggcacgggcgtgaccttcgccgcggcgctgctgttcctcggcgcctgcctggggctctggtcggcctggcgctggatgcaccggcaatga

SEQ ID NO: 6407 - DNA, 333 bp, Desulfomicrobium baculatum DSM 4028; identical to SEQ ID NO: 2174

SEQ ID NO: 6408 - DNA, 867 bp, Flavobacterium johnsoniae UW101
atgattatgaaaatattacaaaaatatagagcagttgcaatgatttcagtatcaatgttgtttgctgcttgtgctcaggaagatcagccaaaagaaactcagttagattatacagttcgtaataaaacagaactggatacctggattgaaacaagttttttaaatccatataacataaaagtgtattatgaatggaaccaaaacttagtagataacaatcgctttttgtttcctcctacagtagacagagtaaaaccagcaatggaagttgtaaaagcaatctggattgatagttattcgactattggaggagcagatttcgttaagaaaatttcacctagagaatttgtattagtaggaggaactaacttaaatacatctggtacagttacattaggtattgcagaaggaggacagagagttacgctttttgaattagattatttaaatagaaaaagcagagcagatgtaactagatttatccatacaattcagcatgagtatgtacacatcttaaaccagacaaaaccttttgatgagcaggcatgggcaaaattaacaccagcaggatatacatcaagctggtatatttatacagatgctgcttcaagagctttaggttttataactaattatgcgagattgaatatttacgaagattttgccgaaacagcttcaataatcttaacaagttcaaaagcagaatacgatgcaattttggcaagtgttacagatgcaacagcaaaagcaaaccttaaaaagaaagaagcaattgtagttcagtattataaagataatttcggaatggatttttacgctttaagagacgaagcgcaaaaaaatacaaccacagttatcaacaattaa

SEQ ID NO: 6409 - DNA, 840 bp, Capnocytophaga ochracea DSM 7271
atgaaaaagatatactttatagcaatgttcactctcttgttagtggcttgcaacagaaaagagacacttagtgataaaagtgtgcttaaaaccaaagtaacagctcaaactgaattggatacttatatatacaacaatttccaaaaaccttataacattatagttacttacaactggaaagattccgatttcgagtttaacaagtttctatatccccctaccgaaagcaagataaaacctatgcttgaagtagttaaaaaggtttggatagatagctattccgaaatagcaggagctaactttataaaagaagtggctccaagacaaatttcattggtaggaggttataacgttaatgaaaacggtacgattactcttggttttgccgatagtggtatgaaaattactctttttaatgtcgaccagctcgaccttaccaatcacgctggcactcgcctgtattttcataccattcagcacgagtattgccatattatcaaccagaaaaaaccctattctaccgagtttggcaaaataactcctaactacacctccgtttgggcaaactatggaaatgatgaagctaacgagttaggctttattaccaattatgctagagccaatgatgtagaagactttgccgaaatgacctctacaatgcttgggatgagcaaaactgcttgggatgctaaagtagaggctattacagataccaaggctaaagaagctattcgcaagaaagaagaatttgtagtagcctattttaaaagcgaatggaatatagacttttacgcactacaagccaaagtagaagaacaaatgctttctgtattacaataa

SEQ ID NO: 6410 - DNA, 1398 bp, Pedobacter heparinus DSM 2366
atgaaaaactttatatatacactgggtattttttctcttctgggcttaacgataagctgtaaaaagagtgagaacctggataaggaaattgttggccttgggggcgacacctgggtgcagggagcacttgatcaatggttgtatactaactttacgcagccttttaacatgtctgttaaatacagatgggatggtacggaatatgatcctgcaaagacgctaacaccaccaaaagttgaaagggttcaacccttaatggaaatggtaaaagcagtctggattgatccatatgtatcggaaagtaatatggatttcatcagaaaatacggcccaaaaaactatgtgctggtagggagtttacaatataatgtaggtggtacagtaactttaggggaagcagaaggaggggtaaaagtaaccctgtttaatgtcaataacttctcaaaaaccaacagggaggtttctcagcgggtacttaaaaccatccatcatgagtttacgcatattttaaaccaaaccattagctatcagaaagaatttccgcaggttacacctgcaggttatactgccgactggaacaatactacgctggtaaatgccaataatgcgggatacattacccagtattcccaggcttcaccaaatgaagattttgcagaaatgacatcagttatgctgacagaaggaaaatcctcttacgatgcaattgtaaacagtattgtagtccctaagctcgattctattcccgatccggccaatccacccttcatcattgtcagggaattaccaaatacggctgcccaggcggccctcaggaaaaaagagcaatttgtagtttcttatttcaaaagcagttacggaattgaattcgcccgtttgcaaaacaaagtaaactatgctttggcagcaaatgcaccttctgatttagctacattattcggtaaccgcaaaaagtatacttcaatttctgtcgatcctgacaatgttcctggcatgtcggcaaattttatgtctacctgggcaacaactaaaacaggtcttgcagcggttggtggtcaaggcagggtattaaataattttgtgctgtttttttatcccagagctggtgaactggtgttgcgtatcaactatgccaattcaaccggtgtactggccgcaaactttgtgtataaggtagcttataacgcaaacaatcagttaaccctgacttatttaaggcgggatggaaatgctgaggtgattgcaccgggagtggttgcattaaccaattaccttacttcaggtagtttcgcggtcagctggcgttatgatgccaatttccttgaattcggacagtggacaaaagtttcagatcctacttcatcgtttttcgggaatttaggtgtaataaaatattag

SEQ ID NO: 6411 - DNA, 930 bp, Dyadobacter fermentans DSM 18053
atgaaaacgatattcagacattttacccattacatgatcgccgcattgctgcttggcatgacttcctgcaaagaggaggagctgggcaatgtagacgatattcccgggctgggcggcgacgtttgggctgaggggccgatcgataaatggattcaggatagcctggttgttccttacaatatctccgcaaaatataagtgggatcagtttgagttcgggaatatgaccaaaaacctggtgccgccggatgaagcgcaagtggttccgttgcttagcacaattaaaaaagcgtggacaaccccttacgtcgaggaggcgggaaaagtgttttataataaatattcacccaaattcttcattctatcgggtagcaacgagtacaatgttgaatcaggttctattacgctcggaacggcggaaggcggccgaaaagtaatcctgtacggagtaaatctgttcaaaatcaagggaatggccgggtatgatccggggcgggactcgtcttttgtgaaagattggttcctgcataccatccaccacgagttcggccatattctgcatcagacggtgttctatcctgttgaatacaaaaacatttcaaaagcatattaccagggtggaaactggatcaactggagtgatgccgatgcgcgtcgcgacggctttattaccgcttacagctcatcttcctttgatgaggattttgtggagatgattgcgatgatgcttaccgaaggcagggcgggtttcgacaaaatcgtgaactcgataccggaaggaacgagccgcagcggcgtaacaaaggcgcaggcgcaggccgcgttgcggcaaaaagaggctattattgtagcctattacaagaatacgtggaagattgatttttacagtctgcaaaacaaagtgcggacttcgatgaacaaattgttttaa

SEQ ID NO: 6412 - DNA, 912 bp, Chitinophaga pinensis DSM 2588
atgaaaaatataaagacattattccttctcctgacgctggccttgttggccgcatgtgcaaaagatgacgatctcagtaacctggaagacattccgggactgggtggagatacctggcaaaagacagcgcttgacaaatggctgtacgataccctggtcgtaccgtataacattgaagccaaatacaaatgggaccagtttgagtttgacctgaacaaaacactggtaccgccgcaggaagcaatggtaaaaccagccctgcaatctattaaaaaagtatggattgacacctatgtacaggaagctggtattgaattcttccgtcagaacagcccgaaattcctgatcctttgtggtagtgccagctggaatgtggataacggcaccatcactttaggtaccgctgaaggtggtcgtaaagtggtgctttattctatcaattcttttcgcattaaaggtatgcctaattacaagccttctgactcagcgacgctgaagcagatctttcacgtaatagaacacgaattcgggcatattcttcatcagacgatactttacccgcccgcctttaaaaacatctctgcagggcgttattctgccaactggacgaatatcagcgatgacgaggcacatgctaatggttttattaccccatatgccatgtcaggttttgatgatgactttgtggaaatgatctccctgatgctgacggacggacgcgcagggtttgaaaggctgattgccagcataccggaaggtacggccgccagcggtgtgacacaggcccaggcaatatccgccctgcgtcagaaagaagccatggtcgtggcctactttaaaacagcctggaaaatagatttctacagtctgcagacgaagaagcggaaagcagtggagtcactgatctactaa

SEQ ID NO: 6413 - DNA, 888 bp, Chitinophaga pinensis DSM 2588
ttgatcctgacagtagccgcattcgcagcctgtgcaaagaaagaagacgacctcagtggtgtgcaagatatcccgggcctgggtggcgatacctgggtaccgggatctttagatgcctggttacacgacacgatgactgttccctacaatattgaagtaaagtataaatgggaccagtttgagtttgatgttaccaagaccctggtgcctcccagagaagaggtagtaatccccgctatcagggcgattaaaaaagtgtggatagataattacatcagagaagcaggagcgatcttcttcaagaagtattgtcctaaattctttatcctgtcaggtagcgccagctggaacgacaatggaaccattacactgggtacggcagaaggcggtcgtaaagtagtgatgtacctgctcaatgatttccgcacgaaagaaatgccaggatataaaaagagcgataccggaaacgtaaagcaaatctttcatgtaatagaacatgaattcggacatatcctacatcagacagtgatgtacccggtagaatttaagaagatctgcgccggttattacactggtaactggaacaatatcgctgattccgaagcaagaaaagacggatttgtaacagcatatgccatgtccaatgaaaacgaagactttgtagaaatgatcgctatgatgctcatagaaggaaaagcgggctttgatagaatagtgaacagcatcccggaaggaaccagtgtgaatggtagttcgcaggcacaggcaaaagacaggctacgtcagaaagaagcgatggtagtgagttactttaaaactgcccataaagtcgatttctatagtctgcaggacaataccagaaaatccatcgtacagctgctttactaa

SEQ ID NO: 6414 - DNA, 849 bp, Chitinophaga pinensis DSM 2588
atgaaacaaatgcagataaaattgctcatggtatttatcttcctcggtagcatcatggcttgttcaaaggatgataaaatagatagtgtgaacatccccggcctcggaggtgaaacctgggtaaaaggaccgctggatttctggctggattccgtattcacaaagccctttaatatcgaagtcaaataccgcttcgaacgctatgaactgaccctggataaaacactggtaccagtcatggaaagtaaagtgcaaccggttatgagcactatccagaaaacctggatcgcgccttatatcgcagaagccggcgagactttcttcaaaacctattgtcagaaacagtttgtcctggtaggtagtccgcagttcaactctaacaataccatcacactcggtacagcagaaggcggtcgtaagatcgtattattctggctgaatgattttttactgactgacaagccttttgtaaaggaaatgctgcataccattcaccacgaatttgcgcatattctgcatcagaccattatgtaccctgtagaatacaaacgcatctctaccggctataccggtagctggaatgactatacactggaagaagcgctggatagaggatttattacacagtatgcccgcagcgcaccggatgaagactttgtagaaatgatctccaccatgctggtagaaggtaaagatggttatgaagccattattgccgaagccccggatgatgcacaggcgaagttccgtcagaaggaagaaatcgttgtgcgctactttatggagaattacaacatcgacttctaccgtctccagacccgcgtacaggatgcaattgataacttgtaa

SEQ ID NO: 6415 - DNA, 651 bp, Dehalococcoides ethenogenes 195
atgcgtatttttctggataccgctaatattgaagagattaaaaaaggcctgaaactgggagtggtgagcggtgtgaccaccaatcccactctggttgccaaagaaggcatcagtgattataaatccgtagtacagcagatatgtgccttgctgccggagggtgatgtctctgccgaaattacggctgaagaccccgccgaaatgctcaagcaggcccgcgagatagctaaatgggcacccaacgtggtggtcaaaatacccgccaccgccgaagggctggagattatttccaagctgagcaaagagggtgtccgcttcaatatgaccctctgtttctcggtcaaccaggctttgctgggggctttggccggtgcggcctttgtcagcccgtttgtgggcaggctggatgatgccgggcatgacggcatgatgcttataaatgatattgtcagtatatataaggaatacggctttgaaacccaggtgattgccgccagtatccgccacccgcttcattgcactcaggcggcccagaccggtgccggtattgccaccgtaccttacaaggtgctgatgcagatgatgcagcatccgctgacagattcgggtattgcccgtttcatggctgactggaaaagtgtccagaagtaa

SEQ ID NO: 6416 - DNA, 741 bp, Deinococcus geothermalis DSM 11300
atgcaatttttcatcgacaccgcgatcattgacgaggtccgtgaaatcaaccgctggggtgtgctgtcgggcgtcaccaccaaccccagcctggtcgccgcgtcggggcgcgacttcaaggaagtcattcaggaactcgccgcgttggtcggtggcgcgatcagcgcggaggccaccgcccttgacgctgagggcatgatcaaagaaggccgcgagtttgccagttggagcgagcacgttgtcgtcaagttgccgctgactccggcgggcctgcaggcctgtcaggccctaacctcggagggcatccgcaccaacatcaccctgtgcttcagcgtgccgcaggcgctgctggcggcccgggccggggccagctacatcagcccgtttgcgggccgggtggacgacatcggctgggacggcatcgagctggtgcgccagatcaaggaagcctacgtgctgggggacattccgaccaaggtgctggctgcctcgattcgccacccgcagcacgtggtgcaggcggcgctggcgggagccgacgtggcgaccgtgccctacaaggtctttacccagatgatcaagcatcccctcacccaggcggggctcgatgcctttctccaggactgggcgcggcgcgccggggccagtcccgaaacgccttccagcgaggcaggcagcaatccccagcagggcggcgtgaccgcgcagggtgaaccggtgcagggaggccagcggcagtga

SEQ ID NO: 6417 - DNA, 648 bp, Moorella thermoacetica ATCC 39073
gtgcggatttttattgatacggccaacgtcgaagagattaaagcagccaatgatctgggtataattgcaggtgtaaccactaatccttcccttatcgcccgggaaggacgcaatttccgcgaaatagtggaagaaatcgcagctattgtggatggaccaatcagcgccgaagtagtgagcaccacagccccggagatggtggccgaaggggtcgaactggcggccatccatcccaatattgtcatcaagatccccatgatcgccgaggggctaaaagcggtcaaggagttgtccgcccgtggcattaaaaccaatgtgaccctggtgttttccgccaaccaggccctgctggcggccctggcaggagcgacctacgtcagtccctttgtcgggcgcctggatgacatcagccatgacggcctgcaggttattgccgacattgttcccatctttgcccagtacggctttaaaacccagataatcgccgccagcatccgccatcccctccacgtcctggaggcagcccgcctgggcgccgatatcgccaccgtcccctttaaggtcctcatgcagatgctcaaacatcccctgacagacaccggcctggcacgcttcctggcagactgggaaaaggtaaagaataagtaa

SEQ ID NO: 6418 - DNA, 651 bp, Desulfotomaculum reducens MI-1
atgcttctttttatcgatactgcaaatgtagatgaaattcgggctgccaatgccctgggtgtcattgctggcgtaaccaccaatccctctctgattgcccgagaaggacgtgattttgcggaagttgtaaaagaaataacctccattgttgacggtcccatcagtgcagaagtgattagcttggatgccgaaggtatgatgaaagaagctgtggaacttgcagccattcaccccaatattgttatcaaaataccaatgaccaccgagggattaaaagcaacccgggcctgtatggaaaagggcattaaaaccaatgttaccctaatcttttctgctaatcaggcgctattggctgccagggcaggtgctacctatgttagtccctttgtgggacgcttagatgatattggccaggatgggattggcttgatctacgatatagcagatatctttaacaattatgatcttgctacccaaattatctcagccagtattcgtcacccgttacacgttcagcaatccgccaaggccggggcccacatagccacagtaccttataaagtattgctgcaaatggccaaacatcccttaacagataagggaattgatgccttccttgccgactgggcaaagcttaccccaaaagcctaa

SEQ ID NO: 6419 - DNA, 651 bp, Dehalococcoides BAV1
atgcgcatttttctggataccgccaatattgaagaaattaaaaaaggcctgaaactcggggtggtgagtggtgtaactaccaatcccacactggttgctaaagaaggcataagtgattataaatctgtagttcagcagatatgcgctttgctgccggagggtgatgtttctgccgaaattacggctgaagaccctgccgaaatgctgaaacaggcccgtgaaatagccaaatgggcacccaatgtagtggtcaagatacctgccactactgaagggttggagataatttccaagctaagcaaagagggtgtccgtttcaatatgacactctgtttttcggttaaccaagctttgctgggggctttggccggggcggcctttgtcagcccgttcgtgggcaggctggacgacgccgggcatgacggcatgatgctgataaatgatatagttaatatatataaggaatacgggtttgaaacccgggtgattgccgccagtatccgccatccgcttcactgcactcaggcggcccaaaccggggcaagcattgccactgtaccctacaaggtgcttatgcagatgatgaaccacccgctgacagattcgggtgttgcccgtttcatggctgactggaaaagcgtccagaagtaa

SEQ ID NO: 6420 - DNA, 648 bp, Candidatus Desulforudis audaxviator MP104C
atggaattgtttctcgatacggccaacgtggatgaaatcagggaggcggccgccctgggcgtgatttcgggcgtcaccaccaacccgagcctcatcgcgagggaggggcgtgatttcacgcaggtagtccgggagattaccgggttggtggacggaccggtaagcgcggaggtcatcagtaccgaagcggaggctatggtggccgaagccgaagaactgtctcagattcatccaaacgtggtcatcaaaatacctatgatcctcgaaggcttgaaggccgtcagtatgctggaaccccggggcatccggaccaacgtgaccctcgttttttccgccaaccaggcgctcttggccgcactggccggagccagtttcgtcagcccgtttgtcgggcgcctggacgacgcgggacacgacggcatggaagtggtccgcgacactgtggatatattcgatctttacgaacttccgaccagggtgatcgccgcttcgattcggcaccccctgcacgtgctggcggcggccaaggcgggagcgcacatcgccaccgtgccctatcaggtgttgatgcagatggccggacacccgcttacggatgtgggcttgcggaagttcctggacgactgggccaggcttaagaagcgttaa

SEQ ID NO: 6421 - DNA, 663 bp, Eggerthella lenta DSM 2243
gtgaagttttttctggacaccgccgatctcgacgaaatagaagaggcggccagctggggcgtgctcgccggcgtcactacgaacccgacgctgtacgcgcgcaccggaggcaagctcgacgatttccacaaccacatcaagcgcatctgcgaaatcgtggacgggcccgtctccgctgaaagcgtcgccatgacgcgcgacgagatcatccgcgacggccgcgagctggccgcgcttgccgacaacgtggtcgtgaagatccccaccatggtggagggtctcgccgccaccaaggcgctctccgaagagggcatccccgtcaacatgacgctgtgcttcagcgtgccgcaggccatcatggccgcccgcgccggcgcccgctacatcagccccttcgtcggccggttcgacgacatcgccgaggacggcatctcgcagttggccgacgtggtggccgcggtgaacaactacgacttcggccacgacgtggagatcatcgccgcgtcggtgcgcagcgcgaaccacgtgacgcaggccgccctcatgggcgccgacatcgccacggtgccgttcgctgcgctcaagaagtgcgtgcaacatccgctgaccgaccgcggcctggatgcgttcatgaaggactgggagaaagttcagcaagcatga

SEQ ID NO: 6422 - DNA, 681 bp, Cryptobacterium curtum DSM 15641
gtgaagttcttcttggacacggccgatttggctgagatcgaggaggcagccagctggggcgccattgccggcgtcacaaccaatccgacgctctatgcgcggacgggtggcaagctgtctgatttccacaaccacatcaagcgcatctgcgagatcgttgatggccctgtttcggccgaaagtgttgcgatgcagcgtgacgaaatcgtgcgtgatgggcttgagcttgcggatattgccgataacgttgtggtaaaggttcccacgatggttgaaggtcttgccgctacgcatgagcttgcgcgccgtggggttccggtaaatatgacgctgtgcttcagcgtgccgcaggccttgcttgccgctcgtgctggtgcacgctatgtgagtccctttatcggtcggtttgatgacatctccgaagatgggcttgatcaggtcagtaatatcgtcggggcactttctcagtacgatttttcggacgcaaccgtgcacggggagcgcattgaagttatcgccgcatcagtaagaagcgcacatcatgtcactcagtgtgcgctgatgggggctgatattgctacggtgccgtttggcgtactgaaaaagatggttcagcatccgctgactgatcgtggccttgaatccttcatgaaggactgggagaaagtgcagggagcatga

SEQ ID NO: 6423 - DNA, 681 bp, Slackia heliotrinireducens DSM 20476
gtgaagttctttttggacacagccgaccttgatgagatcaaagaggcagcgagctggggtgcgctcgccggcgtgaccaccaacccgaccttgtattcccgcatcggcggcaagctcgacgacttctacaaccacatcgagcgcatctgcgacatcgtcgatggccccgtcagcgccgagagcgttgccatgacccgcgacgaaatcgtccgcgacggccgtgagttggccaggatcgcccccaacgttgtcgtgaaggtccccaccatggtcgaaggtctggcggcatgccgcaccctggccgacgagggcatccgcgtcaacatgaccctgtgcttcaccgtgccgcaggccatcctggccgctcgtgccggcgcgcgttacatctcgcccttcgtgggccgcttcgatgacatctccgagaacggtcttgcccagctcgaggacgtcgtcaccgccatcaacaactacgattacactgagaacaccgtcaacggcgagcagatcgaaatcatcgccgcttccatccgcagcgcgaaccacgtgacgcaggccgctctcatgggcgccgacatcgccaccgttcccttcaacgtgctgaagaagatgatccagcatccgctgaccgaccgtggtctcgagtccttcctgaaggactgggagaaagttaagaacgcataa

SEQ ID NO: 6424 - DNA, 660 bp, Desulfotomaculum acetoxidans DSM 771
gtggtgttggaaataaaactttttttggatacggcaaatgtggaggaaataagagatgcttattcactgggtgttatttccggtgtaactactaatccgtctttaattgccttggaggggcgggattttgtccaggttgtgcgcgagattgcctccattgtagacgggccaatcagtgccgaggctgtaagcctggaagccgcgcctatgattgaggaagccaggcagttatcctctattcatcctaatatagtagtaaagatacccatgacagcagaaggtttaaaagccgtcaaagagttatcatcccagggaattaaaacaaatgtaacacttattttttcggctaatcaggcactgctggcagcattggccggtgcatcgtatgtaagcccttttgttggccgtttggatgacataggttataacggcatgcagctgatagaggaaattatggcgatttttaatcagtacggtttgattgcggaagttatagctgccagcgtccggcatcccatgcatgttattgatgcggccaagtctggagctgatattgcaactatcccctataaggttttataccaaatgataaaacatcctttaactgattcaggtattgaaagatttctaaaagattgggagaaagttcccgtaaaataa

SEQ ID NO: 6425 - DNA, 648 bp, Alicyclobacillus acidocaldarius DSM 446
atgaagctgttcatcgatacggcgaacgtcgacgaaatccgccgggcagcggatatgggcattctgagcggtgtcacgaccaacccgagcctcgtggccaaagagggacgtgacttcgttcaggtgctgaaggaaattgtcgagatcgtcgatgggcccatcagcgccgaggtggtgagcctggacgccgagggcatggtgaaggaggcgctgcctctttcggaaattcaccctaacatcgtcatcaagatcccgatgaccgcggagggcctcaaggcggttcatcagctcgcgaagcgcgggattcgaacgaacgtgacgctgattttcagcgcgaaccaggcgctgctcgccgctcgcgccggcgcgtcgttcgtcagccccttcatcggtcggttggatgacatcagcatggacggcgtcgaactgattgcggatatcgctcagatcttcgacatccatggcatcgaaacggaaatcatcgcggccagcatccggcatccgatgcacgtgaccgccgcggcgaaggcgggggcgcacatcgcgacgtgtccgttcagcgtgctggatcagatgatcaagcatccgctgacggatcgcggcatcgagcggttcttggccgattggaataagatgagccagaagtga

SEQ ID NO: 6426 - DNA, 774 bp, Ralstonia solanacearum
gtgagcacgcccgaagagatcgtccggttagaccgcaagctgatcctgcgcgatgccacccgcgagttgagcatgccgtcccgccggctgttcggaaagcgagccatcacgctcggcggattgctgctgctgaccggatgtcgcatcaccgacgaaccttcagtggaatccttcctgatgacggtttcgcgcttcaatgaccgcgtgcaggcctggttgttcgacccacgccggctggcgccaacctatcccgagtccgagctgacacgaccgttcccgttcaatgcttactatggcatcgatgaagtgccagaggtggacgctaacggctttcagctcgaggtcggcggcctggtctcacgcaagacgccgtggacgctcgacgcgttgtacgcattgccgcagacgtcccaggtcacgcgccatatctgcgtggaggggtggagcgccgtcggcaagtggggcggtacgcgcttctccgacttcctccagcgcgtcggggcggatatgactgcaaagtacgtgggttttcggtgcgccgacgactattactccagcatcgacatgcccaccgcgttgcatccgcagacgctgctgacattcacctatgacggcgaacgcttgccgccaaagtacggatttccaatgaagctgcgcatgcctaccaagctcgggtacaagaacccgaagcacatcgttgcgatcttcgtgaccaacaagtatccgggcggttactgggaggaccaggggtacaactggttcggcggttcctga

SEQ ID NO: 6427 - DNA, 789 bp, Dechloromonas aromatica RCB
atgatcaagaaaccttcccggcagctttcgattgatggcgaccttgtactcaaggacgcgatgaaggatatcgctcgtcacctcgaccagccgacacgtcgcgcatttctacagcgatccttgagcctcggcggactgtcgctgctcagcggttgcgccatggtcgatgaaagcggtgtcgagaacgccctgatgaccgtctcccgcttcaacgacagggtccaggcctggctgttcgacccgaaacgtctggctccgacctatccggattcgatgatcactcgcccctttcccttcaacgcctactacggcgaggacgagatccgggaagtggaggaggaaagctaccgcctggaagtgaccggcatggtggccgacaaacatgcctggactctcgccgagttgcgtgccatgccgcagaccgaccagattactcgacatatttgcgtcgagggctggagtgccatcggcaaatggggcggcgtgccgttcgccagtttcctgcgcaaggtcggtgccgatctgagcgccaagtatgtcggcttcaaatgcgccgatgactactacaccagcatcgacatgccgacagccctgcatccgcaaaccctgctgacgctgacttacgacagccagccgctaccgccgcgttacggcttcccgatgaagctgcgcatgccgaccaagctcggctacaagaacccgaaacacatccaggccatttttgtcaccaacacctaccccgggggctattgggaagaccaggggtacaactggttcggcggcagttga

SEQ ID NO: 6428 - DNA, 792 bp, Polaromonas JS666
atgatcaaaacccctccccgcctggccattgacggcgacgccgtgctcaaggaagccgtgagccgaatcagccacgccagtcgcatcaaggagcccgcccgccgcgacttcctgcgccgctcgctcacgctcggcggcctgtccatgctcacgggttgcacgctggtggatgaagccagcatagacacggcattgatgcggatttcccgcatgaatgacaaggtgcaaggctggctgtttgaccccaaccgcctggcccccacctaccccgactcgatgatcacgcgccccttccccttcaatgcctactacagcgagagcgaagtgcgccagatcgaggaaagcagctaccgcctggaggtcaccggcctcgtcgccgacaagcgcaaatgggcgcttgcagagctgcgcgccatgccgcaggtagaccaggtcacccgccacatctgcgtcgaaggctggagcgcgattggcaaatggggcggtgtgccgtttgccagctttctgcgtcgggttggtgctgacctgactgccaaatacgtcgggttcaagtgcgccgacgactacttcaccagcatcgacatgccgaccgccctgcacccgcaaaccgtgctggcgctcacctacgacgggcagccgctcccccccaaatacggctttccgatgaagctgcgcatgcccaccaagctgggctacaagaaccccaaacatatccaggcgatttttgtcaccaacacctaccctggcggctactgggaagaccagggctacaactggttcggaggtagctga

SEQ ID NO: 6429 - DNA, 792 bp, Polaromonas JS666
atgatcaaaacccctccccgcctggccattgacggcgacgccgtgctcaaggaagccgtgagccgaatcagccacgccagtcgcatcagcgagcccgcccgccgcgacttcctgcgccgctcgctcacgctcggcggcctgtccatgctcacgggttgcacgctggtggatgaagccagcatagacacggcattgatgcggatttcccgcatgaatgacaaggtgcaaggctggctgtttgaccccaaccgcctggcccccacctaccccgactcgatgatcacgcgccccttccccttcaatgcctactacaacgagagcgaagtgcgccagatcgaggaaagcagctaccgcctggaggtcaccggcctcgtcgccgacaagcgcaaatgggcgctgccggagctgcgcgccatgccgcaggtagaccaagtcacccgccacatctgcgtcgaaggctggagcgcgatcggcaaatggggcggtgtgccgtttgccagctttctgcgccgggttggtgctgacctgactgccaaatacgtcgggttcaagtgcgccgacgactacttcaccagcatcgacatgccgaccgccctgcacccgcaaaccgtgctggcgctcacctacgacgggcagccgctaccccccaaatacggctttccgatgaagctgcgcatgcccaccaagctgggctacaagaaccccaaacatatccaggcgattttcgtcaccaacacctaccctggcggctactgggaagaccagggctacaactggttcggaggtagctga

SEQ ID NO: 6430 - DNA, 789 bp, Serratia proteamaculans 568
atgaaagcacagaaacagccaataagcctgagtgaagggcaagagatcgtcagagaggcgcagcaactgctggcacgccagctggagtcttcttcgcggcggcgcttcctgcgcaacgggctgacgctggggggaattgccatgctcaccgggtgtgacatcagcgacaacaccaatgtcgaacaggcgctgagccgcatctcacgctttaacgatcgggtacagggctggctgttcaatgccgaccatctggcgccggtatatgccgagtcgatgatcactcgtccgttcccgttcaacgcgttttatgccgaggatcaggcaccggagatcaatggcgacgactaccggctggaggtcaacggactggtgctgaataagcagccctggacgctgccgcaattgcacaagatgacgcaaatcagtcaggtgacgcgccatatctgcgtagagggttggagtgcgatcggcaagtggggcggagtgccgttcgcggaatttctccaggcgatcggtgcggacctgagcgccaaatatgtcagtttcaaatgcgccgacgattactacaccagcatcgatatggccacggcgctgcatccacaaaccattatggcgctgacctacgacggccagatcttgccgcgaaaatacggctatccgatgaagctgcgtatgccgaccaagctcggctacaagaatccgaaacatattcaggtgattgaagtcaccaaccgctttcccggcggttactgggaagatcaaggttacaactggtttggcggcagctaa

SEQ ID NO: 6431 - DNA, 792 bp, Delftia acidovorans SPH-1
atgaaaatcttcaaagtcccttccctgcccggcgtcgatggcgaggccgtggtgcgcgaggcacgctcgctgatcgtccgcaagctggaccagcccgcacgccgcgccttcttgcagcgctcgctgacgctgggcggcctgtccctgctcacgggctgcagcatcagcgatgacagccacgtcgaggccgcgctcagccaggtatcgcgcttcaacgaccgcatgcagggcctgctcttcagccccacgcggctggcgcccacctattccgcagccgagatcacgcgccccttccccttcaatgcctactacggcgaggacgaggtgcgcgaggtggacggggccagctggcgcctggaggtgaccggcatggtcgccgaccgccatgcctggaccctggccgagctgcgcgccatgccgcaggacgaacagatcacgcgccatatctgcgtggaaggctggagcgccataggccgctggggcggcgtgcgctttgccgatttcctgcgccacataggcgccgacaccagtgccaagtacgtcggcttcaagtgcgttgacgactacttcaccagcatcgacatggccacggccctgcatccgcagacgctgatggcattgacttacgacgggcagcccctgccgcccaaatatggctttccgatgaagctgcgcatgcccaccaagctgggctacaagaacccgaagcacatccaggccatgttcgtcaccaacacctactccggcggctactgggaagaccagggctacaactggttcggaggcagctga

SEQ ID NO: 6432 - DNA, 777 bp, Burkholderia phymatum STM815
atgaaaaccagcgacaaaccgatcgtcaagctcgatcgcgaagcgattctcgccgatgcgcgccgcgaactggaaatgccttcgcgccgcctgttcggcaagcgcatgctgaccctgggcgggctctcgttgctgaccggctgctcgatcaccgacgaggactcggtcaacaagtttctgacggctgtctcgcgtctgaacgaccgcgcgcaggcactgctgttcgatccgaagcaactcgcgcccacttatacggaagcgcaaatcacgcggccgtttccgttcaacgcgttctacggcatcgacgacgtgcccgaagtggacggcagcgactatcgcctgaaagtcagcggtctcgtgacggggcagcgcgtgtggacgctgcctgaactgtacgcgctgccgcacgctgaacagatcacacggcatatctgcgtcgaaggctggagcgcaatcggacgctggggcggcacgccgttcgctggcttcctgcgccgcatcggcgccgatacgaccgcgaagtatgtcggctttcgctgcgcggacgattactacgagagcatcgacatgcccactgcgctgcatccgcagaccttgctcacgttcgaatacgacggcgagcgcttgcccgcgaaatacggctatccgatgaagctgcgcatgccgaccaagctcggctacaagaatccgaaacacatcgtcgagatcttcgtcacgaatacgtatcccggcggctattgggttgatcagggctacaactggttcggcggttcctga

SEQ ID NO: 6433 - DNA, 750 bp, Gluconacetobacter diazotrophicus PAl 5 JGI
atgagtcacaaccgcctcgatcgctcggcgatcgcccccgaactgcgccggatcgagcgccgtctgatgctcaaaggcgccctgtcgcttggtggactgtcgatgctgtccggctgtgcgctggacgacgagccgtccgtggagcgtgcgctcagcgcgatgtcgcgtttcaccgaccggatgcaggccctgctgttcagccgccagcggctcgcgcgggaattcgacgcatccaggatcacgcatccttttccgttcaacgcctattacgacgagagcgaggttcgcactgtcgatcccgctggctggcgcctggacgtcggcggtctggtgtcggacagacgcccgtggtcgctcgcgcagttccgcgcgctgccgcagaaacggcaaattacacgccatatctgcgtcgagggatggagtgcgatcggcgactggtccggcgtgccgctttcgatgttcctgcaaaaggtcggcgcggatctgcgtgcgaaatatgtcaattttcgctgcttcgacgattattcgaccagcatcgacatggcgaccgcgctgcatccgcagaccattctggcgctggactatggagaccgtgcccttccgcctgcctatggcgcgccgatgaaggtcaggattccaacgaagctcggctacaaaaatccgaaatatctcgcgtccatcgaagtcaccaatcgctttccgggcggctactgggaagatcagggttacgactggtttggcgggtcataa

SEQ ID NO: 6434 - DNA, 750 bp, Gluconacetobacter diazotrophicus PAl 5 JGI
atgaagcggccggacctggatcgcgcggccatcgcgccggaattgcgccgcctggagtgtcgactgatgctgaagggcatggtgtcgctcggggggcttgccatgttgtcgggctgcgtgctggatgacgaacctgcggtcgaacgtgcgctcgcgcgggtgatgaactttaccgatcgcgcgcaggcgctgttgttcagccggcatcgcctggcgcgcgagttcgacgcctcgcggatcacgcgtcctttcccgttcaatgcctattacgggcaggatgaggtgcgtacggtcgatccggcgcaatggcgcctggaggtgtcgggtctggtcacggacacgcgtccctggtcgctcgcgcggttccgcgccttgccgcagaagcgtcagatcacgcgtcatatctgcgtggagggatggagcgcgatcggctgctggtccggcgtgccgctttcggtgttcctgcagcatgtcggggccgatctgcgggcgaaatacgtcgattttcattgtttcgacgattattcgaccagcatcgacatggcgacggccctgcatccacagaccatcatggtactggatttcgacgatgccgcgctgccggcggcctatggcgcccccatgaaggtccggatcccgaccaagctgggctacaagaatccgaaatatctggcggcgatcactgtcacgaaccgctttcccggcggctactgggaggatcaggggtatgactggttcggcggatcgtaa

SEQ ID NO: 6435 - DNA, 792 bp, Variovorax paradoxus S110
atgagaatcttcaaagccccaaagatgaccggcgtcgatgccgacgccgtggtgcgcgaggcccgcacactgatcgcgaagcagctcgaccagcccgcgcgccgcgccttcctgcagcgctcgctgacgctcggcggcctttcgctgcttacgggatgcagcatcagcgacgacagccatgtggaagcggcgctctcgaagatctcgcgcttcaatgacaaggtgcagggcctcattttcagcccgacgcagctcgccgaaacctacccggaatcgatgatcacccggcccttcccgttcaatgcctactacggcgaggacgaggtccgcgaggtcgacgaggccggctacaggctcgaagtgacaggcatggtcgccgacaggcgcagctggacactggccgagctgcgcgccatgccgcagcacgaccaggtcacgcgccacatctgcgtcgagggctggagcgcgatcggcaagtggggcggcgtgcgctttgcggacttccttcggcgcatcggcgcggacaccaccgccaggtatgtcggcttcaagtgcgccgacgactactacaccagcatcgacatgccgaccgcgctgcacccgcagacgctgctcacgctcagctacgacggccagcccctgccgcccaagtacggctttccgatgaagctgcggatgccgaccaagcttggctacaagaaccccaagcacatcaaggcgatgttcgtcaccaacacctattccggtggctactgggaagaccagggctacaactggttcggagggagctga

SEQ ID NO: 6436 - DNA, 822 bp, Acidovorax sp. JS42
atgagaaccaatacgctgtaccaggtcaccctgctggacaccctggccgcctggacgctggccctgctgtggctgctgccgctggcctatgcggtgtggaccgcctttcaccccgcggagtacgccacgcgcttcgacctgctggcgccctggacgctggagaacttccgccgcgcctgggaggccgcgcccttcgcgcgctacttcctcaataccaccgtgctggtggcgatgatcctggccgcgcagctggtgctgtccacgctggcggcctatgccttcgcgcgctatcgctttcgcggccagaacgtggccttcgcgctggtgctggtgcagctcatggtcatgcccgacatcctgctggtcgagaactacaagaccatgggccgcctgggcctggtggattcgctggtggccatcggtctgccgtactttgcctcggcgtttgccatcttcctgctgcgccagaccttcatgggcattcccaaggagctggacgaagctgcgcgcgtggagggcgccagcgccctgcagatcctatggcgcgtatacgtgccgctggcgcggccggtgtacaccgcgtttgcgctggtgtcggtgagctttcactggaacaactttctgtggccgctcatcatcaccaacagcgtggaatcccgcccgctcaccgtggggctgcaggtgttctcgtcggtggagcagggcgtggaatggtcgctcatcaccgcggccacgctgatgtccaccgcgccgctgctcatcgggttcatactctttcagcgccagttcgtgcaaagcttcatgcgcgcgggcatcaagtag

SEQ ID NO: 6437 - DNA, 825 bp, Mycobacterium tuberculosis F11
atgagctcacctagtcgcgtctccaacactgcggtctacgcggtgctgacgatcggcgcggtaatcacgctgtcccccttcttgcttggcctgttgacctcgttcacttccgcacaccagttcgcgacgggtactccgctgcagttgccgcgaccgcccacgctggccaactacgccgatatcgccgatgccggatttcgccgcgcggcggtggtgaccgcgttgatgacggcggtgatcctgctgggccagctgacattttcggtgctggccgcctacgcgttcgcgcggttgcaatttcggggacgtgatgcgttgttctgggtctacgtcgcaaccttgatggtgccggggacggtgaccgtggtgccgctgtatctgatgatggcccagctaggcctgcgcaacacgttctgggcgttggtgctcccgtttatgttcggttcgccgtacgcgattttcctgctacgcgagcactttcgcctcatcccagatgacttgatcaatgccgcgcgcctcgacggtgccaacactttggacgtgatcgtgcatgtggtgatcccaagcagccggccggtcctggccgccttggcgatgatcaccgtggtctcgcagtggaacaacttcatgtggccgttggtgatcaccagcggccacaaatggcgtgtcctaacggtggcgacggctgacctgcagtcgcggttcaacgaccagtggacgctggtgatggcggcgaccacggtggcaatcgtgccgctgattgcgctcttcgtgaccttccagcggcacatcgtcgcatcgattgtggtctcggggctcaagtga

SEQ ID NO: 6438 - DNA, 825 bp, Opitutus terrae PB90 1
atgaaacgcccgctcgcctggatcgtcagcgtcgcgacggcggccgtttttctcgcgccgttgctctggatgctgctcgcgtcgctgcgcgatgagtcgcggatctttcatttcgacgcggcgaactggttcaccacgaccggctggacgctgcaaaattacgcagacgccctgcgccgcgccggcctcggccaggcgctgctggtctcgctgctgcaggtcggcctgatcgtggccggaggactggtggtcaacacgaccgcggcttacgccttcgcgcggctctcgtttcccggccgcgacacgttgttcgctctcgtcgtcatgctgatcatcctgccggtcgaggtgctggcggtgccgatgtttttcaccgcgcgcgatctcgggctgaccggaggtttcggcccggcactggccgggctcaccgtgccgtttttcgccaaggcatttaacctctatttcctgcgccagcactttctcgcgctgccggtcgagctcgaggaggcggcggtgatcgatggggcgacgtcctggcggcagttccggcatgtggcgctgccggcggtgaaaccggccctcgccacggtggtgctgctcgacgtgctcgcacattggggcgatttcctctggccactgctgatcggcacccgcgaggagacccgcacggtgcaactcgccctcgccaacctcttcaccaccccgcccgtgcagtggggcgatattctcgcgtgcgccgtcctcgccacgctgccggtgctcctgctcttccgcgggttgcagcgccatctcgtcgccaccgaggtgcgctcgggcatcaaatag

SEQ ID NO: 6439 - DNA, 825 bp, Methylobacterium sp. 4-46
gtgacccgggagcgcctccccgccctcgggcgcgccgcgacggggctcctcgccctcgtctgggtgatccccttcctgtggatgggggtcgcgaccctgcgcccgcccggggccgcgggcgccgcggcctccctggtgccgggtggggcgcccagcctcgccaacctcgcggaggcctgggcctcggcgcccttcccgctctacgccctcaacacgctgctgatgtgcgccggcatcttggcgctgcagctcgtcaccgcctcgctcgccgcctacgcgttcgcgcgcctcgactttcccggccgcacggccctgttctacgccttcctggtccagctgatgctggttccggtggtgctgatcgtccccaacctgaagacggtggcgatgctcggcctctacgacacgctgctgggcgtgatggcgccctactgcgccaccgccttcgggaccttcctgctgcgccagagcttccgcgaggtgccgcgcgaactcgaggacgccgcccgcatcgacggggccggcctcctccagcgcatccgccacgtctacctgccgctgaccaagccgaccctgatcgccttctcgatcgtctcggtgacgacccactggaacgagttcgtctggccgctgatggtcgtcacctcccccgaccggcggccgctcaccctcggcctcgccaccttcacgctcagcgccgagggcacccaggcctggggcgtgatcgcggccgggacgctcctcgtcagcacgccgctcctcgtcgccttcctgctgttccagcgccgcttcgtgaacagcttcctcgcctccggcctcaagtga

SEQ ID NO: 6440 - DNA, 822 bp, Diaphorobacter TPSY uid29975
atgagaaccaatacgctgtaccaggtcaccctgctggacaccctggccgcctggacgctggccctgctgtggctgctgccgctggcctatgcggtgtggacggcctttcaccccgcggagtacgccacgcgcttcgatctgctggcgccctggacgctggagaacttccgccgcgcctgggaggccgcgcccttcgcgcgctacttcctcaacaccaccgtgctggtggcgatgatcctggccgcgcagctggtgctgtccacgctggcggcctatgccttcgcgcgctatcgctttcgcggccagaacgtggccttcgcgctggtgctggtgcagctcatggtcatgcccgacatcctgctggtcgagaactacaagaccatgggccgcctgggcctggtggattcgctggtggccatcgggctgccgtacttcgcctcggcgtttgccatcttcctgctgcgccagaccttcatgggcattcccaaggagctggatgaagccgcgcgcgtggagggtgccagcgccctgcagatcctgtggcgcgtatacgtgccgctggcgcggccggtgtacaccgcctttgcgctggtgtcggtgagctttcactggaacaactttctgtggccgctcatcatcaccaacagcgtggaatcccgcccgctcaccgtggggctgcaggtgttctcgtcggtggagcagggcgtggaatggtcgctcatcaccgcggccacgctgatgtccaccgcgccgctgctcatcgggttcatactctttcagcgccagttcgtgcaaagcttcatgcgcgcgggcatcaagtag

SEQ ID NO: 6441 - DNA, 912 bp, Beutenbergia cavernae DSM 12333
gtgacatcgcagcatcaggagtcggcgccgtcgtcggccctctcgacgccgacggcgcacggcggacgcaccgcagcgtccgcgtcgcgctcccgagcgtgggcgaacgtgctcacctacgcgttcctcctggcggccggcgtgatcgtgctcgcgccgttcctgttctccgtgatgacgtcgctcaagacgccccgccagttcaacaccacgtggccgctgacgctgccggacccgtggaccatcgagaactacaccgcgctgttcggcgagcggtacgacttcgtggtcccgatcgccgtcaccgcgcaggtcgtggtcgtgctcgtgctcacgcagatgctcacgagcgtgctcgccgcgtacgcgttcgccgtgctcgacttcccgggccgcgacgcgctgttctgggtctacgtcgcctgcctcatgatcccggcggtcgtcatcatcatcccgctgtactcgatgatgacgtcggtcgggctgaagaacacgttcgccggcctcgtggtgccgttcctgttcgccggcccgtacgcgatcttcctgctccgggagaacttccggtccgtgccgaccgacatcctggacgccgcgaagctcgacggcgccggcgtgctacgcaccctgttccgcatcatgctgccgatgaacgtgcccatcctcaccacgctcctgctcatcaccgtcgtcacgcagtggaacaacttcatgtggccgctcgtgatcgcgccgaagaccgagtggaacgtcatcaccgtcgcgacggcggcgctccagacccagtacgagggcaactggacgctggtcatggccgcatcgacgatcgccctgctccccctcgtcatcctgttcctcgtgttccagcggcggatcacctcggcgatcgggatcaccgggctgcgctga

SEQ ID NO: 6442 - DNA, 909 bp, Brachybacterium faecium DSM 4810
atgaccctgcaggaccgcaccccggtcgccgcgcccgcccccggccgacggcgcccgctgaccagctcgctgctggcccggcgcgtgatgggccacgccgcgacctacctggtgctcgtggccgcggcggtgctgacgctcggcccgttcctgttctcggtgatgacggcgctgacctccacccagcagttcgcgcagcaggggccgctgtcgatgcccgccccggccgtgctcgacaacttcgtggccctgttcgccccctccgcgggggcggacggcttcatcacgcccgtcgcggtcaccgtgcagatggtcgcggtgatcctggtgggccagatggtgttctcggtgctggccgcctacgccttcgcccagctgcgcttccccggccgtgacctgctgttctgggtgtacgtggcgacgctgatggtgccgcaggtggtggtcgtggtgccgctgtacctggtgctcagcgaggcggggctgcgcaacaccttctgggcgctggtgatcccgttcgtgctcggctccccgtacgcgatcttcctgctgcgggagaacttccgcggcgtgccctcggagctgatggacgccatgcggatcgacggcgccggcaccctgcgcctgctgtggcacctggtggtgccgctgaaccggccgatcatcgtcaccctggtgctgatcaccgtggtcacccactggaacagcttcatgtggccgatggtgatcacctccggcccggagtggcgggtgatcaccgtggcgacctccgcgctgcagtcgcagtacaacaacaactggaccctggtgatggcggggaccaccctggcgatgctgccgctggtgatcctcatggtgctgttccagaagcagatcacccgctccgtgggggacgcgacgctgcggtga

SEQ ID NO: 6443 - DNA, 735 bp, Ralstonia solanacearum
atgagtgaggccgtgatgaccgccaacgagaccacgcaccgcgccgagtggggtgataccgcggtgctgcaggcgcagggactggtcaaggcgttcaggcagggggggctgaatgtcgatgtgctcaggggcgtcgacatccgcatcggcgtgggcgagaaggtcgccatcgtcggcgcgtcgggctcgggcaagagcacgctgctgcatgtgctgggcgggctggacgtgcccacctcgggccgcgtgtcgctgctcggcaagccgttcaccgccatgagcgagcgcgagcgcaatacgctgcgcaaccgcgcgctgggcttcgtctaccagttccaccacctgctgccggagttcaccgcgctcgacaacgtcgccatgccgctgcgcatccgcggcgagaacgaggcgcaggcgcgccataccgcgcaggccatgctggcgcgcgtgggcctgggcgagcgcacggcgcaccggccgggcgagctgtccggcggcgagcgccagcgggtggcgatcgcgcgcgcgctggtgggctcgcccgcctgcgtgctggccgacgagcccaccggcaacctcgacgaccacaccgccggcgaggtcttcgacctgatgctggagctgacgcgcacgctcggcaccagcttcgtcatcgtcacgcacgatatcgacctggccggacgctgcgatcgcatcctgcggctgcgcgacgggcatctgcaccaggaacggtaa

SEQ ID NO: 6444 - DNA, 735 bp, Ralstonia eutropha JMP134
atgagtgaagcgatgctgcaagccgatacgaagcccgtcaccgggcaacagccgggtacgccggtgctgatgggcgaaggcctgttcaagcgtttccgccagggcgggctcgatgtcgaagtgctcaagggcgtggacgtgcgcgtggacgcgggcgagaaggtcgccatcgtcggcgcttcgggctcgggcaagagcacgctgctgcatgtcctgggcgggctcgacaaccccgacgcgggtcgcgtggcgctgcacggcaagccgttcacggcgctgcgcgagcgcgagcgcaatgtggtgcgcaaccgctcgctcggctttgtctaccagttccaccacctgctgccggaattcacggcgctcgataacgtggccatgcccatgcgtatccgcgggctgacccagcagcaggcgcgcgatgcggcgcaagccatgctcgagcgtgttggcctgggcggccgttcgaagcatcgtccgggcgaactgtcgggcggtgagcgtcaacgcgtggcgattgcgcgcgcgctggtcgggcagccggcctgcgtgctggccgacgagccgaccggcaacctcgacgatcacaccgcaggcggggtctatgacctgatgctggagttgtcgcgcacgcttggcaccagttttgtcatcgtcacgcacgacttggacctggccggccgctgcgaccgcgtactgcggctgcgcgacgggcaccttcaccaggagcggtga

SEQ ID NO: 6445 - DNA, 750 bp, Cupriavidus metallidurans CH34 uid250
atgagtgatacgacgctgctccccgaagcctcattccaggccggcacccaaggccctggcacgccaaccggcacgccggtcctgctgggcgagggcctgaccaagcgtttcaaacagggcggcctggacgtcgaagtcctgcgtggcgtcgatgtgcgcgttgacgctggcgagaaggtggccatcgtcggtgcttccggttcgggcaaatcgacactgctgcacgtgctgggcgggctcgacaaccccgacgccggccgcgtggcgctgctgggcaagccgttcacggcgctgcgcgagaagcagcgcaatatcgtgcgcaaccgctcgctgggcttcgtctatcagtttcaccatctgctgccggagtttacggcgctcgacaacgtggcgatgccaatgcgcatccgcggcctgagcgagcccgccgcgcgcgccgaggcgcaggccgttcttgagcgcgtggggcttggcggccgctcgaagcaccgccccggcgaactctcgggcggcgagcgccagcgcgtggcaattgcccgcgcgctggtcggaaagccggcctgcgtgctggccgacgagccgaccggcaaccttgacgaccacacggcaggcggcgtgtacgacctgatgctggagctgtcacgcacgctgggcacgagcttcgtgatcgtcacccacgacctcgacctggctggccgttgcgaccgcgtgctgcggctgcgcgacggtcacttgcatcaagagcgttga

SEQ ID NO: 6446 - DNA, 684 bp, Ruegeria sp. TM1040
atgagtgaggtgacgctgaaaatcgaaggcctgaggaagacctatctggctggcacccctggtgaggttgcggttctgcgcggcgtggatctgaccctgcatgcgggcgaggttgtggcgctggtggcgccctcgggggcgggtaaatcgacgcttctgcagattgccgggcttctggatgtggccgacgcaggccgggtggagattgccgggcaggacatggcgggcgcgcgcgatcgcaaacgcacgcgggtgcggcggcaggatgtgggttttgtctatcagttccaccatctgctgccggagttctcggcgctggagaatatcgtgctgccgcaactcgccaatggcatctcgcagcgggacgccgaagcgcgcggcgccgagctcctggcgcttgtggggctcgaaacccgcgccgcgcatcgccccgcggcgctttccggcggcgagcagcaacgggtggcgttctgtcgcgccctggccaatcgcccgcggctgttgctcgcggatgagccaaccggaaacctggacccggcgacgtcggatcaagtgttcgaagtgctgatgcaattggtgtccgagacgggtctttcggcgctgatcgccacgcataatcttgagctggccgcaagaatggaccgggtgttgcatcttgaggacggcgttctggtcgagcgctga

SEQ ID NO: 6447 - DNA, 675 bp, Rhodobacter sphaeroides 2 4 1
atgagtgagatgctggttctggacgggctgaccaaggcctacaaccggggccgccccggcgaggtgacggtgctgcggggcgccacgctctcggtgggcacgggcgaggtggtggcgctggtggcgccctcgggggcggggaaatccacgctgctccatatcgcggggctgctcgacacgcccgacgaggggcgcgtggccatcggcgggaccgagatggcggggctgggcgaccgggcgcggaccgggacgcggcggcgcgaggtgggcttcatctaccagttccaccatctcctgcccgaattcaccgcgctcgagaatgtggtgctgccgcaactggccaatggcgtttcccggcgcggggccgaggcgcgggcgcgcgacctgctgggccgcgtcggtgttggcgcgcgggaaggacaccggccggcggcgctctcgggcggcgagcagcagcgcgtggccttctgccgggcgctcgccaacgccccgcggctgcttctggccgacgagcccacgggcaaccttgatcccggcacctcggatcaggtgttcggcgtgctgatggatctggtgcgcggaaccggcctctccgccctcatcgccacccacaatctggagctggccgcccggatggaccgggtggtgcggctcgaggccggccgggtcgtctga

SEQ ID NO: 6448 - DNA, 663 bp, Paracoccus denitrificans PD1222
atgagtgacatcctggttctggaaggaatttccaagacttacggcattggtggtcccgcgccggtgccggtgttgaacgggttgtccctgcagatcgtccgaggcgaggtggtggcgctggtcgcgccctcgggcgccggcaagtcgacgctgctgcacatcgccgggctgctcgacaccgcggattctggccgggtgctgctgaaggggcgcgacatggccgggcagagcgaccgggcgcggaccgaggcgcggcgcgaggaactgggcttcgtctatcagttccaccacctgcttccagaattttcggcggcggagaacatcgtcctgccgcaactcgccaacggcgtctcgcaggcgacggcgcgggcgcgggcgctggatctgctggggcgcgtggggctgacgcatcgcgccgatcaccgcccggcgcaattgtccgggggcgagcagcagcgcgtcgccttctgccgggcgctggcgaaccagccctcgctgctgctggcggacgagccgacggggaacctggaccctgcgacctcggacaaggtcttcgacatgctgatggcgctggtgcgcgagaccgggcttgccgcgctgatcgccacccataacatggacctggcggcgcggatggaccgggtgatccggctggacgcatga

SEQ ID NO: 6449 - DNA, 723 bp, Burkholderia mallei SAVP1
atgaatcagaaccatcaggatggcggcgcgcgcgaatgcgtgctggaagcgcgcggcgtcacgaagacgttcgtgcagggcggcttcaacgtgcaggtgctcgacaacgcgcaggtgtcggtgcgccgcggcgagaagctcgcgatcgtcggcgcgtcgggctcgggcaagagcacgctgctgcacgtgctgggcgggctcgacgagccgagcgcgggacaggtgtcgctgctcggcaagccgttcacgcagctcgccgagcgcgagcgcaacgagctgcgcaatcgcgcgctcggcttcgtctatcagttccaccatctgctgccggaattcaccgcgctcgacaacgtcgcgatgccgctccgaatccgccggatgtcgaccgaggaggcgcgccggcatgcgcgcgagatgctcgagcaggtggggctcggcgcgcgcgcgaagcatcgcccgggcgagctgtcgggcggcgagcgccagcgcgtcgcgatcgcgcgcgcgctcgtgaccaagcccgcttgcgtgctcgccgacgagccgaccggcaacctcgacggctcgaccgccgatcatgtgttccacctgatgctcgagctgtcgcgaacgctcgacacgagcttcgtgatcgtcacgcacgatcccgatctcgccgcgcgctgcgaccgcatcctgcggctgcgcgacggcgtgctgcacgaggagccggccgtgccggtgtga

SEQ ID NO: 6450 - DNA, 675 bp, Rhodobacter sphaeroides ATCC 17029
atgagtgagatgctggttctggacgggctgaccaaggcctacaaccgcggcaagccgggcgaggtgacggtgctgcgcggcgccacgctctcggtgggcgcgggcgaggttgtggcgctggtggcgccctcgggggcggggaaatccaccctgctccatatcgcggggctgctcgacacgcccgacgaggggcgcgtggccatcggcgggaccgagatggcggggctcggcgaccgggcgcggaccgggacgcggcggcgcgaggtgggcttcatctaccagttccaccatctcctgcccgaattcaccgcgctcgagaatgtggtgctgccgcaactggccaacggggtggcgcggacggcggccgtggcgcgggcgcgcgaccttctgcgccgcgtgggggtgggcgcgcgcgagggccatcggcctgccgccctctcgggcggcgagcagcagcgcgtggccttctgccgggcgctcgccaacgccccgcggctgcttctggccgacgagcccacgggcaacctcgatcccggcacctcggatcaggtgttcggcgtgctgatggatctggtgcgcggaaccggcctctccgccctcatcgccacccacaatctcgagctggccgcgcggatggaccgggtggtgcggctcgaggcgggtcgggtcgtctga

SEQ ID NO: 6451 - DNA, 750 bp, Burkholderia mallei NCTC 10247
atgaatgaccgggttttcgagcagacgatgaatcagaaccatcaggatggcggcgcgcgcgaatgcgtgctggaagcgcgcggcgtcacgaagacgttcgtgcagggcggcttcaacgtgcaggtgctcgacaacgcgcaggtgtcggtgcgccgcggcgagaagctcgcgatcgtcggcgcgtcgggctcgggcaagagcacgctgctgcacgtgctgggcgggctcgacgagccgagcgcgggacaggtgtcgctgctcggcaagccgttcacgcagctcgccgagcgcgagcgcaacgagctgcgcaatcgcgcgctcggcttcgtctatcagttccaccatctgctgccggaattcaccgcgctcgacaacgtcgcgatgccgctccgaatccgccggatgtcgaccgaggaggcgcgccggcatgcgcgcgagatgctcgagcaggtggggctcggcgcgcgcgcgaagcatcgcccgggcgagctgtcgggcggcgagcgccagcgcgtcgcgatcgcgcgcgcgctcgtgaccaagcccgcttgcgtgctcgccgacgagccgaccggcaacctcgacggctcgaccgccgatcatgtgttccacctgatgctcgagctgtcgcgaacgctcgacacgagcttcgtgatcgtcacgcacgatcccgatctcgccgcgcgctgcgaccgcatcctgcggctgcgcgacggcgtgctgcacgaggagccggccgtgccggtgtga

SEQ ID NO: 6452 - DNA, 750 bp, Burkholderia pseudomallei 668
atgaatgaccgggttttcgagcagacgatgaatcagaaccatcaggatgacggcgcgcgcgaatgcgtgctggaagcgcgcggcgtcacgaagacgttcgtgcagggcggcttcaacgtgcaggtgctcgacaacgcgcaggtgtcggtgcgccgcggcgagaagctcgcgatcgtcggcgcgtcgggctcgggcaagagcacgctgctgcacgtgctgggcgggctcgacgagccgagcgcgggacaggtgtcgctgctcggcaagccgttcacgcagctcgccgagcgcgagcgcaacgagctgcgcaatcgcgcgctcggcttcgtctatcagttccaccatctgctgccggaattcaccgcgctcgacaacgtcgcgatgccgctccgaatccgccggatgtcgaccgaggaggcgcgccggcatgcgcgcgagatgctcgagcaggtggggctcggcccgcgcgcgaagcatcgcccgggcgagctgtcgggcggcgagcgccagcgcgtcgcgatcgcgcgcgcgctcgtgaccaagcccgcttgcgtgctcgccgacgagccgaccggcaacctcgacggctcgaccgccgatcatgtgttccacctgatgctcgagctgtcgcgaacgctcgacacgagcttcgtgatcgtcacgcacgatcccgatctcgccgcgcgctgcgaccgcatcctgcggctgcgcgacggcgtgctgcacgaggagccggccgtgccggtgtga

SEQ ID NO: 6453 - DNA, 750 bp, Burkholderia pseudomallei 1106a
atgaatgaccgggttttcgagcagacgatgaatcagaaccatcaggatggcggcgcgcgcgaatgcgtgctggaagcgcgcggcgtcacgaagacgttcgtgcagggcggcttcaacgtgcaggtgctcgacaacgcgcaggtgtcggtgcgccgcggcgagaagctcgcgatcgtcggcgcgtcgggctcgggcaagagcacgctgctgcacgtgctgggcgggctcgacgagccgagcgcgggacaggtgtcgctgctcggcaagccgttcacgcagctcgccgagcgcgagcgcaacgagctgcgcaatcgcgcgctcggcttcgtctatcagttccaccatctgctgccggaattcaccgcgctcgacaacgtcgcgatgccgctccgaatccgccggatgtcgaccgaggaggcgcgccgccatgcgcgcgagatgctcgagcaggtggggctcggcgcgcgcgcgaagcatcgcccgggcgagctgtcgggcggcgagcgccagcgcgtcgcgatcgcgcgcgcgctcgtgaccaagcccgcttgcgtgctcgccgacgagccgaccggcaacctcgacggctcgaccgccgatcatgtgttccacctgatgctcgagctgtcgcgaacgctcgacacgagcttcgtgatcgtcacgcacgatcccgatctcgccgcgcgctgcgaccgcatcctgcggctgcgcgacggcgtgctgcacgaggagccggccgtgccggtgtga

SEQ ID NO: 6454 - DNA, 675 bp, Rhodobacter sphaeroides ATCC 17025
atgagtgagatgctggttctcgacgggctgaccaaggcctacaaccgcggcaagcccggcgaggtgacggtgctgcgtggcgccacgctctcggtcgggaccggcgaggtggtggcgctggtcgcgccctcgggggcggggaaatccacgcttctgcacatcgcggggctgctcgacacgccggacgagggccgcgtcgccatcggcggcatggcgatggagggcttgggcgaccgcgcgcggaccgaggcgcggcggcgcgaggtgggcttcatctaccagttccaccacctgctgcccgaattcaccgcgctcgagaacgtggtgctgccgcagctggccaatggcgtcgcgcgccgcgaggccgaggcgcgggcgcgcgacctcttgggccgcgtcggcgtcggcgcgcgcgaggggcaccggcccgcggcgctttcgggcggtgagcagcagcgcgtggccttctgccgggcgctggccaatgccccgcggcttctgctggccgacgaacccaccgggaacctcgatcccggcacctcggatcaggtcttcggcgtgctgatggatctggtgcggggcaccggcctttcggcgctgatcgcgacgcacaacctcgagcttgcggcgcggatggaccgggtggtgcggctcgacgcggggcgcgtcgtctga

SEQ ID NO: 6455 - DNA, 693 bp, Geobacter lovleyi SZ
atgagtagccttttggaggttactgggctctgtaaggattaccggatggggtctgattccgtccaggtcctgaaagggattgatcttgatatctcagctggaaccacaactgccctggtaggggcttccggcgccggcaagagcacattgctccatattctgggagcgcttgatcgcccaagcagcggtacggttacctataaaggtcaggagctgttcacgcggtctgaccgtgaactggcagatttcagaagccgcaccatcggttttgtgtttcagtttcatcacctgttgccggaattcacggcactggaaaatgtgatgatgccggccttgattgcacgtagggaaaaccatctggcacatcaacaagcccggacgcttttgacggaagtgggcctggaacaccgtcttaaccacaggccgggtgaactctcaggcggggaacaacagcgcgttgccatagcccgggcgctggtgatggagcctgagttgctgttggctgacgagccgaccggcaaccttgatgcaaagaccagcgaggcgatctacgaattgctggtgaaaattcagaaacagactggcatcagcatggtagttgttacccacaatgagagaattgctgcaaggatggagcgggtagtccggttactggatggcctgattcttccttgcactacggaggatatgtga

SEQ ID NO: 6456 - DNA, 759 bp, Pseudomonas syringae tomato DC3000
atgagtaacgaccgcccgctgatcttcgtcgatctggacgacaccctgttccagaccgcgcgcaaaacaccggctgacattgaaaagcacgtcgcaacgctggatatcagcggcaatgccaacggctacatgaccaacgtgcagaagtccttcgcgcactggctactggcgcacgccgatgtggtgccggtgaccgcgcgcagtgtagaggcttacagccgggtgaagttgccgttcactgccggcgcgatctgttcgcatggcggcgtgatgctcgatgtcatggggcgactggaccctgactggaacgagcagatgaagcagaccctggccagctatcaatcgcggttacatgaattgtctgccgctacgctggcaatcggtcaggagatgggcttttcactgcgtggctgggtggttgaagaggcgcagctgtttcattacgtggtgaccaagcacaacgaaagcgatgacagcatcctcaccaaggtactcgccgaaatgcaggcccgaggcttgctcgacggcatgcacatccacggtaacggcaacaatctggcgttcctgcccgaggggctggccaagcgttacgccgtgcaggaatggctgcgtcgtgacctggcgatcaatggcgaacgtccggtgctcggttttggcgacagcatcaccgacctgggtttcatggatgagtgtcactggtgggcgacgcctgcgcgcagccagttggcgaaaatgtttgtcggagcagcacatgagtga

SEQ ID NO: 6457 - DNA, 759 bp, Pseudomonas syringae pv B728a
atgagtaacgaccgcccgctgatcttcgtcgatctggacgacacgctgttccagaccgcgcgcaaaaccccggctggcattgaaaagcacgtcgcaaccctggacatcacgggtaaagccaacggctacatgaccaacgtgcagaagtcgttcgcgcactggctgctggcgcattccgacgtggtgccggtgacggcgcgcagtgtcgaggcctacagccgggtcaaactgccgttcacctcaggtgcgatctgctcccatggtggcgtgatgcttgatgtcatggggcggctggatcatgactggaacgagcagatgaaacggaccctggccagctaccagtcacgcctgcatgagctgtcggcgacgacactggcgatcggtcaggagctggggttttcactgcgcggctgggtggtcgaagaggcgcagttgttccattacgtcgtgaccaagcacaacgagagcgatgacagcatcctcggcaaagtactggccgaagtgcaggcgcggggcttgctcgacggtatgcatattcacggcaacggcaacaatctggccttcctgcccgaagggctggcaaagcgttacgcagtccaggagtggctgcggcgcgacaaggcgatcaatggcgaacgcccggtgcttggttttggcgacagcatcaccgatctgggtttcatggacgagtgccactggtgggcgacacctgcccgcagtcagctggcgaaaatgtttgtcggagcagcgcatgagtga

SEQ ID NO: 6458 - DNA, 810 bp, Psychrobacter arcticum 273-4
atgaccttcctatttttccaacccagttcaaacatcattaagccttatgcgctaatggatttggacgatacgctctttcagacccaacgtaaaattgatgcttgggaattaccaacgactgaacctgaaaatttggtttgcgccaccgtcaataaacaaggcgagccgttaagctttatgagtcagcgccaggcggcattctttaattggctgcttgccagcactgaattgatagccgtcacagcacgtgatcgtctggagattaagcgcgtcaagctgctctttaatagctggcaagtattaacccatggcgcggttattttaacctctgatggtgagccactaagcacatggcaacagcatatgtataatgcgcttatcccattacaagataagatcaatcagctgaccgagtgggtgaatagctatagtaaagaaagcgatagaactcataacgatttaaaacttaccccgcataccgatacttttatcgacagcgaactgaccatttatttagcgatcaaacatacgcaaaaagatcatcaagcattggcagagttggctacacagctaccaacgctaataccagattttgatgcacatttttatgtgcatgtgaatgctaataatttagccatattaccgcatgctgttcataagcgtcatgcggtgcagtttttattagagcagcacttggatcatcagcgcccaagctttggttttggtgatagtctggcagacctgccattcctgcaattacttgactggtacggcatgcccaatcacgggcagcttcatactcaacaatag

SEQ ID NO: 6459 - DNA, 744 bp, Nitrosococcus oceani ATCC 19707
atggagcgttccgtattcatcttttctgatctagatgatactttgttgcagactcaacgcaaatgcggggtatcgggtccattaacggaggcggcggtcgatagagaaggccgtcccttgtctttccactcccaggaacaattattgttgttgcggctctttaaagcttgcactttgattcccgtgaccggacgcaatttagaggcgttgggtcgaattcgctcacccctcttttccagctatcgggtcactagtcacggtgcattggtttgggatgccaataatgctttaatcccggagtgggagagcaccattaggggagaggcgctgatttgggaaccgcggatgcaacgtcttcttgcggtaatggagggctatcagcgggcggagcaggtagaaaatttgcggtttcgtattatttatgatgcacagatacctgtctatctttctatcaagggtagccccggacagctttcagcagtcgaggagatagtggctccagtttgggtccaggaaatgggaggaaaatttcaccgcaatgaccataatatggcgctccttcctccttatgcggataagggcagggctgtgaaatacatcatgacgctgatccgccaacgttgtgaagggccaccgttatttattggtatgggtgacagcttgaccgatattcctttcctccgtgcttgccattacgcgcttacaccgcaaaatagtcaaattcaacaggaagcttggatgtga

SEQ ID NO: 6460 - DNA, 759 bp, Burkholderia 383
atgagcggtaatcgccccctggcattcgtcgacctcgacgacaccctgttccagaccgcccgcaagatggcggaaggcgtcccgcgaacgacggccacgctggacgtgcaaggtcagccaaacggcttcatgaacccggtccagcacgcgttcatcacgtggctgctggccaccgccgacgtcgttccggtcaccgcgcgcagcgtggaggcatacggccgcgtcatgcttcccttcgccgaaggcgcaatctgctcgcatgggggcgtcatgctccgtcccgacggatcgctcgatcgaagctggcacgggcaaatggtcgaggccctccggagcgttcaggaccggctgccggcactcagcgaggccacgctggggatcggcagggcgctcggctacgcgctccgcagctgggtggtggaagaagaaggcttgcgccactacgtggtggtcaagcacaacgagtccgacgactcggtgctcgccgaggtgctggccgaagtccggtcccggcgcatgttggacggcatgcacgttcacgcgaacggcaacaacctcgccttcctgccaacggggctggccaagcgcgcggccgttcacgagtggttgcgccgcgaccgtgagatccacggcgagcgaccggtcctgggcttcggcgacagcatcaccgatctggggtacatggacctctgccacatgtgggcgacaccggcgcgcagccagcttgcgaattgggtgacggggacgatccatgggtaa

SEQ ID NO: 6461 - DNA, 765 bp, Rhodospirillum rubrum ATCC 11170
atgaggcgcgttgttttcgtcgatctcgacgacaccttgttccagacggcgcgcaaaaacccgggcgcccaaaccctggcggcgctcgacaaggacggcaagccgctgtccttccagtcgacgcggcaggtggccttcctggagtggctgagcgccgacgccgtgatcgtgccggtgaccggacgcagcgtcgaggccttccggcgggtgaccctgcccctcggcccgcgcgccatctgttcgtttggcggcgtgatcctgggcgccgacggcctgccccatcccgaatggcatcgtcagatgagccagaaagcccaggccacggcccgggtgatggagctgcttgacgatatggtcgctcaagtcctggcgcgaaccggcgtcgatgcccgccaccacatcatccacgatgccgaactggcgctttacctgtcgatcaagcacaacggcggatcggccgaggaaaccgcccgtctggcccaggccctggcccccgccgtccccgaggggtggacgacgcatctcaacggcgccaacatggcgctgttgccgcccttcctgggcaagcgcgccgccgtcgcctttttcctggaaacccaattgggcgacgggccgctgctgaccatcggctttggcgacagcctgaccgacctgggcttcatgtccttgtgcgattacgccctcaccccgtcgcgctcgcagatcctgggttttttgaacacgacctggccggccgtcgcggcgatggcggacagcgcggcatga

SEQ ID NO: 6462 - DNA, 762 bp, Psychromonas ingrahamii 37
atgacacagtcatctcgcatatttgtcttcacagatttagatgatagtttgtttagcagtaagagaaaacatacaaaaacggctgatagtcagataacctctgttaacaaacagggtgaaatagaatcctatgcaacgcttcaacaacaaaaattagtgcagatgttagcggctttgaaagcctcctttattgcggtaacaggacgaagaacgagtgcctataagcattgtattattgatcaagtaacaaacagtgagtatgccattgtttctcatggtgcgctgatattagataaaaaatctgcattattgccctgctggattaattatttaaataacacttatgatatgaaacattggcagaagaagctgactcaggcgcattgtcagctaatcaattattttagcgctatgaattgtgaagcccgtgttcgtttgattatcgatcatgatatttgtacttatatttgcataaaaattcctgctcatcagcatcaggaaagcttgttagctaagattaatttgcatcttaagcaacttgattttagcattcatggcaatgccggtaacttcgccgtattacccccttatgcgagtaaagaactagcggttaactacttgataaaaaagctaaatatatctgataaagacgtggttttcgggatcggtgatagtgtgtctgatctcccctttattcgaaatttagattttgctatctttcctaaatccagccaaataatgaaagctatctcccatgtttaa

SEQ ID NO: 6463 - DNA, 756 bp, Polaromonas naphthalenivorans CJ2
gtgaagaaattcctgttcgttgacttggacgacaccctattccagacgccaggcaaatgcgcggacgaaaaagacctgcaccctgcagcttatctgaaggacggctccgtctgctccttctcaacgccgcgccagcgcgcatttttcgcgctgatgaacaaggaaatgacgctgattccagccacggcgcgcaaccgcgacgcgctgagccgcgttgatttaccgttttccagccacgccatcatcgactacggcggcgtcgtgctgacccccgacggcgcgcccgatggcgagtggctcgacctcatgcgcgcagacatggcgctcgcgctgggcggcctgaaggaagccatcgacgtgattgaccgctattcggccagcgtgggtttaaaaggccgcgcccgcctgatcgaagactacgccacgccgttttacatcgtcgtcaaggatccagacaagcaggccgagcgcttagagagcatcgagcgcgaagccctgacggattggatcgccagcccaactggccaggatttttacatccaccgcaacggcaacaacttggccgttctgcccaaggcgctgaacaaggcccgcgccgttcactatttacgccagaagctgcagaccgagcatggcgacatcatgacgctgggcatgggcgacagtaaatccgatgcgcgcttcatggccgcctgcgactacgccattgttcccagcggcacccagctctcgtccctgacggtgggggcgctatga

SEQ ID NO: 6464 - DNA, 855 bp, Psychrobacter PRwf-1
atgacgatcaatacccatagcttaacgccctttatgcccgactcgttaatcatcaagccttatgcattgatggatttggatgacaccttatttcagacacaacgaaaaattgcagcgtggcagctaccgactgctgagccacatcatttggtatatgccgccgtcaataaacaaggtgagccattaagtcttatgacccagcgccagcagctgttttttaattggttactctcaagtacggagctgattgtggtgacagctcgtgaccgacatgagattaaacgggtagtgcttaactttagcagctggcaagtgctgacccatggcgcccttatcttacagccctcaggggagccattaaaggcttggcaacaccagatgggcgcaatattagcgccgctacaagccaagttacagcagttaatagcgataattgaggcgtataaccacagacagcaagggccattaagactggcgctgcatcacgatgattttgtggcaccaggcactgactccagcgatgactcattgagcgagatgctgatttatttggccatcaagcatcaccaaaaagatgccatggctttacagcaatttggtgagtggctgctggctgagcacccccagttggccgatgatttttatatccatagcaatgccaataatttggccatattgcccaagggtatccataaacgtcatgcggtagcctacttgcttgagcagcatttagaccacgctcgccctagctttggctttggcgatagcttggcagatttaccttttttgcagcagcttgattggtacggcacccccaatcatggtcaacttcatgaccatattcatgtgctttaa

SEQ ID NO: 6465 - DNA, 813 bp, Yersinia pseudotuberculosis IP 31758
atgaataagcctgtttttttgtgtgatctggacgatacgctgttccagacacggcgcaaaatggtcgatgagctagaccttcctccttttcgggtaggggcgttggatcgcagcctgacaccccgcagtttcatgaccgaagagcagtccatgttggtggattggctcttggagcacgcagaatttatccccgtgaccgcccgtggaacagaagagatcagccgcgtcaacattcctttcagctcatgggcgatcaccacccatggtgccgttattctgacgcccgacagacaacccgatgccggctggcaggatacggtgctgacgaacttgcagccctatcgtgaccgtttgatagcaatggaaagccgtatcaatgacatgatggccgaacggggcctgaatgcctggtgtcgaatcaattatgaatacggcgacaccccggtttatttcgtgatgaaacaccgtgatagcacacagatagccgagttgtatgccttcaacgaccaactggaatccctcttttccactgatggattttatattcaccgtaacagcaacaatattgcgtggttaccggtttgtatcgaaaaaggcctggcgaccacttatctgcttgataaattacgccacgaacatggcgcgtttccggttctgggtttcggcgatagcctgagcgacttcagctttatgcgccactgtcattggttcggtatgcccgcgaaaagtcagttctcgcaggccctgacatcgcatttatttgataacacgacatttaataaaaataatgttaatggagataacgatgcatga

SEQ ID NO: 6466 - DNA, 813 bp, Yersinia pestis Angola
atgaataagcctgtttttttgtgtgatctggacgatacgctgttccagacacggcgcaaaatggtcgatgagctagaccttcctccttttcgggtaggggcgttggatcgcagcctgacaccccgcagtttcatgaccgaagagcagtccatgttggtggattggctcttggagcacgcagaatttatccccgtgaccgcccgtggaacagaagagatcagccgcgtcaacattcctttcagctcatgggcgatcaccacccatggtgccgttattctgacgcccgacagacaacccgatgccggctggcaggatacggtgctgacgaacttgcagccctatcgtgaccgtttgatagcaatggaaagccgtatcaatgacatgatggccgaacggggtctgaatgcctggtgtcgaatcaattatgaatacggcgacaccccggtttatttcgtgatgaaacaccgtgatagcacacagatagccgagttgtatgccttcaacgaccaactggaatccctcttttccactgatggattttatattcaccgtaacagcaacaatattgcgtggttaccggtttgtatcgaaaaaggcctggcgaccacttatctgcttgataaattacgccacgaacatggcgcgtttccggttctgggtttcggcgatagcctgagcgacttcagctttatgcgccactgtcattggttcggtatgcccgcgaaaagtcagttctcgcaggccctgacatcgcatttatttgataacacgacatttaataaaaataatgttaatggagataacgatgcatga

SEQ ID NO: 6467 - DNA, 813 bp, Yersinia pseudotuberculosis YPIII
atgaataagcctgtttttttgtgtgatctggacgatacgctattccagacacggcgcaaaatggtcgatgagctagaccttcctccttttcgggtaggggcgttggatcgcagcctgacaccccgcagtttcatgaccgaagagcagtccatgttggtggattggctcttggagcacgcagaatttatccccgtgaccgcccgtggaacagaagagatcagccgcgtcaacattcctttcagctcatgggcgatcaccacccatggtgccgttattctgacgcccgacagacaacccgatgccggctggcaggatacggtgctgacgaacttgcagccctatcgtgaccgtttgatagcaatggaaagccgtatcaatgacatgatggccgaacggggcctgaatgcctggtgtcgaatcaattatgaatacggcgacaccccggtttatttcgtgatgaaacaccgtgatagcacacagatagccgagttgtatgccttcaacgaccaactggaatccctcttttccactgatggattttatattcaccgtaacagcaacaatattgcgtggttaccggtttgtatcgaaaaaggcctggcgaccacttatctgcttgataaattacgccacgaacatggcgcgtttccggttctgggtttcggcgatagcctgagcgacttcagctttatgcgccactgtcattggttcggtatgcccgcgaaaagtcagttctcgcaggccctgacatcgcatttatttgataacacgacatttaataaaaataatgttaatggagataacgatgcatga

SEQ ID NO: 6468 - DNA, 774 bp, Escherichia coli O157 H7 EC4115
atgaataaacccgttgttctgagcgaccttgacgacacgctctttcagacccgtcgtaaaatggtggacgagctggccctggagccattccgtaccggtgccgttgatcgcaccctgaatccacgaagctttatgacggaagaacagtccatgttggtggactggctcctggagcaggctgaactcatacccgttaccgcacggggaactgaagaaatcagccgcgtacggatccctttccactcctgggcaatcacaacgcacggggccgtcattctcacgcctgaaggcaaacccgacgaggagtggaaggcccatatgctcggccagctggctccctaccaggaaaagctgacatcgatgcagcgtctgatcactgaaatgatggacgcaaaaggaatcaatgcctgggcaaggctgaacttcgaatacggtgaaacggcggtttatatggtgatgaaacaccgcgacagcacccgccttgacgagctcaatgccattgcagatgagatagaaacggtgtttccgaccgagggcttctacatccaccgcaacagtaataacgtggcctggcttcccaccccggttgagaaagggctggcagtcagctggctgcttgaaaaacttcgggctgaacgaggagttttccccgtaattggtttgggcgacagcctgagcgatcatcgttttatgaaactgtgcagctggtttggcatcccgcgtcagagtcagtttgcagatgccatttcacagcgaatttttggagaaaattaa

SEQ ID NO: 6469 - DNA, 468 bp, Thiobacillus denitrificans ATCC 25259
atgaatgcacttcgtagaaacgtactgaaaagcgctgccggcgccggtactgtggccgtcgccgtggctgccggcctgctcaagccgacccaggcgctcgccgcgtggaacaaatcggccttcgaggccaagaacgtcgccgacgcgatgaaagggctgggttcctcgggcccgtccgacagcaaggacatcatgatcaaggcgccggacatcgccgaaaacggcgccgtcgtgccggtcgagatcaccagcaagcttcccgacacgaccagcatcgcgatcctcgccgagaagaacgccagcccgctggtcgccgaatacgcgctcgccggcggcacgcagggctatgtctcgacgcgcatcaaaatgggccagacctcgctcgtgcgcgccgtcgtcaaggccggcggcaagtcctacacggcggcgaaggaagtgaaagtcaccatcggcggttgcggcggctga

SEQ ID NO: 6470 - DNA, 471 bp, Magnetococcus MC-1
atgtttgatgtaaccaaccctatgttgacccgtcgtagcctgatggctggagcgggaagtgtggccctgttggcgatgggaacggccaaaaacgcccaggcaaatggcgacaaagtgctggcgaatattaaggagcatatgggcagctcggcgtatgccgagagcagcgccattaagattgatgccccgattattgccgaaaacggtgccatggtgccggtcaagatcaccattgatcaccctatggatgccgacaactacatccagaccatcgcggtatttgtggacaataacccaaccccttttgccggtctctatagcttgaccccggccaatggtaaggcgtttgtgtcgtcccgtctcaagattggtaaaacctcgcaggtgcgtgccattgccaagaccaacaccggcaagctgattggggcgagcaaagaggtaaaggtgaccatcggcggttgtggtggttga

SEQ ID NO: 6471 - DNA, 423 bp, Paracoccus denitrificans PD1222
atgatcctttcaagacgcgaggcgctctggatcggctttggcggccttgccgccgccgtcctgccgggcaaggccgcgctggccgccaccgttgacgagttgaccgcgaccttcaccggcggcgcggcggtgggcgaaggcgggctgaccctgaccgcccccgagatcgccgagaacggcaacaccgtgccggtcgaggtcaacgcgccgggcgccgtggcggtcatgctgctggcctcgggcaaccccgaacccgcggtcgccaccttcaccttcggccccgccgccgccgaacagcgcgccgccacccggatccgcctggcccagacccaggacgtgatcgcgctggccaagatgggcgacggctcggtcgtcagggcgcagaccacggtcaaggtcaccatcggcggctgcggcggctga

SEQ ID NO: 6472 - DNA, 486 bp, Polynucleobacter necessarius asymbioticus QLW P1DMWA 1
atgatgaagccaaaattgatctgccaaagcaatcgccgccagtggctgaagcaattccaaaagatcggtgtatttgcgctgggagcatggcttagtccattagccgtatttgccaaaaaagcagatgcagcgaaagccattcaagaaatcactggtggcaaatcagtgcaggatggaagggtaactttagttattccaccacttgtagagaatggcaacctcgttgtactcaaggtaagtgtagatagccccatgacagcaaatgattatgtgaaatccattcacgttattgctgaaggcaacccttttcccaatatatttacggcctacctcacgccaagatctggaactgctactttaactacgcgcgttcgtttggcagatagtcaaacagtttgggcaatcgcacaaatgaatgatggtagtttttggcaaggacatgctgatactttggtgacactttcagcctgtacggagttggtatga

SEQ ID NO: 6473 - DNA, 417 bp, Rhodobacter sphaeroides ATCC 17025
atgaggctttcgagacgagacacactggtgctgggcatgggcggcctcgcggccctgacgctgccgatgcccgcgctcgcggcggccgacgaggccattgccgccttcacgggcggcgcggccacgggcagcggcggcatcacgctgaccgcgcccgagatcgccgagaacggcaacaccgtgccggtcacggtggatgcgcccggcgctgcggcgatcatgctggtcgcgaccggcaatccggaaccggcggtggcgaccttcaccttcggcccggccgcgggctcgcagatggccgccacgcggatccggcttgccaagacgcaggacgtggtcgccatcgcgaggatgcccgacggcagcttcgttcaggcaagcgccacggtgaaggtcaccatcggcggctgcggcggctga

SEQ ID NO: 6474 - DNA, 453 bp, Bradyrhizobium BTAi1
atgggcgcaatcaacagacgacaggcgttccttctcggtggcggtttcgtcgccttgacggtgctgccgatggccgccaacgccgagccgagcaacgacgcggccgagctgatcaagaagttcaccggtggcaaggaagcggccaagggcaagatcacgctcgatctgcctgagattgccgagaacggcaacactgtgccgctcgcgctcacggtcgaaagcccgatgacggccgagaactacgtcaaggaagtgctgttcgtggccgacggcaatcccaatgccggcgtcgcgactctgatgttcacgccgatgtccggcaaggcggaggcgtcgatccgcatccgtctggcgcagacccagaacgtgatcgcggtcgcgaagatgagcgacggctcgctgttcaccgagcgcaagacggtcaaggtcaccatcggcggctgcggcggctga

SEQ ID NO: 6475 - DNA, 417 bp, Dinoroseobacter shibae DFL 12
atggagttcacgcgacgtgaaacgatggccattggcgccggggctgcgcttgccgcagtgctgcccggggtcgtgtccgcggccgtcaaggccagtatcgacgaattcaccgggggcgccgaggtcggcaccggcggtgtcaccctgaccgcgccggagattgccgagaacggcaacaccgttccgatctccgtgagtgcccccggcgccacggcgattctggtgctggctctgggcaacccgacccctgccgtggccgagttcaagttcggtccgcttgcgggcgaccagtccgcctcgacccgcattcgcctcgccggcacccaggaggtcgccgccatcgccaagatggccgacggcactttctcgtcggagaccaagaccgtaaaggtcaccatcggcggctgcggcggctaa

SEQ ID NO: 6476 - DNA, 471 bp, Methylobacterium populi BJ001
atgacctctgccaagatccccgcattgaaccgccgccaagccctggccttcggcaccggagccgtcgtggcaaccgccttcgccttccgcgctggaccggccctggccgcgaagcctgcgaccgatgaggccatcaaggccttcacccgcggcaaggagcccgtgaggggcaaggtcaagctcgaactccccgagatcgccgagaacggcaacaccgtaccgatgacggtgagcgtcgacgtgccgatgacgccggagagctatgtcgaggaggtgatgatcgttgccgagggcaatccgaaccccggcgtcatcagcttccacttcacgccgtcgagcgtcgccgaggcgaacacgcgcatccgtcttgccgagacgcagaacgtcatcgcggtcgcccgcatgaacgacggctcggtcttcagcgacgtccgccaggtgaaggtcaccatcggcggctgcggcggctaa

SEQ ID NO: 6477 - DNA, 462 bp, Methylobacterium nodulans ORS 2060
atgacggggccggaccggcggagctttctcgcggggggcgcgggtctcctggccgtggcgctggtgcgcccggccgaggcggtcgagcgcccgccgcgcgagcccaccgaggccgcgatccggcgcttcgccggagacgcgccgatccatcccggccgcgtggcgctggatttgcccccgctcgtcgagaacggcaacgccgtgccgcttaccgtgaccgtcgagagcccgatgagtgcggccgaccatgtccggcgcatcgccgtcttcaacgacaagaacccgcagccgaacgtgctcaccgtgcatctcgggccgcgcgccggccgggccgcaatctcgacgcgcatccggctcgcggattcccagaccgtgacggcgatcgccgagatgagcgacggcacctactggtcggccaccgccgacgcgatcgtgacgctcgccgcctgcgtggagggatga

SEQ ID NO: 6478 - DNA, 930 bp, Yersinia pseudotuberculosis IP 31758
atgaactcacccgatatagccctaatcaaaacctacctgctcactttgcaggataacatctgtggggccttggctcaggccgatggtcacgccgaattcacggaagagtgctgggtccgcgaagaaggtggcggtggccgcagccgggtcttggttaatggcgctgtattcgaacaagctggggttaacttctcccatgtgtccggggcgatgttacccgcctctgccactgctcaccggccagagttggcgggccgcagttttcaggcgctgggcgtgtcgctggttattcatccgctaaatccttatctgcctaccagccacgccaatgtgcggttctttattgctgagaaacccggtgaagacgccgtgtggtggtttggcggtggttttgatttaaccccgtactacggctttgaagaagatgccattcattggcatcaggtagcgcatagcctttgccagccattcggcgagcaaatctatccgcgctataaaaaatggtgtgatgactatttttatattaaacatcgccaggaagcccgtggtattggcggcctgttttttgacgatctgaatagtcctgattttatgacctgctttaatttcacccaagccgttggcgatggcttcctggcggcttatatgccaatcgtcgcgcggcgtaaagccctgggctggggtgatcgagagcgtcaattccagctttatcgccggggccgctatgtcgagttcaatctagtctgggatcgcggtacgttgttcggcctgcaaacgggtgggcgcactgaatctattttgatgtccctgccgccgttggtgcgctgggaatataactatcagccagaggcagatagtgcagaagccgcgttgtaccgcgattttctgccggtaaaagactggttagcgattaaaggagaaacacactaa

SEQ ID NO: 6479 - DNA, 921 bp, Serratia proteamaculans 568
atgagtttatcgaccatcgcagaagtaaaaaccttcctgctggcgctgcaagaccgcatctgcacgcagttggcccaggccgacggcagcgccgttttcaacgaagaccgctggacgcgtgaagaaggcggcggtggccgcagccgggtgttgaccgagggtgcggtgttcgaacaggcgggcgtcaacttctcacacgtctccggcgctaccctgcccgcttccgctaccgcgcatcgccccgaactggccggacgcagtttccaggcgatgggcgtgtcgctggtgatccatccgcgcagcccttacattccgaccagccacgccaacgtgcgctttttcattgcggaaaagccgggcgaagagccggtgtggtggtttggcggcggctttgacctgacgccgttttatggctttgaagaagatgccgttcactggcaccgcaccgccgaacggctgtgtgcgcccttcggtgagcaggtctatcccaaatacaaaaagtggtgcgacgactatttctttatcaaacaccgtaacgaagcacgcggcatcggcggcctgttctttgatgacctgaacaccccggacttcgccacctgcttcgcgtttacccaggcggtgggcgaaggcttcctcgaggcctatctgccgatcgtagagaaacgcaaaacgctgagctggggcgatcacgagcgccagttccaactgtatcgtcgcggccgctacgtagaattcaatttggtctgggaccggggcacgctgttcggcctgcaaaccggtggccgcaccgaatccatcctgatgtcgatgccgccgctggtgcgttgggaatacaattatcaaccggcggaagacagcccggaagcggcgctgtaccgtgatttcctgccggtacgcgattggctgaaggagccggaatga

SEQ ID NO: 6480 - DNA, 930 bp, Yersinia pestis Angola
atgaactcacccgatatagccctaatcaaaacctacctgctcactttgcaggataacatctgtgcggccctggctcaggccgatggccacgccgaattcacggaagagtgctgggtccgcgaagaaggtggcggtggccgcagccgggtcttggttaatggcgctgtattcgaacaagctggggttaacttctcccatgtgtccggggcgatgttacccgcctctgccactgctcaccggccagagttggcgggccgcagttttcaggcgctgggcgtatcgctggttattcatccgctaaatccttatctgcctaccagccacgccaatgtgcggttctttattgctgagaaacccggtgaagacgccgtgtggtggtttggcggtggttttgatttaaccccgtactacggctttgaagaagatgccattcattggcatcaggtagcgcatagcctttgccagccattcggcgagcaaatctatccgcgctataaaaaatggtgtgatgactatttttatattaaacatcgccaggaagcccgtggtattggcggcctgttttttgacgatctgaatagtcctgattttatgacctgctttaatttcacccaagccgttggcgatggcttcctggcggcttatatgccaatcgtcgcgcggcgtaaagcgctgggctggggtgatcgagagcgtcaattccagctttatcgccggggccgctatgtcgagttcaatctggtctgggatcgcggtacgttgttcggcctgcaaacgggtgggcgcactgaatctattttgatgtccctgccgccgttggtgcgctgggaatataactatcagccagaggcagatagtgcagaagccgcgttgtaccgcgattttctgccggtaaaagactggttagcaattaaaggagaaacacactaa

SEQ ID NO: 6481 - DNA, 930 bp, Yersinia pseudotuberculosis YPIII
atgaactcacccgatatagccctaatcaaaacctatctgctcactttgcaggataacatctgtgcggccctggctcaggccgatggccacgccgaattcacggaagagtgctgggtccgcgaagaaggtggcggtggccgcagccgggtcttggttaatggcgctgtattcgaacaagctggggttaacttctcccatgtgtccggggcgatgttacccgcctctgccactgctcaccggccagagttggcgggccgcagttttcaggcgctgggcgtgtcgctggttattcatccgctaaatccttatctgcctaccagccacgccaatgtgcggttctttattgctgagaaacccggtgaagacgccgtgtggtggtttggcggtggttttgatttaaccccgtactacggctttgaagaagatgccattcattggcatcaggtagcgcatagcctttgccagccattcggcgagcaaatctatccgcgctataaaaaatggtgtgatgactatttttatattaaacatcgccaggaagcccgtggtattggcggcctgttttttgacgatctgaatagtcctgattttatgacctgctttaatttcacccaagccgttggcgatggcttcctggcggcttatatgccaatcgtcgcgcggcgtaaagccctgggctggggtgatcgagagcgtcaattccagctttatcgccggggccgctatgtcgagttcaatctggtctgggatcgcggtacgttgttcggcctgcaaacgggtgggcgcactgaatctattttgatgtccctgccgccgttggtgcgctgggaatataactatcagccagaggcagatagtgcagaagccgcgttgtaccgcgattttctgccggtaaaagactggttagcgattaaaggagaaacacactaa

SEQ ID NO: 6482 - DNA, 936 bp, Dickeya dadantii Ech703
atgactaccatgaattcacctgacatcgacgcgatcaaacattttctactgacgttgcaggacagcatttgccggcagttagaacaggtcgacggcaatgccgttttccaggaagatgcctggcagcacgcctccggcggcggcggacgcagccgggttctgcggcaaggaacggtgtttgaacaggccggcgtcaatttttctcacgtctcgggcgccgcactaccgccctcggccagtatgcatcgccctgaattggcggggcgtcgttttcaggccatgggcgtttcgttggttatccaccccctgaatccatatgtgccgaccagccacgccaatgtgcgtttttttattgccgagaaagatggcgagccgccggtgtggtggtttggcggcggttttgatctcacgccattctatggatttaaagaagacgccattcactggcatcagactgcgttcgcgctgtgccgtcctttcggcgacgatgtttatccccgttataaaaaatggtgcgacgactactttttcctgaagcatcggggcgaggcgcgcggcatcggcgggttattttttgacgacctgaacgcgccggacttcgacaccagtttcgccttcatgcgcgccgtgggcgaaggttttctgcacgcttacctgcccatcgtcaaccgtcgtaagccgctggcatggggcgatcgcgagcgccagtttcagctctatcgtcgcggccgctatgtggaattcaacctggtctgggatcgcggcacgctgttcggcctgcaaagcgggggacgcaccgagtcgattttgatgtctatgccgccgttggtgcgctgggagtaccaataccagccggaagccgacagcccggaagcagcgctataccgcgactttttacccgcgcgcgactggctatccactgagggagaagagtga

SEQ ID NO: 6483 - DNA, 939 bp, Dickeya zeae Ech1591
atgagctcacctgatatcaccgcgatcaagcacttcctgctcaagctacaagacaccctgtgccgacagttggaactggccgacggtagcgcaacgtttatcgaagatgcctggcaacacgcatccggcggcggcggacgcagccgtgttctgcgtcaggggcgggtgtttgaacaggcaggcgtgaatttttctcacgtttccggcgcctcgctgccgccgtcggccagtactcatcgcccggaactggcggggcgcagttttcaggcgatgggcgtatcgctggttatccatccgctcaatccatacgtgccgaccagccacgccaacattcgcttcttcatcgccgaaaaaccgggcgaaccggccgtatggtggttcggcggtggttttgatctcacgccgttttatggttttgaagaggatgccgtccactggcatcaaaccgcatttgatttatgtcggccattcggcgatgacgtttacccacgttacaagaaatggtgcgacgattacttcttcctcaaacatcgcaatgaagcgcgcggcgtcggcggcctgttcttcgatgatctcaacacaccggatttcgacaccagtttcgctttcatgcgtgcggtgggcgaagggttccaacatgcctatctgccgatcgtcaatcgccgcaaagacattccgtggggcgaacgggaacgccagttccagctttaccgccgggggcgttatgtggaattcaatctggtatgggaccggggcacgctgttcggcctgcaaagcggcgggcgtaccgaatcgattctgatgtcaatgccgccgctggtgcgctgggaataccagtaccagccggaacccgatagcccggaagcggcgctctatcgcgacttcctgccgccgcgagactggctgggcctgaatacgccgtcggagccgcacgaatga

SEQ ID NO: 6484 - DNA, 933 bp, Pectobacterium carotovorum PC1
atgtctgacgtcaacgcggtaaaacattttttgcttagcttacagaaggatatctgtcagcagcttgcagcgatcgatggcggagctgatttcgccgaggatgaatggcagcgtgccgaaggcggcggcgggtgcagtcgcgtgctgtccggcgggcgcgtctttgaacgagccggcgtaaacttttcccacgttaccggtaagtcattgccgccttcagccagcacccatcgtcccgatctggcgggccgcagctttcaggcgatgggcgtgtcgctggtcattcacccactgagcccttacatccccaccagccatgccaatgtgcgcctgtttatcgccgagaaaccgggagaagaacccgtctggtggtttggcggcgggttcgatctcacgccctattatggtttcaaagaggatgcggtgcactggcaccagaccgctcacgacctatgtcagccgttcggtgacgaggtatacccgcgctataaaaagtggtgcgacgattacttcttcctaaaacaccgtaacgaagcacgcggtatcggcgggctctttttcgacgatctcaacgagccagattttgctaccagcttcgccttcattcgtgccgtcggtaacgggttcctcgatggctatttgcccatcgtcgagcggcgtaaagatctgccgtggggagagcgcgagcgcgaattccagctctatcgtcgtggtcgctatgtggaatttaacctgatttgggatcgcggtacgctgtttggcctgcaaagcggcgggcgcaccgagtcaattttgatgtccatgccgccgctggcgcgctgggaatatcagcaccagcctgagccgggtagtccagaagccctgctgtatcaagattttttaccggccagagactggctggcagaaagtcacacgcacaacaaggaagcataa

SEQ ID NO: 6485 - DNA, 1014 bp, Desulfovibrio desulfuricans G20
gtgaaactgcctgttttagcgctgaccatgggtgaccctgcgggaatcggaccggaaataacagccaaggccctcggacgcgatgaaattcacaccatgtgcataccgcttgtggtgggcgatatggcgcttatgcaggcgcacgaacgatatatgaacggccgcaggtgcatacttgtggacggagtggaagcgctggatacgctgcctgctgacggtgtggccgtttttcagccgcacggacctttacgcggcgttgtggcgggtacgctgtcagcggaagcaggccgcgcagctgcggcctatgtgtacggagccatagaactggccaaacgcggcgacattcagggcatagtgactgccccgctgaacaaggaagcgctgcatatgggcggcgacacccaccccggacacacggaactgctggcagaaagcttcggagtgcgcaactatgccatggtgctggccgcggaagacagatatgtgtttcatgtgaccacacatcagtcgctgcgttccgccattgattcacttaccgtggatgccgtgtaccagcgcatcaggctggcccatctgctggcgacggcactgggcacaccgcaggagacggtggcagtggccggagtcaatccgcacgccggagaaggcggcatgttcggcacggaagaacgcgacatcataacccccgctgtacagaaggccgtggcggagggcataccggctgaaggtccggttccggccgatgtgctgttcccgcgcatggtacgcggtcagtaccggtttgccatcgccatgtatcacgatcaggggcacgccgttttcaaatcgctgtatttcgacaccggcgtcaacatcaccatagggctgccggtcatccgcacctctgttgaccacggcacggcctttgatattgcgggcaaaggcattgccagcgaagaaagcatgatcgaagcggtccgcgcagcagcccgtctgggcaacagctgggcacatataagccgcagcgccatgtga

SEQ ID NO: 6486 - DNA, 996 bp, Rhodoferax ferrireducens T118
atgtaccgtcctttgattgccatcaccatgggagacgcagctggtatcggccccgaaatcatcatgaagagccttgctaagcccgcgctatatgaaacctgtcggccgctggttatcggtgatgctgcccgactgcgccaggccggcgcgctgtgtggcgttgacctgcaagtcaaagtccgcacccgtatcgaggaagccacatttaccttcgggcaagtggactgtctggatctcgggctcattccagcggatctgcccttcggcaagttatccgcaatagcgggtgatgccgcttatcgctatgtcgccaaagcagtggaattgatcaaagcggacatcgctgacgccatttgcacggcaccgctgaacaaggaagctctgcacgcgggcggtcacttgttccccggccataccgaaatgctggcccacctgaccggtacgccggaagtttccatgatgctggtcgctccaaaactgcgggtgattcacgtgacaacgcacatgggcttactcgacgccatcgatcgtatcgagcccggcttggtcgagcggacgatcgcccgtggccacgacaccttggtgcgcgcaggaattcctcagccccgtatcggcgtctgcgcgatcaacccccatgccggggaaaacggtctgtttgggcgaggcgaagaggaacagaaaatcacgccagccatcaccgcctgcttggccagaggctggcagatagaaggtccattgcccgccgatacgctgttcttccgtgccggacgcggcgatttcgatctggtggtggctatgtaccacgaccagggtcacggccccatcaaggtgctcggcattgaagccggcgttaatgttaccgttggcctaccagtgattcgcacgtcagtcgaccatggcacggcattcgacatcgccgggcaaggagttgccgacgagcgctccatgttggaagccttgcgccaggcgattgaattggcaacccggcgcgggtag

SEQ ID NO: 6487 - DNA, 1008 bp, Rhodopseudomonas palustris BisB18
atgacccgtccgaccattgcgatcaccatgggcgatcccgccggcattgggcccgaggtgatcatgaaggccttggcgcatcccgacgcgcagaagaattgcaacgcgctggtggtcggcgacgccaaccggctgcgcaaggccggcaagatctgcgggctgtcgctgcaggtcgacgccttgagcgacgccaaggacgcgaattttgcctcgaaggcggtgcagtgcgtcgatctcaagatcgtccctgacgatctgccgttcggcaaaatgtcgccggtcgccggcgaggcggcgttccgcttcatcgagaaggcggtgcaactggtgcaggccggggtcgcgcagggcatctgcaccgcgccgctctccaaggaagcgctgcacgccgccggccacaaattccccggccacaccgaaatgctggcgcatctcaccggcacccccgaagtctcgatgatgctggtgtcgccgaagctgcgggtgatccacgttacgactcatatcggcctgatcgacgccatcgccaagatcgagcccggcctggtcgagcgcgtgatcacgcgcggccacgaggtgctggtccgcgccggcatcaagaatccgaagatcggcgtctgcgcgatcaatccgcacgccggcgagaacggtctgttcggccgcggcgaggaagccgagaagatcacccccgccatcgaagcctgtcagcgcaagggctgggacgtccgcggcccgctgccggccgacacgctgttcttcctcgccggccgcggcgacttcgacatggtggtggcgatgtatcacgatcagggccacggcccgatcaaggtgctggggctggaagccggggtgaacatcaccgtcggcctgccggtgatccgcacctcggtcgaccacggcaccgccttcgacatcgccggcaagggcatcgccgacgagcgcagcctgatcgaggcgctgcgccaggcggtcgagctggcgccgaagcaggtcgccgagccggtctga

SEQ ID NO: 6488 - DNA, 1002 bp, Cupriavidus metallidurans CH34 uid250
atgagcgactacattcctgtcatcggcatcacgatgggtgatgccacgggcatcgggcccgaagtcatcgtcaagagcctggcccacgaaaccgtctacgcccaatgccgcccgctggttatcggcgatgcgcgccgtctcgagcaggcaggcaggctcgtcaactcggcactcaagatccgcgcgatccagtcgcccgaggaagcacgcttcgagccgggcacgatcgattgcatcgacctgggcctgatccccgaagacctgccgttcggcaaactgtctgccgtggcgggcgacgcggcgttccgctacatcgagcgcgcggtcagactggcgcaggaagaaaagatcgatgcgatctgcaccgcgccgctgaacaaggaagccctgcacgcgggcggccacaagtttccgggccacaccgagatgctggcgcacctgaccggcacgcccgaagtctcgatgatgctcgtcgcgccgaagctgcgcgtgattcacgtcaccacgcacatcggcctgcttgatgccatccgcaagatcgaacccggtctggtacagcgcacgatcgagcgcggccaggtgacgctgcagcgcgcgggcatcgctgccccgcgcatcggcgtctgcggcatcaacccgcacgctggcgagaacggcctgttcggtcacggcgaggaagagcagaagatcattccggccgtggaagcgctgcgcgcgcgcggctgggacgtggaaggcccgctgccggccgatacactgttctaccgcgccggccgtggcgatttcgacctcgtggtggccatgtatcacgatcagggccatggcccggtcaaggtgcttggcctggaagccggcgtgaacatcaccgtgggcctgccagtcatccgcacgtcggtggaccacggcaccgcgttcgacatcgccggcaagggcatcgccgacgaacgcagcctgctggaagcattgcgccagggcgcggagctggctacccgccgcgcgtga

SEQ ID NO: 6489 - DNA, 1026 bp, Burkholderia cenocepacia AU 1054
atggacaaccgtcccatcatcggcatcaccatgggcgacgcggccggcgtcggaccggaaatcatcatgaagagcctcgcgcatgcatccgtgtacgaggagtgccgccccgtggtcgtcggcgacgccgcgcgcctgcgcgatgcaggccgcagagccggtgtcgatctcgaggtgagcgcgatcggccgtccgtccgaaggcgcgttccgcgtgggcgtcgtcgattgcatcgacctcgcgctgattccggccgacctgccttatggaaagctgtcggcgatcgcgggagacgccgcgtaccaatacatcgcgcgcaccgtcgaactgacgtcgaaaggcgagctcgacgcgatctgcaccgcgccgctgaacaaggaagcgctgcatgccggcggccacatttttcccggccacacggaaatgctcgctcatctgaccggcatcgacgaggtgtcgatgatgctggtcgcacccaatctccgggtgatccacgtgacgacgcacatcggcctgctcgacgcgatccgcaagatcgagccgggcctcgtgcaacgcacgatcgaacgcgggcacgacacgctggtgcgcgccggcatcgcgaatccgcgcatcggcgtctgcgggatcaacccgcatgccggcgagaacgggctgttcggctacggcgaagaggaagagaagatcgtgccggcggtcgaagtcctgcaggcgcgcggctgggacgtggaaggcccgctgccggccgatacgctgtttttccgcgcgggccgcggcgatttcgacgtggtcgtcgcgatgtatcacgaccagggacacgggccggtaaaggtgatgggcctcgaagccggcgtcaacgtgacggtcggcctgcccgtgatccgcacgtccgtcgaccatggcaccgcgttcgacatcgcgggcaagggcatcgccgacgaacgcagcctgctcgaagcgttccgccaggccgtggatctcgcgacgcggcgcaacgaatcgtcgcccgtggccagcgccgcgtaa

SEQ ID NO: 6490 - DNA, 1020 bp, Rubrobacter xylanophilus DSM 9941
gtgaggccgcccgtcgtagcgctgaccatgggagatcccgccggcatcgggccggagatcatcgcccgggccttcgccgagcccggcttctcggaggagaaccgcgtcgtcgtggtcggggacggggcgaggctcgagcgcgcggcggccctgctccggcttccgctgcggatcgagaccgtgagcggtcccgaggaggcccgcttccggcccggctccgtcgacctcatcccggcgagccggctccccgccgacctgcccttcggccggctggacccccgggccggggacgccgccttcgagtacctgaggcgggccgtggggctcgcgctcgaggggagggtgagcgcggtggcgaccgcgcccctcaacaaggaggcgctgcacctggccgggcaccgctacccggggcacaccgagatcctggccgagctcaccggcaccagagactacgccatgatgctcgtcgccgacgggctgcgggtcatacacgtctccacccacgtccccctgcgggaggccatagagctggtgcgccccgagagggagcttgcggtcatccggctggcgcacggcgcgatgcgccgcatcggcctcgagagcccccgggtggcggtggccgggctcaacccccacgccggggagaacgggctcttcggggaggaggaccgagagcacatagccccggcggtggagagggcccgctccgaggggatagacgccagcggcccgtggccgccggacaccgtgttcctgcgggcccggcggggcgagttcgacatcgtcgtggtgcagtaccacgaccaggggcacatcccggccaagcttctgggcttcgagggcggggtgaacgtgacggtggggctgccgttcttccgcaccagcgtggaccacggcaccgccttcgacatcgccggcacggggagggccgaccactccagcctgctggcggcgctccgcctggcgcgggagctcgccggggcgcaggaggaggatcggcagaagaagaggaggggttga

SEQ ID NO: 6491 - DNA, 1023 bp, Moorella thermoacetica ATCC 39073
atggtaaaacccttaattgctattactgtaggtgacccttgcggcattgggcctgagattactgctaaagccctggccataccagagatttataatctatgccggcctctggctatagccgatgccggcctgatgggcgaagctatcaagatcgcgggagttaacctgtccgttcgagccgtgaccagtcctggtgaaggccggtatgagtatggcaccatcgatgtcctggacatgcaaaatgttgacctgaaccagttgcagtacggcaaagtaacccgcatggggggtgaagccagtttccagtatataacccgagccattgaactcgccctggccggggaagttgatgccgtcaccaccggtcccattaataaagaagctatcaaccttgccggacatcattactccgggcatacggagatcttcgccgacctgacgaaaacgcaggactactgcatgatgctcgttgacaagaattttcgggtttcccatgtgactacccatgtggctttcagtcaggtaccatcactgataaaaaaggagcgggtacttacagtaatcaaattgactaacgatgctcttttaaaaatgggaatttcaatgccgagaattgcggtcgctggactcaacccccatgccggcgaggatggtctcttcggccgcgaggaaatcgaggaaatcggtccggctatcaccgccgccagggagcagggaatccaggtagatggcccggtacctccagataccatttttgttaaactccagggtggccagtatgatgctgtagtagctatgtaccatgatcagggccatattccaaccaaattaatcggctttaaatatgacaatgccaccggcaagtggggatcggttgccgggataaacatcactttaggattaccaataatacggacctcagttgatcatggtaccgcttttggtaaagctggaaaggggacagccaaccccgaaagtatggtggatgccttgaaaatgggggcaataatgacgcgaacctaa

SEQ ID NO: 6492 - DNA, 1026 bp, Burkholderia cenocepacia HI2424; identical to SEQ ID NO: 6489

SEQ ID NO: 6493 - DNA, 1002 bp, Burkholderia multivorans ATCC 17616 JGI
atgagcaactaccttcccgtgatcggcattacgatgggcgacgcagcaggcgtcggcccggaaatcatcgtcaagagcctcgcacacgacgtcgtttatcggcaatgccgtccgctcgtgatcggcgatgcgcgccggctcgaacgagcgaacgagatcgtcggcggcacgacgaagatccgccgcatccaggaagcggccgacgcgcgctacgaaccgggcacgatcgactgcatcgatctcgacctgattccggccgacctgccattcggccgcttgtcggccgtcgcgggcgatgcggcctaccaattcatcgcgcgcgcggtgaagctggcggaagccgggcagatcgacgccatctgcacggcgccgctcaacaaggaagcgctgcacgccggcggccacaagtatcccggccacaccgaaatgctggcgcatctgacgggcgtcgacgaagtatcgatgatgctcgtcgcgccgcaactgcgcgtgattcatgtgaccacgcatatcggcatcatcgacgcgatccgcaaaatcgagccgggcctcgtacagcgcacgatcgagcgcggccacgcgacgctcgtgaaggccggcatcgcaaagccgcgcatcggcgtatgcgggatcaatccgcatgccggcgagaacggtctgttcggatacggcgaggaagaagagaagatcgtgccggcggtcgcgttgttgcaggaacgcggcctcgacgtgaccggcccgctgcctgccgacacgctgtttttccgtgcgggccgcggcgacttcgatctcgtggtcgcgatgtatcacgaccagggtcatggcccggtgaaggtgctcgggctcgaagcgggcgtcaacgtgacggtgggactggaagtcatccgcacgtcggtcgatcacggcaccgcgttcgacatcgcgggcacgggcgtcgcggacgagcgcagcctgctcgaagcgctgcgccagggcgccgaactcgcgacgcggcgcggctga

SEQ ID NO: 6494 - DNA, 1026 bp, Burkholderia cenocepacia MC0 3
atggacaaccgtcccatcatcggcatcaccatgggcgacgcggccggcgtcggaccggaaatcatcatgaagagcctcgcgcatgcatccgtgtacgaggagtgccgccccgtggtcgtcggcgacgccgcgcgcctgcgcgatgcaggccgcagggccggtgtcgatctcgaggtgagcgcgatcggccgtccgtccgaaggcgcgttccgcgtgggcgtcgtcgattgcatcgacctcgcgctgattccggccgacctgccttatggaaagctgtcggcgatcgcgggagacgccgcgtaccaatacatcgcgcgcaccgtcgaactgacgtcgaaaggcgagctcgacgcgatctgcaccgcgccgctgaacaaggaagcgctgcatgccggcggccacatcttccccggccacacggaaatgctcgcgcatctgaccggcatcgacgaggtgtcgatgatgctggtcgcaccgaatctccgggtgatccacgtgacgacgcacatcggcctgctcgacgcgatccgcaagatcgagccgggcctcgtgcaacgcacgatcgagcgcgggcacgacacgctggtgcgcgccggcatcgcgaatccgcgcatcggcgtctgcgggatcaacccgcatgccggcgagaacgggctgttcggctacggcgaagaggaagagaagatcgtgccggccgtcgaggtcctgcaggcgcgcggctgggacgtggaaggcccgctgccggccgatacgctgttttttcgcgcgggccgcggcgatttcgacgtggtcgtcgcgatgtatcacgaccagggacacgggccggtgaaggtgatgggcctcgaagccggcgtcaacgtgacggtcggcctgcccgtgatccgcacgtccgtcgaccatggcaccgcgttcgacatcgcgggcaagggcatcgccgacgaacgcagcctgctcgaagcgttccgccaggccgtggatctcgcgacgcggcgcaacgaatcgtcgcccgtggccagcgccgcgtaa

SEQ ID NO: 6495 - DNA, 1020 bp, Burkholderia ambifaria MC40 6
atggacaaccgccccatcatcggcatcaccatgggcgacgcggccggcgtcggaccggaaatcatcatgaagagccttgcccatgcgtccgtgtatgagcagtgccgtcccgtggtcatcggcgacgccgcgcgcctgcgcgacgccggccgcctggcgggcgtcgatctcgacgtgcgtgccgtcagccggccggccgacggcgcgttccgcgtgggcgtcgtcgattgcatcgacatggcgctcattccggccgacctgccctacggcaagctgtccgccgtcgccggagacgccgcgtatcaatacatcgcgcgcaccgtcgagctgacgtcgaaaggcgagctcgacgcgatctgcaccgcgccgctcaacaaggaagcgctgcatgccggcggccatattttccccggacacacggaaatgctcgcgcatctgacgggcatcgacgaagtgtcgatgatgctggtcgcgcccaaccttcgcgtgatccacgtgacgacgcacatcggcctgctcgacgcgattcgcaagatcgagccgggcctcgtgcaacgcacgatcgagcgcgcacacgacacgctggttcgcgccggcatcgcgaatccccgcatcggcgtatgcgggatcaatccccatgccggcgagaacggcctgttcggctacggcgaagaggaagagaagatcgttccggcggtccagatcctccaggcgcgcggatgggacgtggaaggcccgctgccggcggacacgctgttcttccgtgcgggccgcggcgatttcgacgtggtcgtcgcgatgtatcacgaccaggggcacgggccggtgaaggtgatgggcctcgaagccggcgtgaacgtgacggtcggcctgccggtcatccgcacgtcggtggaccacggcaccgcattcgacatcgccggcaagggcatcgccgacgaacgcagcctgctggaggctttccgccaggccgtggaacttgccacgcgacgcaacgagccggcgccagtcgccgcgtaa

SEQ ID NO: 6496 - DNA, 1026 bp, Opitutus terrae PB90 1
atgacgaaatccgcgctgccccgcatcgccgtcacgatgggcgatccggccggaatcggccccgagacgtgtctgcggctgctgaacaatcccgagctcgcgcaggtgggcgtccccgtggtgttcggtgatgtcggcgtgctccggcgcgtgtcggcgctgttgggaatcccattctacgcaccgatcctcaagccggatacgtggacgcaggggtttgcggaggtgatccagccgagcgtgctggatctgggcctgctcgcggccgacgacgtcgtgcccggccgggttgacgcgcgctgcggcgaagcggcgtttcgcagcgtgatcgccgcgatcgaagcggcactggccgggcaggtcgacgccgtggccacggcaccgctcaacaaggaggcgatgcatctcgccgggcacaactaccccggccacacggagattttcgcggagcggatgcgcgcagcacgctcgtgcatgatgctcacgtcgccggagctgacgtgcagcttcgtcaccgtgcacgtcggctacggtgaggtgccggcgctgctcaacgtcccgcgcatcgtcgacgtgatcgagctgaccgccgaggccatgcagcggatccgcgggcgcgcgccaaggctcgcggtgtgcgggctcaatccgcacgccggcgaacacggcttgttcggccagcgggaggaggagcgtttcatcgcgcccgccatcgcggccgcgcggagcaagggcatcgaggtgatcgggccgttgccgcccgacacggccttcctcgccagccggcggaagcagacggacgcgttcgtctgcatgtatcacgaccaagggcacattcccctgaaagcgctggcgttcgactcggcgattaacacgacgctcggtctgccggtgatccgcaccagcgtggatcacggcacggcgttcgacatcgcgtggcaggggcgggcgaatccgaacagcttgttcgaagcggtgcgattggcggccaagctcagcgcaaaagaaccggcaactcaccgatga

SEQ ID NO: 6497 - DNA, 1029 bp, Burkholderia phymatum STM815
atgaacagcacgtattcacgagatcaaatcatgagcaactaccttcccgtaataggcatcacgatgggcgatgcagccggcgtcggcgctgaagtcgtcgtcaagagcctcgcgcatgcatccgtctatgcgcaatgccgtccgctcgtgatcggcgacgcgaagcgcctcgaacgcgcaaatcagatcgtgggcggcgagatgaaaattcgccgcatcgaagacgcctccgaagcgcgctacgagcagggcacgatcgactgcatcgacctcggcctgattcccgacgacctgccgttcggccagctgtcggctatcgcgggcgatgccgcgtaccagtacatcaagcgcgccgtggaactcgcgcagtcgggcaagatcgacgcgatctgcacggcgcctctgaacaaggaagcgctgcatgcgggcggtcacaagtatccgggccacacggaaatgctggcgcatctgacgggtgtcgacgaagtgtcgatgatgctcgtcgccccgcaactgcgcgtgatccatgtgacgacgcacatcggcatcatcgacgccatccgcaagatcgagccgggcctcgtgcagcgcacgatcgaacgcggcaatgcgacgctcgtgaaggcggggatcgagcgtccgcgcatcggcgtgtgcgggatcaatccgcatgcgggcgagaacggtctgttcggctacggcgaagaggaagagaagatcatccccgcggtgacgctgctgcaggagcgcggtctcgacgtgacgggcccgttgcccgccgacaccctgtttttccgcgcgggccgcggcgatttcgatctggtggtggcgatgtatcacgaccaggggcatggtcccgtgaaggtgctcggtctcgaagcgggcgtgaacgtgacggtggggctggaagtgatccgcacgtccgtcgatcacggcaccgctttcgacatcgcgggcaagggtgtcgtcgatgaaggcagcatgctcgaagcgctgcgccagggcgccgaactggcgacgcgccgctga

SEQ ID NO: 6498 - DNA, 984 bp, Salmonella enterica serovar Newport SL254
gtggagactaaaaccgttgccattactatgggcgatccagcgggcattgggccggaaattattgttaaagcgctaagcgaagacggtctcaacggcgcgccgctggtggttattggatgcctcgcaacgttgaaacgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgaccctgacccatagccgcgattacgcgatggtactttacaccgataaactaaaagtgattcacgtttcaacgcatatcgcgctgcgtaaattccttgatacgttaagtaccgcgcgtgtcgaaacggtgattggcattgctgatactttcctcaagcgtgtgggttacgttaaaccgcgtatcgccgtggcaggcgtgaatcctcatgcgggcgagaatggcctgtttggcgatgaagagacgcgtatcctgacgccagccattaccgatgcccgcgcaaaaggtatggacgtttatgggccgtgcccgccggatactgtatttctccaggcttatgagggacagtatgatatggtggtggcgatgtatcatgatcaggggcatatcccgttgaaattgcttggcttttatgatggcgtgaatatcaccgcggggctgccgtttattcggacctctgccgatcatggcaccgcatttgatatcgcctggacgggaaaagcaaaatctgagagcatggccgtatcgatcaaactggcaatgcaactggcataa

SEQ ID NO: 6499 - DNA, 984 bp, Salmonella enterica serovar Schwarzengrund CVM19633
gtggagactaaaaccgttgccattaccatgggcgatccagcgggcattgggccggaaattattgttaaagcgctaagcgaagacggtctcaacggcgcgccgctggtggttattggatgcctcgcaacgttgaaacgtttacaggcgaagggcattacgccgaacgtcgagttacgggccattgaacgggttgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcagggcacaactatccgggccataccgagctgcttgcgaccctgacccatagccgtgattacgcgatggtactttacaccgataaactaaaagtgattcacgtttcaacgcatatcgcgctgcgtaaattccttgatacgttaagtaccgcgcgtgtcgaaacggtgattggtattgctgatactttcctcaagcgtgtgggttacgttaaaccgcgtatcgccgtggcaggcgtgaatcctcatgcgggcgagaatggcctgtttggcgatgaagagacgcgtatcctgacgccagccattaccgatgcccgcgcaaaaggtatggacgtttatgggccatgcccgccggatactgtatttctccaggcttatgaggggcagtatgatatggtggtggcgatgtatcatgaccaggggcatatcccgttgaaattgcttggattttatgatggtgtgaatatcaccgcggggctgccatttattcggacctctgccgatcatggcaccgcatttgatatcgcctggacgggaaaagcaaaatctgagagcatggccgtatcgatcaaactggcaatgcaactggcataa

SEQ ID NO: 6500 - DNA, 984 bp, Salmonella enterica serovar Agona SL483
gtggagactaaaaccgttgccattaccatgggcgatccagcgggcattgggccggaaattattgttaaagcgctaagcgaagacggtctcaacggcgcgccgctggtggttattggatgcctcgcaacgttgaaacgtttacaggcgaagggcatcacgccgaacgtcgagttacgggccattgaacgggtcgccgaagcgcgttttgcgcccggcaccattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgaccctgacccatagccgcgattacgcgatggtactttacaccgataaactaaaagtgattcacgtttcaacgcatatcgcgctgcgtaaattccttgatacgttaagtaccacgcgtgtcgaaacggtgattggcattgctgatactttcctcaagcgtgtgggttacgttaaaccgcgtatcgccgtggcaggcgtgaatcctcatgcgggcgagaatggcctgtttggcgatgaagagacgcgtatcctgacgccagccattaccgatgcccgtgcaaaaggtatggacgtttatgggccgtgcccgccggatactgtatttctccaggcttatgaggggcagtatgatatggtggtggcgatgtatcatgaccagggacatatcccgttgaaattgcttggcttttatgatggcgtgaatatcaccgcggggctgccgtttattcggacctctgccgatcatggcaccgcatttgatatcgcctggacgggaaaagcaaaatctgagagcatggccgtatcgatcaaactggcaatgcaactggcataa
